United States Patent 10,724,096 (METHODS AND COMPOSITIONS FOR INHIBITING AND TREATING NEUROLOGICAL CONDITIONS) - sequence listing, part 12

SEQ ID NO: 27 - DNA, 18527786 bp, Homo sapiens (residues 16,469,145-18,527,786 of 18,527,786)
  misc_feature (4041202)..(4061201): n is a, c, g, or t
gctgcatctcaggcctgagaccctgcaaatacggaaacgctgctcttgacagctcagagtccaagtgttccatttcctcctggaggcccgacatggggctctgattgctttgccaggaagaaacggacaaacagttgtgcatacacagatgtggtgggtacggaacatgtggctgtgggtttggggggagaaggggacagctgctggctggaaacagccaggggaggggagctcacccccaggaaaggctcaaggattgtgagaggtggcagctgctgtccacaatacccaggtgacagtggctccacagagaccatcagctccaaaccactcatttcacagccagcaagactaagacccagaagagggaaggagctggcccatgcagacatattctccagtggggaggagagaagtgagaatcaggtctcagtttctcaacagtctccccaaattatttacccatccatacagctgtggggagaggggggttaaaacagaaatcagaccacactactcccgtgcttaaaacctgcaatggctttcactgactcagaataagatctacagtcctcacctcggcacgcaaagccctacaggatctgccctgcccccactatgacaccctcaaactctctctatcactcactctgctctggccacgccagtctcccttcttctctcaaatgagctaagcttgctcccagctcagggcttctgccctttctcaccttggtccagaccaccctccccaagatcatcccattccaacccctcagaaaggccatcccacccttgggttgccagatataaaataaaccccaggatgcccaggtgaatgctcatttcagacacatattttttttagtataagtatgtctcaaatattccataagacatgtttccactaaaaaattatttgatgtttacctgaaattccaatttccctgggtgtcctttgttttcatttgctaaatctagcagccctggccctgacctcccgattgaaagcaacctcaggcagagtcactctttaccacatctgcattttatgttcttcacagtctgcactggcatctgaaatgacctcatttgttaaattaccctctgtttctcccacctacgagccgcgtggcagcacggagcaagtctgtcttacttagtacagcatccccagggtctagtgcagagcctggcacacaggagatgcttactatgtatttcaggagacctcatcacataagagtaaaaaacacagactctacagcctgactgtgtcagctcaaatcctggctctgatgcttcctagctctgtaagcttgccctataacttaatctctctgggccttggtttcctcatctgtaaaatgggtacaataatagtaaccacctttaaagagtgttgtgaagttttaatgaatgcatatctgtaaggcacagagaacagaacccagcacaaagaaaatgtccactcggtgctagtttatgataaactcagtagttagtggttgggttttggggaaagggggtgagggactcttcccccatctgatcagttaggtgacactagcgggctggactgtgggccagggccccttcctctcctggagagcctgtctgcaagagctctgttcccgattagcatctcaccagcccagatgctgccatggccatgggaaaatgtttccaagcagggagtaaatggagtaaacaagcctgggaaggagagtggacccagcacctctttcctttggggctgcagtggatgccatggtgcactcctcaaatgcctgtcacagagacagagacaccccttaccccaggtgctgggagtgctggctgacaatgaccctcagctaaggccctctcctagagctgccttcagcctaagagggccacctgtctgaggcggtacacccactcctgaggacagcccactgggcaacaagggtgcaaaggccttgcccacttgctgcaattgtgcataatctgaagagctatcctagttccagagttccttccagatgggactatcagtggctggggtggagcctctgcaacctctcctttagctgcttccaagggcccacctgtgtgcaaatcgccagcttccagaaacccaacctacagaggtgtggcctttaaaactcctgagacagactgactcaacctatcctccgtgagcaggcaggaagaggcgtgataattttaatttttaattaaaaagatgattttaaattaaaaaacactgtatcacacactgagaacgctggctcctttttcaataggtccagttagctcaaggagggtcttagctggtgtgatgtaagcagcctcaggctgaaaggctcaagtagttaagagtttctagatagaatgcggtaataccgtttggtttctactgcatttattttgacaattaccttctatttatagcactcattttctattttcaatgatgatgcaaatttctctttttaaataagttcactgaagttttgttaagtgaatcaattttttttttttttgagacggagtctcacactgttgcaggggctggtgtgcagtggcacaatctcgactcactgcaacctctgcctcccgggttcaaacgataagtgaatcaattttttaaagcattaaacaaataataatacaaagaatactcagatatagcaaaaattacaaacttagcgtgtgagctgaactgaagaacactggcttagcccttaggatggcctaaagcccacttctgcggctggcacagtcgtgaccttgagcttaacctttctctcagtttgcttgcatgtccagagggcaagtgagcttggggctcgattttttttttattttattttttgttttgttttgtttgttttcagacaatgtctcaccctgtcacccaggctggagtgcagcggcatgatctcaactcactgcagcctcaacctcttgggctcaagcaatcctcccacctcagcctctcaagtacctagaactacaggtgcacattaccatgcccggctaaggggctgaactatttctgatgcagagacagagcagtgaacatgacagagtccctgtcctcatgttgtttatattctagggagagacagacaataagcaaaaaggggcaaaagatccgatgtgtcaaagggtgatgcggactgttctgttgagaatgacagagtaggggaggggcgcggaagggcaggagtgcagcaacttaaacaggagggcatggaggcctttgcggagaagatggcatttccaaaaagctttcaaggcaagaagggagagagccgcagggatgtctgagggaactggtccagcagaggaagcggcctggggtgagaatgggcttgccatgttctggaacagcgaggagatccgtgtggctagagccaggggagcaagttccgaggaatgaacagggcctggcgggctgtggggattttattccaatgaggcaggaacctttggagggtgctgggagaggggttgaagagatctgattgatgtttccagcaggtctctctgttggctcaggggagaaccaatctccaaaatacttcatctctgtcaaagcctccgacattcatccttgtgcccgggcatcacagcagctttgtgaggctggaaggacgggagccctgctgaggtgcaggggggctcatgatagatcgcctggaatggggctcagtgatcccaggtctgggcaccctgcacaaagtcacactccagagaagcctgggaggtgccagaaagcgctggatcacgtgaacagatgcgcacattacccaagtgagaaacaattcctgagcacttattatgtgccaggttctaccaacgtcattcattctctcaaccaccctagaaggtgagttttgtgatacccactttacagatgagaaaactgaggcacagagaggtaaggtcattctcccaggatcccagagcaaggaagtagcagagctaggatgcaaagtcgagcagctgggctctaaaatgcttgatctcccaggcccagggaggatgccaggaaggccccagcacagaacaacttcccacaaaggcctaaacatccaccctccacacgtcatgactctgatggtaagtgcagccttcaccaggtgcctagtttgatgaggctacatgaggagggtcccaggtagcagaagagaggacacggaaaagaggttgcttcatgcacactgaactccccgtccccagccccccagccctccgctgcatctctgagcaagtcaggaatcctgcagaaagagagaggtgagaatagccccgctgtgtcctcagggtccagggctcctcactgacaagcgagttaaacccacttccccacagcctctggggctcagacagagaagccaaaggaatgaggggggccagggcttttggcaaactggacagtgcaccttgaggaccctttctcccacttttgctaagtataggcaatcctaagcaagctcggatcatgacatcacagccaaccccaagcccaccccctccaggaagcaggccggagtaacactcacagctgacacgcggcattagcttggtgctgagccaggtcattcatcctcatgacagccccctgcagcaggaattgtcgttacccccactttacagagttggagactgaggccctgagaggtgaaaggacttgcccaaggtcactgggctggcgagcagtagaacagggatttgaacgttggctgttggctccagagaaaaagcacttcctgtctcctctgaacccaaaggaaagactgtccctcccatccttttcattttcctattcaaacacctttactgcacactgtggccacttgccccttctcaccatctccactgctaccatgctggtccgaggcaccgtcatctcacttggtggggtaacctcttagatgtctcccggcttccagttctccctccacagctactccccctcacagcagccaaagggcctgtggaccacttccctcctctgctcaatgccctccgctagcacccagcccacctgcgccccattgtgctcttatttgtccaattccaaagatggaggagcgtccgctatgtgaataggaagataacgtcgacatttattgagcacttactgtgccaggagctgcactgagcaggctccttgtattatcttgcttaatcctcacaatgtcctggatttatcccgtttatgggtaaaaggacaatgaggcacagacaagatcagtcaacttgctgagaggaccacagttcatgagtggctcagcagcctggccagaagctctccttgccctcactttcacgtagagagtggctggcccttggctgaatgactgcatcttggggtagtctgcacgcctgatcgcacatgagacttgccccccattgccctctgagggcaaagtcacacagctccatcatcttaggctctagccactcagatgtgatcccttggagaagtgagttagtgatgatgatgatgatgatgatgatgatgatgatgatgatgatgagttaacagtggccgagtgctgatacaccaaagtttctccaccttggcaccactgacatttgaggtcagatgattctctgttgtcggggctgtcatgtgcattataggatgtttggtggcatccctggcctctacttactagaaaccagtagcactctagagctaggacaaccaaaaatgtgtctggacattgcccattgtcccctgggggccagaatcaccccagctgagaagctctgctctagactctctacccgattgctttacctctgagtctggccatcaaccttaggaggtatacggaattgtccctactttgcaattacaggaggaaatagaggctcagagaggcaaaggagtttggctcacatctcgtgcccgtgaggctagcttgggttcttctgtctgtgaggggggtcccaggtagtacagaaaaagagggtatggaaaagcagttgccttccttcttccagcctaccacccacaattccaaatgcgttagtaatcttgcaggaagagagaggctattgcaacaagcgtcagcctctctgaccaacagcccaacggggcaccccaggatcagacacccttactgtccagtgggtgcctgagccgggactcaaacccaggtctgtctgatgccaagtccatctcttcttggccactagctacctctgatggtcactgtggcagaggggccccgccaggccaggaggtcgcaggactccaggacacatgcattcagtgagggcccaccctctatgtggagctgagggaaaggagagtcactaaaaatgcccacagcctgctgggcctgacctacttcccatagttccagggatgcagactgggcccacctgcccaccttgctaccccatctcccagacaggcctacagaggaagctggtgaaggcggatggggcagggacccagggagaagcccacttttcaaaaactagagtccaccaggggcagtggcatggtactcacgaattttaagaaaacattcccaagttcatgctgagactgcggctccgggtgtaaacaatactccaaggcggccaagaaatccttatgaacttccaggatgtcttcgatgttcgagaacaggacctgtgaggaaaagagaggccagaggacagcgttaaggctcagagggagagcaaagccaagcactgaaaaaatacaaacctcggtgcgggtgacattgtagtcaaagaagaactctcaaacaccggaactggtttaccactaatagaaatctttgtaataacagaaatattaccaatatttatttactataatcggaattagtgactaatcgtgtgttaagaactttatacgcattcatagaatctaatccccactgtaaatctgtgagatagaaactattgttatgcccaatttacagatgaagaaccaaggctcagataaaataatattcccaaggtcaaagtcttgcaagcagctccacatttagtatgcagacattcatcacagtcagacacaactgctgtgtccagctacaggacgatgttgaaattacaagtatatttccatgcactcattaaaatgacgtggtagaagaaaacacaataaggaaggaggttagaaatacgctgtctaaactctcacaaacaatatatgagataccctgtttccccacatcaatctaaaagtgtaaaacactaatacaatttgacccagcaatcctacattttagaatttaaccttctgatcagttgttcccaacaaggggcaattttacccaccaccccgccacacacacaggatatgcggcaattgtcaagggacatttttggttgtcacaaattgggaggaaaaggggtgtttcgtagacagaggccagggatgctgttaacccttcctgcaatgtacaggacagaccccgcaatgagcaattattattattactttgcctctctgagtcttttatgattgtattttttaaattattattattattttcttttttagagacggaatctcgctctgtcgcccaggctggagtgtgaagtacagtggcacaaacttggctcagtgcaacctccgtctccagggttcaagcaattctcctgcctcagcctcccgagtagctgggaatacagatgcatgccgccatgcctggctaactttttttgtattttagtagagacagggtttcaccgtgttgcccaggctggtttcgaactcctgagctcaggcaatctgcctgcctcagcctcccaaagtgctaggattacaggcgtgagccacctcgcctggccctcatgattgtatgttttttaagaatagttgttaacagccaaaaactggaaataactaaaatatccatccacaggagaatgggtaagtaaactgtgttgcattcctacaatggaacaccacacagcaatgaaaaagagtgaaccacagctacacacaacatcatgggcaaatcccagaggcaggcagggacacgaaagagctcactttaatgtaaatttcaagaacaggcaaaaccaatccatggtactaggaaccagggattacctttagggagggaggactgactgaggggggcccagagtgggcagttggggctgggaaatgctctctgccttcatttggtttcatggtacactggtgcattcgtacgtagacacgcactgcattcagcactaaggtttgcaccctttactgtatgagacttctacctcattaaaaaaaaaggtaattttttataaactgtaataagtcgcagcttaaaattataataaataatttgtaaactataacaaacagtgtaataaataagtggaataaacaggaggtgctcagccatatttgctgaatgaatgagtgaataaatgaatgcaggcatagagtttagatcccagtgcatgaacacacacacacacacacacacacacacacacacacacacacacacacacacacacacacacacacacaccccacccccaggaggagccatgcagagaccttgagcaagtccttgacatctctaagactcagctttcttatgcaaataattcggtgtagagctgtcaacatgcaaggccaccgtccagattaatcagggcgtttggggggaatgtcttctatgaccgagtcctttgtgtgctgtaaatactgggcaccttggacaccaggaccctcagagccccgaggcctgaaaggcagctcagagagtgaggtcacacagaaagccaggcctggagagccaggctggggctgagccatgcacacagaaggcctattgatctcctcctcaaactccccagagccatggccaaggccaaactggacccaattactcatcagccctgcctggacactggatgcccagggcgggagcgggggccgggactgccaggagagggactggaggtgcccggctcccgggggcacttgggagaggattttccactggctccaagccagagggcctgacacgaggagcccggaagactggggggtcacaatgagcacagagggaaagtctcgggttggaaagtggggcccggggctaaaaattcctgctgacatccaccaagcacagcttgctcacaggacaagaggcctccaggggctgaagggagcaagctggggcagggcaaagctggcggccagcagccagcgggtgatgcgcctccccctgcatgcacaccctctgagcatcgcacgggaagagcaaggcacaaagcaacacagatgctctagaacaggggccagccccagcgtccacaccttgacattctcctccgtgaggcccttctccactgagtcggccacgttctgccggatgcgatgcaggaatgcctggaggagagaagcagagagaggtgagtgtccgcgtctccagctctcccatggacggccctacagaaggctctcaagttcaaatgccaactaggatctgggaggtaccacgagtccagggacacaggcagaggacgaggaaaaacgtgctctgcttacaccttaaacacactggagcagccctcactcccacacggtcaccaggggtgtgctgtgcacctacgacgccaggccctgcactgggccctgaagatacagcagagaaaatctcaaagcccctgccttcgaggaacctttggcccaaaaagatacacacctgcttcctcacccaggggcgcctctcagactctaattcatttcccctttcaattttttttttactttgctttacaatttaacctctgagtaataacacagtcacatggctcaaaagtcaaaaataaaaatggcaaaaacagagaaagtctctctccttaccccagccccaaaccatctagtccctccccaacccctacaggaaccccagctactagtttcttgggtattcttccaaaaaatctatgcaaaaacaaacacacacacatacacatctattcctttttttttttaacctctttacacaccaaaaaatagcaacgtatactggatgacccgcacctggattttctacttaatatagctcagagatccttccagatcatctcacaagaagcttccttgcagatgccaggaatgtactgtttgaatggaccatggtccttctaccaccctttcaggggcttggaacagacaaatcacgtctctcctctgtgagacgcagtagatgagtgtgacgacaccagggcaggagtgacaggggctgcgggagccgagggtgcaccattcatgtggggtcacgtggggaggccgcaggcccaggaccaccagaggttcggatttgggtgttgttgtggtttttaatgaagccagaaattagaattttttttcaaaagaaaagtctcccagttttgaagtgttggtgaaaaagccctctgttattgcaaggaactggattttaggggttgtgagtaaaagtggggggaccagggcagtagggtgcaatggtgccaacaagagatgacggtggcctggcaccaggtggtgtgggtagaaaagtggcagaaagaagagctgccgaggggtcacacgtatgggctgagagagtcacagggataaatgttggggaaaggagagacagcagagtcagcacctaagggagaccgaggcccagcacccacagccacctccgcctggtttgccggaactccaggatgtgggatctggctgtaggctaacctggaagcagccacatggagacccctgggaaaaggaattcatggtgctgtcatagccacagggccacggggagctgtggggcctatcagtcacctgccctgccaagatggatgacagattgggggtccacacgggggctgctccaggtgagcacatggtctccctgtcacagagcccaggtgcaggctgattaagacatgggctgcaggggcctgtctcatcccaccacgcttgtctagggagatctctgagtgcaggagagatggcggggacagcccaagatagtgctggggtcaggggaagcggagcaggtaagcagagaggaggctagccctctgcacaaggctgtcagatcctttccatcacccagagacacgacacgtccatgcctgcccccgggagcccggccacctgcccagactcaagcctcttgggagggggcgcaatgacagtccacatggcgagtcacagaggaaggcaagacacaggaagcagcttcgtctctgtccacacagagtgcagagccatctcagccagtcttggggctttaacccatttatgcctagtgttccattactggaatgctaagcttgtgggagttacttatatcctactcttcaaggtcattgccaaggtctgattttttattaaaaaaaaaaattgcaacctccagcataaatgggttaaatcccctttttttatgacccccatgtttatatccccagcctggacttctcccctgaaacccccagactcttatctccagctgcagattcagtgtctccacctggatgtccaaactcagcctgtccaacacttaattaatgacctttcccaaactcacaccgaactcttccccacttaatggcacctctgtctttcaagggctctagccaaaacccactagccgtcctcagcccctctcctctgacactccatttccaatacatcagcaaatgttaccagctttacctgaatactacaaccactggtccccatctccacagccaccacccccccagtccaagccatcatcatctcctgcctggactaacacagccatttccctcctggtccccttcaccctcccaaaagtctgttctctacacacacagccagggagatccctttaaatatgtacaggagatcagtcaatccatgcctttaaaatctccatggcttcccactgcacttaaaatccaaatctttccatggtccccatgatcttgtccttgttaatctctctgatctcatcttccagtacttcatcctcccacacacctcaatataaataatcttcagccacactctcattctagattctatccacctgccaaatacactcctgcctcaggacctttgcatatgctgttcctgcttgcaagatgttctcccccattctgccctgagcagcctcctcatccatccggccttagttcaaatgtcacctccgccaagaggccctcctcttcttaatgcaaactcctatcttcccatcttgcgttaggagctcatttgacagatgaggaaactgaggttaagcaatctatacaagctcctaagggaaaggccaggataagcagggatcatggctgggatgaaaccataacccccaatccaacatcagaggccaggtttggaaactggtgagtctgagtttcaaccatgggtccttcctgctgtgtgacctcaggaaagtgcactagcctctctaagtcttcatttactcttcccagtggaatcataggaatacagcaccttttagaatgtcatgggataaagtgaatggaagctccctgaaggcagggaccctgcctgtcttgttcacagctacgtcttcagggccaaatgtagtgctcagcaaatagcaggtgcttgaaaatcaaaggaaggtttggaatgcgcctggcacagtgcctgacccatgccggagacctcgactcaggctccttggaagtctgtggatcctgtttttgaaacgacaatgagcggaggggacagggactggggttcctagaggatgttttaacagggcctgggatactgacaggaagtcaagctccagcctccccagactagagggagacaaaggcagcctcacccagcacagccagggagggcaggaagctgggagtgccgcactccgctggcctagattggggcttcctgtcctggtttcttcacacgagctctgccaccgctattgtgctgcaacaatgggaggctcgggccacccactgaggaactgcaaacaagccggtgtgaaggccacaatgggcagctcgtgacccggaaagaatgggcagcagaggctctgggaccagccctcctgctgcccaaggcacgactggcttttccaggcagcacggcgtcccctgcactggcaggatggtgaaagggaccctccagggcgactcttcctttgtccaaggcttgacagctttgaaacactcaggtcaaaagcagctctcatctccgaagcctcccttagacacaatactgttctcaggatttccagggctgcctgagaaactcctccagcctcggaagctttgcccatgcctggaccacttgtcctcacatctgcccaagtcctcctcttcattttatgaatgtgatgatgaaatacgtcagggatacagaaaagaatagagagaaacaacaaacacccacaaactcatcactacccagctttggcaaatcttaatactacaccgaatttgcttgaaaccatttgcaaaaagaaattcaacaagtctaggggaggcacagactggaaacgggatgaggaggctcttgggggtgctggaaatgttctatatcttgatctgagcagtggagacacaggtcactgcatatgcaaagccccagcagtatgcactcgagattagttcagtttacccacagtaccatgcaaatatcaaacctccatgtattaagtagaaaaggcagaaaggaatcattacagagagaggtgagccactgggcaccttctctccctgcaaggtacttggagctggtgctcctcattcccacgcatgcctctgcccacttaccaagctgtgtgcatctataagcaagagagaatattgttttgcatgttcacaacatttttataagtagcatgctttcagcaacttgattttctcactcaacatcatgtcttccacatttacccatgttgatatgtacactgggcaacatctgctatccagaccccacccttaccccacaccacatcgagctgccagcacctgcatctcttggcctgaagaccccgctctcatgtgcagggcaggccagaggtgcggaagaagtaagactgcctgggagcagccctcagtgatggccagcaggacctggcatgaaaagacagatgaggaaactgaggcactcgatggacactatctccccgagtgccttgatggattcagctccggtggcccccatggtaacccgcttgatgacacacctttcttggctgccttctcctccctgcctcactcccccactctcctattgatgcttcctggggtgacctcccaagtatgctacttgcccttgaatcagtctcgggtcatgttctttggggaatccacaataagacagacctcaagttgttcatttcattgcttactagtcaaaatcacagcatgaagtaaccactgccatgctgcagacacttgtttcaaacatccttactgtaaacaatggcactcaggtgtaagttctttcagctgtatactctcgtcgactggggtatgggtatacaagttcctctaggtgatgcacatgtttcctcgagcccaggcgttcaagttcctctaaatgtatatccaggtcttctggggcataagagaaggaccagagagactgtttactcagctcccagcctgagtgtttccagggtccccagagctctagactgagcaggaagccacatcataattgattagtgatgtctgccatggatgtggcagggagagggttagaaggatgatgagtttgccatctccaacaagctcccacttaatggagataccaagagtatgagacactggtctgaggtcaaacagcaaactggtgacaaaacacagattagaaccaggtctcccgatgccaggccaggtctcacctgtcgccctaacctgagcccagtggttctcaacttgggggtgattttaccccctagaagacatgtgccaatgtctagagacattttgggttgtcacaactgaggacaggggtgctcctggcatctagtgtgtagaggccagggatgctgcgaaacaccctacagtgcacaggacaaccccacaaagacacagctgaccgcaaacaacagtgacaaggtcaagaaatccttgcctcagaaaaggctctaattaaaacctagaaaaaaatccaacctcttccaccgcccaaatactgtctaatgcgggctcttctcaccccactggctcagctgcaggtacactggtctcctttttgtttcttgaacacaccaggcccccagcatccaggccttcgcacgtgctgttctttgcctacagagcttttcccaagacattcaattggcaggagaggtccctcctctcacaggccacccctggacccatataagagaggatctcacccactacatagccacctgaaccctgttacccttcacagacgtctccgctattggctgtgctcttatcaattaagtatggataggtttgatcattcagtatcatctccctcactaaagtatcagctccctcagggcagaagtcaatttccttggccgtctacgcagcgcctgggacagaggctggcacacagcaggtgctcaagagagactggtatgtggagaaaggatgggagagacagggagaaactgagaacaggctccagaaagtaagctgatatcgagctgggagaggcaactagaataagaacacctttttaactcactaactacacctttaggcctcattatgtgcaggtgctgctctaggtgttttaatcctcaaactcgaggaggcaggcattgttattactatgtccattctacagaagagcctaaggcccagcgcagtaaagaccttatttaaagccacacggctggcaagtgaaggagctgggccttaaacccagacagtctccatcacgcgccatcagtgagtgactgtggacaatgaaccgcatcagcctttaaaacaggtagcagctgcccttaggggtgcccctggggagctgccatctgcctggaacccatggctgctgttgcctggggaggataaatctctccctggagataaaaaggacagaaagaggccttgaagtcactccctgagactgatgccggcaacctgatctgcttggggagggggcccgactgcccccaaggacacctctgccgtggctggggtgacctcaccagacatatggtgaaacttgagagggccagggtatgggctgggagcaaagggaagcgatgagtgggggtgggtggggggagctccagaacacagccaagacaaaagggggtgccctgaggaccccatccccaacatgatctgggtggcggggagtcggaagcacagtgtcatggaacagcaagggccttggaatctgagcgatgataataaaatcgctataacagcagaagggggcttacacagcctgctgcaagccgccccacacagcccagagtctggggagctccccaattgcccaatgaccccttcaaatgcccaaatcctatgctccatccatccaagttctgggtatttatcctacaggggaaaataaatctcatatgtggcatgaagctttaccttcaatatctgatttataattccatcactgggggtttagttaaataaattaccatccagctcaacaaggaatgatcatgctaaaaatagtttgcagaagtctatttaataacacggaaaaggactgttgatgtatccttaactaggaaaaaaaatcaagttacaaacaagtacataaaatataatctcactgttggttaaataaattctctctccctaggcatagaaaaatgaagtatggaaggaaatacccatactacaagaaactatgtaggaatgtggccaaaattactagctgtcccccaatatcattctctccttttcctttagaaacagaactccagatttaaaaataaggactgtatttcccagcatcccttgcagctaggtgtgggcatgcaactaagttcaggtcagtacagcatacatggcatattatgtacaacatcttggaagtatccttgtgggttgggggaggaatgggtagggattctcttctgctattcccttttcctactgattggattgcaaatgcgatgcctggaagtgaagcagacatcttataccatgaggtagaagccacgtgttggggaaaacagagcagcattcagtaggcacttatgttcctagtgatggtacagccaacatatccgccctgggtcacctataattacagaataaggaaataaactttcatcacatttaagacactgttatttgggttttatcacaagccactgaacctaatcctaactgacagaggggcattctaaagaatttccattttcttctttcttcatttatttccctttccagatttctacaatgaacatgctactttttaagcaaaagtcatttttaacataaatgcatgtttttatttttctggatgggaggggtactaaacacacaggctctctctcgcccaccccatcacctgccccaatcatcaggacccctggcttctgtcttctcctccttggatatgtgtatccctgtgcagggaaggcagtgcccgccagtggggaacagagcagcggcaaggcaaatatgagatggaaagatttaccttctgcagaagagcctctgagctgccgaccagccctccttctctgagtcaactctggaaacctggggacccccacaagctggcctggagcttccacagcctgggccagaacacaagaatgtccaccacccagagcccacaccactgcccaggctgattaaaaccctctccactctgttcccacctagcattccttcatcacgtccatgccaggggccagaaacagagagccactggctcagaaccaactgaggctttcccaaaagacccaaattttggatttgaaacatcctccccaaggattccaccgctgactcattcagtcacagacatactctgagaggactgggaagagatagcttttttttttttacaaagtcagacttactactcctttactcccatggcacatttacaaagtccatatatgtatctataactcatttcattatatagtccacagcacaaacatattgctttgaattgtatctttaacaggctaatttcttcctgaaagcatacaaagaacctacaactgaggcctcctgggaatataccaaggcaccatccaccccggggcctttgtacttgctgttccctttgcctggaagactctttctccagatatctgcagggccccaccctcaattcattcctgtattagtctgttctcacactgctaataaagatataccagagactgggtaatttataaagaggtttaattgactcacagttccacatggctgaggaggcctcacaatcaaggcagaaggcaaatgagaagtaaagttatgtcttacatggcggcaggcaagagagcttgtgtaggggaactcccctttataaaaccatcagatctcgtgagacttactcactatcacgagaacggcatgggaaagacccgcccccatgattcaattacctcccaccaggtccctcccatgacacatgggaattatgggagctacaattcaaggtgagatttgggtggggacacagccaaaccatatcaattcccctctagaatcaaatgccagttcttctgaggccttccccgactgctccatttgaaacagacacccattcccctgcacactgtatctcatcctcctccatcccccacagcactgccctccacctgcactgagctgtttcttcacttacagttcctgtgtcccctacaaagtcagtcccaggagggtggcagcttgtttgggcagtgtccacccactggacctagaaccgtgctggactggacacagagcagatgcccagtaacaaggggttcagcaggtgactgatggtcagcatgttcgtcctgcataacaatcccacaaggtgggctactgcatcccctttttaggaaagaggaaaacagggcatgaatcacacattaggctctggagtcggccaagcctcgcacctcagttgcctcatctataaaatctgtgtaatggagcctcaccttgcaagtcgctgacatgaggattaaatctgacactgcttgtaaataacttgttgcctctgcccacggtgggagcccccggcccccaggatccagccaggatcacaggaggtgcccaataagtcctcagtaaatgtccagtgaaggggtgggcactttcaattccgtgtagcccctggaccagctcagaccaggccccttccctgggcacatttccttggcaccattccttggacctatagaaatgttggaggcctttaaaaatacgtgcattggctccaaatacaaaaggaaaactgcattgtcaaaaagaataaatcttgatttaaatgtctacaaaattaccaatcaactctgcctgtggctatgtgcacagagaatgcagggagtgtgtgctgtgggtgcatcttagcgggtgtaccatgacaggacccttggggtggttccccagatgcagcagaccctgaggcaagaagtggagtacaagtagtttctttgggaggtgggaggtgggagatggtccctggaaacaccaacagggaggtggaaccaagaagggaaggcagcccacgaagggtatgagaccaagcaagttaccaccatgaggccccagacagaccgtgtggaacgcacacctcacagccaccctcagggagtgaggaggccagggagtctgtacatcagccctgtctgtcactagtttaagggcagtgggggtgatcctggcactccccatcttccctgaaagtgacagagcagctcagagcagacaaagccatcaggcagaggagcgcaggtgctggcagtggagcgtccctctggtgtgccctggagtggttgaggtgtcgcaatgcagcctcaaaaagaaagagggtgtagggcccccccgagcttgggggggtgaaagacagggctttgcagcaccgcagccacacaggccaggcacttcagcagatgttctcctaatacacaccaggacggcctcgctgcctgttaaaacaccaaaatacttctgagctgatggggaaaatctctacatgtgcagggctgaaggtcagaggaggtggctgcggaaccacaggcagtccccggtcagacgtggaggcaggtttcacgtggagcagacacagggagcaaacagcattgcgtgtatctgaggatacagcatcacgggcagggtcaacagctggggcaaaggccccaaggcacattcagtctttccaagacaatcctatcgaaaacgcctatccctgctctgttttcctcacagcacctgtcaccatggacattatgtgtgttcattatcagtctattatccatctagcccacctgaatccaggctgcatctgcggggaacccatacacattcccctgcggaggccaaagatatggccagcattccacctcctcctcccatgccccaactctcagaagccctccctacccttagaaactctctctactccttgctagaagggcactgtatctcctaagcaagcagtatgtaagagtggatgaggctcaaaggctagaactagccacctggttcaaatcctgcccctgccacctactgctctgtgacctaggcaactgactccatctctctgggcctcatctataacatggatggggaccataaaactactgacttcatgggctattgtgaggctgatatgaaatactgcaggcaggccaggcgcggtagctcacgcctataataccagcactttgggaggctgagatgggtggatcacctgaggtcaggagttcgcgaccagcctgaccaacatagtgaaaccctgtctctacaaaaaatacaaaaattagccagccatggtggctcacatctgtaatcccagctacttgcgaggctaagacaggagaatcatttgaacctgggaagcagaggttacaatgaactgaaatcgcaccactgcactccagcctgggtaacagagcaagattccatctcaaaaaaaaaaaaaaaaaaagaaaagaaagaaaaaaagaaatactacaggcaaagcatttaaatgggctcaaatcccagctctgctgcttacaagctctaagacctgaagtaaattatttattctctctgcctccatttcctcctctataacgggggataaaatgagtacacaggattacaatgagaattacagaagctaacacacataacaagcacttgaatggtccctggtgcatagcaggtgctcaaaaaacattagctattattggccaggctcacacctgtgagctcacacctgtaatcctaacactgtgggaggccgaggcaggctgattgcttgaacccaggagttcgagcaatcaatcaatacggcaaaacctcatctctaccaaaaatacaaacaaacaaacaaaatagccaggtgtggtggcgcacacctgtagtcccagctactcgagaggctgaggtgagagcatcacttcagcctaggaggcagaggttgcagtgagccaagatcgcaccactgcacttcagcctggatgacaaagcaagaccctgcctcaaaaaaaaaaaagcattggctattatgatctccccatcttgagtttctagagtgtctgcagggagtccaagccctggtgcaggtagacagaacccactgtgcttcctaaggaaacctggatttggatcaaccacatctgtagggcttctacatgcaccaagcacactcacatttatcccacactatttttacttatttttattagttttttccatcctgcaaatagctctattattatagactgcctgcttccgagtctcctgaggtgagatgagaaggggaaggctttataaactgcagagccccccacatcctcatcaccaccagcgcacccctctgccctgccccatcctccttgctgactgccaaccacgtgacttcagcaagtcaccacacttctgagtcaatttcctggaccaaacaaaaagggggggaggagtagttgttgaggtttaagtgaaatgatgcaggtgaacactttgtaactacaaacacttcctggaaaaagtggcagaaaggctgagccaggagagggaggctggactaggaaaggggcaggaagttgcttgtgatgatattctagggggacaagtcctctccgagtaccaaccatcccagcaagtgttaaccagggcctgccgtgcaccaggcaccgagctgggtgctggagacacagatataagccatgaccctgccacggaaggacttatgcattcttacattcgcctgtgtagtcagcaaatacttactgcacacctattatgtgccaggcactgcgctaagagccaatgacacatcagtgaatgaacaaatcagactaactccccaccttcacaaagtagtggcagagacagactatacactgattttaaaataaaatggcaggtaggaatgattgctacaaagaaaactaaagcagggtaagaaaacagagaaggataaggtgggaatgccatttcaaggagctgttcagagaaagccgttctgagaagatggcatttgagcagacacagggagcaaacagcattgcgtgtatcggaggacacagcatcatgggcagggtcaacagccggggcaaaggccccgaggcacattcagtctttccaggacaatcctatcgaaaacgtctatccctgctctgttttcctcacagcacctgtcaccatggacattatgtgtgtttatatcagtctattatccatctagcccacttgagtctcacctccaggaaggcaaggatgtttgtctgtctaggtcactgtggtgtcccagagcctaggattggacccagcacacagcagaccctcgaaaaggatgtgtttaattaattagtcaatcaatcatctagagtagactactcccacccccacccagattctaggccctggtaaaaggtgcccagttctcaccccaccccgccccgttccccaccacatcgggagaggaagttgatgcaaaaaacaagttgcaacaacctgtcatgaagaggtctgatgcaacagtgggggaaggcagtgggggacactgagaggaacccaatgcttttcttcacgcagcccccatcaaggggctggggcctggcctacaaactttcctgagttcaccaacaacccatccttccttcaacagatatttatgcagagcctcctctacatgatggggctaccttatgggtctcaaactggtaactcagaggcatcattcctttggcctgcagaggggtttgagaaacttgggcctaagtttgaatatcaggtttcccattaaaatccaaattccaagcttcttttgaaaaaactgacacatgggtctcaaatgcccacaaggctgcaggtgctgtagagcagagtgatagccatcaccttcacccaggacaagtgctcctcaatttcccaccacccaacccactgctgcgccctgtgaacacctgagtgtgagacttctgtcctagacacaggcaaggcaaacctgaacctgctacttcgcctttaccctcacccagggcagacatcactaatggaatgcagatctttttcctgctaagtcttctccaagccgttcagaatttatctcccttcactgttgtcagaaatggtctaaaatccttcccattcacaacccagcttctccctactcctttgggctcctcagttgttgatttttttcctgaaaaatgggctcatcagagtgggattctagcagagattctcaactttggtaccttgacagttcagtggatagttctttgctgtgagggatgtcctgagtattataagacactcagcagcttccctgccctctaccctctagatacaaataacaaccctcctctcctcagttgtgacaatcaaaaatgtgtccagacattgcccatgtcccctggaggcaaaatcatccttggttaagaaccattgcattatagcaaagctaagaaaatggcctctagacagagccaagtattttgggttcaaatcctggttcggtcatttgctggctgtgtgaccctaaacagcctctctgtgtctcagcttccctctctatgaaatggggatataaaaatggtacctgactgctaatggtatgaagtttctttttttttttttttttttgagacaaagtctcgctctgtcacccaggctggagtgcagtggcaccatctcagctcactgcaacctccgccttctgggttcaagcgattcttctgcctcaacctcccaagtagctgggattacaggtgcatgcctccacacctggctaatgtttgtatttttagtagagacagggtttcactatgttggccatgctggtctcaaactacggacctcaggtgatgcacctgccttggcctcccaaagttctgggattacaggcgtaagccatcatgcccagccaatatgaagtttctttctgaagtgatgaaatggtcctaaaattagatggtggtacaactctatgaatataccgaaaaccattcacctgtacacttcaaatgggtaaactgtatggtggtacgtgaattatatctcacactattacaccaaaagaagaaaaaagaaatagatacctgcatcacgggggcatggggagaatttgatgggttaggataaaatgcactaggaagcactgtacgaactgtagcccttatcgtcagcaccagccctcgcccatctggggcctgcatgggcgtgtggctggaaggaaaagcctcaagtgacggagacagtggtggctgggaacaggccctgctttgggtggcatttcccgccggaatgtcctggacaaagagaaccaagtcactcggggccccaggatgcagggcggggtggctggacatcctggggtccttgtgcctgtctgcagcaggacaatgagtggaatgcggtctcctctctgtggggctgacacttgacatctgaagacaatgactttcaagaggttttgttttttcctcagtccaactattttttttccatcttcccaaacaattgttcctggggctggagggcgagcagtccccccttagctggtgaaggattgtatttgtagagtcaggaaacaatgcacaaaagtgagagaatgtaaaaatagtggcattcagggcccaggcctcagtgagggaggtgcagccatggaggtttcctcccattgatttttcccagagcctgctcggccccagggagggaattctggcagcagaagggccagtcttaggagtacagacactggctgcttggctgcagcttggggtcttcagtttagggagtgtcaactatgtacccaatgcttcccacgattgcctcatcctagacaatctcatctccattttacgaaaaaggagaccgaggttctcagtggctgacgcggcagcctcagagcatgcagctaagcagacaaagctggcctctgacctcggggccatcagagtccaggctctgactttctgccacatccactctaaccctctcttgcgatctcagcttccctgaccagccactcacttcccactagtgatggggccacatcattaaagttgtgacccccaagctccacaagggaagaaacttctgtccctggagcccaatacagtgccaggccttctgatccaacgtgaaaggagggagaacttgcaggacagaaaggacccagagcttgcagacatcagaggactctcagagaggccccaacagcccttgaccattgtggtgggctgaacaataatccctcaaagacgtccacatactaatccacggaacctgtgaatacaccaccttccatggcaaaagggactctgcagatgtgattaaggtaaggatcttggaaagggggggattatcaatagcattgaggtgggcccaacataatcacaaggatccttaaaaggaaaagaggggctaggcacgatggctgaagcctataatcccagcactttgggaggccgaggtgggtggatcacttgaggtcaggattttgagaccagcctggccaacataccaaaacccaatctctagtaaaaattaaaaaattagccagatgtggtggtgcacacctgtggtcccagctcttggaaggctgaggcgtgagaattgcttgaacacgggaagcagtggttgcagtgagccaagatagcgccactacactccaacctgggagacagagcaagactctttctcaaaaaaaaaaaaaaaagaaagaaagaaagaaaaagagggaggtaggagagtgagtgccaggggtcagaggaagaccagaagacgctatgctgctggctgggagatggacgaggccacaagccaaggaatgcaggggcctctggaagctggaaaaggcaaggaaacggattctccccagaccccccaggagcacagccctgctggcaccttgatttcagccccgtaagacccagttcagactcctgacctccagaagtgtaagataataaatctgtgctgtttaaaggcacaagaaactaatacgactgctagctcgaaacatgtacacgaaagaaaagcaaacctgttgtatctccatgaatcacggccaaacacaatcctaatactctgttattatgattactacaaaacagatattatcatacagtctagctatacatttcatacattgtttggcatatgtttagtaagctgcaaaatgctttctttccccacccacaaaagtatctacaaacaaatattcattaaggacagatggtctaataacagtaattactataataattacagcaacatcaagtatctttcactattcagatctattcagttcctgagtttagaaagcaagaagccatttagaaagatcagataagggaaaccttgggatactaagctgtcagaactagataatgcctgcatttccaatgaaacgtggacacgacaaccagctgcaacacatattaagtgcttactgcatgccaatgccaggggtacaggaggaagcgactcctacacccccatttcacagacaaggaacagagttatttgctcaaagtcatgcagaggaggaggacggagccagacctaagtgcaggccccaggggcttcagagccaagtctctttcccatggggctatactgcttcttcagttcaaaaattgggagaatttaattaggggaaggagaatagtgtagcctcgtgggaagaccaggagttgggaggcctaaatcagcgtccccaatccctgggccgtgggctgttaggaaccgggccacacagcaggaggtgagcagcaggcaagaagcaaagcttcatctgtatttagagccatccccattgcccgcatgaccacctgagctccgcctcctgtcacatcagcagcagcatcagattctcataggagcacaaaccctactgcaaaccacccatgccggggatctaggttgcaccctccttacgagaatctaatgcctgatgatctgtcactgtctcccatcacccccagatgggactgtctagttgcaggaaaacaagctcagggttcccactgattctacattatggtgagttgcataattatttcattatatgttacaatgtaataataatagaaacaaagtatacaacaaatgtaatgtgtttgaatcatcctgaaaccatcccttccccacccctaggtccgtggaaaaaaatgtcttccaggaaacccgtccctggtgccaaaacggctggggaccactggcctagatcacttaggcatccctgggtggagtgacacaaagggatcgtcacaaaaggcaaatgtggtcacccactgccctgcccagcccatcagccgctccccgcttctctgagaaccccatccagaagggctctgcaggacctgacctcagcctccaagctgtgctgcagccagaccggcctccaggatcctcagctgttccccaaacacacccagcttgctcctgcccccaggcctcagcacaggtgctccctccacctgcaacactcatctccctcctgccagctgcttcaagtctcacattccctgccctccccagtgagatccaaggttggtcagggcccaggaaacccatgcataggctcccatacttagtgccaccatgactataacttaaccttgatttatgtgatgattcaattaataacaggcttgcccaccagcctaagacctctcagaggtcccacttagtcccagtttccatcttctttcatttatgctcattcttggtgagtgagtggatggacgggtagagggagggagacccctttctctggggcaggttcctcacctgtaaaatagacactgtgtgataacactgccggcttcatggattaccatgaggactacgagaaatgctgcacactagctgaatgatttcagatgactgattcctcctctctgggcctcagtttccccatctgcacagcgcccaccactcagggcctgctgacctggttgccaaatgtagccctgccacagactcgctgtgggaccctgagaaagctgctcccacactctgttccctcgtccgcgaaacggggaacagtggtcagatgagaggatctcaaagggctcccagctctggggctatgaggtcaggcccacacattctaaccacctcgactccctgccttccagccagaccagtgacaaccagccacaccacagactacgacagctcaccagggattctgcaagggagtctttcaatggctccttccctgggggacctgactatgggacagagcccccgaggagggaggggagatgatggaaccagagaagcatgaagaagccccctcaaacgagggccctgaagaggggatggctgagagctggaagatggaggttctggtgtcagacaagctggttcaagtccccacctgtcagcgggggagggtacgtgggcctctgaacctcagtttccacctaactcagagaaggaaatagataacgaaccctaacttcagagtcgcaccagagtgaaatgccaacgcttacgttaccatcactgatggggttcttatctgtcagtgcatcgacgtaaaagcagccctctccaactacagaccacgctgtactttcccgacatttccccagagtcgtgtgtctcattccactgcagccccaatgcctagtctgcccttcctaggtcaccccaggctttttcttacctcagggactttgcacgtgctgttccccgcccctcatcgtcactgcacaggatgctcaaatatcacctccacagagagcctcccctgaccatcctggctgaagcagcctcacccaagccacaagtcgcccccgagccaccctctacctcgataatctgttttaattccctgtaatgcaggtagcacaaagtgttgttctatgcattttgctaatttagagtcctcctctctgcgcactgccagctccgtgatggtgagggtctctggctgcttgtgctgaatccacagcatgggttgaggtagacagaagatgctgaataaatactggttaagaggggaaaggaggtgaagttccataagcctccaagcttccattcctatgtatgtaacacagagtaaaagcctctatctctcagtgttcttttgaggattcaaggaaatatcactcaaaacataaagtgcttagcacagagaatggaacacaataaaaactcaaattttaaaattaccaatgtccatcaacaggagaacggatgaacaaatggtggtgttctcacacaacagaaaatgattcagtaatcaaaagaaaattgctaacacacgcagcaaactggacgcatctcaaaaacatggcccaagcgaaagaagccagacacaaaagggtgcagccacccgtgggattccacatctacgaagtcccaaaactggcaagacccttctttgatgacagaggttagaaaagccgtcactcggccgggcccagtggctcacgcctgtaataccagcactttgggaggcagaggcggccgatcacttgagttcaggagttcgagaccagcctggccaacacgatgaaaccccgtctctgctaaaaatataaaaattagccaggcatggtggctactcaggagactgaggcaggagaatcatttgaacccaggagacagaggttgcagtgagctgagatcatgccactgcactccagcctgggtgacaaagcgagactctgcctcaaaaaaaaaaaagaaaagtcgtcattcaaggctggataaagactggcaaggggctcaaggggactctggaggcaaagaatgttctagatcttcacctggtggtgatgcatacgtaatcaccaatggagctgtgcacttcactgtctgtaattatcctgcaacagaaactattcccttttttttttttcagcaaagggtttaaaaggagattgtcaccgtccaccctggtttgtctactgtccacgcatgggttgtcctggctcaagccctgagggccaatacatcgttctggcttcaggcagagccagaccccattcccattccttctacaactgtgcatccacgaagccctggcttctttgaggcccgttgccaaagagacgagccaccctccacacacaccccctcgctgcctcccaaccctgcttctaagaagattcgggaacaggaagcctgtgtctgctctcaggttctgaagcaaagaggctgggggtggtggtgcgggggaggggagatgaggggctgccccgttgaatgagacgtgccttgaatcctgaggggatcctctccaggtgtgtgagaggtgtcccccgcccaccacaggcacagggacagccacaaacacctactctaccgtcgtcgctggggcatctctaggagccccagcacccactaggcatggggccggcttcgtacatcaaagagcccttgcatgttgcctttctgcttaaaatcctccaacagaggctgcgctatcagaatgagctcacactctgtgacctcacctcctacgcaactcccttctccctcatctcctcccacactggcacccttgaaggtgcagaaacacatgagacaggctcttgccacaggacctttgcactggctgtcccctctgcctggaacgcctgtcaccacgtaaccacatgactcattcactctgctccttcaggtctctgctcaaacgtcacctcctcagtgaagcctgccctgcccacaccattgaaaactgccacatcttcccagcagcccagccctctaattttgcttcatgtttttccatagcacttaccacctgagaacactacaaattttccttggctgacaccttcactgtctgtcttcactgcacacacggtgagggagagagcttttgtctgtattgtgcactgcggcagcctggacactcagtacacagcaggtgctccataaatcacttgtaagcccaaggaggtaaatttgaggtttatcacggaatggactttctaaaattttctgcaggatttcaattgtctgctaagaatatgtgctatctttaccaattaaaaagaacaattagaaatctggttttaaaagccaggtgggagccatctctaggtcagtgggtctgatgcccaggaagcgggcataagaattacctgtcaagcttttcaaaacacatgttttgcccaggaggtataccaggaaatgacagtctgactcaagaggtctggaaaagccaggaaatcagctctttttccaaagctcccagataaccctgaagggctccaggaggtacacgaacccgagaatgggcagcagggcagggaaagcagctcagaggaggtcagggaggaccctgagcatgaccttgacaaacaggcaagatctggccagccaggcacagtggctcacatctgtaatcccagcactttggaaggctgaggcaggtggatcacctgaggtcaggagttcgagaccagcctggccaacaaggcaaaaccccatctctactaaaaataaaaaattagccagacatggtggtgcatgcctgtaatcccagctacttgggaggcagaggcaggagaatcacttaaacctgggatgcagaggttgcagtgagccaagattgctccactgcattccagcctgggtgacaaagtgaatctccatctcaaaaaaaaaaatctggccatgcagaagtgaggaaggaaaggaaactggagacccagatttgcaaacctttgcaatcacaaggcaaccccttggcagccctaatccatgaccctcaggctacagcaggcgtctgaatcacctggggcactcagtggaaatgctgattcctgggccctgaagactgagaggctccaacgcagtgggagagggaggagcctgggcatctgccttgttaacatgcttccccaggcacctgcgatggggcaccaggtttagaaggtgctggttgagtcttctggtttcagtatgtacagttgcctttcatcaggaaaattaataaagtcataggaagaaaactggaaatcacacattctgacagtgcccactgtcaatatttcaacatgtcaccttccatggcgtctcctgcagtttttaggcatggctgtcatcaccggttgcacataattttgcatgtcacctttccagtggtccacagtggctaaggaaatgggtgtggctcatgtccctaaccatttccctatccgacctttaggttgttgccgattttgagcgctcacagtggtgtttcaatgagtaacctggtacataaaagtatctggggattttccccccatgcttaggatttttttcagcagtgggatcccctgcaattccaggggaatcactgtttgggagtctcttgttgtctccgctaagtgttttgccaaagggtttgcaccaatttattgctctaaaatgatgccaaaggcaacaagttctagccgggcgtggtggctcacgcctgtaatcccaacactttgggaggccgaggcaggtgaatggcttgaacccaggaggcagaagttacagtgagctgagactgtgccattacactccagcctgggcgacaggagcaaaactccatctcaaaataaaaaaaggcaacaaaagttcaagccttatcagccgtgcagccccatcaccatgcggaggaggaacccgaggcccagctgatgctcattaagaattccttcatgccggacacggttccaagtgctttctcaacagaaacccataaatcctcaccacagccctgtgggcagggtgtgatgccacgcactagcatagaagaagcattcagcaagcgtgttttgctattattattacttgcatttgattttcctctaaaaatgatgtgtctaggctgggcgcggtggctcccatctataatcccagcactttgagaggctgaggtgggcgaatcacctgagttcaggagttcgagaccaccctggccaacatggtgaaatcccatctctactaaaaatacaaaaattagctaggcgtggtggcgggcacctgtagtcccagctactcaggaagctgaggcaagagaatcgctcgaacctgggaggcggaggttgctgtgagctgagatcgagccactgcactccggcctggctgaacagagcgagactctgtctcaaaataaataaataaataaaataactaaaaaaataaaaaagtaaaaataatgtgtccagccatatcactgagcaaaactggggttccagaaagctgggccaggtttcttgggtggcacaggtatggccctgcagggtgcccatgcccccaagaaggcgcaggtgcgcagctcgtggcagccctgtttctggtgaatcaggccggcccctgtccctgtgacactgggtgagacgtgcccatggccatacctgcagaagagatgccccagcccaagcagtgccataggaggacagcactccaatgccccaaatactgccccagccaccaaccacgggacacagacccagcagttccctttttctctttgcggaacttcccaccacatcaagctggaaaggaagtcggcagctcagcgggaggaaaggcgacagtatacaaatcgcttcatgtctgctgaggaaatttactgccctgaaactgagggctgaggaaggaggaaggggcagagcaggctgggctaggactcaccctgtccactgccgtccagccaggatggccgcatggctgagtgccaaggccaatggcgaagttgtctggagaaatcaaaacaagtgtactcagggaccacatatccctgggcaggtcactacgttcgccgacctcagttttactcatctgtaaaatgggcaaaacaggatccacaacaagagctactaaaaagatttaagtaagagaggacctgtaaagtgcttaccagcacacagtaggtgctcaagaaatgtccataactggccaggcgcggtggctcatgcctgtaatcccagcactttaggaggccgagggaggcaaatcacctgaggtcaggagttcaagaccagcctcgccaacatggcaaaacctcgtctctactaaaaatacaaaaattatctgggtgaggtggcaggtgtcggtaatctctgctactcgggaggctgaggcaggagaatcacttgaacctaggaggcaaaggttgtagtgagccgagatcacgccactgcactccagcctgagtgatagagtgagacttggtctcaaaaaaaaaaaaaaaaaaaaaaaaggaaagaaaaaggaatgtccataccaattattaagttcaagcttctcatcctggcatctagctaccacatcctaccagaggcacctctggcctccaagtgccccacactagcccctttcctgatcaccgctaagcatgtgatgcaccagcaatgcaccaaccacagagcagcaaggaactgtctcaggacagaacctctgggacctcattcattcattcagcaggtacttactgagaagcagatgagctgagactgacatgaagaggtggggacatgtggctatctaggggagactgttccagacagcaggaataccacctgcagaggaactgaggcaggagtgagcccggtgtgttcaaagaacagcaaggaaagctgagagagggcgaggtgagagcaggaagaaacgaggcaagagacttaaccaggagccagaatgtgcagtgccttctgggccacagtggggtcttcagcttttctctgggtaaggtgggagccatggagggttctgagcaggggaaggacaggatctgacctgagttcttaaggggccatctggctgtgtgtgaacaacagactgtagcagggagctcaggaggagtctcctgcaatcgtccaggcgggaggtgatggaggatttgaccagggtggtggtgagctgtggtcagaatccagaggtattccaagacagagcccacgggattttctgagagatgggatgtgagggacgagagagagggaagtcgaggccgtctccctggtttctggcctgtaccactggcaaggatgaaggccacttttattgagacaggaagactgtggtttggggggcgggtagagagttcaatctcggacattttaagtctgacctcacgcaaggcagtctggtgaaggagacagaccgtccgtcagcaaatccttgcacaatgtgcattcaactgcaatcgtgctgagtgctgggcagggtgacctaggcagaggcattcagtgaaggctgcctggaggaggacaccagagcggaggcctgaaggctgaggagctggggacacacgagggaggggttgaaagctgctatctctgtgtgtcttccactttcctcatcacttcacctcccacttcacatccagtgaggacagagcccgagaatgaaggaagtgtggtttctggggttcagagctctggggtcagacagagatagcttcaaatcccagacctacccttttcttgttgcatggcctgaagctggtgccttcaccactccctgcctcagtttctacattcataaaagagggtgattctgccatgttttcagggtgtgtcaggctctggaaacccagataaagatgcccacctctctcccccaacctgggcacctccttccagcctcagtgagaagctgctttgccagggaagctggaaggatgtgacagggcagggagtggctggacccgcacggctgaaaccactggctgaggccacagatccaggcaaatctccggcccctccgctgccctggccaggcacatggtggcccacagagattttccatcaggtcaaaacaggaactccatggaaacgcacagcctcagcctgccatggggcaaggtgtttttccacagagcgaggctgaattcagcgttaaatggctctgcagggtggcaggggccactaccctccgaaaagagaagcaggtactagccagtgggagacaggaacctgcttccagcctcagctttggggaaacaggcacctataccacacccttgctcacacggtttccaccaccgcacacgctgctcctgcatccctgaccacaccaggcactcattggttctctcggcaaatgacgcatgtagcacgtccagaaggacaggcactgctgtaggccctggggatgagcatgaacaaaagagatgaagctcctgccctcacggagctgatattctacaggggtggagctggagccagggagattcaccagaatagactgcgaagccttacgaagaaatcaagcaggaaagggagagataaagcaaggagacgggtgcttttttaaatgtggtggccaggaaaagcctccctgataagaacacgtccagctgagacccagatgaggtaaggaggtaagccatgggttaccaagggagagcacaccatgggcagtggggcagcaggggcctgcttggtgcacagggacaacaaggagaccacaatggctggagcagagtgaacaggtgagagtaaggactgggaaaggggactcaggcagggggtgatatggtttggctgtgtccccacccaaatctcatcttgagttcccacatgttatgggagggatgcaatgggaggtaattaaatgggggcaggtctttcccgtgctgttctcgtgatagtgaataagtctcaagagatcagatggctttataaggtgcggtttccctgcacaagctctctctttgcctgccgccatccatgtaaaatgtgacttgctcctccttgccttccaccacgattttaaggcctctccaggtgtgtggaactgtaagtccattaaacctcttgcttttgtaaattgcccagtgtcgggtatgtctttatcagcagtatgaaaatggactaatacaggcggttttggaaatctgggcaagaaggtaggtgggggccagaggtgcagctaaggagacagggttctgttgtaagctcagcaggcaaggccctgaggaaggagggctctcacatctaacaagcagggggaagagacaagcatcacatcctcaccaatggaggtgagcacagtgacctttcccctggacggtagaggaccccaaggcccagctggagactcccctcaccccctgaggcttattttccccctctgtaaaatggggacacaagtcctgcccagcctcctgcaggggcatctaatgaggaatgaggctaaaagagtgaagctagagtccgggtcatcctggaccacaacctcagggctgctctggcccctacaccccaacagcctcccaggttctaaagtccaatgtcccccatggaccccgcccccctcagacagccgagacaggcgctctgagagccaagatgtccaaggaggtggcacctggcaaccagatgcctgcttagcagctgtgggaggggatggcagctggactccttggcaaccagccgctggagcctggaagccaggcatcacttcagagggggagtccacggggcggggctggggacagagtttctcaggctcctttctaaagcacatgactcacaggccctcggaaaacccagcaggcccctgaattccagaacactgcttgtagggctggaggcctctactttgctctctgcctggaaactacttagtgtccagtcactgaggtatttgctcccatggccactcagtctcctctctggaagggagaccaatgcctactatgcgggcacacgtgaagattcagcattaacacaaaaaatcagaacagcaggcattcaggaagcagctaccctgtgccaggctctgtgctacgtatttctcctaagagtcagtggtagtactgttaatcccattttacagatgagaaaactgaggcacactcacaggtaaagcatcacacacagcgagtggcagagccagagactgacctccactccaggcccataaccactccaacaccctgcgatgtgcgaaaggtccgaggggtttctcccgccccttggtccagtcaacaagtaattccactcatcaatatgaataataatagttgctgttgtttattggcaactatttagcaactgggaagtgagctaacgtttatgagcaacggggaagtgaggtaagtggcccacaaaggcacactgggaagggggaagtacagcctaaatacaggctttctgatgccaaaacccgccacaccacacgaggcacaaacaccagaccaggtctgaacaacatgagctggtcatgccccaattctctaactctccagcctccagcatgaggcccaggagcccccggccacacaccaccattctcttgagggtatgaaggctttcgctggaatcccaaacccagacagtgaacggaaggctgttcaaccccagcaaccttcagaactgaccattacggttgatgctgatcccatgcctaccacccagaagtgcctacagacagggcctccggcggaatccaaggctccctaacatcacatcacaaatatctgagaacaaaacttgacagctagagtcaggcagggaggtaagaacctgaaatgctgttgccctcaagaggttaacagtctcaaggtagccacaaccacacataatggactctgatataaagaccaaggcctgaagggtcacggcaaagccaagctgtatggcttggggccggcagctgtacctctctgagactctgcatccacatctgtaaaatgggcataacgacagcagtactctgtagtgacaaagacctgcggagaggctgtggatcaagaactaagaacaatgccaaaaacacagctctgactggaagtggggttgctatcatcatcatcagcagcagcagcatcattatcgggattatcagtatttcagatcccacagccagaggtgcccaagacgtctacaccaggggctacaaacaccaatgccaacagaagccatgcaaggaaagtgactgagtgaagctggccaggagtagtacaaaagggaagggtggggactgtggcaaactggagagcagacatccatctaaagggtaagctgtgactgtgttccaatcaaatgtcgccaggcaaaagtacagccggatttctgtttccctacagaaattggaaagccatatttttgcaaaaaaaagtcctacttttaaaaccctgtgctacttaattctaatatgttcatggtaaggcaaagaaactagaatagccaaaacaattctgtaaaagaacagtgttggaggattcacattatccagttttaagaattattatggccaggcacagtggctcatgcctgtaatcccagcactttgggaggccaaggcgggcagatcacttgaggtgaggagttcaagatcagcctggccaaaaggatgaaatcccgtctctactaaaagtcaaaaatcaaaaaaaaaaaaaaaaaattagccaggcatggcacacgcctgtaatcctagctactccagaggctgaggtgggacaatcgcttgaacccaggaggtggaggttgcagtgagccaagatggtgccactgtactccagcctgggtgacagagtgagactccgtctctaaaaaaaaaaaggaactattataaagttacaataattatgatgatatggtactggtgaaaggggagacacacagatcaatggaacagaaaagagagtacaggaattgacccacacaaatatggccgtttgacttttcataaggatgcaaaggcaattccgtagagaaaggacagtcttttaaactgttgctttaaaccaatgatcttggaacaaccacacacgatatgcaaattaatgaacctcaacctaaactacacacttcatacaaaagtaaactcaaaatggatcacagatctaaattcaaaacataaaactttagaagaaaacaggagaaaatccttgtgacctgagattaagaaaagagttcttagatgtgacattaaaaaaagcaagatccgtaaaagaagaaaagggataaattagaacaaaaatgaaaacttttgccatgcaaaatacactgtcaagagaacaaaagacaagctacagatggggagaaaatatttacaaatgacatatctgacaaaggatttatattcagaatacaaccctaaattaacaaaggaaacaagccaaaatttttaatggattaaaaaacttgaacattttcttcacccaagaagtatataaatggtaaatatgcacatgaaaagataggcagcatcattagcgattaggagaatgtaagttaaaattacaatgggatacctctatgcttctacttaaacggcttttgaaaaacccgacaataccaagtgctgatgaggatgtggaaccacagaatctctcctatactgctgtggggaaagtaaattagtacagcatctttggaaaacttcccacaaagttttttggcagcttcccataaagtcaaatatctacttaccatatggcccaacaaccctgctcctggatgtttaccctagagaaatgaaaacttatgttcacacaaaaagctatacataaatatttatagcagctctattaaaaatcaccaaaaactggaaacaagcaattcaacatgtgaatggataaacaaactgtggtatatccaaacaagggagtactactcggtaatgaaaaggaacaaactgttgatacacacaacaatgcagatgaatctcaaaggctttatggtgactgaaagaagccagtctcaaaaggtggtgtacagcatgattccatttatacggaatgtgtatgttttagaaaaggcagaactacagggagaggaaatggatgagtggttgtcaggggtaacgatgggggaaggtgtgactactaaggggtggcatgagagtgttttttgggtgatggaagtcttctctatccagactgtagtggtaagtatataactctacatatgtgttaaaattcataaaactctaaacccccaaaaagtcatttttactctatgtaagcttcaaaagtcaaattaaatgtttgaaaaatttcacactgggtatcagtatggacactgggtttttcaaatatatgtgcagatagaaagatacagaagtaaatatagattgtgtaagtgtctatacatatattcctggataccatggcatccagtaacaatgagcataactactgcccagattaggtttctaaataccattctccaattaaaagagctaggggtccttaaagaactggttgatttcagggctgaggcagggaaaatacaagatgagccagaatatcttgtggttagatttcaactagtaaagaaatgctcaaaagagaccaggtgcagtggctcacacctataatcccagcactttgggaggtcaaagcaggaggactgcttgagaccaacagttcaagaccagcctgggcaacacagcaagacccatctctaccatctctacaaaataatgttttttaatgttcaaaaaaaagagaaagaagaaaaaaaatagaggaggcatgtcaaaagggcacggggtcaaccagaaagaactcctaatggccaaagttgggacaacttgaacaacaaaataaataatgacaatactggtttatgataatataaataatggaatgaatcagggagaattctttttacacaaggattttagttaataaaagtaggaggagtgaaggaaatagaaagccacgactggaagaccacagtaagagctatcacaggccagacccaccggtggatgctaaaactagtgggcaaaggttcaaacaaaaacagggtatttccacagtctcaaagaatctcccccaaaatgtctagtaattacaaaggaaaattagtaacctcaccatggagtatcctggctttcaccatcttaattaagtgttaacatctccccttgaacatatcaacatcacatgccccctgattaaaatgcacagagaggggcacatcgctcctggggtatccctcctaattacgcataagctcaagtccaaagtggcagacagtctacaaaatacctgaccaggactcttcaaaaaagtgtcaaggtcatgaaaggcaaagaaagactggggaactctcacagattacaggagactaaggggccatgctatctaaatgcaacatggtgccctaggttggatcctgaaaataaaaagaacgtttgtagggaaactaacaaaattctactgaatcttatagttaatagtactgtatcaagattaattttttctactacaaagaagtactttgtacttaggtaattatactacagtaatataaaatgtcaacgtaatgggaagctgggtgaaggatgtacaagaactctgtactatatttgcaagttttctgtaagcctacaattatctcaaaataaaaagtttcttaaagccctgtgctgaccaaaccaaatcacctactggccagacaatgcacaactacacaaggaatgtgactcatgggccacaatggtgcagcccctggcctacagctgacaccccactcctccccaaaagaagacccaagaagaactctgaacttggtgcagagaagagtccccaagtcagacaccccctgcctcatccccctaatttgtttttcatggccacaccaagagtctatagctagaaaagcacacagcctggtttgaacccaggccctgccacaaactcactgtggaatcctgggtaagggactcccccttcctcttctgaaaacagggaaggggtccacctccaggagctattatgaagctcagatgagaatgtctagctatgaatttgctacgaatttgcatgccctcatgacccagtcacctcctattaggccctatttcctgttgcattaaggattaagtttccaacaattgaaccttgggggacacattcaaaccacagcaacatgttacaattgaggaaatggaggcccacagattttaaatgacttaccctgttacagatggtgatgaatttgtactatacaaaaatcaggggagccaatgctcaggagatttggactctgggaccacctgtgccttgacctggccacagatgtctggcaagtccttctcctgctgagtctcagggtcctcatgggtgactcagtcaacaattagcaaaggaaaaagtcaggctgggtcactgatattgtttggctgtgtcctcactcaaatctcatctcgaattgtagctctcataattcccatgtgttgtgggagggacacagtgggagataattgaatcatgggggaagtttcccccatgcggttctcgtggtattgaataagtcttacaagatctgatggtttcataaaaggaaacccctttcacttggttctcattgtctcttgcccacctaagatatgccttttgccttcccccatgattgtgaggcctccccagccacgtgaaactgtgagtccattaaacctctttacctctataaattacccagtctcgagtatgtctttatcagcagcgtgaaaatggactaatacacccatatatccatttctatgaatatgtcctgttaaagtggtgagaaagtctcattaaatgtagaggaaaggtttgggatggtctggcttaaaataatggccggccagggaaggtcttctgagaagggaaaatttgagcacagaactgaaagcatgatgaggagaccaagccaggggcagatctggggaaaggacttcccaggtagaggaaacagcacaggcaagaacctagaggccgggctgtgtttagagggtccatggagcagcaggctcaataaaggattctcgctctcactgcagtgtgatgaggagtcccaggaggggcatcacaagggagaagaagtgaacaggcgagtgtcatagtctaaggtggggttagcaagatcgctctggttgctgtggacaaaaaggactgtaggaggtgacggggctacagcaacaggccaagcaaaagaggagaaggccttaaaccagagtgctggttaacagcacagcctccggaaccaggttgcctgggtttacacagcgctgccactcaccagctgcgtgaccttgggcaagagacttcacctctccgaacttcaacatcctcatttgtgaaatgaaaaagaaggatacatgcctgatatggttgaatgaagactaaagaaaataccatttgtaaagtgtgtgaaagaggaaatgtctgttagatggggtggtggcagagagggtagtgaggatgagaggcttggaaggcagaacaatgagactggccactggatgggatggtgagacagaaacagaggatggagagtgactccgaagtttttggcctgagcaagtggaagaatggaggtgccattagctgagatgagagagagagggaggaaccagttacaggggcaagatgaggaatttggttcagcacatgtgtagtttcaggtgttattttagatccaagtagcaatggcaaagagacagtggccatacccgggtgcaatccagaggtggggatggtacaaaggacacaagtgacatcaccaggaagagaagaggcccacaggtgggggctggcacccccaaaccatcggaacccaggaggcagaggagaaataacaaaggacctaagcagatgtacgggaggaaaaccgagagcccacagcaccctgacaccgtgtctcaatcataccctgcctgtctcaggagtgagattggtctcgactactcagcagcatctcccagaacaaagacacatcttaaaatgtttcttcagtatccacttcaccactacctgttacccaagtaccccaaggaagaaaagtcattgtcttcaaaataccccaaatgagctggccacttctaaagtgattcctgctcaaacagctcacctgctaatgtcccctccatgtctttatggatctcacgctcctgaatataccacagtcacaacacaaggtgaacggaaagcaaatcagttgcaaaaggaaactgcaaatcctgcaaaagatgcagggttttatgacatcagtgaaagtgatgctggagaaccacagctggctgccaggcaaagctataaacaaataaagacccaggagtcgctggctcacaatgagagtgaagaaagcccaggaagaccacataagaagttccaaaggaacttttctgaccatcagagagtgcacaagaagtccaaaaacgggctccaggggttttgcaaaatgactctttatcatcatgctataaagtgaaaccttacatgaatgatgtggcatcgtgtaatcatttaattttatcagaaaaattacacatacccccaacagtaaaaaataacacttggttccctccttgttgattctaagaattcatgcaatgttgttattacattctaaatacagttactgacgggataaaattccacctatttttaggattgtggttttcttcttcaaagtgaaggactcatctagactctacccccgccaccccacattctcaatattgctatgttagggcccattttcaatgagttctcagcagcaggcctcattttggtaacaattattctgtgacagtgaggccgtcctgatctgcacactgctggaccgaaaggcctccccctcttccctaaagaagccccttttctgggggtcaagaagccgacctgcccacaggaactgggagcccaccagaagagaaaggcaagtgggcgactgggcatgaaaccttgggaattaaatgtcctgggtcctcctgaccccacctgagcccacagcagctccttcccactccactggctggacagaagcagccacagctccctgtgtgtagccagcagaccctcccttgtgcaatctcattgaagtatatacttaaaatgggtaggttcttccagatatcatttctatttctttctctcttttttttttttgagaccgagtttcgctcttgtcactcaggctggagtgcaatggcatgatctcggctcactgcagcctccatctcccaggttcaaacgattctcctacctaagcctcccaagtagctgggattacaggcacctgccaccacacccacctaatttctgtatatttagtagagatggggtttcaccatgttggccaggctggtctggaactcctgacttcaggtgattcgcctgcctcagcctcccaaagtgctgggattacaggcgtgagccactgcacccagccagatataatttctatttcgatgaagcatatttttttaaagtgctgatctgcctgtcagcctacttcctgcctggggtctcctctgacaagcccacaggaggtttaccagcagtggctgccccgctcccacacctgtgatgggtggcagccaacaccagcccagaggacacctttagggcccactcatcgaagctgcaaagatgctgagcgccactggtacctccactgccatccattctgctcaagaaactggctttgggtgggaccccctggtggtgccaaggcttggctccagccactgtgaccacccaaggttccccaaactcatccacagagcctggcaccagatagcagagcggccagccagggctgagctcaggcctcatcgctgatgttcggactccagggacaccccctctcaccctacagaagtacctgtcccagctggccagtctctttgggcttttacctccaaccttcaagatgtcaccacctccaccggtgccagcagcccctctgctttccctcagtaagcctgtgcactcagagggttttgatccaaggcatcagcaggaaaaaaaaagtgcaccaatgtccccaaattcattccataaatactgacgagcccccatcatgtggcaggcggtggagacggagggcacaggaagacagagcttacctctagcaaagggagacagacaacacagcagcaggcaaagccacagggcagaaagagccgggatggatgggccggtgccttccagcagggggttcagaaaaggccatgaggagggtccatgaagacagtggggcctgagcgggctcatggatcacagcaggaagagaatggggctgggctggacccgagcatctgaggagcagccaggggccaggatggctctgggcagagaaagggggtgagtcggggaggtgaggtcaaacctggaatctaggcctgaacaaaactccctgggaggggtcctggtggcatgctgggggcggggggtggtaagcagctggacccccttggaggacaaataagcaacaaatctatttgcctcctttcagggcatgtaggttttggactttctaaagggctaggcaaacctacccttggggacccatcctacagagaccctagaacctgggcccaagacatgaccaacaaggagactcagggagaggagggagagcaggagagaaagaaagtggcggggaaacgggatagggtagaaaagggaggatgggggccgggcacggtggctcacgcctataatcccagcactttgggaggccgaggcaggtggatcacctgaggtcaggagttcgagaccagcctggccaacatggcaaaaccagatctctactaaaaatacaaaaattagctaggtgtggtggtgcacacctgtaatcccagctactcaggaggctgaggtgggaaaaatcgcttgaacccgggaggcagaggttgcagtgagccaagatcatgccactgcactccagcctgggtcacaaagcaagactctgtcaaaaaaaaaagagaaagaaagaaaagaaaaaaaagagaagagtagaaaagaaaagaaagagaaggaaggaaagaaaaagagagagagagaaagaaagaaaaagagagagagaaagagaaagagagaggagggtagggaggagaggaaagggagaggtggaggggagggaaagaggaggaggcgtgggaaggacaagaggtcacaaggatgcgactcctgaccctcccagccccccctccccacaacacactccaagaacctctcagaagcccccttgagcataagatgctgatgaccctctggggacccattctctgggcctcactggtggctagaaacgtccagcaaaggctgcgagaagcgggctggaaggccattcctgacaccctccttcctcaccatggtgacgggcgacagtgcccaccgcccctcaaccctggccctccctgaggaggcctggggaggattcttccttttagccctggaaacagaccctgacactcgtgtctgcttcccccgatcccaggacgacacggcacttatgaatacataaatctcataatcatgtaaaagctggctctgtctagtgatttcttttcaaagacatcataaaggtcctttataaacaaacaaaaaaaaaaaagaaagaaagaaaaaaggctgattccaaaacatcacacattacaagtgtttgaaggaacagcgaatgcccgctggcagcaaacagcccccggccagccggggtccacaagagaatgtttcagaggcctgagcactctcgagctcatttactctctctgctgctccccacattatggatttatgtaagcaggacgacgaaaaccctcgtcttcccccttacattaaaaaaaaaaaaagcaaccataaaacaaaaaacaaaacaaaacaaaaaaacatttttgcaaggaattttataagctgatctggagaacagaagaaggactaaggaaacccctaaagaagtctggttgcaaaatgttctgaaaagaaaaaacaaacttttaacacaggaacacccaatgatacattttttaagtctaattttgaaaaatgatcaaaacactttttttccccaacattacaaattacaagtggccaccagatgctggaggagggaaatatggctgtggtttgttttatcttctctgtttttaagaaacctcaaaattagggaagtcacatatacacaagcaaaggcaaggcaggaaaactgccgatgtgggagctaaacttcacttgcagatggcggaggcttcgagattaacgcacccaggaatcagccacatccagccctagagcgggggaccatgagagaatgtgtgcaaacccaaattgaacttgtaattcacttgatggatttaaaaggcccgtgggaagttttctgtaagccgggaacattttgctgctaagaaagccccaccacccagggaacaggcgggcagtgtcctcgagccttttgcaggatagaggcagatgtttggagatatgatgtaacctgggtgagtgaattcattcaaagatgagtcatgaaagcagccctcaaatgtccttcagaaatctcagtagcagaacacagagcttggacccaaatgcccacctaccaccctcaaacaggaagctcccctctttcaaagaagctctggccctgaggatgatggcaggcttcagctctttggccaccagcttctattccctcattttaccgtaaagtaccctgatgctgcttgaaaggtgttgctcatcccccacctgaggcacacagagcacaggatgaagccaattctttgtacgttgagcccctagatcaaactctacctgaagctgtaggtctagcttcatgggctattatacttcttctcttatatgagtctgactggtttgggttttcagtcactgctatggtttgaaggcatcccccacatttcatgtgttggaaacaaatacccgctgtggcaagattcagaggtggggcctgtaagaggtgactggctcataagaggctctgccctcatgaatgaattaatgcattcacggattaacgggctaatggatgaatggggtatcatgggagtggaaccggtggctttgtaagaagaggaagagaaacctgagctggcgtgttagtgtgctcagcccccctgccacgtgattccctaaactgcctcgagtctctttagaacccccaagaacgttctcaccagatgtggcccctccacctgggacttctcagcttccataactgtaagaagaaagtttcttttctttataaattacccagtttcaggtattctgttatgagcaacagaagatagactaagacactcactcacacattgagccccaccatgcaaggattaaataaaaccctgactttagctagaaccttcaaagttcggccatgtctaccccttccaaataaccaccaattcagaatggaacaagttcctccaatgtcatggaaggttcccagcttcacccaacttcacagtgcgatctaccatctgcttcctcaacatctccatccaccttcatcacgggacaacctgcagagcctcaggccctgactctgctcctcaccacagaggttttctgagtaataatgatggtaataacaacatcatcaacagtcagggcttgctgagagctcaggatgggccagtgggcttgctctaagcacgttcatatggttatctcatttaatacaacacccttagcagtgggtatcattagtctccccgtgctatagataagggagcggagtcacctgcccagagtcacacagcttgtctgtggcagggccaggctatcagccagcccccacgcagccacttgaaatgagtatttttatgttgatatgagtaactatggctatcatatcaaaaccattatttcatgaacattattaagctgagactataaagtttttaaaaagggaggaggttcagattgagtaaaaatattatatagacaatgttgtgactggtatttgaatattatacaaatcataagactgatactgaaatgagtatattgcaggaaatactggacggacagatgaacagacggacggatgacaaatggatggacagatggatggacaggtgggtgggtggggagatggatgggtgatggataaggaggaaagaagaagggagaaaaagaatgaagtgaagaaggggaggaaagaaggagaaaaatgggcctggcacgtagtaggtgctcaaccaatatgctgaatgaacccattagcaaagaagtagtagagtgctgtagttaagagtgtgggctttgaagtcagactgctggttcatgacttggctcagcctttcctcgctgaggaaccctgggcatgtgacaaaacctctctgtgccccagtctcctggactgtgaaatgggacaataggaacacttccatcaaggcagccagaagaaataagtcagttaatgaatgcagaatgctcaggacacagccggatgcatcctaagtgcttggtaagtgtcagctaacaatatgatgagtaagttgtcaaatccattctagggctgacccagtctaaccacctctctatttcagaagcaacctcaagttccacgagcctcccccgaaagtaggaacggaagagaggaaacagaggaacaaaaggctccactctccccaggctccaaggaaaaaggagggtggagggctgcaaggtaatttaagaagtttaacagggaaaaaaagtcttcaacatgagtgcggaaaaaaaaaagataaattcaatggtccaggctgcctctcgagacagctaaattctgttgtgctcattctgcatgcttcagcttttcttagactctgaggagtttttgcctaaattagagcctgcaatatgctgaagagaagaaagggaaggtgaagggaggcagagaaaggatcaggggcctgttaggcacgccctagaggaagcctggctgttccatccactccaacactgaatgccgagacagtgaaagtcaaatcccagcacctttccccacagccacagccacaagctgtgggttgcacccaagtcccacagcccagccctcagtgcactcaacactttccctgccatatcccaacatccccagcagcagccacccagattctccagaacatctgcttacctctacccaccctgtccccatcagctcccaccctccccagtcaactgaaacattactggctgctcaggtgactgctatcaccacccgggaaccccaacacatatttattcccaggaatatgtgagagggtgagagtgtgcgcatgtgcatgaataatgcatacactgtacttatgcaaggagatatgcatgcagaaaacggcaccccagctagctgacttggaactgtgcagattcatgcacacacacacacacacacactaatatcactcccttcggtaaacacagacagacaaagcacacagaaataaatcgttaccttcgcgctgctgctgccagatggcagagcctggcattgctgtgtctgcacgtctgtgcatttgtgtgtaataataacggtggctgacatgactgagctcctaccacgtgctggacgctgtcctaagtgctgcatcaaacccagaggaggtgttattattacccgtttcatagctggggaaaccaaggcacagaggtcaagtcatttgccccaaggtcaccctgctggtgaggggtaaagtcaaggactacagaataagcacccaatatgagcaagtctcgttttatgaccctggggggtgacagggaggaatcccaagatgaccagctgccatgggggtcctcaacaagcccaccgtcccagtgatgggtcaggtttcaacacaattgaaacggacaagagccagaactccccaggaaagaggggtgcccaaggttcagaaatgtttgaaatcaagttcagtgtccagcaaagtcctcaccaccagcaacaagtcaacccgggggcagagtatgcaaactggcaacccacaggtttggcccacagtcatgtttggtttggcccatgaagtgtttgttaaaaatgtgattgagttgccaacttttaaaaatcgagtgatttcataccaaaaactccacatttcctgccattggaaaatgtctttaagaagtcaagagatctggcaataccgggctcgagttcccgcacggggactgctgcctggggctgagaggtggctgcttgcttgacatgggacatgtgctccagaaggcacagattggggttgggggcctgcctgtgggggctcacttctgtgcctcagtttcttcatctgtaaaacagcttccccataggactggtgtctggcacccagcaagcactcaataaatgttaaatagcactgctgtctccccaacatccaaggcccagggcttgaggcattgttttataaaaataagagctaaggccaggcgtggtggctcatgcctgtaatcccagcactttgggaggccaggtggatcacctgaggtcaggagttcgagaccagcctgaccaacatggagaaacccggtctctactaaaaacacaaaattagctgggcatggtggctcatgcctgtaatcctagctactcaggaggctgaggcaggagaatcacttgaacccagaaggcagaggttgctgtgagccaagatcgcgccactgcactccagcctgggcaacaagagcaaaactccatctcaaaaaaaaaggagctaacacacatctagcacccgcgctgtcccaggctctgttctgagagctgtactttatgaactcactcaatcgtcccaagaaacctatgagaccattcctaggtaaaagcccaagagaaataaaaactatctccatacaaaaacttgtacactcatgtgcatagcagtattattcatagtagccaaactgtcaaaacccaaatgtccatcagctaatgaatggataaacaaaatgtatatccatataatggaatatgatacagccataaaaaaggaatgaaattctgacacatattacaatgtggaagaagccagatacaaaaaaaaaaaaaatacacacacacacacacacacacacacacacacacacatagtatgattccatttatatccatttatatgaaatgtccaaatctgtagagatagaaagtacattagtgggccaggcatggtggctcatgcctgtaatcccagcactttgagaggcaagttgggtggatcacttgaggtcaggagttcgagaccagcctggccaacattgcgataccccatatctactaaaaatacaaaaattagcctgacatggtggtatgcgcctgtagttccagctacttggaaggctgaggggggagaattgcttgaaccggaaggcagaggctacagtgagctgagatcgtgccactgcactccatcctggataacagagcaagaaactgtctcaaaataaataaataaatacatacatacataaataagtagactaatggttccagggattggggaagtggaataatggggagtgactaccaatgggtttgggttgtttttcaggtgtgattaaaacgttctgaaattagaagatagtgacagttacacaagcttctgaatataccaaaagccactggagtggacactttggggaattccttatggcatgtgaattatactcaattaaaaaattaaaaagagaaacacctatgagataggcattcttgttattcccattttacagatgagaaaaccaaggtacagagagattaagggtaaagagatgttcctctatatccacatcgatgttgaaagtagagagacaaagttagggggagagggttacgtgatttttcctgcactggctgctttaccggtcacagccatagggatctggatttgcaacccttgctcgggcaaatcatttactctctctgagcccgaggcaaaggccagacaggaatggcttttctcttaatcttgatccctctcgggtccccaaggaccctacaagtctggagcattacatggaagcattacttattcatatgtaagggtcagttctggccattaataaatgatgattttaacgactcacagtggtccactcccagggaaatgggaagaaaccattctgggttttctaggtccaagcccttcacatggctggctcagatgtcaaagcaagtggctcagtagcccatctcctcccaagtgtctggccaggagaagaaccccttactcaccaggcagaatatgacctcaccgggctaaaggatcccctcactcactagaagcccccatgggacaagaggacccctaccccacagagtgggaggacccccttatgaacacccccataatttggagcagcaggctctcactgagctactgggagctgcaaacgagcccctctaaaccaaggccctgtctctgagcacggaagggacctcaaggtgccctgcacctcattctcagatgcagggaccagcctgtgaatgaagtatcagaagccagacagtgagagggagaaacagagggagataggggcacagagaatgagactgagacagaaaaacagagagagggaaggcaaggggcggacagagagtcctgaaggaagctggaggcaaagctgggaagacagagctaaccaggacaatgaaaacaagagctctctctccactccagaaggaaagaggccaggaggcagagaggaggcccagcaggagcctttgcttggggtccttcccacactgcagggcagcaccagtactgcccaggagcccccatcagtgggtggtgggggtggcttcccagccaggctggagcctgccagggcagcctctgcagaggaggaggccggctggtcaggctgggggctgggccgggaagtgccaagcacccagccaggttgccatggccacggagacaaagagaggggctgaggagaggcccagggacagggtccctaagaggggccccggctgcctacagtcctcggggactgggccttggatgttggggagacagcagtgctatttaacatttattgagtgcttgctgggtaccagacagcagtcctatggggaagctgttttacagataaagaaactgaggcacagaagcgagccactgcagtatctcataggggtttttgtgactagcctatgagttgattaagtgaaactctttagtacagttcccaatgtattgaaaccctcacatgtcaactattattgcaaaatgtcaccaaaagtcaggtgacattgttaatgtaattctcttgcgtccttatcctcagtcactaacatgacacctgatgtgtcatgtatgtatttgatgaccggcttactgtctgcctcttaccagagggttagatccataaggacaggggctcgggtctgttccatcacccactaaacactcagctcagcccagaactgtacctggcagagctgggatgctggttctgccacgtatttgctgtgtgacccaagacaaatgactcaacccctctgagcctccatttccttatctgtggaatgggaatacaatgatgatgaccttgcccacatacagagaggctcaaagaaggatgctcctgcagcactgcttagtacagaccagtgactttcaaatgagggcaattttgcttgccccaaccccccacccctgaggacatatggcactgtctggagatatttttggttgtcacaactgaggaggagggtgcttttggctggtgggtagagccagggacgctcctaaacattctacaatgcacaggataggataatcccccacaacaaagccccaaatgtcactagagctgaggctgagaaatccagaagaaaaagaaaaaggcaggaaccaccaagatgcccatcaagaagggaatgaatgtataaactccagcagaatcgccctgcaaaatggtaggcagaagtcagaaggaagggcctgaaactgtgtaaaacaacataaaaagattatccagacatacacatcccatgagcaaagccagctcagaatgctaggtgatcctacgtttaccctcagggacccagaatttgaacccaggagctcagccccaagcctacagatttaaccacctgctccaccagcctctgctctgtatcttttaccaaaacaaatgcacgtgctcgaaagcatgctatgtcactgctgcaggttcacatcgatgtgtggcaatgacatgaacaaacacacagggaaagatctggaaagctgcacaccagcctattaacaagagcaactggggctggaggcaaccaggaacacgaaggggtaggttacctcatccacaatgcattaattttctacaagaagaatgcatttgtatttgtcatgttatgaaacattaatgaaaaattacaaatacatacactctttaacccagaaattccattcccagaaatgaataaacttacaggtatgaagtggcatgtgtctgtcccaccatgatttgtaatggcaaaagatgggcacaacctcagtgtccatcaacaggggactaatttaataataattaaaaaaaaaaaaaaagtacctccattcaacagaattctatacagctatcatttttgaaatgaggcaattccatgtgctatcatggaacaacctccatcatacaggcacaaagcaaaatgcagaaacgtgtactgtgggccccacttgtgtaacaaaaggggtacacccagactatctgaaggggcctgtatgacaccggggccagtggctgcctctggggagggaacttggaggctaacatttcattctatctcactgtatgctttttaatttgaaccatgaaaatgattacacatttatatatttatatatttatatgtgtacatatacatatatactgtatatataaatatccagttatatgtgtcgtacatcatatatggtatatataacatagatgtgatataaaatgtatataaaatagttttatatatgtatatgcgtaattatatatacatatatagttatatatacagttatatacacatataattatatacacatgtatagctgtaacattttaaattaatttaaaagacacaaaagatcatatactatataattccattttacataaagttcaaaaacaggcaaaactaatcttcgcagatacaaatcagaacagtggttacttttggggatactgactgggagaagacaccctctggggtgctggcaatatctgatctgagtgacagttattcagatatatcttattataagctcaccaagccgtttacttggtgtattgtacattttgcatacaagatatacctaaaataattaaaattttaaaattttaatggaagaaaaaggactgatcacggtggaaagcatttctggaaattctctaaattctatcatccccctttaccagagggagctctttgcttgggtccctgagaggtggccaagctagggtccagccccgcaccacaacttccccagaaaaaagccaaatgggaatcaagctggcctttgtggttgagtccagcagagcaggacaaagggccaaatgacggccccctgctccccccagaccccccccaggacactgaagcccattcatgttggaggctggccatttccccagggctccagccccctcctctcaggagctgggaacaatatccccttttaccacccctcttgtctctcacttccgcatttaattgcaagttcatgggtattaagtggcccatacagctgacccagctctctctcccctcccatccccccaaaaaagaggcccacagcgctgtctctgttcactgcccctgtgtgcccgctctttctcaatgatcttccccagagagaaagagaacgacacccccgtcggtccccgcttgtcaccttcctcaaacaaccctgttctcacccagaaagcacagtctggcaaagcgagctgctcgtggccctggcacagggcgccaggcctgcaatggcagctctgtcccgactttcccggccagcggcacatccactttgcaccccgctgtaaccccacctgatgcctgagaacactgaggcccaggagagtcgatgacaggcctgcagtcctgacagagccagtgctcagaccctcaagattcctcagcctggatctgtgactttccctaagctgccttcttgtccccattcaagggggtgcccaaagcctttgactcttaatctcttctctagctttgcaattccagggacgacgctgagctcatctgtaacctttaagggttgggaagaagtcacgtaagtcaatctcctgccttttgcatgaactcacttttgcccttgcccatggggttcctacctctggaatgtcctcaagtctgccgcatctatcctgaaagtctccacctcctccaggaagccttccaggttgtatgggtcaaggtctagtttcccctcctccactgaaaaactttatcacccacattcctccactaccaattcaagtccaacccagctctatctccatccacctcctggtccaagccaccaccatccctcactggacactgaggcagctacctaaccaatcttgctgctcctacggtccagcctccatacccacacctaagggtcctttttaaatcatccatcagaccactcttctgctctgcttaaagccctccccggcaggctgccacactgggaggaaatccctgctcctcacctcttcctggaaggccctgcatgctctgtcccattaccctcctcagccttccctccctccacaccagcaccagcctccccgctgcacttaaactctgacaagtcctttcccacctcccagcccatgcgcttgcaaactgaagtgtacctgtcaatcagctgggggccttgtcaaaagcagattctgctgcggtggatgtgaggtgagcccaagctcccacggtgatactgccaagtccctggagcacacgtggaggagctttggcatgcagtaggtgctcaacaaaattcatctcctggtgttatattcacctgactaaatttagaaggaactgtgtatctgaccctcctgctgggattaaattggaatcgcttcagatctatgcaagaccctgacttaaatctctaaatatgaattaaataacttttttctttttgagacagagtctcgctctgtcgcctaggctccagtgcaatggcgagatctcggctcactgaaacctccacctcccgagttcaagcaattctcctgaatagctgagattacaggcacgcgccaccacccacagctaatttttgtatttttagtagagacggggtttcaccacgttggccagactggtcttgaactcctgatcaagtgatccgcccacctcagcctcccagagtgctgaaattacaggcatgagccaccccacctggccctgaataaatagcattttaatttaaaatataacagctatcatttcttgagtgcccacacattttctttcatttaattctcaagactctcatatacacttggttgagggtggcaggagcttgctgcatggaagcccctcacagtccccaagtgagatccccactgcccaccacaaggacatgcagacaggcctggaagaggaaaacgttcgaaacatccctctaagcctgtgtccacccaagcacactgtcagtggcatcctaaaacgaagagcaactcctataaaccctgtggccctgccccgagcagcgcggtctatcaccctggagactgcatgtgctaaaagcgttagctggttcaaacttaagtatttcaaaagccaccctctggggccccagtcttatcctacatgcattttgttaataatacagccaaagactggaggggccttggcttcctgtgtaccccatgggtaagggttttccagccccattttagataggtggaaaatggggtacagagaggttgtcctgcaggcaagcgggcctctgtccccccacaacagggcagaggggccagctgggttgaaacccaagaagaaagtacccgtgttctcctgggtgagggggcaggggctgcgggcacaagggccctgcttatcagtggccaccagtacctctccctggctgggcacctccacccatccagataggatctcactctaatctgcctctgcgccaggggccagcagacccctgccataaagggggccttgggggactttgatgtggtagaggacagagccagcctgacttgtgggccagctgtggcggaggggagagcctaaggagcttcaaaacagtctcagcttctctcctgtccatgtgggactctggagaatttgaataaagctatttcaccaaactttacactcatttaaacttcactacaacccttaaggtagctactataatcaccccacgttttacaagtggaaaactgaggcacagagagcctaaatagcctgctcaaggtcacaccgctgggaagtggcagggctaattcaaatgcaggctgagctgacattaagggcctggatttattgataagccccttatcagtagggcgaccaacagccccagtttactgaggtctgaggggtttcctgagatgtgggacttttagttttaaaaccagaacagtcctaagcaaactggggcagttggtcactctatttaccacttgacttatcagtgagaataaagataataatagtaacagcgacagcagccaacaatccctgggcacttaggatgtgtgcccggcatcatgcaaaccccaaagcctcaccacacagtggtcctgtgaggtgggagcttttgttccctctctttccctccctcatgtcacagacgaggaaaccaaggaccagggaagctgcagaacttacctacgaggcgtaaaagggagtacagcctctcagatggcaaaagcagccagctatccatgtactgagcctctcgggcagggctaaaacaaggccccaagcaccatggtacatactgaacacgggcctttataatgagaccaatgcctttaacatacatgacacatgacctaaccactctggatgcaaatatctaattttttttttttgtagtgacaggatctcactatgttgcccaggctggtcttgaactcttaacctcaagcaatcctcccgccatggcctcccaaagtgcagggattacaggtgtgggccaccgcactcagcctgtggatgcaaataattatgggatttctaaagatatgttagcttaaaatctgccacttactagctgggtaacctttggagagttcctgcctatcaccaggataaaatggggataataagaatccttccctcacaggctgcagtgagtatcccacaagattgtgcagctgaagagcttaagacatggtctagctcgtgtgaagaaccagctactagtagcagtattcgtactggcattagtgtctatgccatcataggcagcgtggtcttttgtggaaaccatgcgagctgcgtaagcaccaaggaacatctcctctttcagcaactctccatgcctcatgcatcggtgacactgaaggtctaattctgagaagctggccagtcgggctctccctcttgctgagaaaatgagaccacaccaggcctgacaaccacacacctgcctgccctaagtcatcttgaagcaagcccagccccaccacgcagagacacccaaagagcttcctaaaaccatcctgcgacagagtcccttctggtcagagcaccatcctccagtaggtaagggccaaggcacagtttcacctccgtggatataggctttctgttgagaaaccagcctgcgtcctgcatccagtcgctcctctcctcccaccaccaccctgggccaggacacccacgtctctccccggggctgttgcagtcacctcctcactggtctccccacttatctttgtcccctgctatggtttagctatggcttatttgtccccaccaaaactcatgttgaaatctggtccccagtgaggcgatgttgagaggcagggtcgcatgggaggtgtttgagtcatggaggcggacccctcatgagtgggctggtgccatcctcacagtagtgagctctcactctggggagtctggattagttccccaagagtgggttgttataaagccaagacgccccttgggttttgtctcttcactcatgtctgctttctctctgaccttctctgccatgccatgatgcagcaggaaggtcttcatcagacaccatggccatgcccttgaacttcccagcctgtgcaactgtgagctaaataaatctcttttctttataaattacccagcttcaggcgttctgttataagcagcagaaaacaaactaagacaccctgcacacaccccatccccacccccgccaaaccatctactttcttcacggtagccaggtagccagaggggttcttttaaaaggtaagtcattcactgtcactgcctggcctaatgctcctacagcttctctacctcttacaataaaagcccaaccctttgccatggcctccaagaccctgcccaatgcagcccccacatggtgctcagatctcttctcccacccattctcccctcactcactctacccagccacaccagcctccttgatgatcctgaaattggccaagctcatccctgcctcggggcctttgcacaggctactcttcctgccttaattcccatggctggcttctcagtgtccaggtcccagctcaaaggccacctcatcagacaggcaggccttccctgatcatcagatccaaaacagcccccgactctaattcatatctctgtgttactgtctgcatagcacttgtcacttacaagatttttctcatttgttatttcttcattattcatctcccccatcccaaacatcagagatatgagagcagggattgtatctgttttgatcactgctgtttcccccatgcctggcacacagtaggaccttagtcagtatctgctgacagcatgaagacagcagaaaacaagattcctggagctctaagtatgcctgacatggtgtgggaatcccccattccctttgcaacaagggctctgagagaagccaggccgttctgcgagcttgtaacaggggccctggcccaagctggggagtgaggagcgggcaagccaaggggggctttcctgagaagacgccttagacccccaccacccagcgtgctccctggaccagtggcatcagcgtctcatctcctgggagcttgcttagaaatgcggcatctcaggccctactccagacctgctgatccaaaatctgcattggaactaggtttgcaggtagttcagaggtatagtcagatttgcgatatcctggtttaaacccccagataagtaggtaatagcaggcatggctggttcagggcatccctgggaaccaaaaggctcacggcaggcccacgaggccaatctcatgcaaaacatggcttcccagcagcacaggccagaccagaaaaagcactgaggcccatccagggaccccaagcatccttcctccctcagacccaaaataggatccaagaagctcagagccagcatatgcgggtgggggagggagaacagggagatgaacccaacagatttgcatggcagactccccgaaagccatgccatctggagcccctttgtgataaagggaaggggaacagagtgagagccaggagtattttcaaggagtggggtaagggggcaaaagaggtatgtacagggagagggagggccacctgtcaccaagaccagcagcaccccaattccacttcccaaccacctgcaacacacagggccacacacgccaaaaacagcttgtaatccacatagcatcaccccttctgcagcttcccgaggtctgatatcctggaagtcgtgccctgagtcctgctcttagtacatgtggttgtggggcagccggcacctcaccccatctacactgacgaacctgtgacccaggcgtgggcaatcagagctctggggccctctggatgggtgatacttggttcatggatgggtccatgacctcaaggtcaggccagggaacacctggatccaactgtgcctgaggccattactcctgagtcaagtaagcccagaaagtctttttttgtttgtctgtttgcttcagactcttcaagttagggtttctgtcacttacaacccaaacagtcctgagtgatacagctgttacagcacctatcatcctgtaatgtctcacttaggtgcccattttctcccctggactggagcccttgaggacacacaccattgtttgagtcatctgcgtttctgacgcccagaagaaggcctgggatataatataatcttcaggaaatacgtgacaacgactggatagctcgtccttctttcactctgcaaatatctactaagcacccactatgtgccaggcactgttctaggtgtggggacacaacagggaataaaagagacaaaaccccctgccctctgggagcttaaattctagcgaaggaagagcaggcaagaagcagaggagtcaatcaaatacaagtgccacggagaagagggagacagagggggagcatgggaggaggggtgactttcgatgggaggccagggaaggctgggctgagagggagaggcccaagacctgaagaggtcatgagtgcacaaatacctggagaatgttcccgaccaacaggacagcatgtgcaaaggccctgaggcaggagtgtgctgggcacttttggcgaaggagtcagaagaccacagactacagggcgttgggatttcctctgggtgaggtgggaggcagcgggggctcagataggacgaatgtgacctgatttacgcagggtacatgtggagaaccaggggcaagggtggaagcatgggacaagggaggagacgactgcaagagtcccagcaggagaccatggtggctgagacccggggctacccatgggaggtgagaagtggccggatcctggctgcttgtccaagttggagctgacaggatttcctgatgggttggatgtgggatgtaagaggaagagtggcgtcaagatggcccaaggaggtgccagagtgactggaaggagggggccgcaagaggagtggcggggaggaggcagcaagtttgtgatgcctgctgaatgccctcatggagatgtcgggtcatcatctagaggtcgggacagaggtcagggcaaggaatataaatttgagaaatgctggcagggcattttaaatgattgagcaagatgagctcaactacagaatgataatgaagtgacagaggaagagagggaagaaatggtccccatctccttaccaccgggctgccagtgcccaccagcctcctggctatgtgccggggagaagaaacggtgatagcagcaggacatcaactccttgttctagaacagcttgctatggacaatggagtttcacatccactgtttagcctgctccaaagaggtaggtagggcaggaattagcattccccaccccaactcatcacccagataagaaactgaggctcagtcagagaaggacaggcgggtgcaaggtgatccaggctaactcagctggctgagccacccggccaaggccaggctgcagacaccacgtgctctctgccaagtgcagctcttcaggagcagaaacagagagaccccctccaccctaccttctgcggctgccaaagacctgacacacggggaggggctgagaatatgtcttggcccgaagtgttgtggtgactggcagacaacaagtgctggcagcgaattagggagccaggaggggcagccagcaccacacacagggctgggtctccagggtcccctcagcaccgggggctcccttcttcctggacttacaggccagccccaagcccagaatcccacctcacccctctgtgccccccaacagccaccaactcttgagagagacaccagggatggggcatcctgctcccacctcagccacagggctcagcctcagggatcgagacccaggttcaaatcccagctccagtgccaactgacaatgagacttagaaccagctgtaacacctctccaagcttcaatgtccccacctgtaagacaggtggcaaatacagaaacacttccatcatcactgccgccaaagcagcgaacatgtgctgagctctcaggatgtgccagacactgctctagaccagggcttctcccgctcagtgccactgacaattggggccaggtaatactgtgtgataaggctgtgctaggcactgtaggacgttcagcagcatccctggactctacctgcttcatgacagtagcaggtagagtccagacatccttcctccccagttgtgacaaccaaaaatatctccagacattgccatatgtcccctttgggggaggggccaaactgcccttgtttgagaaccactgttctaagcccaccagaacatcagctccaggaggacaaagatctttgtccattcatcaaatctagggcctggatttgaacttaagggacctggttgcacaacttgctcagacacctgctatcctgattctcaaaggcctatgggagggtttatgtgacccaatattacatacaggtctgccccacagtaggtgtttctaaatggtcattttttgtttgttctaaactctagacttggttcattattattaataacagctaacataattaagcatttattatgtgccaggtaccaaatgaaacatcttttgcacaccatcactcatttcagaggtacaatgatcctagaaggaagggattactattactcccactttattaaggacaaaactaaggttcaaacatgttaaatgacttgccccaggtcacactcccagtaagaggaggagccgggactgaaagataacataccagcgcctctcagactttgggctttcagattggtaagttccctgacaagggagcaacaagcatttaatgagcactgactgtatgccaggcactgggctcagcatcagggataccaaggtcaagatggcccccaaacagctccaacagcaggcagaaggtgaagagggctcagtgccagtatggagggctggggctggggaaaaggaagtcagagatgcataagagtagcaggaatggcttctcagaagaggtatagggacagttcaaaggaatccgatatccattcatccatggaacagtcagagaacgcctcttcaaggtgacatctcaacagaacatagctgaagatggaggtgagccatgctgacatgagggaaaagacaactggcagggaactgtcttttttaaattattgttagtctatattaatttgaaaaatagtgtgttaattagaactagtgtagcaatgccaaaaaagtatacaaagataaagtgaaaattctttttctacactcccccccattctcagcctgaggctaccaaggctaacatctggtgcacatcctgcagtatctttctccacactcataaatacccattgagagagccttttttgtgtttttttttctctacaaaattggggtcctgctctacatttcactcagcaacttatccctccttaaaggtacagcacatacagcccctcatgtccatagagaccaacctcattctttccaacagctgtccgttaccccaacatgtggatcaacaaccatcctaatgagacttttctctgctaacggccactcacagagttgccaatttcttttgccattagaaacaaaactggaataaacatctttgtaacttacatctttacctactttttttttcttgtttctataggagaagttcctaaaggaactgaatcaaagggtatcgtgggtttttatttttaaagacactgccaatgtattttcccccaaggcagcaatcatgaacactcccaccagtgtcctctgggactgcttgcttgcctgcagccaggccagcgctgggcattatgcctcttgtgtacgtgtgacgacagtaagggatggaaggtgacgttgactgatagggtttctcagcggaaatgcagctccacacagttccaaaaaacactgccaattccagagcattctgggcccaaatgaggctagaggggtgtgggggagcaggctgtccactcagggggccctgagcaagatggggacaccttcctcccaagcccctccccatccttgcaagccgactcctgagcctgcaccatcctcatttctgaaatggatttcacacccaggagtaacaaagatggctttgtcagtaggaaaggggaggggggcactgttgtcggaacattctggatcctgttcattcaaagctctgtgtgtggggatggagagggcagagttggggaacaacggggtgcttcctgctctggggctgacctcaggcacaggcaccgtgggcagagctggagcggccccaaattccctgccatcccctcactggcacactccacaaacatttgctgagagcttaggctgtgccaggcactccgggagcactttacatttatcagctcatgcagttcatccccacagccccatcagcgaggtcacatcattaacaccactgtgcagatgagaaaatagagctccaagaaaagcagccaggactcgaggtcacacagctcgtgagcagcacaggaggacaaagcaggggcagtggactgccatctagccacctgcagaacaggctctcctgcccgggctgctgtggcagcctcctcctcagcctccaccccacctcctatcatctacccgcacaagtagccagagggatcctgcgaaaactgagtcagatctgcccctcctctgctgaaacactccaaggacaacaccacctcactcagcgacaccacctcactcagcgtagaaagcaaagcccttacaatggccctcaaggccctgtgcaatctgcccaccagcctccctactcctactgccacctctctgacttgacctcccattgctctgcccctggccattccggcctccgtgtggatcctaaaacaggctcctgcctcagggcctttgcacttgctgtttcccatgcttggaatgctctccccataaagacagaggcaaagtccttttcctgatgttacacccctagaaggggcagagcctggattcagggaagacaaaatgcacacagctgagtcttcaatagaagagaaagatgctgtgtgactctgggtaggtcagggaacctttctgagcctctgcttcctcatcgacacaataaacaggcaacgcaggaacaccttccccaccaggttcttggggggctatgttgcttggaaagtgtccactgggcacagttcctcacacatgtgggcaccagtgttataatgacatccacagggagagctggaatagtcaaggaaggcctcccaaggaggcaggataggagcaaggattctgaggtcagacatggaaaggccaagagccactgcaagcaggccatgggccaacggggctcccctgggacccaagacttgggggaaggcaaagccttccaatctgggatcgaggcaccagcacaggggagaagagatgctcccacctggcatccctccccatcttctggtcccagcaccctgggggcttccttctgggaaccactcctcccccactaccatgtggtagagctacatccctcacccaggaggcagctgccccagggaaacagagagaaattcccattcttactgaaggtggtttgagatgggttttctgtcacttgcaaccaaaggatcctgacaaccagccggctcttgccaatctcagcagtggtagcaatgccattgtctttattattgttcttgttatttcaaaatcttcaagatgagggagaaacgaggccaggggagaggccaccaataggctgcccaagagcaggaagacaccaaacctgaccgggatggtatcagggtcctgcaacctaagaagaggcccaggcagggaccctctaacgcccctggaggaacccactacttcctcccaggttctcccaaaggggcataagtgcaggaagtaggacggaccatgtgggaacctcctgtttaatagctgatgttgcagaaaagagaagggagccattgcccacaggccacaggaagtggaagtctgggaaacagattcgcaccctctaagagagacccaccttctccccttttcatctcaaagaacaagaaggaccactcacaaactggaaaacaagtctccaacttaaaacccctataggagctgggcaggtaacagggaatgctgtgcgcggctccttagtaaaagcaatgactattgtatccttttaacagagaagagtgtctttgcctagtaaacacacaggaatactcttctcttccaaagagaaacctgctaccttccactttccttaaaacacataaccctcttggtctttcagttttccatctgatacacgcaagggttagaagaaacattcctctgtcctcttaattctacaattaaaaaaaaaaaaccaggcctagtacagtggctcatgcctgtaatcccaacactttgggaggctgaggcaggagaatcgcttaagtccaggagttcaagaccagcctgggcaacatagtgagacccttatctctaaaaaaaattttttaattagctgggcatggtgacacacacctgtagttacagctactcaggaggctgaggtgggaaggtcaccccaggaggggttggaggctgcagtgagctatgatcacaccactgcactccagcctgggcagcaaggcaagatctcacctcaattaaaaaaaaaaaaaaaaaaaggcagggcacggtggctcactcttgtaatcccagcactttgggaggctgaagcaggtggatcatctcagatcaagagtttgagaccagcctggccaacatagcaaaaccccatctctattaaaaatacaaaaattagccaggcatggtggtgcacacctgtagtcccagctacttgggaggctgaggtagaagaatcacttgaacccgggaggcaggggctgcagtgagctgagatcgcaccactgcactccagcctgggcgacaagagccagactcctcctcaaaaaaaaaataataataataattaaaaaccagcagggcaagtgccataataaatggcaaccaatgtttggtctcagtgttaggaacatgttatggaggggtggagactgtggctaaatgaagactgaagccctgtgccctgcagaaggggcagctgctcttcaggtccagccaaaccaaacgttgcctgcagaagagcaagtgacacatcttctgattactaagaagccagaaataataggtttttgtatgaaatgtcttcatttttcattgctggcaagtaaataacaattttttttttattattattaaacatggggtttcactatgtttgccaggctggtcacgaactcccgacctcaggtgatccacccacctcagcctcccaaagtgctgggattacaggcctgagccactgtacccagcctaaacaaaaaattttaaaacaatcccgtgcaggctgacaaaacccacatatgagcctaacctggacttaggacccctgggtttggaaccagtggttctgatcataagtaaaaggaggggccctgctttcatcacatctgtggcctcagtagcttgtacaaggcctggcccacagcaagggtacgatcaatgacttctgaccagagttggatacacacacacacacacgtgtgcatgcaaactactgaccagacctggatacacacacacacgtgtgcatgcactctactgacaagacctggatacacacccccccacacacacacacacgtacgtgtgcatgcacactactgaccagacctggatacacacacacacgtgtgcatgcacactactgaccagacctggatacacacacacacccctcacactactgatcactgaagtcaaagaatctgaaagtgaagtttcctagagacaagggaatcccctaggacaaaacattcatccaactcatttggatacaacttaaacctccctctctgtcctccaaggagtcttagctgttggacaaaagcagactatcacggaataggagtcagaaaacctgggtttcggttccatctcaaccgcagacccacttgggatccccaggccaagtgactgaacagctcggtgcctcaatttccccttcctgaaaagcgagatgattggatgagatgatgtctcagtgtcttccagctccaacagccggtttccaggattctagtgctaataatttctttgggctaataaggaccaaagggtcctaaacccaggttttttcagccctcagttactaaattgacaaaagaaccggtagcaatcaacaaagatgcagatggactgtcattgtgaaaaactgaaaactacctaaatgccccaatataagaggaatgggtaaataatataagaggaatgggtaaataacataagaggaatgggtaaataatataagaggaatgggtaaataacataagaggaatgggtaaataacataagaggaatgggtaaataatataagaggaatgggtaaataatataagaggaatgggtaaataatgtaagaggaatgggtaaataatgtaagaggaatgggtaaaaaatataagaggaatgggtaaataatgtaagaggaatgggtaaataatataagaggaatgggtaaataataattttactagaatgctattattaaattatatattagtataataattcttataagtatagctaatatatatggaatgcttactatgtacctcgcattgttctgatagctttgcaggtcctaattcacctaattcccccctcaatctaagaagagggcactattttaggagatgaggaaaccgaggcacacacagatggagcagctgggccactgaccacacagcaggcaggcagtcaggatttgaactggacagtggccatgatccagcccccacatttcattacgaagccatgaaaggcttgctgatggagagcatttagcagtgacacgaggaagtatgcacaagcagtacctgctgtcgtgtaccaggctcagaccaaatgcaaggaacaaagaggaaatatacccaaagatgaaacagctatttggaagggtgagatctttttattcatctttatttcccaaattttctaaaatgagcgcagtaactgcaaacacagtcatacgtggtgggcgtcctagggagccggctccacacccagcactcacctactctactccacccccaacggcccagatgtcggcctgccctgcatcctgctgtatcccagcatctgggccaggcacacagtaggtgcttaacacaatgtgttggaacaagggaacaagtctatgaggtagggacagcgatttccccattttatagctgaagaaactgaggtccaagaatcagcttcccgaggtcacagagctggtcacagagcttggctctgggacaagcatgagcacatctcagtggagactctctactgaggacaatcaaaatcaccagagctggactgccaaatacaatgcgtgatccaggactagatcctggactgggggtggggatgggcgaggagatgggtatagggaacacttggggagaaatagtgaaatctgaatatagactgtgcattgtatcatttagtataaatgttgacttgcctgattttgttgttgaaggcactgtggttacacaagagaacgtctgtcttcctaagtgatgcatgccaaggtttgcaggggcatcctgtctgcaattactctcaaatagatcaaaataataataacgtgtgtgtgcatgatggagacagggaagaagaaaggaaagggagagggggagcgatcaaataaaaagttaccaaaaagttaactctgaaaagaacatattaaattgcccagaaatacaacatgtttggttttgtgcctagactgccatatgtgtgtagaaatgaataatatatgcagccaggtatacacacaaaatatcattttaccatactgggttccataagagcgcctgtagctgaacagacataagggaatgtgcttttgatactgacacctccactgtatttactacctttgtgttcaaggggaaataaatctttaaaaccacccaatcaacagcttggtgggccactggctggtggctgagaccacccagagctccctgacgtggcaaataaaactttccaatccctttgccctccccagtgtggtaagggcaggaggccaaggaacccaggctgcggctgcccctacacgtgggttcatgctcccaagacacagtcatggccaggaaggcctctgccacagagtgggccccattcagccccttttgctcatgcattcatttcttccacaaatgctaacacagtccccattaagtgctaatcaccagggacttggccatgaacacagcagacaagggctgtgacctcatgcaacttacattctaatgggagagacagatactaaacaaataaatcaacaagataattccaggcagtgacaggtcaagaagaaaatcagtgcagtggcgtagagaaagggactagaaggctctctgaggaagcggcacttgagctgagagctgaaagagaaaggggggtccttggtacaaatcagggttccaagagctccaggtaataggaagagcaaaggaaaaggcttagaggctggagccagttgaatacagtgcaagaatagaaagaaatgtggtggggcctggacagaatgaacaaggcggggagatgaggtctgcacagtgagctaaagctggatcacataataccttctaagccatcataaggagctgggattcgattaacctccatgttccacctccagcagagtgaggatgggggaggaagaggactccttgtgctgttaatgtccgtagcaaacaaaccagaatgaaatggcagggtgttggagctaaaccgaaccctgtcagtaattacattaaatatacataagctaaacagtctaattaaaaggttgcgactgtcagaatggatttagaaaagcaagacccaactatatgatgcctgtaggagatgcacttggaatataaagacacagaggcagaaacgaaaaaaatggaaaacagtaagcagaagaaaggcaacatggctatagcaatatcagacaaaataggcttcaagacaaggagcattatcagagataaaaaggagtatttcataatgataaaaggatcaattcaccaggaagacataatcataaatgtgtatttccagcaagagaactttaaaatgcaaaaagtaataactgacagaactcaaaggagaaaaacataaatctatagtcacagatggagacttccagagccttctctcaataactaccagaacaaggagaccaagcatctgtaaggatatacagatctgaacaacactaacaaccaccttgatccaaatgacatttgtagaacactgcacccaacgacagcagaagacacattcttttcaaatgtacatgaaatggtccctaaggtagactatctgctgggtcataaaccaagtctcaatttcaaaggattgaaaacccacagaatatgttctctgaacacaaattggaaatcactaaacaatgagttatctggaaaagccctaatatgtggagatcaatgcaatcagatgggcttcctcactccccaccccacactcagagtaaacagcacagacaacatctggcgtaaatgtcccctgggagaaagcagtcaggcatctgtcccgtggccaggtctaagcctacactcctaggtaacgggggtaccaggatggggtagatgctctggtttcaacttcaacaacccagttggcaaatcatttcaagagatgctggggcggccgggcacagtggctcattgcctgtaatctcagcactttgggagtcagccgagtgggcaaatcacctgaggtcaggggtttgagaccaccagcctggccaatgtggcgaaaccctgtctctactaaaattacaaaaatcagccagacgtgttggcacatgcctgtaatccccgctactcgggaggctgaggcaggagaatcgctcgaacctgggaagtggaggttgcagtgagccgagattgcaccattgcactccagccttggcaacagagtgagactctgtctcaaaaaaaaaagaaaaaaaggaaaaaaaaaaaaaaaaacagagagatgctgggggtctgtgtactgtgttggagagaccaggtcttaccagcgaggaaaccacacctcataatacagcccacctgccccgtctcgctcagaatgagccagaatgaggccaacagccaatcagttcaccttactcagggttcactctgggcagggccagagagggagtaaataaagtaaagcacagtggtcacaaatatgggctctggagtagaataatcctgagttcaaacccaccactgaccattgttggtgggcagaaccctgagatggccccaggatcactgccccctgtgtccacgccctggaggatcctttcccatttcatgtaagtgggactgtcattgtgactggtaaatgacagaggcgaagggattttgcagatataatcagggtccaaaatcagctgactgagtgagcctgacctaatcaggtaaagccttaaaagacgcctgcgggggataaagcagggagaagagtacaagtacacttctaggcccttcctaaaggaagagattcaaagcaagtgattcacctgctggccgtgatgtggctatgttgtggcaggaccacacccctaagactcaaggcacctctaggaagtgagggtgatcaccagccaataccctgcaaaaaatggggaccccggctccacaatgcacgcaactaaattctgccaacaaccctatgcagatccctcccatgccccacaccctcctcgctccaagcatcagatgagatcacagcccgggtcaacaccctgatggcagcctcatgagaccttcagtagaaaacccagttacattgcacccagacttctggcccacagaaacttcgaggtaattaacaggcgttattttaagccactaaatgtgtggtaacttgtttggcagcaacagataactaatacgccatctctgtgtgatcctaggcaagtgacctcaccctctctgggcctcagtttcctcatctgcaaaactgcaaggctgtaaatgaaacaggatgtgtaacagcctcacccagaaagtgggaagcagcgtgttctgtgccctttcaggttcatggagggatttcacagcagggcaatgggaggtgctgtcatgtatttttgagacaccaatctgttttttcaatcttcggagggattgcttggagaagagagtgaacagcaacttctagctccaacttacagccatcccagttactcccaactgccttcagagtgcacagaccaatgtccagggcaagggaccacttggtcaaaataaattcagtcacttatttcaagtcccaggaaggatctcaggcagtgtgttcaagatgatatgctgtaactgttcctctgcaaaaagtagggaaatactaagattctaaaacagaatgtttaaaaataacctcactaattactggggcctgctcaggtgccaggcagtgagccaagtgtctcaacatattttatagatgaggaaaccaaggttcagagagggaaagcttcttgcccaaggtcacacagctgctgaggcgcagagataagattcagacccagacaatctggctaggcccctggcacttgagcacaatgccacactgtaaaaaattctcctgtgcaaaatcccccagctcacatacccacatagtcaaaagacaccagaccatcttagtccccagaagtctgcacaaaaatgcttagcaattatataattcaaaacaatcacatcatgtaataaaacataggcacatatagaagcaatttttttcattcaaaaaatacttaatgagcatctactatgtagcaggcattgttggtgctggagatcaaaatctctattctcttggcatgcctgtgacattccagcgagggaggcagacaataagtaataaataagtaaaatgtccagtgtgttagctagtgggaaaaaaacaacgcaagcaaaggaagaaatggtgaggtggggatgtgcggtgtcagaaaagacccagtcaagaacatgattttgagcaaaggcctgaaggaggtggagggctgagccacggggacactgggaggtgggagggagcgcattccagacagcacaggtgcaagggccctgaggcaggtgcgtgcttggtgcatttgagaaaaggcaaatgcgcttggaggaagtgggcgagggggtaagagctacccagaagattctggaactggataatggggatgactgcataacttggtgaatatactcaaaaccaccgaatcgtacagtttgaaagggtgaggtttatgatttgtgaattcacatctcagtttttaaaactttatggggaaaaaggagtaatgaaagaggagctgagagagccaagaggggcaggtcttgtgcgacattccaggccagactaaggactgcttttatgctaagtgagatgtaactgtaactgattagggtctcactggatccctctgactgcgtaaggagaacagaatgcgggaggccagggcgagatcaaaagagtcaactgcaacggccctggccattcccggctgcgcgtcctcaggtacgccacttcccctctctgcagctattttcctcatgcaggaagtgggcctgaaaaatccatcccccacagggcagaggtgagagctaatagacagtaaagtgctgttatgatgcctatgcatggagggtggagtaccgatcccgccaaacagtttttaattatgcaaatgagtttcctgaacagaaaacaaggggcaccttcctttgtctcaggaagcagaggttcatctcgcatcaacagccctcccagcccagaggcagctgccttcacagctcatccacattctggccacagatgggggcccaaactcctctttgggtgtggttgggtccactggcctcctccaggaagcctgccctggttacttggtaacccagtacccacaggaaagctgaaacccaaagagaggacagaaccagccgtaggtcacagagcagcctgggagcaggcaggggatctgctgtgggaggggacggtacacccattcctctctgagaccttagtaagaccattgcacagtcttggtttccacgtcaccaactgacccatgccatatccaactgaaagcactctggtggctcctcacaccaccagaaataaaacccaaactgctcaccatgcatctgaggcccatgcgacctggaccccaccaacatgccaatctcatctcccttactctcccctccagccaccctggcctcttactgttcctcaaacaagcctggcacagtcctgcctcagggcctttgcatctgctgctcccactgcctggaacacacttttctccactctttccaccagggctccttctcctccttcaggacttggtcaaatgtcatctccctagaaaagccttccttgcccatcccatctaaagtagatgcgaccatccctgtcacaaacatcacctcattttatttccttctgtctgaatccactccccagctgtgtggacttcagcaagttactcagcctctcccggctttagtttccccatctgcaaaataggtataatgatgatattgacctcagggagttgctgcaagggctcaagaagcatgtggcacagtacctggaacagagcaaggcctcagtgggtgtccttattatgacaactctggtccttttctcaagggatttctttttgcggtgtctgaagattccctgagggcagagaccttgtctgtcttgttccagccacatgccagcacctagcacagtgcctggcacacagtgggtgctgaatggccatttattgaatgaataagtcgattagtggatgaaagcatcaactgcccacaccctgaccccggcctcgctcctcctgagagatgcacagaagccacccaccctcccagcaaggggggaagcacaagaccctgggtcctgacggccaatggccacctgcctgcaccagctttcagtggccccagtcccgccagcctgaaatagtctcgcctcccctggcccagaatcaagggatcgtctgtcagttccatcctggggaaggaatcaggcgggtaaacacagattgagtgtctgaccacaagacaaaagaagagcagacagattcccttctggtcctcaaggagccaagaaaataaaaataagctcaaaaatctacacagggctggaaggctggagggctctgcttcttccttgggacttcctccgggaggaggggtgagcccgcacacagtcactgtactccccagagtaaccctaggagtgctggggtcatccccattttgcagatggggaaaccaggactcagagaggcaaagcaacatccccaaggtcacacaggggaagagctgggatctgaacccaggcaaggtggctcgagagtctgtgctctaaaccatgaaccgcaagagagggagcctcccagacactctgctgggtgaaaagggcaaaccgtattatgctacttacataaacacatcaatctcacgtatttccacacaggcatgctaatgcccccacacgatctgagagcacaggtggtagtcaaaggagcttttagcccagtggttctcaactgggggctatttttcacacccaaccacctctagtggatacctggaatatctggagacatctgtggttgtcacaactggggaagaggggtcctactggcatctggtaggtagaggccagcgatgctgctaaacatcttacaatgcacaggacagcacccccacagcaaagaatggtccagccccgtatgtcgacagtgctgaaggctgagagactagtgggatttgctccagaccaacgctagggccagaaatgaccccgtgaaacctcttcaagagggacttttggccgggcatggtggctcacgcctataatcccagcactgtgggaggccaaggcgggcagaacacttgaggtcaggagttcaataccagcctggtcaacatggtgaaaccctgtctctactaaaaaaatacaaaaagtagccgggcatggtggcacgtgcctgtagtcccagctattcgggaggatgaggcaagagaatcgcttgaacccgggaggcagaggttgaagtgagccaagatcacgccactgcactccagactgggcgacagtacaagactccatcttaaaaaaaaacggggggatttttgatcctggctaaaacacagatccccagaaaaggatgtgggccaccaagctctcttcccaggtatctggggatggaactctaacaaactgagtggctactgcccttaactggtgctcacctcccctctggggacgcaatttatgtcacctgcaaaacaaggagattcagaccgaatgacccacctggcttctgttcaagatctccgaaacgcagggcaggaatcagctccgacctggccccatgtctggggaatgatgctgtgggacacagcacacaggtttgaggggcagcccaccctatcacccacctccctccagtattctagccagcatgcctgtgtctgttggaaaaaaagaaaagccccaaaaatctggagaggtcaggttctcctgcagccaggcatgacctgcttcaaacacttaaactcttgcaaaacctttaagggagagcggctgtgaagcaaataggatgtgggtttctttattaaagggagtggccccaagcccaacaggtcttcagctctctggcctgataaaggagtatctttctctccaagaaaggggtgccctgaagtctcaaaagccagagacaccaaccccattcgcgtcttcttaaagtgacagttaaattgctaccagggcaaacaccagaataaaagtaggtaggcttccagaaggtttgtctgaagaatgagttgtagaatccccacagggttgtccttcttataaggacaacgacctgttgatgacttcattctcgtggcccagaacactgcccaggatatacagcagatgctccataaatacctgcacacagagaaaagcagtctcatatcttcatggttttatctgtacagagctctctgtctgccatacattaaaaaaaatgtaacccatctaaatcctgctgacactcagtttttaccatcaaaagattttcactgacttcctgatgatgatgagcccaacacaaggtggcctgttccaggctctccggcatctgaaaactgaaataaggtggactttttgacttaattcttgcccacctgggcagcccagaggtctcacaggggcagtaattttgctcatgaacacagcctcattttggtgcaattcaggatagtggtgaagaatgtgggccatgcagccgcattacctgggtccaagtgccagttctgtcaggctgtgtgaccttgggaaactgacttggcctctctgtgtctttgtttcatttgtaaaacaggaagcataagaatacctgcaacttttgagttaatgcttaaggaacttataaacagggcttgcaagtatataaatattagcaaattgttaccattattactgttgcattaatctaataaccatgttgaaaatacaattcttcctgtcggcttcttaaaaaatatattcgcatacatatgcataattttatatgaaaagggtattataaacaggattttacttccttatcttcctggttgcctttctgtaaaagatacacatccttccatccttttctccaacctaatgtcaccttatacatataacacacgtgtatattatggttattgtttattttccaaaagaactgtgttacatatacctctcagcatcctacttttcatatgaggaccacgtgaaaatccccccaagttactggggaggtccctctgcctcaatgactgtgaaatcaaagacctgcccccaccccaaccacccgtggcatttctccctagtgtgagactaggagtacagaatcttttaaaacagaaaaaaaaatagtgacaacaaaaaaccacagtttcttgtttggcaagcggagctccaatgagaagaaaaacttttgtctcctccctccaaaaagcagaaccacagaaagcattctgggagctttctgcccacaatccctgttcctcagagactcccatcctggtcggttccgggcagaccctctgtgtctctatagctctctgtcctcagccacggggagaccttcgaggagctgctgaccaactcccacccaccggcctctctgcccacccacccaggccctctcttctctttcgaccactgcccagctgacacaccccatcatgggagttactggcacctgcccctgaggtgcctccccttggcaggtgggcccaaggtctactcagcctcctctaggggagtggggggcaagcttcaccacatccctgtgacgcaggtgctacactgtgcccgttggacagatgtggaaactgaggcacagagcaagtcagtgatcagcccaaggtcacctacagtccaagtggaagaagcctggatttgaacaccagcagcatgactccagagcctcactcaaccctcgtgccatgaacagacccggagcccagagcaagaactcggcagcctgccatttctatccgtccacagttcttcccattctgtggagaaaagaatgggagtcacagagggcaagtaacaggaggaagcgcaggcggaggtgaaacatcacacagacctgggttcaaatcccagttctgccaccttaataaatcatgtgccaagcccttcttggatcagccaaaggcggtctatcaagtggctggggacatgagttgtggggtcaggcagcctaggatcaaatcctggcaatgctgtccacctgacccagagcagctcacttagattcactttgcctcagtttcctcacctctcaatggggataaaaacagcatccccttcataaagaaaattaaatgagttgacacatgcaaagtgcttagaatggcaagtgatgaatcaaagtcagttcctgcacagcaatgactgtcattgttttcatcatgactaacgctgcccagagcacacggggagtaccccacatagccagggcctcgaaatgattcgagccaaggttctgagtcaaaaccccaggcactgtttcccccaagaccgatccagcatctctgtgaaagggctgtccttgccttttcatgattatttaataaacacacgcaaaacaccaaactcagaggactccctggagatgagggagggagtgcaacccagttcctgaaggagatggggaaagatgggaagattctcaaggaaccacaaagccctcggcctggaaccaaacaaaaccactggttcctgtggccggagtttagggtgtcaaaaggaaactcactcagagcccccatcctcctctcagtgctgacttaactcagacctcacttcctccaggaagccctctctgatcacccctgctctctggatgctgaagtcccacaaccctaattatctgtattatttaattttcctacaacaacaataataaccaatatttatataccttactgccagacactgttctaagtgctttacatcaatttctataactcacttatcttctttaaaaacctataaaataggacctattaacatccctctttttacaaataaggctcaaacaggttaaggtgtttgcccaaggtcacaagtccaaggatttaacctcaagcagtctggctccagagccttgcacttggattgttttttttaaacacccatttggccatcctccactacaccgtcctctccttgaggacagaagccacacatggcccctatcacgggggttactttccacggtttccatgggccgatgggaccttcacaccaaggacacacggagaccagggtggtcctttaaggcctgcctctaaccacatggaaataaaagcagggagggattaccgtgcattcttccaagccaggagacagcagggaaaatcccttagcaaatataaaggctgagaagagagagtgggaagacagaagagaatcacaacctgaggctgccagccttgcaaccatggaaagccttggtaattagcagttcctgaagctctaagccccaggttagttttgaaaacgaaaatgccttgggatgtttaggggccattcctgacgggccaagatgagagaggactcctgtggctcacaaacaacgtatggctggtcaggttacacaatccgtctgtttctggcaccagcttggggacacacaaaaggcccaggcagaaaggaagcccggattccccgctccttgtttcacaggtggggaaactgaggtcaggacacgtagcatgattggtccaagacacatgtccaagtcagaaccaattcatctcagaactgacacatcagatacaaaaagaaaaatgtgatgaagtcagcaaatgtaaagtgttaaggagataatgtgaaagtagagaaatctttttttttcctgtttcttgaataataagaatggttggctccaatcaatttccattattccagcttcctcctactctacacgtggacgatttaaaaccacagttaactcaaacacaatctagatctgttctaaaatgaaacacaccatctagggcaggggcgtgggagggagaggtatattttctttcccattaatatcaaaattggtttgtatttcctgtttctcttccaagcagaggagcatggagtggctcagaaggagaagtcaggagttccctagaatttgacattgctcagagacaccagggttgtctacatgtttaattcaaaaactgccagcttctaacagaacaaattcttcccccaccccccacccccgaaactgtgagagaagaagggatgggaaagaaagccaatcctgccttattcttacaggccttcctagaagggtcctttagccaaatggttttcaatgcttctgcacaaccccctctcccacatccccctgcccccagtacatctcctttcacaggcagaagggctctagtctaaggctgtctcctccctgagctggaactctgatctcacacagcctcagctgcacccctaagccatgaggagccccagaggaccccagagtctccctctttctcccaaagactaggagctacaaagcctggctctagggtctttgaaagagccacccccacaccagcccttcctgaaccaggattaaaagacttcctagagcagagaaggggagtaaatgaggccccagcaggaggcatggagattaaagactttagagtctcctaacttccatccaaggctctgccccgtcccaccccctccacccgctggccacttttctcacttcctaggagagtagggaagtggccccttcctccctctcacagaaaaaaagcaaaagaaaaatgcagcatagaataggggtttagaacaccagctgggatagtcccggttcaaagcccagtacccccacttaatcagctgtgcgatcccagacaagctacccggcccctctggagctaaactttcccaatcttaaaaacggaggaggcaggacccagtagctcacgcctgtaatccctgcactttggaggccgaggtcggcggatcacttgaggccaggagtccaagaccagcatggccaacatggtgaaatcccctctctgataaaaatacaaaaattagtcggccgtggtggctggcgcgtgcctgtaatcccagctactcgggaggctgaggcaagagaattgcttgaacccgggaggcggaggttgcagtgaaccgagattgcgccactgtactccagcctgggtgactgagggagactccgtctcaaaaaaaaatttttttaattaaaaatgggggaaatactcgtccctacttcatagaccgcctgtgaaggttaaacctgctaattaatgacacatgtaaggtgtctggcacatagtaagtggtcggttgttattttacaaagtctgaggccgtggttttgcacttggagatggggagttggtgggggtggatgcagttagggagcctggactgccgagttttgagttcgaaacccactctccccgaactccagcaaaaacctgtgcatgggggattctaccctggggttctgtcaatccccgcccctcctctgagcttcaggttttatcctactccatcaacgcgcagggacgttgggctctggggctcctacggtatgtcctagatgagtggtgcaccgggcgcgtagttattcctgggaaaaagacgcaggagcgccagctcccggcgccgccggggtccccaagcccctgcatcgcggatgtaactaattttaaaactatttgaaaggcggggacggggaagaaaagacaaaagggcagcgcgcgccgcggggaagtggagtgcgggagagccccggtcggagcaggaccgtgcgccggccagggagggaggcgacgcgacagctctggaggagctcggatcccccccgctttccgcgcgccctgcggggcgcccccgaggcaattctccacccacggggaccacggccacaggttgtggggaccgcagcggggcgagcggctggagggaaagctgtccccaagctcccgagcgacactcaccgactgcaagaagcgcaaggtgcccacgtagtccctctcggtgcccaagatctcgttgaggacgcagaggcggaggcgcagctggcgctcggactcccgggcggccgcgcacgggccggggccggagctgggcgccgcggcgccaggggcccgggggtccgggtgggcgcagtccccggccccgtcgccgccgggctcgctgccgctgggcgcctccattctagcgcggccgcgcggcgccggctccttccgtcgcgccgagcggcaactcaggcgtccaggcgccccatcccggacggggcgcgccggcgggccgggctcagcggcgggccgggctcccggcgcggcgggcgggactgggggccgggcggctgggccgggggcggaggcagcgcgcgggggccgggcgaggggcgggagggggcggccctcggggctcccagacggctggccccccgcccccgcgccagggaccgtctgccaagtgccacgccgcgctcggccgcagaggcgctctgcgcgtgcacggggcccctggggacgcggcgcggcgctcggcgcctccgtcggaagctcgggggtcgggcgggagcctccggaagggccccgcggagccgggagtccgaggccgcgcgcacgccgaaccgagcgtaccaactccgcgcccggacgcgtggcgcccccccaacccgcagtcaccgcgggctacgccactcccacccggcacacgcgacacccgccgcgcgcaggctcctgcttgcaggtccggccgctgctcgggccaagtaaacaccgggctgggaaagctcgctgcggagccgctcgggggcaagccagccccgccacgcgcgcctccgcggccccgggaagtcaggggcgaccgctgcctgggcagtgacggcccctctctgggcagtgacggcccctcccgggaacgccgggccctcgcggtgccctcggtgctaccacgaccttgggaaggaacatgcgtggcgcgcgctcgctctcacttttctctttcccgtttcctttcccatctctctctttccttccttccttttctttctgaacttctttgccccctgaccctgccctttccacctttcccagaagaaattattacctgctcttgagttattgatcaagtggcaggtaccctgcctgctcccccttccatccacccaccccatgggataaggccttgggaaacccagcttcttgtcaggttgctctgggcaatgttgatcatcacccgccttatcggaaggtatggagaggggaggaagttctggggcctagagtcagctgctcaggttcaaatcctagctccccacttgctggccgggtggccttgggctggtttccttgcttcaagatcctcagtgttttcatcagtataacgggaacgatcatggtacctagctccaaggtcctccccggggttccatgggaagtacttagcacctagaaagttctctgtaaatgtttgttcttactattattgcatgtgtgaagcccaacacctagaaagttctctgtaaatgtttgttcttactattattgcatgtgtgaacggccctctaagcctggccccactctcaaatggcccatacaatccctaatcacccgtgtttccggaccagagattgtatcgtctctgcaggggataaagtgatccacatagtatccgcctctagactgtagtcattttatggacagaaacattgcttatttattcctgttccaaaagcctaggattttcctcccattggcctctcaatactgtaagtgcctaaggacacagggagagaatggggtggcttctgccctctctgacttctttctttgggatcatgggcaaggtagcatttgatctgggccttgggctgagtgaagttcccctgggcagggagtaaaggacatgagataggtgagcctgtcacgcttgggtagtggagtcaattgtgtccaaaggtagctggttttttatttatatttttattcctaataaaggcctctggagtatctctgctttgtgactttaaactgttcacggtacctttctgagcctccgtttcctcatctttaaattaattctgtctaccacgaggggagaacatggctggaacataatggaccatggaatgaagcgggcttgcatttgtatcccagtccaaatccaactggcagggtaaccttggccaagacacgttatttctctgggcctcagtcgtctaatctgtaaaaggggagtctttgtgagagcgaattctatgcaatacagactttctcaaccttgggactattgacatttggagtcacataactctttgttgggggaggggcgtgtcctgtgcatttcaggacatttagccgcgtcccctacccactagatgccagtagcactccctccccaatctgagaatcaaaaatgtctccaggctgggcacagtggctccggcctctaatcccagaattttaggaggtccaagtgggaggattgtttgatcccagaagttcaagaccagcctgggcaacatagcaagaccctgtctctacaaaaaaattttaaaaattagctgggcatggtggcacacacctgtagtaccagctgctgggctgaggtggggagcttgcttgagcccaggaggtcagggctgcaagtaagctgtgatcacaccactgcactccaacctggacaacagagtaagccttgcctcaaaaataaacagaaaaagtgtctccagacattgccagatatccctggggacagaattgccccctgttgagaaccactgatgtaaagtacctgacacacatagctggcacagagtaggtgctcaacaaatgttagttcccttctcagcccatgaccaaggaaggttagcctcaagtttacacacaaatcccacatttcacccaagaattggcccacactgccaaaaaacatttccacgttgtggatgggtcccatctctggcccaccccaatgttttatacatcgttacttcctcagattctgctgggatctttttccccttccatccccatccccagtggtaatgatgacactaaaagataatacagcgtttagtaacatacttaagctctctgtgccttgctttcctcatctgtgaactaagaataatatcagtacctacatcataaagtcgttgcaaggttcctgagtgcatacatggagggtgcttagagcacacagtaggtgctcaataagtgaagtcttttacaatgcgtggattgagtgctgaatctaataggatgcatttggctgcaaggagaagaaaactgggctattgatagcttaaagcataaggacattatttagcaagaggtccagaggcagttggttcctgaggctggtgtaggacttcatgatgtcatcaaggatcatggcacctttgaccctcctatcctcagcatggtggcttttcctcccaagctttagggcctcagaggcacaaaatggctgctgaaacagcaacattgcctcctcacacacctccaatgaaggaaagaaaagtacgaagaagactctgtctcctctgtgcttctctctttgggggaataaacttaagctcccagcaggtcagcactagaagccatggtcacccttgaaaagtccctgaccgagggcatagattgccaccatcaacttagaaaagacctgcttagtcccctggcacaaggctgcccagacaacttggagatctgttgtcaagagagaagaggagctagcatggtgggcatctataagtgtcggccacaagcatctactacacactgggcattgggcggggtcctgaggctgcagcactgagcaccccaacagctgaggcccttgtgctgccggcattattccagcaagggggataggtgaggatgaagacaagttcctcctctcatgcattcaactattatatactgagggcctcctatgctccaggcagggatacagcagtgaacagaacagataaggtccctggcttcctggtgtgtccagtcaagagcagggagagaaggacaataaataaacaaggtcctttcagcttctctaaggcctgcaagggatgggcctggggaagcaccattggttggtggcacctccaggactctgcctcaggtcactaccccagtgtcatgattcagccatcaggattcagccaggggcctcagccttggcgggatcagtggggactccctctcttcaaaacctggctgcctcccagctaatcctggcataggcaactccctaaaccaaacatgactaagcagtcaggctggagtagatctcttcctatccccatttcaactttgacctctattcccttcttccccatcacccgtccggaatatctagtggggagcctatctgtctcatgtgtatgtcagggcagggcctgaaacagccggcagctgggtaacgttctcaaaaagaacagggaggaagaagaaaaaaaaaaaattgcagttcagggggaagaaaaaaaaagtgatgataatgatagggaaattctcttttgcagggacaattttagagtttccgttgccatgtactttgcaaatagtgggaaataccatttcgtttctgttacataagtttcacagttgagggggagaagattctgctgcttggaaacatcagagtttcttattccctgacaagcccctgtcagcttctgcaggctgaggatttgaaggcccccttcccaagctctgtttaaaaggaaaactaattaagttaaagcaaggaaaaacaagtgattttctttcccatcccaagttgaatgagccaattgagaagtgagttactgcactgcccgagggtgccatcatttcccaaatgcaaatgagttctcaaaagtcagaccagcagcccagagcagggctgttcctcattctgagaaccaagagcagctgtctgagaagaagagggaggcctctccacccttggaattagagcagctggacaactcaaatcaacgctggacacacagcccagggttcacttcttcccaccaaaatataatcgtcttcctagtagttgagctacccccagctgcccaagtcaaaacgtctctaagggaagccttgctgttggaagcacattctccagggggctctggttcaaggtctgatttaagcataataggtatccaattaagtcagggctccacagctttgccaaatcatacttttgccaggaggcattggagacactgctttgaggaagcagaaaggaaaacatctaggaccctcagttccaatcccactctgccaccaacatgcacgacttcttctccagcctttggacattgttgtagcaccagagaccagcttctcagcttcaaatcccagtcccactgcttcctaattgtgtcactttgtgtaagtgacttaacctctctgggcttcaatatccatatctgtaaaatggggtcagtaagagcttctacctcacagcgttgttgtgcaggttaaaatatttaatagatccaaagtgcatagtatgctgcccgatccttggatgggtgtttgctattgtaagtggatgaagccatgatgtctggagctatgacagccatcttgagaccctgagataggacacttctaactaactgaaggtgcaaaatgacagatggaaagaatctggatctttgatgtcactgagatcctgaattaaccaaccatggaaccaccctgcctctagacttcttgtattaaaagataataaaatgtataacatcccattttggaccttatggtcaccctatcttttctttcttttttttttttttttgagatggagtctcattctgttgcccagagtggaatgcaatgccgcgatctcggctcactgcaacctcagcctcctgggttcaagtgattctcctgcctcagcctcccaagtatctgggattacaggtgcccgccaccacgcccagctaatttttgtgtttttagtagagacaagatttcaccatgttggccaggctggtctcaaactcctgatctcaggtgatccatccgcctcgacctcccaaaatgctgggattacaggcatgagcacggcgcctggccgaccctatcctttcaaataagcattgacctgacttcttgctacttttaaaatgcaaatgccagccgggcgcggtggctcacacctgtaatcccagcactttgggaggccgagacgggcggatagcgaggtgaggaaattgagaccatcctggctaacacggtgaaaccccatctttactaaaaatacaaaatattagccggtcctggtggcgagcacctgtagtcccagctactcagaagctgaggcggagaatggcgtgaacccgggaggcggagattgcagtgagccagtgagccgagatagcgccactgcattccagcctgggcgacagagcgagactcagtctcaaaaaaaaaaaaaatgcaaatgcctcagaagggtgctggtcttcaccctattgctttcctaatggagcagagacctaaggtttataacgtgaaggctggattgggagtaaaagttgagaaaagggttcagaaagagactgatacatagaaggtaaattctgcaatttcgtcaaggccagagatcgacctggaggaaatatcttgaaattttgcagccaggaatgccagatggtttcaacagacatactggacacacatttatatgtctgggttattttttttttcccagaactgaaagctcaaaaataaagctgcccagtccaaatccagacacctggcaaccccagtggtaacttttactgaaagctgatggtttcctctgtagccggcagaaacacaaacagccacaccctctccaaatgccatttaagccgcagcctgccttccaaatttccagggcaaattccattcctgagccttttttttttgagatagggtctcactcttgtcacccaggctagagtgcagtggcacaatcacagctcactgcagcctcaaccttccaggctcaaacactcctcccatctccacctcctaagtagctgggaccccaggcatatgccaccagaactggctaattttattttttttgtagagatggggatcccactatgttgcccaggctggtcttgaactcctggcctcaagcagtcctcccacctcagcctcccaaagtgctgggattacaggtgtgaggcaccacacccattttttgagtgctcactctgtgcaaggcactgttggattacaggcacctgccaccacgcccaggtaatttttgtctttttagtagagatggggtttcaccatgttggccaggctggtctcgaactcctgacctcagctgacaccagcctcagcctcccaaagtgctgggattacaggtgtgagccactgtgcctggccctgagctggaagttttatacatcacttctgctcccaccctactggccagatcttgccacccagatggctctgtgattctttgccaagccatgccaagccactgcccaggtgttgcaggtgggctgtgggaatcttgtttccttgcgctgaaacagcaccaggcatgtgtaaataatcattgaatgaatcaatatctccagtatatgttttggactccaggttgagagaaacctcaccgtgaatgcctgggactgttctaggtactgggactagaatagtgaataaagcaaaactctgtgtcctcctgttgcttacgttctagggacagaagagacaataaataaagacccccaataagttgacagagtcagccagatcatggtaagagttacggagaaaaacaaaatggattaaacaacagggagcactggggccagcacatgcctggaggggatgagagaaggcctccctgagaaggtgacatttaagcaaagaactgaaagaagtgagggagtgggccccacctgtgttccgggcagcaggaacagcaggtgcaaaggcttggaggtaggagtgtgtccacttgttcaaggaacagcaagggggaagggtagttgagatgcatctagaaaggagaggaaaaccagatgtatgagccatatagttgaccataggactttggctttttctttggatgaactgggagctaaacagaggagagctatgacctaacttaggttctaatagaatccctctgacagctctatgggaagtaaactaagagcagggtgaggtcagaagcagtaagacctatgaggaggatactgcactagtccaggcaagagacattgatgacttgggccagggtgataccagaggagatggagagaaacagttgattctggatatgctctaaagatggagccagcaggatttgcagaggatctaggggtgaaatagagtgaaatagagttaaacacgactcgactctattagtggctcacgcctataatctatgatttttggagttggcattaaccacgatgggaaagatggcaggggtcggtggggtgctgctttggtggagaagatggagcgtttggttttggccatgttcaatgtcaaattaaatacccaagtcagatgttgagtgggcagtcacatccacaatcctgaggttccagggagaggtcaggctggagatagaaatgtagccattgtcaggatataagtgatagttaaagccttggggctgggcgagatcacccagggagggtatgtggatggagaccaggacaaggacagaggtctgggtcacaccagcattcagaatgaggcagccagtgaatggaggctggaacaggggtgagggacagttccaattgtccacaggtgttccctgactcctttaagactagacatagcaatggactctcctgtgatctcattttccctcgtgaaatagacagagggcaaagtctggagtgcagtggcacaaccatggctctgtcatctcctccagagccctgagccccaatttcttattttgttaaatgaggacattaagaaccccactctggctgggtgcggtggctcacgcctgtaatcctagcactttgggaggccatggtgggaagatcacttgaggtcaggagttcgagaccaacctggtcaacctggcaaaactccatctctactaaaaatacaaaaattagtaggtcgtggtggcacacacttgtaatccccactactctggaggctaaggcaggaaaatcgcttgaacccaggaggtggagcgagatcgcaccactgcactccacctgggcgacagagtgagactctgtctccaaaaaaaaaaaaaaaaaaaaaaaagaacctcgctctgccagctctctgagggacacagcgacataaaaagaacttacagaccccaaactgctagaaaaagtgaaaaggagttccttcccccaccatctaaccttaatctttcagaaatgtgaaactgaagcataggaaaatacttacatagattcagagaaaaccaaagagaagtagtggccagtgagatatcatctcacactaatcagaatgactattactaaaaagccaaaaaaatcacagatgccctgaggttgcgaagaaaagggaatgcttatgcactgctggtgggagtgtaaattagtttaaccactgtgggaagcagtgtggcgattcctcaaagacctaaaaacagaactaccattagacccagcaatgctgttactgggtactacccaaaggaatataaatcattctaccataaagacacatacacacgtatgttcatttcagcactgttcacaatagcaaggacatggaatcaacctgaatgcccatcagtggcagactggataaagacaatgtggcacatttacgccatgaataccatgaagccataaaaaataacaagatcatgtccttggcaggaacgtggacggagctgtaggccattatccttagcaatctaaagcaggaacagaaaaccaaatacctcacgttctcacttataagcaggagctaaatgacgagaactcatggacgcagaggggagcaacagacactagggcctacttgagggtgaagattgggaggagggagaggagcagaaaaaataactatttggtactaggcttagtatctgggtgataaaattgtctgcacaacacacccctgtgacacaagtctacctgtataacaaacctgcacaggtacccctgaacctaaaataaaagtttaatgagagagagagagacagagagaaagaaatttaaaaattgaaagaaaaaaaaaaagagtggtggcagagaaagaactacttacaactccatgcaataacatgaatgaattttagaaacatgatattgagccaacgaagccagatacaaaaaggtattatacatgatgtaggtatgattccatttatacagagctcaaaagcaggcagtattgaactacagtgctcagaggatgcagtgtgaatatagcactgcatggcaaagctgcaaagaaaagaagccaggcagcggtttcctctccggttgggaggggtctgggattcagatgagccgcacaaaggcttaagcggggctggaaacgttctatttcctaacccacatggtgacttcacagggattcactctggaatcatttgttaggttttatattgatgtcttatgcacttttccctatgtgttctctgtttcctaatttaaagatgcatcaaaaaccttaaaaataaatatatatacacctatatttacagcctttaaccaagttattcccattctgttcatctaaactacagaaaagaatcacacattcagacaaacttcgatgcgcaaagatgtgcattgcagcatcatttataatagccctatatttgaaagaacctaaattctcacaagtaagtaaatacttaaatatagtatgtccccaatttggaaaattatttagccattgaaaagtctgatgtcaaagaatatttaatagaatagaaaaaaatgctcatgatacatagatgaatggggaggaaaagagcagaaaataaattatgtgataattaaacatgtactccaataaataaatgatatgcagactgtgatcccaatattgtcaacatgtattacatattcataggaaaatgacagcaaggggccaggcacagtgcctcatgcctgtaatcccagaactttgggaggtggaggctgctggatcacttgaagtcgagtttgaaaccatcctggccaacatggcaaaaccccatctctactaaaaatacaaaaattagccgggtgtggtggcaggcgcctgtaatcccagctacttgggaggctgaggcatgagaattgcttgaaaccaggaggtggaggttgcagtgagccaagatcgtgactctgtctcaaaaaaaaaaaaaaaaaaaaaaaaaaagcaaggaaatatattttaaaataacaagagtagttacatctggggagtgggataattatgggtgtttgttttctttatacttttttcacatttccccaattttctgccatggatgtatatggctttaattctttactacactgcttttcctcctcttttgatttggaccccagatgcacagaatcagttggtcacactccttgggccatttgaccgtcaactgcattagactatggcctaggttttgttttattttcacttcttatttttgcctctgtcacccgtctccaactcctcccatttccctctcccccacagacacccacttggatatatttaaagcttgttctttagatccatctgccacacatttgtttggatctatgggtattcaaacaggcatagtagaaaatatatacagagataaagacatagtgttttatctgtgttttcaaatgtttatgtaaatggtacagagttacgcatttcatactatgttacctttttcactcaacatcctgtttctgagatcctgctttgttgctctttgtagatacaactccatgctcagtgttccattgcatgcttgcgctacctggtccatgcttgtgctacctggtcgaggctgcggactacatttcccaggcctcttgcaggtgggtggagccccataactgagttttaactcgtggatgctgttaggtgagatgtgcatcatcacctctagtgctggcccatgaaatttctcccacacatgctcctccttgctcctttcccttatagctgatagggatgacgtcccccacagtgaccttggaagccgcggttgaaggtggcagagtaactctcagtctgggtctgaatgtctccctggaggagagccagactactgatcgctaacagtcaccttggattattatgagccataaaacttccattacatttgaccctttatatgctttaaggcctgtttattacaattgcaattatttttgtttgtttgtttgtgtttgagacagagtcttgctctgttgcccaggctggagtgcagtggcacaatcatggctcactgcagccttgacctcccggactcaagccatcttcccacctcagcctcccaagtaactgtgactacaggcgcttgccaccacatcaggctaatttttgtattttttgtaaggacaggatttcactatgttccctatgctggtctcaatttcctgggctcaggtgatcctcctgccttggcctcccaaagtgctagggttacaggtgtgagccaccgtgcctgaccacgacggcaagtattaaccttaaccaaaaaaaaaaaaaaagaaaaaaaaaagcatattctatttatccatttcctagtgctagacactgttgctccaaactccttgaagcaatgccatgatgaacctcctcatacacatttccatatgcatctgtgagcaagcgttttcaggttatctaacagaaatggaatgcctgcgccatggggtttgtacatattttgtttacctgaccaaagcaatggcagagacattcaggtgtgtggggcagtgacagcagagatgttcatattcagctagccaaagtcagcatggctgcttggggtgggcaggctcaatggggctaccaaggggtcattgctagatcaaccccacagagtgctttgggcattgtttttggcacagcctttaaggctggccttctaagcatccttgagattctgtgagctcccatagctgttaataaaattagagcgagttctgttgcttacaattgcaaatccccttatttatgtatttatttatttagagacagggtcttacactgtagcccaggctggagtgcagtggcatgatcatggctcactgagacctcaaaactcctgggctcaaatgatcctcacacctcagcctcccaagtagctagtagctgattaaaaaaaaaaatgtgcagatgggggtctcactatgttgcccagactggtctcgaactcctaggctcaagccttagcctcctgagtagctaggactacaggcacgtgccaccatgcccagctaatttcatgttttgcagatacggggtttcactatgttgcccaggctggtcccaaactcttggcctcaagggatcctccacgcctcagcctccccaagggcttggattaccgatgggagccacttcaccaggtctgcaaatcccttttcatatgctagattcaggggaaggcaaacttcttctgcagagagccagaaagtaagtatttttggctttgcaagtcatacagtatcttctcagcttctcgattctgctgttgtagcaataaagcagccaaagacaataataatgaatgggtgtggctgtgttccaataaaactttatttataaaaacaatggcccacaagacataacttgttaatccctgagctagataaaaaagagacatctcctttctctaaatctctatgtagacatttatgccatgtttcttagtcttagctacttggtaaacgcttgttctcatccacacagaggggtcctcacacatggcctaacacattaccttgcctgaaatagactggatgaataaatgaatgagtgaatgaatgaatggccttaatttagaggtggtctcaatgaacaacccaggcagagaccaatcagaaccgcagccggctgtagacaacctgtgccacagaaccagcggagtacagagtatcattctttgtccttcagctgttgcatgaagactaccttcttcacaactaaccccccgcccaccctacctggctttatcccacatccctggtaggcatccatttaggggctcagtttctgaatttcagaagttaatgaggaacaagggcaactgtggggggttcagttcttaacagcaaactgttccagtgactaatccatctttcattcccagtatttttatttgtcccagcagaaatgtgtatgagtcacagctcctggataatttttttttaatgcatcattgcgtgtatatctctggcctgcagacctgcaaggtctgggtgctgttgacagggggctaatgatttcagcagcaacaacaaaagctgtcaagtcatgctaaccaggacttctttcccccatgcctatcagcatgaaagaaataaaaaaagaaaaaaaaatggacttagtgtctgattaagaatgtggcacatagagtgatttaggcggccacagacttatactttctcctaccaataactttccctttttttaagaccctgccacaaacacctcttctttcggaaagccttgattaatctaatctcaaagaccagctctcagagcagctctaaaaccactatgatttgcaaatcaaatctcaccctcttctgatctcatttctgtcttgcagtgtattcctgcagcctttgtgtagaaaattcctattctacccctttcaaataatttgtagcttgctttctggagtgtgaagtctcttccacgtgggtatattctctctctccagcgtggtgcagtgaaccgtgattgtgccactgaactccaggctgggcaacacagcaagacactgtctcaaaataaaaatctagtagccgtgtctccatccttatcatattcaattattcagtagcactcagcacagtgatttctctctccttcttaaaatatgctttttgcaccaaatcagacagagttgatttgggaattatgaagagatgaagccaaacatccacttggcccctcactggctatgtgacttcacttcttgggggccccagtttttgcatctataaatggggatgataatgatgataatcataataacagaataaaggtagataatgtttcctgagccactaatcataatatatgctcaatataaacaagggtttttcatctattttgctcattgctgtatggtcggggctagcacagagcctggcaccatttagataatcaacaaacattttttgaataaatgaattaatggattgtttcccatacttgcctaatcttaagatgcctcaccatcctcccaggaagagactccaaggtcaaccttgactctcgtattatctgtgtctagaattctaattcctcaaattgcttagtttccgtattactcaatgatcctaaagatgcaagtgacagaaatccaactcaaaccagttcagggaaaatacggaatatattgggtcatctaagcctgtctaacttcgggcatggctggatccaggtgctcaaagattgcttctttcccaagagtgtaactcagaaggctgtctctgattggtcaggattgggtcatgtgttcaatcactatgactctgaatggccaggcctgagtcatgtattttctactagaaaggaagggaggaatggtccccacaaggttaactggagccccagtactacaagaagagaaataaatgctggctaggcaataacaaagaattgagggaggctcctccagactcaccagtctacattccctcctgaacactctgccaggttaatgctataaagggcaaacatgatcaagttacttatccctgtgctcaagcaccttcactggctccctactgctgactaaagtaattatagtttgctcagcgtggcatggaaagtcctttgcaatatacctgtcttctccaggctgagggatcagtgagaaagctgttctaagaatccggacaagcaatggtgaggcatggagtttggacagcaagagtggggatgcagatgtggatttcagaaaaatccataatttcactgaaactgccttcatcaaggtcaaaaatttggactgccaagtccaaatctagtagctgtgacctggcatggtggctcatacctgtaatcccagcactttgggaggccaaggcaggaagattgcttgaggccaggagttcaagaccagcctgggcaacatattatctaaaaaattaatttaaaaaaagttagccaggcatggtggcatgcaacactagtcccagctacttgagaggctgaggtagaaacctcacttgagtctgggaggtcgaggctgcagtgaactgtgattgcaccactgcactccagcctgggcaacacagcaagaccctgtctcaaaaaaaaatctagtagctgtgtctccatccttatcatattcaattattcagtagcactcagcacagtgatatttctctccttcttaaaacatgctttttgcaggaaatatttgggataccctgtaccccccattcccttgcacggccatgttctactggccttctctggcagcagatatgtgctcagactctatcttctacacccattgaagacaccattggttgcaaaccagcaacattttccccttctccctattgaaaccccaagtttggccaccatatgcttctggagagaatgaaccctcctcacccccagcaggcagatcttaatgaaattcagccaatcatgaagaggcatgtgactcatttctaaccaataagacttgatggaaatctgctggaggcttcagggaaggtcttcttccctctcaaaacaagatacaggaaaggaaagtgacttgttctgctcttgtggcttgtggatgttgttgtgacagcacgatgtctaggggctatggcagccaacttggacccacgaacggagaccgtgccatcatggtagatggaaagatgcaaggaacctggatcctcaatgctgctcttgagccgaattacccaaccctgggactgtcctatctcaggacacattgcataaaacacattgggttcagtcttcatttacttatagcaaaagtcatcttgatggatatactgcttgtatggtaaaacttccagaaacatgactccagctataaccttctttctcacatcactccagacctacgtgggatgtttaatggacatcttcccaagcagtcctacaagcactttaaaaatgtgtcccaacttgaatcaattatctgccacattccccaaaagacttttattcactagataaatggcatcgccatctatgtgatttctctcatgagtgatcctcaagtcttttttccattcctttattcattcatgtaacgaactctcatttactaagctcctctatgcactgggcattatgcaagatgtaggggataacacagtgactaagacaaagttccatccctcgtgaagcttatatttccggttagagggagatattaaacaattaacccataactgacagcagctaagaaataaacaggatgttctcatagaaaaatacagggaggcacacacctagataaggtgatcaggggaggcttccataggcaggtaataaataagctgagatctaaatgcacagccaaaaccaactctgcaaagcatgagaagagttttctaggctgggcgcagtggctcacgctgtaatctcagcactttgggaggccaaggcaggaagattgcttggggccaggagtttgtgaccagcctgggcaacatgacgaaaagtgtctctacaacatacaaaaaaattagccaggtgtgatggtccatgcctttagtcccagctactctggaggctgaggtggaaggatcacttgagcccaggaggctgaggttgtaatgagccgtgactgtgccactacactccagcctgggtgacaaagcaagaccttgtttccaaaaaaaaaaaaaaaaaagagctttctaggcagaggaaatagcaagtgcaaaggccccaaggctggaccaaatttgagctttccagaagccgcgaggaggccagtgaggtggtaatgtggagacaggcagatccagcagggcctcaaaagtgatgtgtggattttatgctaagtgcagtgggcagccaggggaggaatttaaacaaggatgtaacatgatgtgactcaggtttttaaatggtctcacaggctattgcatggacgatggcccataataataaaaatgatcacagctaacactttgatagtagatactgtgtgccaggcattgttctaagcacattccgtatatattaactcattaagtcctcccaccgaccccatgaggtcagcaccataatcattcccattttattgatgaagaaactgaggcacagagaattacagaaacttgcctacggtcacatagccaataaatcaaagcctggcctagaggaaacaaggagactagctacaggctgtggtgcatgtccagaaagggggctgcaggcagtggggcttggattggcccaggggagaagtgcaagggaggatcccgcatataatttcacggcggagaggaaagaacttgcaggtggtcttatcctctgtccattctcactcctttctccagcaggtttttgaacttgacttctggcttggtggtctcccagcccaccttatattaatagatggggatgtcctcgctgtctcctcccccaccatcctgctgtctggcacctcgttcatctcacacaaccactccccttgaaaacagcccgaccctcctacagtacaacagtctccaccttggtcttgccctgcccactccacaccagagattaaaagccaggcagccgctcctggcggtcaaaggagagcactttgtagacgctccctggaccccagcaaaacttctattgtgttgctggagacagaaacaatgccagtggcccagttgctccccagccaaaggtggccccagcaaacagtctcccagccccatggatggggtgcctgggagtgttaacagagctccctcggggaccagagggccaggagagaagcaacatgtgcctgctggacactcccgtctacagccggctgcagcccccacccacccacgtgcctcactctaggcgaagaaaacccaaaagtaggagaggacaggccagagatggctgcttgacctttcaaggggaggcaggagtttctacaaagcctctgggagtcccctaagtatgtgttcctaccctccaggggctaggaggtcaccctctcagttcctcatcagcctgggataggttcagcggtgggtggaaaatatgaccagcaaggggcctacccacacccggggcctgctttggggctttcttaaaaagacagtgctaggatcccagaccaacaagacaccttgtgcaaagctctgtgctctaggctctcagagaataggaaagcaccctgtccttctgggtcagagtggagttaagatgagttatgcagaggcagagatttgggggagagatcaaggaatacttcatggaggagggggcctttgagagtgctctgaaaaaactgagaggattcctttctttgccctgccctccctcttccttctcttataaaaaaaaaaaaaaaaaaaacaaaccctccccaaatgactaataaataaaagacacacaaaagagacacatatgctttatctataatgtataggccgtgttgtttttgaaactcttttctgctctgtaaaggaatgtgtgtgcatcacggaaaccttggaaaacccagagcagcatatagaagaaaatgaaaattgcctctatttccaccatatagagataaaacactcttaacttgtcagagtattcctttccaggctttggtggtgttttttcatattattactaaggtgaaatttacttgcagtgaaatgcacatgtctggaatatatgactcaatgcattttgacaaatgtctacacccgtgtgtacacccttccaatcgagatctagaacattcccctcaccccagaaatttcccccgggtccccttccagtcagcccccatccttctgatttctataaattagttttgcctgccatgtaattggaatcatgtgctatgtgcttttttgtgtctggtttctttcactcaacataaacaatgtttttagatttctccacgtatcagtagcttgttctttttcattgttgagtagtgtcccattgtgtggataaatcacagtgtgttcatcctgcaagaatcttttgggttgtctccactttggggctattatgaaagagccacttataaatattggccaagtctgtgcatggatgtaggttttcatttttcctgagcaaatacttaggagtgggataactgagtcatatgattaacttttatgagaaattgtcaacagttttccaaagtggttgtaccattttatatttccaccagcactatatgagggttccaatttctcgatatcattacattttttcttttttttttttttgtttctttttgagacaagctctcgttctgttatccagtctggagtccagtggcacaattgtggctcactgcaccctcaacctttcaggctcaattgatcctcccacctcagcctcccgagtagctgagaccacaggtacacactaccacacccagctaatttttatattttttttgtagacagagcattttgccatgttgcccagactggtcttgaactcctggtctcaagcaatctgcccgcctcatcctcccaaagtgctaggattacagatgtgagccaccacacccggcctattattacttattaattacacaagtaatacatgagtatagtctcctgcaaggctaaaatacctttggataaccacctggcacccaccagtccccccagaataactaccatcagcagtttgggatgctgcttcgcagacgtttgcagaccttttcttgtacatttatatgtatagatatataacatttttagggggggtggttggagtctcgctctgtcgctcaggctggagttcagtggcgggatctcggctcactgcaacctccgcctctggcattcaaggaattctcctgcctcaccctcctgagtagctgggactacaggcacacaccactgtgctcagctaatttttgtgtttttagtagagacgggggtttcaccatattggtcaggctggtctcgaactcctgacctcaggtgatccacccacctcagcctcccaaagtgctgggattacaggcgtgagccaccatgcctggcctgatatattgactgtgccactgcactccagcctgggaaacagaggaagaccctgtctcaaaaaaaaaaaaaggaatgtttgtgcattgctaaaaccttggaaacccggagaagcatgtagaagaaaatgaaaatcacctccatttccaccatgtagcttaaacatccttaacatgtcagagtattcctctgttttctatagatatatatatacatatcactatatatgtgtgattatatatgtgtctccatagaaataaacaaaacaatactagaaacaaatacaatactagaaacagaacaatactatgtgtcttctatggatatatatatagtattgttttgtggtgactctttttacaaaaatcttgcattatatatttcttcattgtacttaccacccaggccgtattgtttgattccctgcctaggatgttagctcagctggggcagggaatttgttttgttcactgctagattcccagtgtccagcatagagtggctgctccatcaatatctgtggaatgaaaggatagtggacatattgttctgcaatttgctggcttcactctataaatataactcatagatctttccacatccacacttacagatctatttccctctgtaaactgccgcatagcatattctgtgatatgaatgtgcaaaatgtcttttacatccctctgtttgtaggttttagtaaaatcagccaaagggtcaggatttctaccaccacatacttcaaggagctcaacacattgcctacttggtggggagtgggggggaataatggtaaataggtagaatctttataatttggcaagtgagggtggtagtggggagaaaggtagcatcaaagttgtagtggggtggttatgctcactctggagccagatgttctgggttcatatcatgaccaccactgtcatgctgtgtgatcttgggcaagttactcaacttctctgtgcatcagttttccatctgaaagatgggaataataatagtaacctccaagggttgttatgagaattaaaagtctatagagcagcaatgagcacttgttaaatactctggtgttatctactgttattattcaacaaccaaagggtgtttgcctctaaggaacacatccagctcccttcagtcattttctctacctttctggcccgggtgggctctggctttcccatccactgagctagaacctttattgcagagtagagagtgacccggggcaagcggagggccgaggggaggaaacccagggaggagcagctttataggaaccaggagagaaaggagtttccagaagccagggctggtaaacagtgacaaaagctctagcagaggggtaacgatgtggacccagattaggcggttgcaatttggcagcagggaagtcaccggtgacctttgggagaaacgctggggcagaagccagcttcagagggacagggacagggacagggacagggcctgagctggggctggggagtcttccaggagctgccaactgctcttctgagaaacctggccaaattggaccatatcttgaaggagagagaaaatattttgtttttttttaaggataagaagctctgagcaggtttaagaggggaaacttatttcaagagccatgactacaggatctgagaggaggggagctgggactggaatgggagccaagagcccggcattttgatcccaacatttctgctgaatcttttcttccccgccatctccgtgcctctgcacctgccaacctccctgccaggagcacccttcctctgtctgcctggcaaactcctcttcatcttctaaattaggggttgacaaactctggccaccagccaaatccagccccccgccccctgcctgcttttgtacagcttgtgagctaagaatggttttcacattttaaatggctgggatggggggaatcaaaagaagactatttcgtgacacatgaacattatatgaaattcaaattttggcttccataaataaagttttattggcacacagccacactcctttgtttacctattgtctgtggctgctttcttgctacagtggcaaagtggaacagttgtgacagaccatgggtcctgcaaagtctgaaaaattccctatctggccttttacaggaaatgtttgctgatctctggtctaaatcgctacttgaggccgggcatggtggttcacgcctgtaatcccagcactttgggaggctgaagcgggcggatctcttgaggttaggagttcaagaccagcctggccaacatggtgaaaccccatctctactgaaaagacaaaaattacccaggcgtggtggcaggtgcttgtaatcccagctatgtgggaggctgaggcaggataattgcttgaacccaggaggtggaggttgcagtgagctgagatcacgccattgcactccagcatgggtgacggagcaagactccgtttaaaaataaataaaaataaataaataaataataaataaatctctacttgagatgaacaaaaactaccactgtctttctcagccttacctcctttgtgaccatcccttggtcctgtgagcccctttagcactgggaaccaagtcatagtatggcatggtgcacgctggttggctgtcacttgtttgttatgcatttgtccccgccttcctgaaggacctgaaccttgccctgtaggcttcaatcccccagcatggggacattgcctgatcgtccgtaaatattgatttaaatattttaaatatttaaatattgaagttcacccattcaccactctgagtctagttttctcatctgtgagagccttgaacttggtccctacgatctctaatagtctgtgggggaaggacagccaagacctcaccaggcagtatgggattatttgccaaaaatatttaaaaggacctttcgagaattccataagccacaaattcatagactgtgggccaggttttagcccaaacgtgttttgctgggtctgcacctatttttttttttaacttagatgtcaatggaaacctaacccagcccactttagtcaccagtactatctatctgcccctttcaggcatttgagtttgccattcctggatggagagttaaagaccattataaccatgtcacccaggaccccaaaaatggttctacagtcaaaggttaaggatatatttaggtcagttgttcctaaacctggtgaaatcaaatgactcaagcagtatataaaacacagatccctaggcccacccagacccaccgaaacctactctcccataggtcatggtgctggaggcggaatttttttcaagatcctcccaaaatgcttatccattatgggaatatgtattgaatcaatatctgcagatgtcaatttggctggacctgtcaaaattataaatgcacctatctcttgacctagcaattccatttctgggaatctgtcttctaaaccaatgctttttaaactttaatgtgcatacacaccccggtcatctttttaaaatgcagatcctgatggagcagatctgggttggagcctgtaatgctgcagttctaacaaagctcccatctgatgcccagctgatggtcctggaacattctgagtagcaaggccctagatctcccacacacacacccagtgatgtatgtacaagatgatgcattgtatcatagtatgtaattgcaagtatgggaaataacctaattgtccatcaataggggactagcccaataaattatggtgcatctcagaaaggaggagcattatacagccttgaaaagtatcaagtatcaaggcagtgctttaggtactggtatggaatgaactctagggcatattattttaaaagcaaggaggagaatagtgagtggagtgggtaaccacttatataaagagtgttggctgggtgggtatgtggggaatatttatatttatattcacttgtaaatgcacagaattgcctggtagaagacactagtaactggaaagggaaactgagtggatgggtgacagggaagggagggtgacattttactgtacccatttgaattttgaactacgtgaatatgatacctgtttaaaaataaacaaaaattttaaattataattatacataaatagaaagactcaccacatacttctaatgctcagacatgaatttagaccatcagaaaagctgagctgcaggtaacatggtggatgtattagtctattctcatgctgctatgaagaaatacccaagactgggtaatttataaagaaaagagatttaattgactcacagttctgcatggctgaggaagcctcaggaaacttacaatcatggctgaaggcacctcttcacagggcattaggagagagaatgagtgcaagcaggggaaatgccagaggcttatgcaaccatcagatctcagaagactccctcattatcacgagatagcatggggggaaccacccccatgattcaattacctccacctggtcctgcccttgacatgtggggattatggagattacaattcaaggtgggatttgggtggggacacagagccaaaccatatcagtaggataccttctgccttggtacaccatgcacacacacacatccaacgcacatgcacacatatgaacacacacacacttgcatacacctttaaggacagtcaatacagtgtgttgaaagcctgctgagcttaaactctgcaaacctcagttggatcccagctccaccagctgagtgacatcaagcaagacacttagcctcgatggggatgatcaaaatagtcctggctgccctgcagaccttgggtggtgagaaaactcttcataaactgtcaagcatacacatgaaaagactcattataatatgaacctggatgggtgagccagatggggcaatccacagccttctctccatggggtcccgtgcacacctctcaggacgtcactgcaaggtggaaacccaatcccttgacctttgcagtcaggcagctgctccgaacaacccctggcagtgctaatctccaactctcctctcaccatcgggtccagctgctgggctgagtcacacgcaggccgagggacaggcacatgacttgtgtgtggagctggtgtgagtgtagtggttgggggagggtagtaaagaccacaagaggtgattactccccacttagtaggaaatttcacctccaggggaggagatctaagcctgactctaggtcggaactcaagtggctgcctggcctgtctggcagaattcttcctccgggaagcccactggatgtgtatatgtgtgtgtgtgtctgacagagggaggggcagagtgtgtacaaaagaatgatactaaaaataactagccaggcacctgtggctcatgcctataatccctgctacttgggaggctgaggtgggaggatcacttgagcccaggagtttgagactacagtgagctatgattacaccactgcactccagcctgggcaacagagtgagacaccctctctaaaaaataaaaactaaaaaaaaccacatgtactaagcacttaccacatgccaacctctatcctgagcacctcgaagattaaactcattgaatctccattgatactggtatcaccatcaccattacgatcatcctcactttccagatgaagaggccgaggcccaaaacaggtaatgaattttaccaaggtcagtcatatagcccaggttcagagacagtctgattctagagcctccgctcttaacctctcagctacagggaatttcattccttgaagggggtttccagaggtcatttggcccagtgcagtgagtgagatgatggaaacagtcaaccatgtttgcacctggctgtgtgaccctgggcaaattgattacctcctgtgcttcacattttagagcctcactttcctcccctaaaatgaggatcatcacaaccatatccacctctcagggctgttttagggcttagtaataacatacttaaagtcctccacacaagaccttgttaatatgattatcataccgattattatccagtactagtgagcaaggtataaaaaatagctagaaaacccctaatcctgggcaagaaggaatcaaaatctccttcttaagcagtttgtccatatcattcatcagcaacatgtaaccaatacatcttgccttttcttcctgttgccgtcaacccttctaagaaagcaagatagggctagaaaagaaagtgcctatatcttggtcatcattttaaccactttattttttggttttggttttaataatcttgatttctgctgagagacgctcacaggagagagaccctgggtaccaagtccatcctggcggcagggggacagatgaaattcctctttcaaggttgcttccacttccacatccctgggagactcattcaatcctacagttatttagtgagcacagactctgttccagtcatctgttaggcactggggacacagcaccgaacaaggcagacaacattcttcagctcatggagctgacactccggcagaggagacagaaaataagtaagtaaagaggccaggctcagtggctcacgcctgtaatcccagcactttgggaggccaaggagggtggatcacttgaggtcaggagttcaagaccagcctggccaacatggcgaaaccccatctctactaaacctacaaaattagccggttgtggtggcatgtgcctgtaatcccagttactcaggaggctgaagcaggagaatcacttgaacccaggaggcggagattgttgcagtgagccaagatcataccactgtactccggcctgggcgatagagcgagagactctgtctcaaataaataaataaataagtaaagagatcatctaatgtttaagtttcaaaaaatgccatgaagaaaaataaaacagagtaaagggatggagagtgacgagggagcggctgttattttaaacaaggtgatcagagaaggcctcttggaaacatgacagaggagagctaatgaagtgtgtgtacctggggaaagagtattccaggtggagacagggagtggcaggtgcaatggccctgaggcagaacccagggagacagtggtagggcctaagtctggagcggcagacaaggccttgctgtctcctcctttcttctctgccaaactagggtgaggacagcggcctgctggcccacatccatcccagagttgctgggaggtaatggatgggaaattgctctgagaggctgcacagggtccagtaggagtgttattaatggatgcactggacgacgcccatgccaggggcactttaggacaaagtggtttcttctccctcctggtgagtccatgttatcctaaataccagcactgagagagcccaaacttcaaacattcccatcctctccttcaaggaatggaaacagcagggcctagagaaggcaggagaaccatccaaggccacgttgcaagttcctgccagagccccagtgtcaggatcaggctcaagactgaaaaaatactgaaccatcccattcccaggtgacaggagagtaagtaaaatcacttttcttttcttttcttcctaaaaggttgttacttcccctagggcaagagggggatgagactctttgccgggtggatgggctgggaaaaacaacagtttgcaaaacaaattaaatgtgttaaatggccagtttctcccaccagtgggtctctttgccctcagcaagtgacttctcaacttctcctttgtggttttcaaaacattcccctaaatttctttttttgttttgttttgtgacagtcttgctttatcacccaggttggaatgcagtagcatgatctcggttcactgcatcctctgcctcccaggttcaagcaattctcctgcctcagcctcccgagtagctgggattacaggtgcatgccaccatgcccggctaatttttgtattttagtagagacagggtttcaccatgttggccaggctggtctcgaactcccaacgtcaggtgatccacactcctcggcctccccaagggctgagattataggcatgaggcacggtgcccagcctacccctaaatttcttaggtccttgccacccatggtgtataagagtcagagaagatattgggctctttggcccctttccacagatgaggaaactgaggcccagagtagggaaacacacctcatctgagacacttgggctccacagttaggagctgaccttctctctaaaagaagtgactataaaccggtataagataacataatgagaaaggtaatttcagaggatgccaagagctatggatgaaataaaccagagggcttggccgggcacagtggctcatgcctgtaatcccagccctttgagatgccatggcgggggaatcacttgagcccaggagtttgaacctgcaatgagctatgatcacaccactgcactccagcctgggagacagttttttaaaaaaaccagccttgagctcaggagtttgagaccagcctgggcaaatagcgaaaccctcgcctcatctttacaaaaaattcaaaaattaacagagcatggtggtgcatgcctgtggtcccaattactcgggaggctgaggtggcaggatcacttgaaccaagaaggttgaggttgcagtgagctgtgatttcgccactgcactccagcctgggtgacagagtaagaccctgtgtcaaaacaaaacaaaaaaaggtaggattggcaggactactttagtggtggtcagtgaagggtcccgggggagtttgcatatgagctggtcctgtagcttgagcaacaagcagccatgcccagagccaggtaaaaggggggtctgggccaaggggtggcaaatgcaaaggccctgtggcgggggcaagcttggccttggagcagcaaaaaggaaagtccagtggggctggagcagagcagagcagacctggggagggtacgggccgatggcagcggcaggggccatgtctcaggccttcccggccactgtaagaaatgtggatttaatcctaagggcagtggctgccagtcgaggcctccatggttggtgggagagctgggccttaaaacctggatctcattcttcagagccaaggctcacaggcctgcaactccccttggccttctatgtatcccaagacttcctctgtcaaccctggaacttcctggttatactccgggcatgtgactctgtctcgtccgccttgggctgtcaagtgactcccacagccctgatttcccacaaactcactcagcatcaatctcctctcacacacaggcagatattctcctcggcttctgcaggtcacactctctgggagccttgccccagcaaatgaatttgcatctgcccccaatcctcaacagcagcagaaattggggatggggaaaaggagagaacagagagacctttcaggagcgaatcagtctgcaaactggataggaaggcagagagaacacaggccagacccaacctggggagcttatcagctctgtcctggggtgtaggctcccagaggtctgagctgtctcctctggcctcactcctgtgttaagaggtgacagacaggatcccagggtgagtctggctgaaaatagacaggcagcaggggcagccattagtggtcccttgtgaggttctaactctctaccatcaaatcaccatcagaccaccttctttggtgttatctttctttaatgtaggcagctgaagtcctgatattaacaataataattcacttttattgagcacttaatgtgtgctactcactgtactgcgtactttattttatttttattttattttattttattattttatttagagatagggtctagctttgtcaccgaggctggagtggggtggtggaatcatagctcactgcaacctccaactctttggctcaagtgatcctcccatctcagcctcccgagtagctaggactacaggcatgtgccaccctgcccagctcattatttttttaaattttttgtagaggcaagatcttgccatgttgcccaggctgattttgaactcctgacctcaagcgatcctcctgcctcaaactcccaaagtgctaggattacaggtgggagccacagcacttgggccagtactttagaattttaactcatttatacatctatgtcaaacggaaacaaaaagattcttagaaaacttggtgattcctgtgaattttaacaggctggctaccttgtaacaataccagaaacagaaccagtgagtttgtctgccaacactgctttaatacaaacccagtcacccaccccataagtcccacaaaatgccccatgaagattctcccatgtgactattctggagccacccttcaggaagaacttccagacacaaatcagggagcccctgcctcacctcacacctgtcaggatgactactatcaaaaagtaaaacaaaacaaaacaaatatacacagaaaataacaagtgttgggtgaggatgtgggaaaaatttgaacctgtatgcattactggtaggaatgtaaaatggtacagctgctgtagaccacagaatggcagttcctcaaaaaattaaaattaggattaccatatgacccagcaattccacttctgggtatataaccaaaagaatggaaagcaaggtcttgaccgggcatggtagctcatgcctgtaatcccagcactttgggaggccgaggtggacagaccacctgaggtcaggagtttgagaccagcctggccaacatggcgaaaccctgtctctactaaaaatacaaaaattggccaggcatggtggcgcatgcttgtaatcccagctacttaagaggctgaggcaggagaatggcttgaacatgggaggtggaggttgcagtgagctgagattgcaccactgcactccagcctgggcaacagagtgtgactctgtctcaaaaaacaaaaaaaagaaaagaaaagaaaccaaggtcttgaacagatatttgtgcaacagtgttcatagcagcattattcacaatagccaaaagctggaagcaatgcaagtgtccaaccacagatgaatagattaaccaagtgtggcatctacatgcagtgaaatagattccaaccttaaaaatgaaggacattctgatacatgctacaacatgggtgaaccttgaggatattatgctaatgaaacaagccagtcaccaaaagacaaatactatacaattacactgagatgaggtccctagagtagtcaaaatcatagagacagaaggtagaatggcagttgccaggggcagaagggcagaatggggagttgtttaatgggcatggagttcggctttgcaagatgaaaagaattctggagctggacggtggcgaaggttgcacaacaatgtggatgtacttaacgcgtctgaactgtacatttagaaatagttaagatgttacattttatgttatgcgtattttaccacaactaaaaattccttaaaaggccaggtgccacgtctgtaattccagcactttgggaccccgaggcgggtggatcatgaggtcaggagatcgagaccatcctggctaacatggtgaaaccccgtctctaataaaaatgcaaaaaattagccaggtgtggtggcacgtgccagtagcctactcaggaagctgaagcaggagagtcgcttgaacccaggaggtggaggttgcagtgagccgagatcgcaccactgcactctggctgggcgacaaagtgagactctgcctcaaaaaaaaaaaaaaaggccagacgcagtggctcatgtctgcaatcctagcactttgggaggccgaggtgggaggattgcttgagggcaggagtttgaaaccatcctggtcaacatagtcaaaccatgtctctacaaaagaaaataaaagaaaaaaaattgtagtaagaacaaataagatggccctgcctccttcctggggcccagaaagagatctcactttctgacgggaaggaaagggcccccagcagcattgcagtcacacccagctccttctatagatgttaatagcctggagcagatctttgtgaccccaaaataagccatctcagactttcagtgacactctttagccccagaacagcatcacagtgaaaggagaggtcgagagaaatggagctggagttctaacattgactttggggaaccttaaacaattcactccacctccctggacctcagtttcccaatctttccaagtgaggaggctggacttcgcaagttgtccaggaattatatctgaccccagacatgtcttgttcggccatcacaagatttaaaagctgagagatatcccattagaaggtccggccacccgggggctatgtttttccgaggtcaccatagtctggaagtgcactgtctggaagggttcccccttggatggggctagtgctcctcagttccacccctgccacaggcacaaaacttccctgccaggaccttgcaggcagctgagtttgcaaagcctggacaaaatgacagtggagggacctcacacttcagtgacagctggttcagggttttgtgggtgaagatttcttctaaaacacaatttaggggttttccatcatgggacacactatctctgagactctccttttttaactccaaccctggattcctcggaccagtttcccaaatagggggacctcacaagaggctctgcaagccccactggcaccccacaacttgactccctctcaatttgttgggattcccagcaggaaaggaagtctccaggcctgcttgcggggcttccaaacaataacctccctcttgcctcccctcgaaaaatagagaaaatgaaaaagcaggccaggcgcggtggctcacacctgtaatcccagcactgcaagaggctaaggtgggcagatcacctgaggtcaggagtttgagaccagcctgaccaacatggcaaaaccctgtctctactaaaaatacaaaagttagacaagcttggtggcacacacctgtagtcccagctactctggaggctgaggcagtagaattgcttgaacccaggaggcgaggttccagtgagccgagactgccccactgcactctggcctgggcgacagagcgagactctgtctcaacaaaagaaaaaataaaataaaataaaaaagcaaaaaccaaaaaggctcttattaaaacgattcttcatgacaacccagacaggaaagacaggaactgacatcatcatcccttgaactcctcctcaccataatttgatactaataaaggatagcttttattgagcatttactgtgtgccatgccttcttctaagcaccatgcatattatttcattgaatcctcataacaatccaaggagataggcactattataacccattttacagagaagaaaactgaggcagaacctgcacattggtggtgagaaggcctgtaaaagactttagctttctcatctctcatcacgtgaccttggacaagccacttcccctctccaggcttcaatctctaagttgtacaaggtgatcattctggtctaaacagtttgttactccttgaactcttttactaaaaatcaaagcacacattaaaaaaaaagaatgaaaaattggaaacaacactgcctgtatagggggtatatgtgtgtgtttgaagagccaactagtgaaactttaaaagctaaaaaagcctaaaaaaaaaaatatatatatatatatatatatactaataaacgttattttttttttttggagacagggcctcactgtgttgcccaggctggagcacagtggtgcaatcacagctcactgcagcctcaaacttctaggctcaaacgatcctcccacctcagcctcctgagtagcagctgggactataggcatacaccaccacatccaactcattttttattttttctttgtagagatggggtcacaccaggttgcctgggctgatctcaaactcctgacctcaagtgatcctcccacctcagcctcccaaagtgctaggattataggcgtaagccactgtgcttagcctagactttattttttcagagaattttatgtttacagaaaaattgaaaggaaagtacagagagttcccttatactccctctctccctcccctacttttccccattattaacaccttgtattagtgcagtacatttgttacaattgatgagctgatatgggtacattattattaactaaggcccatagtttatattagagttgactgtgttatgcagtctgcaggtcttggcaaatgtatgacatgcatccaccattaccttattaggtagaatagtttcactgccctaaaattctcctgtgcttcaccttttcatccctccccgctccttctccacaaacccctggcaaccacagttttgtggggtttttttgttttttttttttctttctctatagttttggtttatccagaatgtcatatagttggagccatatggtgtgtagacttttcatattgtctttttttttttttttttttttgacacagtctcgctctgtcgcccaggctgggatgcagtggcatgatcttggctcactgcagcctccgcctcccaggttcaagtcattctcctacctcagcctcctgagtagctgggactacaggcacacaccaccacgcctggctaatttttgtatttttagtagagatggggttttcttggccaggctggtctcaaactcctgacctcaggtgatctgcctgccttggcttcccaaagtgctgagattacaggcatgagccactgtgcccagcccatattgtcttatttcacttagcaatacacatttaagattcttccatgtcttttcatggcttgatagatctttttttctaatcaatgaataatattcctttgtctggacgtgccacagtttgctttttcattcaactattgaaggatatcttgattgcttccacgttttggcaattatgaacaaaggcttatacattttttatagtttttcttgccattggaaaaagcaatgacacatgatcactgcagattaggaaaatacaagaggacgcagagaatgaaatttcgatctttcatttcacaaagaaagaaactgaggctaagggagaggaaatgacaagttctccttgttcattcattcatgccttcacttattcctccagtgaatatttacagaggacctattatgttcaggcactgtgctgggacaggagacaccactgggaacaagagagatgtccgttactggggttaatattccagacagacaataaccaagtaaataaatgaatcatatttgtaacgaaatcacagctaatatttattgtgtgctttctttgtgccaaatgttgttcaaaaaactttgtgtactttatgacatttggtcttcacaagcacactgggaagtaagcctgttatctcaattttgcagatgagaaaagtatagttcagagaggtgaaatcatgaacctgaggtcacatcgctcatcgaagtcaggggagcaagatttaaacccaggtcatggctctcccgtctatgcacttaaccactgctctaaaatatgggaagatcatttcagatggagggttagggacagagcccagctgaaccctgaccttcaccttcttacgcctttgtgtcgggcactttgtttttcatggttctgagaagccaaacttcattgttcttcgtgggttcttccagttgcttagctgtggtccctgtggaccagggggaagggcttggagctcatggctggccagggccctgtgtgcaatcagatcacctttatttttaagccattaaatccctggtgacacatgctgctcttcagaggagcaggctgacctgaccaggagaacagagtcactgggcagggagaagccacacacctcaggcaaagtttttgacaatcaggcaaggaggcagggttggggggggtcttacccaaccctgcttcctgtgggatcattcaaatcagtagcagaaaaagccataagcttataaaatggtactggggagtctctgggggaaacaggtactcccatacacccctggggagtggaaggtgccagagcagttttctaaaacaattgtcatcaactaccaagttttacaggaacacagcctttggccagcagtttcaggtctaggggttcatcgtacagatatcttcgcacatgtgtaaaatgaagtatgtgcaatgctacgcttgacagaaatttgtagaaagaactggaatgacccctttcttctcctaccccccacacaggtccctggttaaagaaaccaggtccgtgcttgcaaagaaatctttggcagctgttcaaaggaagacgggtctccatgtattgcaattgagccctcttcagcataaactgttaagggtgaaaaagaaaggttcagaacattatatgctatcctgattgttacaaaagaaacaaaaagaggtgggcaggggctctgtctatagaggtgttgaactgggagttcctccacaagagcttttagcatcctgaggcctggcatcccagtattggccctcccttgctgtgcaatgaagatcgaagtttcaacctctctgtgctccagtttccttaactgtaaaattggacttgttggaaaaattaaataaagtcatctacacaagaggcatttctcaatgcctaggacgtaggaaatggtcaataaggaacagctgtataataattattgtgcacaaactctccctggaagaaggcacaaaaacatggataatgggctattacctctgggcactgggaaaactgggagacgggacaaggggtgaccaatttttcagtgtatgcccttttcgaagtgttaaactttttttttttttttttgagacaggatctcactctgttgccctgctggagtgcaatggtgagatcgtaactcactaaagcctcaacttcctcggctcaagcaatcctctcacctcagcctcctgagaagctgggactacaagtgtgtgccaccatacctggctaattattaaagtttttgtagagacaagatcttctccttgtgttgcccaggctggtctcaaactcctggcctcaagggatcctctggctaaacttttaattttttactttgtgcatgttttaatgttttttaaaaaatattatttaaaatagggtagcaggtccaaatcaaaatgagaaggagcaggtaagcgattttcaggccattttccagatggattttttgagctaacagcaacctgggtcctgtggctcaaggcctggctgctcatgggcattgtctgggaaactgttagaaatgcagaactccagcccaggaccactggagcagaatgtgtgttaacaagctgtccaggtgagccacaggcaggcgcaagttggagaggcagtggtctgaggactgcagtcatagaggacaccaaagtttctcagttttttgactcagctcagccagaggataaatgggatgggttgcccctcccatggggcgagggttggggagaagagagaacagcaagaattaagaactgcttggccaggcacagtggctcacacctgtaatcctagcactttggaaggcagaggtgggcgggtcgcttgagtctgggcgctagagaccagcctgggcaacatggcaaaaatccatctctacccccaaaaatataaaattagccaagtatggtggcacttgcctatggtcctagctacttaggaggctaaggtgggaggatcacttgagcctgggaggtggaggttgcagttagccgagatcaccccactgcactccagcctgggaaacagagggagatcctatctcaaaaaaaaagaatcgcttgctcttcctccataagaggttgtagcacatgagttctaaggtgtgtgacttttagcagctccccacttagggtttaaaataactttctggttgaaattttaaaaaaggaaagtaaggaaggaagaaaagggaacctcccactgcagcccacacaaccccaacaagaaaaggaggcctcctgctccccagcccagcctcaagcccacttaatctctctttggagacaggaacagaggaattgttcaaggagaaatcaagtgggaagctcttggagctgaagagcctgcaagccaatccacttcaagtttctcatgtaacaggtgggaaaatagaggcttggagaggggacatggtttgtccaaggccacccagcaagttaggggcagaagcagtgccagaatcatagaggcaggagagaccttgaaagcacctaccccagagttacaccttcgagggccccccagggaatgtctagaagaggcacagatcagctattccctctccactggccacaggccaggcacctgagccaagctgggcggatgagaatccatcctagaacttttgttggtcaaaggagtcatccatctttgcatctctccacaggtgtagagtctgccactttttaaaaataattgtatataaaattagctgggtgtggtggcatgcacctgtaatcccagttacttgagaggctgaggcaggagaatcgcttgagaggctgaggcaggagaatcgcttgagaggctgaggcaggagaatcacttgaaccggggaggtggaggttgcagtgagccaagattgtgccactgcactcctgcctgggtgacagagtgagactctgtctcaaacaaacaaacaaacaaataaataaataaaacaattgtgtacaatacacataacctaaaatttaccatcttaaccttttttttttttttttcctgtacagatggagtctcaccatattgcccaggctggtctggaagtccttgcctcaagtgatcctaccaccttggcctcccaaagtgctgggattgcaggcgtgagccactgtgccactcattaacctgtttgaagtgtacagtttagtagtgttcagtacattctcactgtcatgcaacaaatttgctacttttgacagacatgaatataagtttcttgaaacacttcttatactcctgtctaagaaaaacaacagtgaacaaagtgataaatggtaacagacactggtgcttggagccagggagacaagagggagtggtggaagctatggcaaacaggaaaacccaaaccccttctaggagacagtcactaatcagctccaatctgcttttgcctgcaggaatgctacatcatctatacaggaaaacacttaattttttttttttgagacagagtttcgctcttgttacccaagctggagtgcaatggcatgatctcggctcactgcaacctccgcctcccaggttcaagtgattctcctgcctcagcctccaaatccaaagtagctgggattacaggtgtgtgtcaccacacctagctaattttttgtgtgtatttttagtagagacagggtttcaacatgttggtcaggctggtctcaaactcctgacctcaagtgatccaactgcctcagcctcccaaagtaagaaaaacctgatttttttaacttttcttttcaaaactcaaaattcaaaacagttgaaaaggtacagaaaatgtctccctcctactacagtttcccactccacaggtaaccacaattactgatttattgtggataaagtgtctttataattatacaaacaaatagtaacataaacataccttttttccgtgttttatcccattttacataaaagagagcataacaaacacattgttttacaccgtgctttttaattaaataatctatcctaaagaatctttttttttcttttttttctttgagacagagttttgcgctatcacccaggctggagtgcagtggcacaaacagagctcattgcagcctcgacctcttgggttcaagcaatcctctcacctcagcctcccaagtagctgggactacaggcacgtgccaccatgcctggctaatttttttatttgtagagatgggggtctcactatgtcactcaggctggtctcaaactgctgggctcaagtgatcctcctgccttgacctcctaaaatgctggaattacaggtgtgagccaccatacccagccaagaatcttctttattagtacatagactatatgtatcctcattatttttacagttgcacagctgtattccaccatacggatgatctatttttttgcagtgtttttttgttttgttttgtttttgttgttttgtttttttttttagacggggtctcactctgttgcccaggctggagtgcagtggtgtgattatggctcattgcagtctcaaactcctgggctcaagctgtcctcctgctttggcctcccaaagtgctgggattacaggcatgagctaccttgactggttggatgacccatatttgatttaacccacccccatttagattgtttttctagactgttgcattttaaacaatgctgcataggtattgatagtgctgagcactatttacaatagcaaaggcatggaaccaacccaaatgtccatcaatgatagataggataaagaaaaggtggtacatatacaccatggaatactatgcagccataaaaaagaataagatcatgtcctttgcagggacatggatgaagctggaagctatcatcctcagcaaagtaacacaggaacagaaaaccaaacactgcatgttctcactcataagtgggagttgaacaacaagaacacatggatacaggaggggaacaacacataccagggccttttgggagttgcagggtaagcggggagagagcattaggacaaacacctaatgcacgctgggcttaaaacctaaatgacaggttgataggtgcagcaaaccaccatggcacatgtatacctatgtaacaaacctgcaaactctgcacatgtatcccagaacttaacgtaaaattaaaaagtaaaataaaataaacaatgctgcctgaataacctcctacatatatatttttcacatatgcaaatgtatctgtaactaaattctccaaattagaatttctgtatgtgcatttctaatatgtaaggaatttgcctacttgtcccctcatagtggttgtaccaagatccattcctgcagccatgtatgagggactatttttttcacaattacacaccttattgttttaatactgatttaaaaaactaaaacaaaacaaaataaaaataatgtgcgatacaaacaaacatgccagtgggccacatcaagccagcaggccccaactttcccaactccaactcttcaaagcccagaatgttgagtgactcgcctcaagttgcccaggacttgaatctgcactgtctgatttctatggctgcacctgatccgcttcccagctgactactaacttctgggatccctcaactttggcagtgagaaactgtggcttctgcaaagtcacgtggagcctttgtccgttcaaaaagttgaaaaagttccaatcttacttgagggtggtgactgtggatggggctgccccacatccaccaagtgccctgctctcagatgtcagcttgtgttgtgtaacaaccaaccgtaaaaatcatatttaggcagggcacagtggctcacgcctgtaatcccagcactttgggaggccaaagcaggcaggtcacttgaggtcaggaattcgagacctacctgggtaacatggcaaaaccctgtctctactatgaaaaatacaaaaattagctgggtgcagtggcaggtgcctgtaatcccagctactcaagagactgaagcatgataatcacttgaacccgggaggcagaggttgcaacaagatgagattgtggcactgcactccagcctgggcaacagagtgagactccatctcaaaaaaaaaaaaaaaaaaaaaaaaaaaaccatatttacttctgttcttttatccaagtgcttgaggaagcttaggattcagacagacttggagcgtcagtcctggctcaacctcctgcaagctgtatgattttgggtaatttacttgtccctcctaagcttcagttttcttaactataatatggagataataatagtctatattgtgaattgtgcttggtaatcacaccagacacaaaatatatacctttaaacattagagtcaggtccagctcaccaaaatactcaggctatgaaaggctgacaagattcagggcacctcggccgggcgtggtggttcacgcctgtaatcccagcactttgggaggccaaagcaggcaggtcacttgaggtcaggaattcgagacctacctgggtaacatggcaaaaccctgtctctactatgaaaaatacaaaaattagctgggtgcagtggcaggtgcctgtaatcccagctactcaagagactgaagcatgataatcacttgaacccgggaggcagaggttgcaacaagatgagattgtggcactgcactccagcctgggcaacagagtgagactccatctcaaaaaaaaaaaaaaaaaaaaaaaaaaaaccatatttacttctgttcttttatccaagtgcttgaggaagcttaggattcagacagacttggagcgtcagtcctggctcaacctcctgcaagctgtatgattttgggtaatttacttgtccctcctaagcttcagttttcttaactataatatggagataataatagtctatattgtgaattgtgcttggtaatcacaccagacacaaaatatatacctttaaacattagagtcaggtccagctcaccaaaatactcaggctatgaaaggctgacaagattcagggcacctcggccgggcgtggtggttcacgcctgtaatcccagcactttgggaggctgaggcgggcggatcacgaggtcaggagatcgagaccatcctggctaacatggtgaaaccccgtctctactaaaaatacaaaaaactagccgggcgtggtggcgggcacctgtagtcccagctactcgggaggctgaggcaggagaatggcgtgaacctgggagacggagcttgcagtgagccgagatcatgccactgcactccagcctgggtggcagagcaagactctgtctcaaaaaaaaaaaaaaaaagattcagggtacctctctcacttgttctcctccgtgacataccttcactgagacaagagcagtgggcagaatcatccacatgcgtcacaccatgttgtggttttttttcactgagcacatagagttggatacgtataagttgaatatacatgtaaagcaattcctttctatatttgcagtgtttgtgcaactagattgtacactccttgaaggaaggaattgtcttccagttggcaagacaggcttgagatcaactaagtattttacaagacagaacaagataagtggccgggatcggcagctcatgcctgtaatctcagcacttggggaggccgaggcaggcagatcactagaggtcaggagttcaagagcagcctggctaacatggtgaaaccccatctatactaaaaaatataaaaaattagccgggtatggtgccaggcacctgtaattccaactattcaggaggctgaggcaggagaatcacttgaatctgggaggcagaggttgcagtgagccgagatcgtgtcattgcactccagcctgggcaacagagcgagactctgtctcaataaacaaataaataaataaataaataacaaaataagcaatgggtacaaagtgccatgaggaaggacaacctgttcaaacagagccccggaagtatttccggaggctcctgagtcagccctttcaggagggtaagaggatgaaagaggaagtaacatttactcaacagcaatttgctgggcactctgtttcctgattttatttttttctgtttaattttttttctcttttcaaaataacaccatgtaccagtcagctttggctacataacaaactctcatttatttcttgctcatggatctgtggattttctgaggagatgctgttggtctcatgagctcagctgggcctctggccattggactcagctctgatctaccctgcgtgtcactcatcctttgggacttgtgggctactcagggcatgttctcagtatcatgaaagccaggcacacaagggaaaagttcacctccactgtacatttcaaacctttgtttggttcatgtccactgccatctcagtggccaaagcaagtcacatggccaagactaaagatgagatggagaagtccattcattccagggaaatggaagaggaaaagggaaatgtttgctctacggcagtctaatctacagcaacaagtaatacaggagtgcagtcttattaaaaattcaagcaagaggccgggtgcagtggctcactcctgtaatcccagcactttgggaggccaagacgggcaggtcacctgaggtcaggagttcaagaccggcctggccaacatggtgaaacccagtctctagtaaaaatacaaaaaaaaaaaaaaaaaaaagccggtatggtggcgggcgcctataatcccagctacttgggaggctgaggcaggagaatagcttgaaccctggaggtggaggttgcagtgagctgagattgtgccacttcactctagcctggatgacaatagcgagactctgtctcaaaaaaaataaataaataaaaattaaaaaaataaaaattcaagcaagaaaatataaaagcacaacaacagcggaaaatacgtcaccatgctcctcatcccaccatcttccccctactccctagaggtaaacacttttcccaggcgtttacacacagagaaagctattttgcccccttggtgccgagacagtcttgctctgtcacccaggctggattacagtggggcaatcgcagcccactgcagcctctacctcctgggctcaagcaatcctcccatctcagcctcccgagtagctgggactacaggcatgctaccacacccaggtcagaaacgtttacttaatacaatgagatcattctacatgtatttgtacctgacaattataagcatctagtcatgtaattattatatggactctacaattaggcatttggggtcaccattttataaatgaggaatctggggttaaaatgcttatccaagatcacccacctcttacatagctgaaccagaattcgaacccacgactttccaaaaattcttttgatttacagtgagctgcctctataaaagcacaagaggttgcaccacaaaacctgttgttatcagccccctacatttatcctttgggaccacagaggaggggtgtccgtgtgtgtgtgtgtgtgtgtgtgtgtgtgtgtgtgtgtgtgtgtgtgtagggggtgggtggtgtcgtgtgatttaggagagtgttcactatgactagcgttgtggcgggagtttgggagacatgatgaagaggaggaaagaccttcaccctcaggtcacttacaattaagccaaagaaaccaggagcctctcttgaagcagtttaataagatggcaggatgtggccaggcatggtggctcccacctgtaatcccagcactttgggaggctaaggcaggcagatgacttgaggtcaggagtttgagaccagcctgaccaacatggtaaaacccggtctctactaaaaatacaaaaattagctgggcatggtgacacacggctatagtcccagctacgggggaggctgaggcaggaggatcacttgaacccaggaggtggaggttgtagtgagccgagatcacaccactgcactccaccctgggcaacgggagtgaaactgtgtctcaaaaaaaaaaaaagaaagaaaagaaaagatggtgggatgtgctagtgtaagccttgggtacccatggggagttttattatctgtctgtctcaaagctgtcccttgacagagagctcagccagaagctagtatccctgatcagagtttggggaggacacaggtcttagccatcttcccagaaaatgggtaagactgagcgaaaggagaaagaacgtactctcacatgaagtgggaacagtgacaaatactacagtcttcagcagcatccggtgtgacatgagtgtgcgctcagggggcttcattcagactgggtgtcagggaaggtttcttggggaatgaacattccagccaaaacctgaaggccaagtgggaagcagctgaagaacaagggaagagagatccccgcagagggaacggcgggtgcgaaagcattgaagctggagagggctgggcattgtagacacagaaaggagggcagcagggtaaggatgactgtgaggaggaaaggagaaggctgagcagctggcagacgctgggctgtgcagggacttgagctaagctgtttagggaaaggtgtgacatgaccacaagctggtgccagagtgaccacagaagagtggcttcctgggcatctaagagggcacagtcagggcggtaagtggcttagaagcagggccgcgatcagtattgtgtacgttgtgtgatgactctggaggggactgaatctgggtatgcagctaaacattcaagttctcaaaagcgtgtttcaaatagcaaaactggagaagccctttaatggagtttgaaaaaggcacaggagagaagtctgacgtgtttcagtgcagggtaagggaagaagtggggagggattgggtttggagggtgtcacgaggcgacaggtgagccgaacaaataggacattgctaagcaaggctgggaagaaagggacgacgggcagaaggcacagcaaaggccaaggcggggtgtttggaacatgcccagctggtgtggagaagagactgggaaggattcaagctcaggctcctggaggagaaaggcataggggaatgctggaccgttcacctgggggttggttatgcagagcctccgatgcctgacatgggaacgagggagtggcctgatcagatggttcgtaataacttggcagattcacctcctgtgctctctcaccccaagggacttgagtgagtcattggggcccttcctcctctccctccacacaaacacacgacttttggggaggccaaggtggcagatgggggtgatagatcctgtaatcctatccccagtccaggggtcaggaagttctttccccagcaggctcccacccaagactgctgttaagactgaggttggagaagtgtttttctcatccacccagcctcaggtgggcaggacgggagccaaccagagccctctggagacagttctgtctgtgggatccgccctttggaggacacaaatgaaacccaatgcaacataaaagatggcaagaggtggccaagtgcttatcttatcaaacaaactgctccttggaaccaaagaaagggaatagagctttgcttgttttctctttttatcttcctgattaattgccagcaaggggtctgtgggatgggtggtggttgagggcgactcttggatgtgtgatctcgcctgggaggcaggtaggtttcccagtcaccctggatttttaacattttcttgttggaagtcacatcctcaagcaaactcttaggcactatttagggagcactccccaaacagctccattatggcctaaatattcttgggaagatgaaaaggggaaaagactatcattgctcaaaacaagtctataatctagatggaagcaggtaaagaggcacaatatttaccatcttttatttttacagggtctttatctatttccatcacttaaccatgagctctttgggaaccagaacccagtcagaaccattggggtatctgaatctggacccaagcatgtagtggggctcagtctacctgtcacctcattcaggattctttcagttgtaagtattagcaactcagctcaaaaaggcttcattgaaaagtatgatatataggccgggcgcaatggctcacacctgtgatcccaacactttgggaggctgagacgggtggatcacctgaggtcaggagttcaagaccagcctgaccaacatggtgaaaccccctctctactaaaaatacaaaattagccaggcgtggtgattcacatgcctataatctcagctactcaggaggctgaggcaggagaattgcttgaacccagaaggtggaggttgcagtgagccaagatcgtgccattgcactccagcctggtcaacaagagcgaaactccatctcaaaaaaaaaaaaagaaagaaaaaaaagtatgatatattaactcacggaatagagaaatccaggtctagaatgacttcaggcatggatagatctaggagtcaaagaacatcaccaagatcagactttcttttccctcagcacttttttctgcactctttgtgccagcctcagttagattctaactcagtggtggctctcagtggcaaaatagcttagcaacaccagttgggtttcttttctcccaatagtaatagaaatgcttaaactggctctagctggatcagtgtgggtcacatgctgatctctgatacaatcactgggcagggaaatgggctacactgattggcctggtgtaggccccatgtccatttcatatttgttacattaataaatacgaaagattagagacagcaataaaacattttacatttgaacaatagagcaactagagtgatcctttttaaaacctacaacaaatcatttgactcctctgctctaaaagctcctcactcagaacaaaagcccaagttcttcagaacaaaagcccaagttctgagccaggcgtggtggctcacgcctataatcccagcactttgggaggctgaggcgggcggatcacctgagatcaggagtttgagaccagcctggccaacatggcgaagctccatctctactaaaaatacaaaaattagccgggcatggtggtgtatgcctataatcccagctacttggaaggctgaggcaggataatcgcttgaacccaggaagcggaggttgcagtgagctcagatcacaccactgcactccagcctgggcaacagagtgagactctgtctcacacacaaaaaaagcccaagttcttacaatagcccacaaggccctacccaacatgcaccctgccccaaccccagttattcactgacctcctagtctccccttcgttcactctgctccagccaggctgctctccttgcatagccacaaaaagtatacatgcagtagcctcattttctttgctaataaaatgagacctcttctagtagacacctgatactttgcccagaattcccctttttctttttttttgagatggagtctcactctgttgcctaggctggagtgcagtggcacgatctcggctcactgaaacctccacctccctggttcaaacgattctcctgcctcagcctcccgagtagctgggattacaggcacgtgccaccacacccagttaattttttgtatttttagtagtgatgggtttcactgtgttagccaggatggtcttgatctactgaccttgtgatccatccgcctcagcctcccaaagtgctgggattataggcatgagccaccgcgcccggccacattcccctttttctggcaactctctggcatctgccctaccacaccttccttccatgtgttttaggaagtgttgacctatcccagatccagagatggacgtgtgacttaggcctggccaatcagaacatccaacagcattccagaaccactcatagcatgtggttcagggatgggcatgtgacccaactcaatctaatgagattcaatcctgaacctttattgggatgattagaaatgaaaagctttctgtatgttgatattattagaaggataatggaagtattgaggctcccaagccacccgctggagagaaaactcacttgtgagtaaaatcagtgccagggaaagcagagcggtgaagcaggaagaggaaaactgagttccggtgacatctttgagcccctggattcagccatgcctgaatcccactagacttttcagttacatattgtagtaggtacccttctttgctcaagccattgtgacttgggttgtagtcacttgtaaccaagagaccattttgaagggctgctattgcgaggattaaatgagatggtgaattacatgaagtgtttagtacaatacgtgctccaaaagaaaaagtcattattattttgcagtttcatcttccatacacatatttaaatctgttttcccttttacgttctttacctaagaaaaaaatgtttaaacttatctataatcaaagctggtattcacttgggaccagtgtagttatactggttatttaaatactgaaatacattcataatagttgataaacagtactgttctgaatctcccacatgctctgtggctctccagaatgcacccaactcgtctgttggaatcctctagctcattctactatctagcacctaaaaggttaacaccaggtctagcagggcctcctgtattctgtttatgattagcgtctcattcatgctacatatttttaatatcacctctgggtacatctgtcaactcgtcaatatgcctgcattaaatggaaacactaaattatcaacagctccatgaaataagacccttactcccctccaaatcaccaattattgataactatgtaacctcttctgatcctaaaaatgccagagacataattatgcacagtggtgacaaagcaggcatgggcaccaggccaagtcctatctttccccttcctgttactttacagagcctctacccttatttctacatcatggtcatatttgtcattcctagttgcaatctgatattcctttgttttaatacactatggctggcctaactcttcctccatggtgggacatatggtccatttttgttcagcttttcaaatgttaaaaactcactctgctggaaattgaatttccatgtggtgcccatctttctggtaataagccatggatttccttcctgattcaaacttcagttttgtgaatcacaagacacagtttaactttttgtctgcaaatgttttctgttgctgttctttgaaataagaacccatgtgctcaattgtgtaatgctgtagtttaataaattattcattttgactctaagtccacaaaggactcaaagtggtttatacaaatatatacaccttgaaatcaatacatgaggtggtcaaggagaaggaaaaataaggagtagtatatccgattggtattgtgttcagctgctggtaagagagaccaggaataacagtggcataaacaccacagatgtttatttttctcttacacaaatgaaatctagagagaggaaacccagagctgatgtggtagctccacaaaattgaggatacgatctctttctatcatcctgcctcactatccttagaatgtggcctccatcctaaagtccacctcgtgctgcaggatgactgcaggagctccagctattgcagccacatttcgggcagcaagaagaaggaaatgaaaaaatcctgtaatcccagttttctttaaggatcattttggaagttccagcccaaaacttcagcttacatataattggccagaatgtagtcctagctacaaaggaggctgagaaatgtaatctcttagttgtgcctgatgccaccccaaataaagttcagggcttatttactaggaaagaagggcaaatggataatacataggccactagtcatttctgccacaggtaagaaaatgaaataaagcgagacatttagctggttcacaaaactgcctactataaggacctttaaggtgtccagctgccaaattgtctctgagaatcctagtaatgatagcagaaggggaatctatgactaaatactaagtgtaatatctaagcaaagagagcaaaccattgctaaaaaaaaaaaaaaaaaaaaaaaaaaaagcttcttttctcaatacagagattaaaaagcaactctacccacaggtctttgtgaggaagacatgggacatgtggacgatatcctcacaatatttctgcaataatgaaacaacatgattctgggacttgcttcaaatattcagcgtgggggagtgggtaggagtatagcgaaaaccagatgggccatgagttgataattgttggactgggtgatggagactgctttgttatatgtttccctttactgtggtgtacatttaacatttttccataataaaaaaagaatttaaacccagcaataaatcctttccaacaattgctttttaaaatgctccttttaataaacttgcttttaagttcaattgacaggtggtttttatcataactcctccctcatatttttggcctttgtatctactgtccttatttattaacttatttttaacagttttattgagatagaatttacatacaattcattttttttttttttttgagacagggtctcactctgtcacccaggctggagtgcaatggtacgatctcagctcactacaacctctgccttccgggttcaagggattctcctgcctcagcctcctgagtagctgggtctacaggcacctgccacgacgcccagctaatttttgtacttttagtagagacggggtttcaccctattggccgggctggtctcaaacgcctgactttatgatctgcccaccttgccctcccaaagtgctgggattacaggcgtaagccacagcacctggcctacaattcatctttaagtgtgcaattcaatggtttcttgtagttgtgcaaccatcactacaatctaatttcggaatgttttcatcactctcaaaagaaaccccatccccatctctacccatgctcctttccccacccccacccccagccctagacaactactaatctactttctgtctctatgcactcccctattctgtatatatcatacagatcatcatacaatatgttttttatgacgagcttcttccacttaacatgatgtcttcaagcttcatccatgctacagcatgtatcagttctttataactttttacagctaaagaatattccattattttgatatacattttgtttagacaaccatcaattgatggacatttgcattgcttccaggtttggggtattatgaattatgttgttaagaatcttcatgttgctgggcgcggtggctcacgcctgtaatcccagcactttgggaggcggaggcaggcggatcacgaggtcaggagatcaagaccatcctggctaacacggtgaaaccccgtctctactaaaaatacaaaaaattagccgggtgtggtggcgggcgcctgtagtcccagctactcgggaggttgaggcaggagaatggcgtgaacccaggaggtggagcttgcaatgagccgagatcgcgccactgcactcaagcctgggcaacacagtgagactccgtctcaaaaaaaaaaaaaaaaaaaaaaaaagagagaatcttcatgtttctatgaagtttctatgtgtatgtatatttttgtgtctctggggtatatatacctaggagtagaattgctgggttaaatggcaattctatgcttaatattttgaggaactgccaaactgttttccaaagtggctgtggtatcttacatttttgccagcaatatataaggactgcaacttctccacagcctcactgacacttgttattatctgtcttttattttatcctcactagtgggtgtggactggtatttcattgtggctttaatttgcattttcccagtgataataaatttaatcatcttttcataagcttattggtcatttgtatatcttctttaaaggagtgtctattcaaattctttgtccatccttcagttgggttgtcctttttttttttttttttttagatgaagtcttgctctgtcacccaggctgaagcgcagtgatgcaatcttggcccactgcgacctctcagcctcccgggttcaagcgactctcttgcctcagcctccaggcagctggaattacaggcacatgccaccacgcccagctactttttgtatttttttagtagagacggggtttcaccatgttggccagactggtcttaaactcctgacctcaggtatctgtccaccttggcctcccaaagtgctgggattacaggcatgagacaccgtgcctggcccattgtcttttcatgatcaaaaccacaaatagaaagggcattgtaaaaaatcccacagctaacatcatacttgatggtgaatgaatgctttccccctaaaattagcaacaagacaagatgtctgctctcattgcatctattaattattgtactggacattctagccagggcaattacataagggggaaaaggcatccagtttagaaaggaagacataaaattttattctactttcagatgtcttgatcctgtatattataaatggcatggaatccactaaaaattgttagaattaataaacaagcttagcaaagctgtgggatataagatcaacatacaaaaatttatctctatgaagtgtcaatgaaaaatcagaaaataaaattaagcaaacaattcattttacaatagcatcaaaaaggataaaatacttaggaataaatttacagaagtacaaaacttatgctgtgaagacttgaaaacactgttgaaatattaaagaagaccgaaataaaaggaaagtcattgcattttcatggactgatagacttaatattatcaatgtagcaatactccccaaactaatctacaggtttaaagcaattcctataaaactcccagctggggccgggcgcagtggctcaggcctgtaatcccagcactttggggggctgaggtgggcagatcacgaggtcagcagatccagaccatcctggctaacacggtgaaaccccgtctctactaaaaatacaaaaaactagccaggcgtggtggtggacgcctgtagtctcagctactcgggaggctgaggcaggagaacggccgtgaactcaggaggcggagcttgcagtgagccgagatcaccactgcactccagcctggacgacagagcaaaactccgtctaaaaaaaaaaaaaaaaaaaatcccagctggtttctttttagttggctgaccctaaaattcatgtggaaatataagcaacccagaacagccaagacaactttgacaaataacaaaattggaaaactcacaattcctgattttaaaacttactataaggtcacaataatcaagacagtgtggcgttggcataaggatagacagataagtcaatggaacagattaagaggacagaaataaacccttacatttatagtcagttgacttattacaatggaaccaaaatagtttgatgtgacaatataatcttttcaataagtggtcacgtgaaaacaatgagtttggactccttcatcacatcatatgcaaacaataactaaaagtggatcacagacctaaggataagaactaaaactataaacttcttagaagaaaacattggaataaatatttgtgactttgggtaaagcaaggccttgttacatatgatgtcaaaaaatataaatgactaaagaaaaacaatagatacattggacttcatcagaattaaacacttgtgtttcaaaggacactatcaagaaagttaaaagacaagcaactgaatgggaggaaatatttgcaaatcatatgtgataaagggcttatatccagaatatctaaagaatacaacccaatagtaaaaagacaaataaaccggcagggcacggtggctcatgcctgtaatcctagcactttgggaggcagaggtggatggatcatttgagatcaggggttcaagaccactacacctggcctaaatcctgggttttaaatctggataatgtccatgcatgaaagagcctgaccacctgtgttggacccccaggtccattatacctagctgtgtgacctcaggcaaattactcaacctctctctgcttttgttatctcatctataaaatggggataaatatagtagtaccacttttagggatgtttgaggagtaaatgagttaacgcatataaagaagagcataataaggagtctaatactagccactatcatcatcatcactataggtcatttggatataacagatacagccctggtacaaacattgtcctgtttcactgtcgtaggtccagcacctaaaagagtgtgtgtggcatattgcaggcgcttaataaatatctcttgaataagtacatgacagcgaatacatgaatgaatggatgaagaaaatatgggtatagtagagctttggtttaaaagtggaagatgacaacaccaaatgctggcaaggatgtggagcaacagaaactctcattcattgctagtagtaatgcaaaatggcacagccacttctgaagacaggttggcagtttcttacaaaactaaacctactcttaccatatgatccagcaatcacactgtttggtatttacccaaaggaattgaaaacgtatttccacacaaaaacctgtacatcatgtttatagcagctttattcatagttgccaaaatcttggaagcaaccaagatgtcctccaataggcaaatggatgaataaactgtgacaccttcagaccagaaactttaaaaacaggggtcgggggtgggggcactatcaagccgtggaaagacatggaggaaacttaaatgcatattactaagcaaaagaagtctttcagtctgaaaggctacatcctgtctgatttcaacgacatgacattctggaaaaggcaaaactatggggactgtaaaaagattagtagttgccaggggttagagaaaagggagagatgaatagttggagcacagaggatttttaaggcagtgaaattgttctgtgtgataccataatggtggatacatgccattatatgtttgtcaaaacccatagaatgtgcaatcccgaaacctaatgtaaactatggactccgggggataatgatgggtgataataatgtgtcaatgtaggttcatcagttgtagcaaatatattattgtggtgcaggatgtcagtagtaggggaggttgtgaatatgtagggatgggggtatgttgaaaatttctacagaaattctattttccactcaattctgctgtgaacttaaaactgctcttaaaagtaaagtttattcattagtgtaagaaattctggaagcctccgtggtaaggccagtcacacgcaggtgctctgatgtaccctagcactggtcatccagagattgggcttctcacttccttctcctggcagtgggccacttgcacagccaaagctaagaacagaagcctggcacacccccaggcgctggccaggccacccttagtgagccaaatacccccaccatggaaccactgctcagctgggtctggccacccagaagcacttacaaactctctgcatctatgtgtgaccagaagcctgatctccccaggcctcatggtggtgtttttaaagaaagcccccagaagctaggcccagacaaaatcagttcccaaagggacaaaggcgctcagtctcacaagttaagtaaaagacaaaaacagaagcaaacatttatatagcattaagcttgtgtctgcactcttcttagcttttacaaacataaattcatttaactttctccacaatcccacaaggtagggactagtattatcaccatgttacggatgaagaaactgaggcacagaaaggctaagtcagtagccataaaaccagtcaatctgttaacatgtcagagctgggtggtgaatccaagcaggctggctccaagaccctgttgatctctctgttgttctcccttccatgtacacagtactttacagtttgcaaaatccctttagcaatatagtatctcatttaagcctcacaaccatcggaggtaggtagggcaggtaatactatctttaagaggaatggcaatgagggaacagcaaatgaggaagctgaagcctagagaaggtaggtgatttgcccaaagttgcatgataaacagcaaaggctctggaggcaggtggcataggttcaaaccccagctattactgatcagcctcataatcttgaacaagttaatacatacctccgtgcctcagtttccccatctttcttagagtttttatgaggattaagcaagtcaatacatggaaagcactttatttaaaatgttggtggccaggagcagtgggtcacacctgtaatcccagcactttgggaggccaaggcatgcggatcactttgagctcaggagtcagagactggtcaacatggaaaacatggcaaaacctggccaacatggttgactcagcctggccaacatgacaaaaccctgtctctacaaaatatacaaaaattagccaggcatagtggctcacacctgtggtcccagctacttgggagactgaggctgaaagacagcttgagcccgggaagcagaggttgcagtgagccaagatcacaccactgcactccagcctgggcgacagagtgagaccccaactcaaaataataaataaacaaataaataaataaaaataaaatgttgtttgccgggtgcggtgattcacgcctgtaatcccagcactttgggaggccgaggtgggcggatcacgatgtcaagagatggagaccatcctggctaacacagcgaaaccccgtctctactaaaaatactaaaacaaaattagccgggcgtggtggcgggctcctgtagttccagttcctggggaggctgaggcgggagaatggcgtaaacccgggaggcggagcttgcagtgagccgagatcacgccgccgcactccagcctgggcgacagagtgagattccgtctcaaaaaaataaattaaataaataaataaataaataataaaatgctggtattttgggccaagcactgtgggtcacacctgttgtattaggttttcacactgctgctaaagacacccgaaactgggaacaaaaagaggtttaattggacttacagttccacatgtctggggaatttctcagaatcattgtgcagggcgaaaagcacttcttacatggtggccgcaagaaagaatgagggaagaagcaaaagcagaaacccctgataaacccatcagatctcgtgagacttattcactatcacgagaatagcacgggaaagactggcccccatgattcaattacctccctctgggtctctcccacaacacgtgggaattctgggagatacaattcaagttgagatttgggttgggacacagtcaaaccatatcacactgtaatccgaacactttgggaggctaaggcaggtggataacttgagtccaggagtttgagaccagcctggacaacatagtgaaaccccatcgctactaaaaaaatacaaaaattagctggccgtggtggtgcactcagctactcgggaggctgaggtaggagaattgcttgaacctgggaggtggaggttgcagtgagccaagatcgcagcactgcactccagcctggcgacagagcgagactccaactcaaaaaaaaaaaaaaaaaaaaaaattagccaagcatggtggcacatgcttgtaatctcaactacttgggaggttgaggtgggaggatctcttgagcccaggaggcagaggttgaagtgggccgagattgcaccaccacactccagcctgggcagcagagcaatatcctgtctaaaaaaaaaaaaaaaaaaaaaaagccattttgtttgtcatggatttttgtattcatttcgattttggtaaatattgcattacaaatactttatcttaattaccaagtttgttaacgctcccttaaattttgtctggcttgcttcaccctagtcctggccctgctttgcatgggggaatcctttaatacacactagctagtgtcatcccactacttgttgaatgctaactatatgccaagaattgctgttagaagttttataagtatacatcacctcaacaacaagaagaagaaaaatcagaaaccaagttgaaaagcaagtgacaggacaggagaaaatatctgtagtttatacaggcaaaagattggtgctcaaaatatataaagaactactacagattcatttttaaaaagacaaactacccaatacaacagcaggcaaaggacagaaatgggcagttcaccaaagaggaaaaacagatggtcagtaaacatatgaaaaaaactttagcctcactggttatgaaatacacatttggaagtgtgatgttatcaagggttgggaagagtgtaaggaaatgggattataaactgattataaactgatatagcctttttggagggaaattcaggatctctattaaagtgaaattgcatacacccactgactgagctatttcacttttgtctgcgccagagaaacacgtacacatgtgcatgaggatatttatcaaaactttgctctgaatggcagtaagttggaaacaccctaaatgcccctcaaaaagggaactgatcaataaaccacagtatagtcattctatgaagtagaagctacagggtttatttttaaggtagatcatgctattaattttggggtgcaaaagcaagtggtagagccatatgcactgtatgttgccacttgtgcttgcaaaaacaaccaggaaaaaaacagtactgaagaagttctcattggccgactatccaacagtcattgccttcttctttgctaataatctccaactttgtctgggtggcaccgtgccccatgccagggaaggaaccaccttttgtctcagccaaccttagcagtccttctcctatctgggagcccagtccaggccaggagcagcatctcccatcattagcccgggtctacagaggccagctcccacccctgaaattgtcacccacacatgtcttaagggtttggaaaatagagcatcttctgggctctttggcagaatggacttgccgggtgggttttttcacttcattcctgcaggcctgcctctctaggtctttgcttccttcctccatgggcttcaggggcagatctgacgtttctaccacacttggtctgcaccagcgtttttccaagctgccctcctgggagcatgtgagcatcatctcctggggaaatgccagggtgtttgagcctgtatcccaggacagtgctcctgaatgataaactctcccttatccaataccatatttcctccctgcactcctacccctccatccgaaaccttctggatccatttcctccacaatctcaagctcccatcagcacttatgacacaaattctggagcccctttggtgccaaatccctcagcatcccagaatatctaccagttgggctgtgcgggaaattgactcttgttattggtctggtggccagcaagggagaaatagatcattcttgttggttggttctccatctcctggaagtgttcaagagagattggaagggtccttggcaggtgatgttgactccagcctctgcaatcacatagccctaggttctagtcccagctcaagcatttcctagctgtgtgcctgtgggaattcacttaacctttgtaagcctctgtctccacctctgtaaagggcaggaaataacagcatgagccttgcagtgttgttgcaaggattaattgagatggcatcttcaaagctccctgcagagggcctgcctggctggctaagccacttggataggcccttcccaacaaacttgagattctataaataagaagaaatgtggctgggcacagtggctcatgcttgtaatcccagcactttgggaggctgaggtgggcggatcacttgaggtcaggagttcgagaccagcctggccaacatgaagaaaccctgtctctactaaaaatacaaaaattagccaggcgtggtagcatgtggctgtaatcccagctattcagaaggctgaggcaggagaatcgcttgaacccgggaggtggaggtttcagtgagccgagatcatgccactgcactccagcctgggtgacagtgaaactgtgtctcaaaaaaagaagaataagaagaaggagaaggagaagaaggagaaggaagaagaaggaagaataaagaagaagaacaggaagaggaaggagaaggagaagaagaagacaaagaggaagaggaagaggaaggagaaggaggagaaggagaagaggaagaagaggaagaaaaagaggaaaaagaagaggaagaggaagaagaagaaaagaagaagaagaacaagaacaagaagaaggggaagaagaagaagaagaagaagaggaagaggaagaagaagaggaagaggaaggagaaggaggagaaggagaagaagaggaagaagaggaagaagaagaggaaaaagaagaggaaaaagaagaggaagaggaagaagaagaaaagaagaagaagaacaagaacaagaacaagaagaaggggaagaagaagaagaagaggaagaggaagaggaagaagaagaagaagaagaggaagaagaagaagaggaagaggaagaagaagaggaagaatgcttcctagaaccagttgggaattgaaagcagtatctggagttgggtgagaagaagaagggacttgaaggggcaaaggaaactcaagctttgttcagctgcagttgtcaagtgtgctgggctctccccagggaagacacccacctgctggggatgacacaccttgccgggaaaacaaggtgctggtgtgtgcagtggtacagggcactgaaaagaacgtggcctaggacacggacagacctggctggcttgagccccttatgagcctcaggcttggagcaagtctctgaagcacaacttctcagccattgctctatggacagtgacagccagatcactctttgcagtgggggctgtcctgggtattgtaggatgtttagcagtatgcaccgtctctacccactaggtgccaggagcagctcctccccccaagttgtgacaactaaaaaaatgtctccattgacattgtcgacattgccaagtgtccccaggggcacaaaatcatccccagttgagaactacagctttaaatctaattaagccttcctggtcaaattgggataacagtgatagtaatactgccttgtatggtggctgtgaggatttccttccttccctccttccttccttccttccttccttccttccttccttccttccttttctctttctttctttacttttagagacagggtctcactttgttacccaggctggagtgcagtagtgcaatcatggctcactgcaccctcgacctcctgggttcaaacgatcctcctgcttcaccctcctaaatagctgagactacaagcatgtgccaccatgcccagctaattttaaaaaatttttttgtggagatgagggtctcgctatgttgcccagcgtggtctcgaactcctagcctcaatccatcctcctgcctcagcctcccaaagccccgggattacaggtgtgagcccctgtacctagccagggcatttcttgagcatttactagatgccagtggctgtgctcatgctttcatgcatcagctcccctcctcccatagcccatcccacatggtgcttttaccctcatcctccctacatagatgaagaaactgtaaacatctttcttttcatcacattcacattcaaccaatacctcccaaggaagggcctcttatgtgccaggattctgggagggattgtggcacatatgtaatctcactggtttctgggtgggtttggctagttgagaaccactcacagtagaccgaagggtgaaaggaggggagaatccaggatattttctctcgttctctctctctgtgcctccaaagcatcatcagcagctgctgtgcctcatctgtggctgcagatccagctgtacagtctgtcccttggtgatcctggatctagctgggcaggccatcaggattctgtctcctgccaggtggcccagcttcaacttcacagcatggtagcaccaactgttctctgctcctcccccaacaaagatggcatcatcttcctgctatggtttagcactgagttgtctaacatgccatttggcttctcacttctatcatctgtgtgaccaattccttgtattatattccctctatttgaatacctagtgggatttctgcttctctgattggtctctgacggctccatatgagatttggtttcctagttcatgctcttggacaccacaataatcagctctttgctgtacatggagtatatctcctgaatataaagataaatgtgtttgatagatgtattagtcaggactcttttgattgcaagtgacagaaaaccagccttaattggtttaagcagaagaagggaatttattggcttatgtaactgaaaagtccaggggatgtttggcttcaggtacagtttgatccagcaactgcaatgctgttgtcagtatgtctccatctctagctcttctttcctctgtgttgacctcatgcttaggcaagctcttccactaaggtgacagacaatggtttcagcatcaacaaacctacacccttcaagtttaccaacttcagtagaaagtcctctttctcaatatttccagctgaagtcccaggcaggattctcattggtccagcttggaacacatgcctgtttctgagccaattactgtgacaaggcaagatactgggttatacatcgaacccctgcagctggacagtggggtcagcatcccccaaaccacaaagtccaagaatgggagtgaggtggttcctgagaatagtgaaggggtgttgttaccaaacatcaatgcatgtgcactgatagatacatgttatttggtttactcgatggtgatgccgagctaaccagcagatcaggaggagcagaagattagcaatcagaagacccatgtttgagctcagggtcttcaggcacccttctctgaactgcaattttctcatgcataaaattcaacaaaaaacaataaccggccgggcgcagtggctcacgcctataatcccagcactttgggaggccgagatgggcagatcacgaggtcaggagatcgagaccatcctggctaacatggtgaaaccctgtctctactaaaaatacaaaaaattagccaggcacggtggcgggcgcctgtagtcccagctactcgggaggctgaggccagagaatggcgtgaacccgggaggcggagcttgcagtgagccaaactcacaccactgcactccagcctgggtgacagagcaagactccgtctcaacaacaacaacaaaaataataataataataataatcacaaacattaagtgaatggcaattatataccaggcacttatgtaggctccagaaatacagacgtgaaggaaagaaaaatagagtcaatatcccctgaagtgcacatgtagctgtaagaactacttgagattctttgtgcaaaatgcctcgctgagcccctatcagggcctcagaaggtagtggttgagttgaagtttgaagaaaagagagaaaggcccttataaagtatagactactatggcaaaggctgagaggagtacaccgtggcttttctccgtttctaccttagttaggctcatggttgcctggaattaagactacacgtgactggcctggtgcagcgactcacgcctgtaatcccagcactttgggaggttgaggcgggcggatcacgaggtcaggagatagaggccatactggctaacaaggtgaaaccccgtctctactaaaaataccaaaaaaattaggcgggtgtggtggcaggcgcctgtagtcccagatactcgggaggctgaggcaggagaatggcgtggagccgggagacggagcttgtagtgagccaagatcacaccattgcactccagccctggcgacagagctagactgtctcaaaaaaaaaaaaaaaaaaaaaaaaaaagactacacatgactaagttgtagtcaaggggatgtgtgtgaaaatgtagtatggaggggagctgggagtggagggggcagggagtgttctttttctgtgtgagacggagtcttgctctgttgcccaggctggagtgcggtggtgcaatcatagttcactgcagcctccaattcctggactcaagtgattttcctgcctcagcttcctgagcagttgagactacaggcacacaccaccacaactggctaatttctttaatttttttttttgtacagacagggtctcaccatgttgcccaggctggtttcaagcacttggcctcaagtaatcctcccattttggcctcccaaagcgctgagattaaaggtgtgagccaccacgcccagccaagggggtgttcttaaaggaagaaacgaggcacctaggtgctccttcggcttccctggtacctgaaatgtgcataagatgacagctggcagagcaggcagcttggaccatgaggggttaactactggatcttgcccctcatttctctcatcttttttttcttttttcttttttgagacagagtcttgctctgttgcccaggctggagtgcagtggcacaatcttgactcactgcaacctctgattcctgggttcaagtgattctcctgccccagcctccccagtagctgggattacgtgtatgtaccaccatgcctggctaatttttatatttttagtagagatggggtttcgccatgttgcccaggctggtctcgaactcctggcctcaagtgatccacccatcttggtcccccaaagtgctgggattacagaccttagccaccgcgcccagcctttctctcatctttatgtgaaaaaatgtctcttgacctcatctccagctataactccatctctttccttctctttgcagcaaaactcaaagagtctatatctcaaatttctctcttcttactcacccccgccctgcatgtggctctatcccagggtcacttcaaagtcctcatccatcctggacccctcagcagcatgtgacacagttgctctctctctcctttttcaaaaagtttggtaaaatatacataacataaaattgaccattttaaccagtggtattaagggtacagttccaatgagaagagttggacacagggcggggaacatcacacaccggggcctgttgtggggtggggggatgggggagggatagcattaggagaaatacttaatgtaaatgacgagttaatgggtgcagcaaaccaacatggcacatgtatacatatgtaacaaacctgcatgttgtgcacatgtaccctataacttaaggtatataaaaaattatctgataaataactttaaaaaagggtacagttctgaagcattaagtacatttgcactgttttacaactgtcaccaacatccacctccaaaacttttttgtctcctcaaattgaaaatttgcatccaagccaagcacagtggctcacacctgtaatcccagctactcgggaggccaatgcaggaggatcacttgagtccaggagtttgagattagcttgggcaacatagcaagactccatttctacaaagaattgaaaaattagccagacattgtagtgtgcacccgtagtcccagctactcaggaggctagagcaggaggatgacttgagcccaggagttcgaggctgcagtgagctatgctcatgccaccacactccagcttgggagacagagtgaagcactgtctccaaaagaaaaaaaaaaaaaaaggaggccaagcatggtggctcacacctgtaatcccagcattttgggaggcctaggtggcagatcacctgaggtcaggagttcaagaccagcctggccaacatggtgaaaccctgtctctactaaaaagacaataattagccaggtgtggtggcgggcacctgtaatcccagctactcaggaggctgaggcaagagaatcgcttgaatctgggaggtggaggttgcagtgagccaagatcatgccactgcactccagcctggtgacagagtgagactccgtgaagaaagaaagaaagaaagaaagaaggaaagaaagaaagaaagaaagaaagaaagaaagaaagaaagaaagaaagaaagaaagaaagaaagaaagaaaggaaagaaagaaaggaaagaaagaaagaaagaaagaaagaaagaaagaaagaaagaaagaaaggaaagaaagaaagaaagaaaaaaaaaaaaaagaaagaaattctgcattcactcccaattctttccaccccaccccctccagaccctggtaacctctaatctattttctgtctcaatgaatgtgcagattctagatatttcaaaaagtagaatcatgtaatatttgtcctttgagtctagcttctttcatgcaccattatgtttttgagactcacccaggttgtagcatgtgtcatacttcattcctttatgtctgaatcatattccattgtagggatagaccacatttgtttatgcatttatccactgatggacatgtgagctctctccactttttggtcactgtgaataatgctactatgaacattcacagaggacctttgcacggacacagattttctcacctaggagtgaaattagtgaatcccatggtaaatttaacttcttccctcctgaaacaattttctttcttagcttccaggacacatttggcttcctcctgctgtgtccgctacttcttagcttcctttcctggctctctctcttcctctccacctgccagatgtgacgtgccccaggggatcccagacaggccctgttctctattctacccacacctactccctagggatcccatttgggctctgactttgaaaatctctgtatatgcggatgactccaaatttgtatctctgcctcttcactgaacttcaggctccccttgtacatccaactgccacctgacatccccaccggtccagagtggagactgggatcatgcccacaaatctgttcctcccacaggctccccatctcagtaaacggcaccttcatttttcccattgtgctggccaaaaccttggaatcatcctggattcctctttttttcccacactctacctccaatccatcagcaaatcctgctggctctgccttcaaaatgtacccaggatccgaggatcgcttgagcccaggagttcgaggctgcagtgaaccatgactgtgccactacactccagcctgagcaacagagtgagactctggctcttaacaacaacaaacacacacacgtgtacacacacacacacacacacacaaaacagccaggcatggcgactcatgcctataatctcagcactttggaaggccgaggccggagaatcccccgaggccaggagctggaaaccagcctgggcaacatagtagacctcatcactacaaaaaaatttttttaattagccaggctgggcagggtggctcacacctgtaatcctagcattttgggaggccaaggcgggcggatcacttgaagttgggagttcaagacaagcctggccaacatggtgaaaccccatctctactaaaaatacaaaaattagccaggcgtggtggcgggaacctgtaatcccagctacttgggaggctgaggcaggagaatcacttgaactggggaggcagaggttgcagcgagccaagattgtgccattgcactccagcctggatgacaagggtgagactctgtctcaaaaaaaaaaaaaaattaggcatggtagtgcatgcctgtagtcccagctacttgggaagctgagatgggaggatcacttgaacccaggagttcgaggttgcagtgaactatgatcacactatagtacaccagcctgggcaacagagatcctgtagcttaaaaacaaaaatgtacccaagagccaatcacccttcacctcatccacctctgccctaccgcagggccaggtcatcacatgtctcacctggactctagcaatcaccttctccctggtgtctgtgtcccatccctgccccgacagtctattctcccacattgcctgaaggatcctgttagcacccaacgtcaggtcagggctttctttactcagagccttccacggctcccagctcacccagagagcagccatagtccccacaatggcccacggggtcctataggacatgtctcctccccattgcctctctgccttcacctcctcccactctcaccctggttccctctattccagccataccagcctcatggctatttcttcaaaactccagtcacactctcactgcatggctcttagactttctgttccttctgctgaaatgctcttcccacaccaacttcctttacctccttccatttttttctcagtgagactttccttgcaaacctacttaacattatccccccaacacttcctacctctttctttttctttctttttttttggaaacaaagtcttgctctgtttcccaggttggagtgcagtggagcaatctgggctccctgcaacctctacctcccgagttcaggcaattttcgtgcctcacccgcctgagtaactgggactacaggcacacaccaccatgcttagctaatttttgtatttttagtagagagactgggttttgccatgttggccaggctggtctcaaactactggcctcatgtgatctgcctgcctcaacctcccaaagtgctgggattacaggtgtgagccaccgtgccctgcccttaccccattctctgctttatttttctctagagcactcatctccatctaccatgctgtacatgttacatattgtcctgttcactgtctgtctgcctgcactggaatgcaaggaagagatgaggacttgctccctggagtagccccagcacctaaaacagtaactgacacatatctgttaactgaattaacacaaactaagccaaaaaaaaaaggacttgttggctaatagacctgaaaaaatctgggactgggatagcttcaggcatggctaaatccaggagctcaataccatcagaactcattctttccatgccttggctgtgttttcctctgggttaacctcactcacaggctaactccccaagcatggcaattgcagctctttccccttttcccattattcctgcaggatttcaagtctcaagggaacaatttgggtcatgtgtctattcccaatcactgtggccagaggatggacagctctaaagggctgaaagcccaggaggcagccaggggagtgtgaaccttccagaagcttttctgatggccccactcagcaactctgcctccagctcattagcccaaactcgctggtcattcccagcttcaagcacctttgggaaagtggaggctttatcttgccagcctccaaaaagagcaaaaggcaaggggaaaggggttgtgaagagcttttgggtgaagagtacagtactttcacaggctcctccaacctcgaagaacagggagaaaggaattgaggacaaaagtcaacacgcctcaggcaaaccatcttatgcaattttgcccaaggctgcagtttcagttcaatgaaatcctacaaccactcactgggcaataatgccatgcaaggtttttctatcttggcactactgacattttggacagaatgtaatgattctgggccgggtgcggtggatcacgcctgtaatcccagcactttgggaggccgaggcgggcggatcacgaggtcaggagttcgagaccagcctgaccaacatggtgaatcccccgtctctactaaaaatacaaaaattagccgggcgtggtggtgtccgcctgtaatcccagctactcaggaggctgaggcaggagaatcgtgtgaacctgggaagcagaggttgcagtgagctgagattgcaccactgcactccactccagcctgggcgtcagagctagactccatctcaaaaaaaaaaaaaaaaaaagaatgtaatgcttctctgttgtgggggctagctatcctgttgattgtaggatatttcacagcatccctgacctctaaccctagaccccatccccagtcatgacaaccaaaatcatctcctagacattgtccaatgtcctctgctgggcaaaatagcccccagttgagatgcactgcatttctacagtctaagttccataagagcaggttgcctgtttgctttacagctgtgtcttccgcacgtagcacaatttcttggcacatagtaggtgttcaattaatagttcttgagttgcatgaatgaacaaatgaatgaatgcctgatgcagtgcagtactggggtccacacagtgaagaacacacagaccttacccccaagaagatcaagatctagtagaagccccaaagtgtttccaaaatggggaaccttctgtccctctcagtgacatgtcacaggaactcacaagctagcaggtcagaggctatgccaccaaaccacagtgggcttcatgcgctctgcagacataacagccacggtcaggcttacagtcaacaagggaaccagaacagtgaggccagctgggtggtaggcccgctagaaaaaatttaatccctttgaacccatgagcaacaatgtgatgtgtcgttttctttttcttttttctttctttctttctctctcttttttttttttttttgtgtgtgtgatagggcctcactctgtcactcaggctggagtgcagtggcataatcatagctcttcgcagcctcaacttcctgagctcaagcgatccttccacctcagcctcccgagtagctggggcaataagcatgcaccaccgtgcccggttatttatttgtttatttatttatttattgtagaggcaagatctcactatgtttcccagacttgtctcaaactcgtggcctcaagagatcctccagccttcgcacccccgaagtcctgggattacaggcatgagccaccaccccagcctgttttatttttctattgagatataatacacatatgtcaaaattacccttttaaagtgtacaattcaatggtttctagtatattcacagagttgtgtaaccatcaccacaatcaatttttgaacattttcatcaccccaaaggacacttataccgatgagcaaccactcccatttaacccctcctcccatcctctggcagctgccacctgctttttgtttctatacatttgcctgctctgggcatttcatgtaatatgtggccttttgggtctggcttctttcatttagcatcacggtttcaagatctgtccatattgcagcatgtatcaaggcttcacgcctttttgtggctggataatatcccattgtatggatagaccacacttcatttatccttccatccatccatggacatttgggctgtttccactgtttggctattgtgaataacgctgctataaacatccattttttacgagattgtgtgtgtgtaccttgtaccattttcttgggtgtatatctgggagtggaactgctgtgtcttatggcaatttggtgtttcctgaggatggctctgctttgaggactgtgctgaaaatggtgggacaacagtttccagcctcttggacttctcaaaggcagtaaaaattcttaaaaataaaatgaatgattgggcaaccgaaataagatggtctactttttatattgccaagtaaagactacaggataaaataaaattaaagaaatattttttccattacttcacagtaaaagaacattttaaccaccaacatcactacccccaaaaaggaaaggagattaatatattaacataaatggtagttgtttaagtttactttcatgaaaatttcactacatgcctgtgtgttcccccatagtaccaggaactgataaacaaagaagcaaacgacctcctcaccatctacagtctagccaggtgatggtgggggggggggcggagagagaaagagagagagagagagagagagagagagagtgtgtgtgtgtgtgtgtgtgtgtgtgtgtgtgtgtggtcagaggatgtcggatgtcagatatcccaactctaaggaattctgagatgtgtaaaagggattgttttgcccaaaggaggttttcaggctctgaaaagaataaaatcccaggataactgctttaatggaggcacaagcaacaagagaaccccaagacagaaattagttctgattggctgggaacggtggctcacacctataatcccagcacgttgggaagccgaggcgggcggatcacatgaggtcaggagttcaagaccagcctggccaacataacgagaccccatgtctactaaaaatacaaaaatcagccaggcgtggtggagcacacctgtagtcccagctactcaggaggctgaggcaggagacttgcttgaacctgggaggcagaggttgcagtgagccgagatcacgccactgcactccagcctgggcgacagagtgagactcagtctcaaaaaaaaagaagaaagaaattagttctgatcatgggaaaaccaggtgagtagcaatgatctcagcaggctgagatgaattctatgcagccacaagtctgggagataatgtttaccagaccagagagaatctgtaattcctacggccttggtaccttcaggaatagagagattctattgccaaataatgacttccaggtggtgcattaatgacaacagtgggtagttttggtcccctctgccgctgggcccaggggactctgggaaccatcacccttggtgggatctggcttgggagttggccctaaatcgcctgccatgggagcgggtttagaggggaagcagtggccccccaggaggtcaggggtcctagagtcatctagaagaacaacagaaagaaatacctagggcaggtcaggcgcggtggctcacgccggtaatgctagcactttgggaggccaaggtgggcagaccagctgaggtcaggtgtttgacaccagcctggccgacatggcgaaaccccgtctctactaaaaataccaaaaaaaattagttgggcatggtggtgggcgcctgtaatcccagctactggggaggctaaggcaggagaattgcttgaacccgagaggtggaggctgcagtgagtcatgatcgtgcctctgcactccagcctgggcgacagagcaagaatctatctcaaaaaaaaaaaaaaaaagggccaggcacagtggttcatgcctgtaatcccagcacatggggaggccaaagtgggaggatcacgaggtcaggagctcaagaccatcctggctaacacggtgaaacctcatctccactaaaaatacaaaaaattagctgggtgtggtggcacgttcctttagtcccagctattcgggaggctgaggcaggagaatcacctgaacccgggaggcggaggttgcagtgagccgagaaggcgccactgccactgcactccagcctgggcgacagagcaagaaagaaagagagagagagagagagagaaagaaagaagagaaagaaagaaaagaaagaaagaaagagagagagaaagacctagggcagcagacaccaggctttggtctgtgaggctctgataccccgccccccacaagctgctgaatgtccttggagaatgagaggcgaggggatgggaggcaatggggctgaaatcacttctaggaaggaactaccctctgtgctttcccatcaggcaactgaaggagcaagttcccggggctggaagcacagcaatgagagggaagcacagaggtcacgggtgacagtggggaaaacgaggcagcagtggaaatgtatcagaagcaaaatgtgctgggttttgcctaaggctagcaatgcaaaacaaatcaggaaagtcccctggacttcgtgaggtgggctcaggcacacatggaaaattgtggtgagggaggagattttttcctaattagcactgagggatccaataagccaaacctttttcacacatgacatagctatcagattttatcccggtgccagggaagctcacgagaatgattctgagacaagatgatgaagccaaaatctttcccccggctttttttttttttttttttttttctaaagtgtaaaacaggaccaggtggtgagtctagttgaactgctcgagcattggtgctctctggtggccaatatagaaattgcattggcagcggtgcaaaagttttcctttttatgaaaaaagtcagataatctaagaggtgttgcagaagctagcattgcttaagagggatgtttattggaaggtgtaatcttggagttagaatctttaacatgcttcttctgaaaccagcttttcctcgttctctgtcttggtaaatggcctgaccacccattgttccccaagtaagaaacgtgggggtcacactagacacctactctccctcatcttcacactcaggcagtccctgaggcttgtgcccttaactgtctaaatttgcctttttcttcttcttttttttttttttttcctgagacggaatctcattctgtcacctgggttggagtacaatggtgtgatctcggctcactgcaacctccacctcccgggtcaagcgattctcctgcctcagcctctggagtagctgggattacaggcatatgccaccacgcccagctaatttttgtatttttagtagagacagagtttcaccatgttggccaggctggtctccaactcctggcctcaggcgatctgcccacctcagcctcccaaagtgctgggattataagcgtgagccaccatgcctggccttttttctttatttcttttttcttttcttttctttttttttttttaaagtttgggtctgctctgtcacccaagctggagtgcagtgggtgacagagctctctgagacctcaaattcctgggctcaagcaacagtcccacctccgtctccaaaaccactgggattacaggtgcaaaccactgggattacaggtgcgagtcactgggattacaggtgcgagccactgggattacaggtgcgagtcactgggattacaggtgcgagtcactgggccctgcctacctagcatcgcttctgtcatattctgttagcaacactctccaaagcccaaccagtttcaaggggaggggatgtagacctcacctttcaatgagaagagtgtcaacgaatttgtggactttatttcaaaacagccacaacaactaattcctgataaaaactgaaaatatgacataataaggctttaaccacccccacgtttgtttatgtgtttatgatctgtttcccacgctacaaattaagcttgatgagggtaaagacttgggcattttgcccactgcagtgtccctgaggccaaggacagggctgaagaattacacggtgattagatcagaggaaatatcaccgtctcccctcctcctgtctattttaggccaaagcatccttcaacatccagctcacagctcttctccgtggtcttctaaactccagtttttctttgcctattcacctgagggtcactttgtgctatactaagttgtcacgtcttaaattacagcatccagtattaccagttcagctgctggagcctgacaccctggacccaaatcccagctctcatgtgaaccagccatgtaaccttggacaagaaacctcagttttctcttctgttaaatgggggaaatattggggattttgtaaggattcaatgagccaatttaagtaaagcactcagaacagtccctggcctataggaagcaccagagaagtagtgttagccactattgcctcttgtatctctgcattgtagggttctttatccatcaattttttctttctttccttctttctttctttctttctttcttttctttctttttctttctctttctttccttcttccttctttctctccttccttcctctttctttctttttctttccttcttccttctttctctctccttccttacttcctttctttctctccttctttccttccttcctttctctctctctctctctttcttccttcctttcctttctttctttctttctccttttctcttcttctctctctctctccctctctctttctctttctttttttttttttgagtcagagtctcactctgtcacccaggctggagtgcagtggtgtgatcttggctcactgcaacctccgcctcacgggttcaagcgattctcctgcctcagcctcctgagtagctgggattacaggcatgtgccaccacacccatctaatttttgtatttttagtagagacggggttttgctatgttggccaggctggtctccaactcctgacctcaagtgatctgcccgccttggcatcccaaagtgctgggattacagacgtgagccaccatgctcagcctctttcttttttgagatggagctttggtgtgttacccaggatggtcttgaacttctgtgctcaagtgattctcccacctaagccccccgaccaagtagctggactgcaggcatgagccaccatgcctggctgtattttcttttcctaaaccgctttatcaagatacacttcacataccatagaattcacccatttaaagtgtacaattcagtggccttcagtatattcagagtcgtgcaaccatcaccaccatctaatttgggaacattttcatcatcctgaaaatgaaagccagtacccatgagcatttactcctcatttccccctcctcctaatgcctgacaaccacgaatctactctcagtgtctgtggatttgcctatatccatggtattttgtttcttgcatcctttcatctttgtcttgttttctgcctcccaataataataaaccataagaccctggacactctgtcctctcttttgtgtcccttcctggacttcagtgagtgattcacctaatgggcatctgctgatcaagtaatacactggccctttgactgagaacaagcacagagcatctacaatgcatcgggtaatattccaggtgctgcatatacattaactcatatgatccttacacagaaatccatgacacaggcactgttattatccccacctgactgatagggaaactgagacaggagaagttgagtaccttgccagagtgacatagccagcaaggaggcaaagccagaattcaaacctggacatttatgcctggagtctgcactccaccactgcaccacactttctcctgtgaggccaagtggatgggccttcatttgcgagcagttccaggaaacctgcacgggggctgggaaagagcaaggtggaagctgctgtagatgctccccccaccaaccaccaccagccaactacgtcccttagtatttcacagccttgtgtagctcctcaagtgtgtattctggactgctctagcaacttgatttaaccaatagaatgtagtagaagggacgctgtgccactccaagtcaaagcctaaagaaggcctggcagggcacagtggctcacatctttacagtacattgggagaccaagccagctggatcccttgagcccaggattttgaaaccagcctggggaacatagtgagaccccatctctatgaaatttttttttttaaattagccagagtggtggtgcactcctgtagtcccagctactcaggaggctgaagtgggaagactgcttgagcccaggaggtcaagggtgtagtgagccatgattgcaccactgcactccagcctgggtggtagagtgaaaccctgtctcaaaaaaaaaaaaaaaaatcctggtggcttctgttttgtcactttttagaactctgagtcacaatgtaagagatctggccaccctgctgaagaaaccacataggaagaggccctcagtctacacagggagcgctccaggtatcccagctatcccagcattttggctgtcccccctcaaagtcccagacatgtgagtgaaccattgcagacattctagcacagttgagctcccactgatgacctcagatttagttaagaccacatgcagcagaagagccgcccagctgatcctagtcaacccagagcatggtgagtaatcatcaactattgttttaagccactaaggagtagacagtcaaacagcagtagataatcaaaacaaggagtaagaccacttctgtggacagaagacccatgaagggtctgacctcatgattccacagtctcctgctgactcaaagaagagggtagaaagctaatcagaagagctgagtgtctgctccagccagcagctggggtgcagattcatgaccttcactcagctggtcagatgtgttggctcaggactttgaatctggagtaagcaacacaaaagaccaggaggtttagacttgttctgaaaggagtggtggtgacatctgactagcatcttgtttccagtggcagcccctgaggcaaggccaagagtggggatgcagcatccagccaagacagcaacagcatcctttccagaatcttctttggtgcaatttctgaacccttcacatccctcattttccacctattttctgagcctgattctccagtcttctgattcattttgaaaaagactctcatcattccaggaaagcacttttgcagctgaagttagcagtagtttgtgtattgattgggtttgtttgcatgcaacagaaaactcccaaacaactgtggcttaaacaagatagttgattttctctttgtgaaaaatgtacagaactcagcagtccaggtcccaccaggtcttcagagacccagtatccttgtgtcttggtgctctggctccgctccacgtggcacattgcctcagggtctaaaatagctgcccaagctccagccattgtgttcacattctggccaggagagaagaggaaaggttaaagaaaaacatgcccctccctttttaggaaaccacttggaagtccctcctaatcctttgcttatatctcatagctagaacttaatcacaagaccacgcttaggtacaaggaaggcaggaatgagcagtccttagctgagcggttaggtcctcaactaaaaataagagttatgttgctaaagaggaaagaaagaatgatgctgaaggaggctactggagatctctgcctgggtctgcctctgctgtgttcaaccaagaactctgcatgggagagccaagccagactgatgcaaggcaagtgagctccaaaactggggcttcacctgggagggttcttggctttacccagcagagaattcaagggcaagtcagtggtgttagacagcaacttttattgaagcagcagtgtacggcaacagcagaggtactgctccttgcagagcagggctaacccctgggcataggggttgttggcagctgtatttatatccacttataattatatgttaatgaagaggcacgttatccagaactttctggaaaaagggtgaggagtttctgaaaccatataaagtaacttcctggctgttgccatggcatttgtaaactgtcagggtgctggtgggagcgtctttgtgctaacgagcagtgagggcaactagaggtcactttctttgccatgttctgtttcttcactgcatcctgtttcaaccagatcctgctctgatgagctgggttgctatggtggttgtgatcagtgctcggaaaacaagtcctgctgatttacctcaagactgcgagatggtggccacgggagaggagggaccctgacaatgcctaatcacgttgacccagctggctcctctcttaattttctccaattcttttttatttttgagatggagtctcactctgtcacataggctggagttcagcttactgcaacctctgcttcccgggttcaagcgattctcctgtctcagcctcccaagtagctgggactataggcacccaccacaatgcctaattttttgtatttttggtagagacggggtttcaccatgttggccaggctggtctcgaactcctgacctcaggtgatctgcctgcctcagcctctcaaactcctgggattacaggtgtgagccactgtgcctggccttctccagtttttttaaacccttccacctcatttgtcttaaactcccaccagcacttccctgaccctggatcccctcattttcctgatccattttctatccaaggaaaacccacagtcccaacccacttcctggccagtctagctcccatgcctttatacatgctgttcctttcacctggaagggccctccttctccctgtggcttatctaaaggttacctgtgaggagcatttgtcatgcttcttggccacccagtatcttttgtttgtttttttgagactgagctggagtgcagtggtgcaatcactgctcactgcagcctcaacttcctgggctcaagcaatcctcccacttcagccttctgtgtagctggaaccacaggtgtgtaccaccgcgcccgactaattttttcattttttatagagacagggtcgaggctggtctcaaattcctgggctcaagccatccttctgcctcagcctcccagagtgctgagattacaagcctgagccaccgtgcctggcccccgcctcaatctttaaagccggtaatgtcattctgaaggctcccttgttaaataaaaaataaaaagccagtaacggcatcaccccaacctctgcttctgtcatcatatctccttctctgaccctgacctccctgcctccctctccctgacctccctgcctccctaagtacccctgtgattacatttggcccacccagataatccagaataatcttcccgtctcaagagtcttcatttaatcccatctgcaaagtttgccacgtgaggccacgtattcacagatcctaggggctcaagatactggaatctttggggtctaatatgaatctgtccactacagttaggttccccagaagcacatcctcagacaaggatttgggtgcaaatggtttatttgggggtgcttccaggaagcagcagtggaagagtggagaagtgaaactgggaagggaaggaagcctgagggggtcatccagccagacacctctgcgggcacctgaggctgagtccccagggcacctctaggaaactgagcagagaaccctacagcgctgtctgttcttccctgtggggctttccccaggctgttcaccatctggcacttctggtctgccccgtcttggctgaacacacatctgcagccagagacagcactcaggcctagagtctggcatatttaaaaccaataaagtaccgaaacagtgtgtagcagacactgttggtgcccccagctgtctgccctgggcactcacttctactcactggaggtagctgctgtctgagggcacctgctatgttctggccctggggctctaggggctggcagtctgagtgcaggaccaagtgtcagagttaatgtccctagaacagcccttatgcaatggcagatgggaacctggcgaatgaacatcccagcttcctaatccctcagctggggtaactcagacgggtctacattggctccccagctccccagtggggttgaactctggtgccctcggaggtcaccagctggtgtcacacctgcattggctgccttcccttctcttccctgctccatcccacatccctgctgatgggtcctgggatcaccacccaaatatatgggaatccctgtcatagggttgtcttttgggggagcccaaaccaagacacagggacaaaaataaaccccacaacttaaaccacacaactgcggtgtgttacatatttacattgaagaaattcacatttttttagtgcagctggacacaaagaacacaaataagcagaatataatttacattataaattacatgctggtagattccctgaggtcaggagttcgcaaccagtctctactaaaaatacaaaaaaatcaaccaggtgtggtggcgggcacctgtaatcccagctactcgggaggctgaggcaggggaattgcttgaaccagggaggtggaggttgcagttagccaagatagcgccactgcactccagcttgggcgacagagcaagactctgtctcaaaatacacacatacgtaaataaataaatacataaaacacacatgtacacacaatgcagctatattatacatacacacacacatgctgtctcctttgtagagaattccaaaagtctatatttgaggctcctccttcatatgaggcccagccaaatgatgcttctgcctcgaatacccctcctagccctgacctcagaattgagggggttgtatttgagttttgtcttaaagtacacatggaaaatacacatttcaggccgggtgtggtggcttactcctgtaatctcagcactttgggaggctgaggcgggcagatcacttgaggtcaggagtttcagaccagcctggtcaacatggtgaaactcagtcccaacaaaaaaatttaaaaactagccagtgtggtagtgcttacctgcagtcccagccactcaggaggctgaggtgggaggattgcctaagctcgggagttcgaggctgcagtgagctatgatcacatcactgcactccagcctgacagtcagagcaagactttgccttaaaaatttttttaaaaattgtctagtagtctagcacagctgctggacagaggggcactgggagtaggattgctagacaaaacacaatatgcccagctagattcgaatttctggtaaacagtgaatactttttagtataaccacatcccaattattgcatgggaccctcttttactaaaaaaagtatttgttgtttatctgaagttcagatgtaactgaacatcctgtatttttattttctaaatctggccaccataactgaaagagagagagagaacagtgagagggaaagcgagacataagaccacagggacacaaaaatggggacagacagagaaatagggacaaatagagaaagaataaaggagagatggacaaacacagatatggccacaagatgcctgcagtaggaaaacagaagaagaggcagaaagggggcagacccagagaccacctcctagactggggaagatagaaggggaacagcccagcgtggacaggggcctagccagagttccttccccaggcaaggctagggagagaagcacctacaggagggcacagttttaaaaaaaattgctgaccaggtgcagtggctcatacctgtaatcccagcactttcggaggctgaggcgggcagatcacgaggtcaggagatggagaccatcctggctaacgtggtgaaaccccatctctacttaaaaaaaaaaatacaaaaacttagctgggtgtggtggcatgcgcctgtagtcccagctactcaggaggctgagacaggagaatcacttgaacccgggagggggaggttgcagtgagctgagatcgcaccactccactccagcctgggtgacagagcaagactcagtctcaaaaaataaataaataaataaaattgctgccagaactctagccataaagtctgcattccagtcaacagaaccaaggaagagtagaagaaaggcacttcctgtaaattgcatccaatctgccagaatttagtcacatgggcacaaccagaggagccgaaaaatgtggtccttaatccaggtggccatgtacccggctaaaatttgaaggttcttttctttttctttttctttttttttgtttttttagagacagggtcttgctctatcacccaggctggagggcagtagcatgatcatggctcactgtagcctcaacctcctgaggctcaagcaatcctcctgtctcagcctcccgagtagctggaaccacaggtgcatgccaccacacccagctattttttttattttttgtggggatggcagtctcaccatgttcccatctggtctcaaactcctggctcaagtaatcctcctgcctcagcctctcaaagtgctgggattacaggtgtgagtcactgagcccaactgaagtctgaagtttctttctttttttttttttttagacagagtcttgctctgttgcccaggctggaatgcagtggcacaatcttggcttgctgcgacctctacctcccaggttcaagtgattatcctgccccagcctcccaagtagctgggactacaggtgcgcaccaccacgcccagctaatttttgtatttttagtagcgacagagtctcgccatgttagccaggctggtctcgaatccctgacctctggtgatccacccgcctcagcctcccaaagtgctgggattacaggcatgagccaccagtcccagacaaagtttctatttttaagaaagaagaggaaaatggatcctgacactgtcccttcatctttcttgctggaatagggatgttttgcctgcaactgtggcatcttttttttttttttttttttttttgatacagagtctcactctgtcacccagggtggagtgcagtggagtgatcttggctcactgcaagctccacctcctgggttcatgccattctcctgcctcagcctcccaagtagcagggactacaggcgcccaccaccaagcctggctaattttgtttttgtatttttagtagagggggtttcaccatgttagccaggatggtcttgatctcctgacctcgtgatccacctgcctcggcctcccaaagtgctgggattacaggcgtgagccagcaactgtggtatctttaaagaccactattgtgcctaccatatagaaacaagtggtcctccaaataactgctgatttaatattaaatccgtaaactctactcaagccagttccattcattcattcattccacaaatagttattaagcgtctactatgtgttctgggcatagagctacgaaaaagacaatgtctctgccttcatggaattcacattctgcctgtggaaggcatgatgataagtgagcaaacacattgtggaaacccaactttcctttaaagatggagcctaataattctccccttgagtgtgagctggacttagccactcacttctcacacgactatgtgtaaaggaaaattgcattctgtctggaactttaccaaatactgttcaccattttaagaccacatcacccatatttatgcctaccatggtatttgagtcaccaaaacagcactcctggtcagactgcatggtgggccactttggaactggtgataaaaattgcttctgctggctgggcgcggtggttcatgcctgtaatcccagcactttgggaggccaaggcgggtggatcacgaggtcaagagattgagaccatcctggtcaacatggtgaaaccccatctttaccaaaaatgcaaaaattagctgggtgtgggggtgcaagcctgtagtctcagctacttgggaggctgaggcaggagaatcacttgaacctgggatgagtaggttgcagtgagccaagatggtgccactgcactccagtctgggcgacagagcaagactccatctcaaaaaacaaacaaacaaaaattgcttctgcttccttcagtctctttccctttttctccctctctctctctcttcctctcattttctcttgggtcactcactctgggaaacaggagataccacagcatgagcacatgcaagcagctctaccgagaggagtggaactgaggcctctgtcccatgagagggagcctctttggaagttgatcctccagccccagttgagcctcatctgactgcagccccagatgacagctcaacagcaatctcaacagatcctgatccagaaacacccatgctgctcccaaattcctgacccacagaaactgtgagataagaaatgtttgcttttaagctgctaagtgtcaggtcatttatcatgcagcaacagataactaatatacagataaataaacaccatcatttaaaattcagttcagtgcaactaacaaaagatgatatggaagcaagtagtggaggtaggagggataaaactgggaggttggtgaccttgtgggtgacattgagttgagggcagagtggtgggaagggggcagccatcagtgctttccaaccctagcagatactacacacccccttttataactgcaaggcctttgttagctgttctgaaatgaaattcataggtaataaaatcttcccacacacagttttaataagactacgaaggtgaaacaaaaggaatgcaatgtataatttgcaaattttatttcaatagataaatgctcagatacaattacactagaaggtgtaatgaagcaggcggatgctggaacctaaaagtgggatcccctggaattgccacagccatatgtgcaggctgattggagtgccctagcagcaaatcagataccatagctggtgtaaatgacagcaatgtggctttgaagtggtaaatgatatttggtaaagttccagacaaaatacatttttctggccaggtgtgctggcttactcctgtaatcccagcactttggaaggtggaggtaggaggatcgcttgagaccaggagtttgagaccaacctgggcaacacagggagaccctatctccacaaaaatatttaacaattagtcaggtacggtggcacacacctgtagtcccagctactctggaggctgaatttggaggatcatttgagcccaagaggtggaggctgcagtgagccatgatcacaccactgcactccagcctgggcaacagagtgagactctgcctcaaaaaaaaaaattgtaaaattagccaggcatggtggcacacatctgtaatcccagcactttgggaggcaaaggtgggaggatcgcttcagccagaagttccagaccagcagggacaacatagggagacccccatctctacaaaaatattttttcaaattagctgggcatggtgttgcatgcttcgatcacaccactgcactccagcctgggtgatggagtgaaaccttgtctcaaaatacatatgtatatatacatatacatatacatatacatatatatttcccttgaattgcaatgatatttgcatttctggaaaatgtggtgatattaaatctacacaagggccgggcatggtggctcacgcctgtaatcccagcactttgggaggccaaggcgggcagatcacttgaggtcaggagttggagaccagcctggccaacatagtgaaacctcgtctctactaaaaatacaaataaaattagccaggcgtggtggcgggtgcctgtaatcccagctactcaggaggctgaggcaggagaatcgcttgaacctgggaggcagaggttgcagtgagtggagatcacaccactgcacttcagcctaggcgacagtgcgagactccatctcaaaacaaacaaacaaacaaacaaaaaaactacagcaaaaaacattttatatgtaaagcagatttagattctaggctcagatcattatcaataagtttttcatctccaggagtgtctggccatgtggcatacattgaattgtttgttacataggattgttcagctctctgcaggatgttatctagcattcctgttccctctattacgacaacagaaatatccccccaacaaaatttcaaaatgcgtctgggggtggtactgccttcatggagaagcactgattaagagggacagaaaaatgtaagacaagcccttgatgggaacaaaaaggagcccagagtggccagagtcctgaagaaaagcaggaaggagatgagctcagagaaaatggcagggcctctatcacaccttgttggccacagtatgatactgaacttggactcaattccaagggcaatagggagcctctgttggattttcggcaggggagtgacatagtctggccttgctgtgtgtgtgtgttggggggagtggggtgggatcaaaacatgttactcagcagactgcactgtactctagagaatttcattcattcattcattcattcaacacataaggattgaggtgtgtctcagtgatctattgctgtgtaacaagcaagaccccagaatgtagtggcataaagtaatgattttttgttttctgctattctgtggctcagctgggcagtttttctgctggtctcactagtcacttgtgctgctgtattcagctggtgggtcggctgggagagctgcaatgactgggctccctatccacgtgctctttcttctggggctgctaccattttgttgttattattgttgttgttgtttgagacagagtcttgctctgtctcccaggctggagggcagaggggcagtcacggctcactacagcctccacctcctgggctcaagcaatcttcccacctcagccctccaagtagctgggactacaggcaggcatcactattcctggataattttttaaattttttgtagcatcagggtcttgatatgttgcccaggctggtctcgaactcctgggctcaagtgatcctcctacttcagcctcccagtgttggaattacaggcatgagccactgacctgcccagggctgcttctgagtgtcattcagcattcccaggcagtaaaggaagaagtgagccagggctgttgatgctctgggacttgtgcagcctcttttctgtcacattctattggtcaagaccagccacaaggctagtctaggttcaggctggtggagaaacaaactctacctcttgctgggagtgactgcgaaatcgcattacaagcagtggaacttgcagaatttaaggccatgaaatattcaacgtgactgtagaccgggccctggggatatggcctgcccctctgcaaccgtgctttagtgagacaacaaatagtcaacacgtacaaaagctcagaaagtgctgtggaaaacatcagctagggagagagggggctacttgagacaggtcagggaaggcttcccagagacgtctgagctaagacccgagcactggagcatgcctgcctgggatgtctgtgcctctgaggtttccaaggaagacaactgtctttgcataagcccatggctgcccttgggggaaggggcccaggggacaccactaatggttgctgtgatagcatcattgtggaatggagtggaagctgccttggggccagagtatctgtcccccagcactcatttgcaggctgtgtgacactggccatctgggtttcttcccctgactcccaaagcccaggtccagttcactgcactgtgagggttcacaggtttataacaggataaactacagagagaggtcagtgcttcctggtatactatgcacagctgcgacactcaataaacagaagttcactgaactgcaaggtcactgctgctgtgacaggagggtcatatggatgtgtgtatcttgccagtggctgtggtgaaaccctgcttgtggagaatagacataaacacaccttctctctctccctctctgtcttcctttcacctcccctctccctccaccccttccatttcctattctcccagcatgttctttccactcttcctcacctccttccccttcacctccttcctacaccattcctttttccatctctttcctgttttcctaacttgttactctcatctttttctttcttttctgttcttcctgacagctccccttcctacctcctctcccttcaccctttctcctactctttcccctcctctcatttctacctctctttccttttcacttcccctctccctcctgtctttctcctttttcttttacctctgtgcctccctctcacctcttcccacaccacctcatctcctccataactaactcacctcctttttgtttgtttgttttttgagacagggtctccttctgtggcccaggctggagtgcagtggtgccatcacagctcactgcggcctcaacctccgaggctcaagcgatcctcccacctcagcctccccagtagctgggaccacaagcagcgccaccaggcccggctgttttactttttattttgtagagaaagggtctccctatgttgcccaggctggtctcgaactcctgggctcaagcgatgctcccgccttggcctccggaagcgctgggattagaggcgtgagccgccgcgccgggcctccccccttcccctccgccgccgccttctcatcgcccttcctccttcctcctgacgccccttactcccgatcacttctcattcattcaccagcttccagtcctcgctccctcacctcttttctttcctactcgccttctcctcctgcccctttatcatctctccttgtcaccgttcttttttgccaatcctctcgttccccttcctttcctcatctcctctcttacccacgtcatctccattctcgtgctccccttcacctcccgttaccttgcgcttctctcctctcatctccatcaccacctctccccgctttcgcctttctttagcccccgcgtcccctatacccttcgcccatgcccactcccctccccaccttctcttcttccaccctccaccctcgccttctgtctctcgcccacctgactccgctccgcccccagccttaggctccgccccgctgggggtcacggggccgacggacgctaggcggccgtagcggcctcgccagtcacgtggtcacgtgacgcgctccaacatggcggcgccgtggggccgaggtgtcgcttcctgacggggcggcgcggacggacgcggccggtgccggccgggacgccgggcccgcagcctagctcgccatctcgctcacgccgcccgcccgcggggccgtcagcccccgccgggccggggccatgcaggagagccagaccaagagcatgttcgtgtcccgggccctggagaagatcctagccgacaaggaggtgaagcggccccagcactcccagctgcgcagggcctgccaggtggcgctcggtgggtgagccgctcccgccctgccccgcgctggcctcagcacgtcggccgttgccctatcctactcggccttggcccggcctcctggcctccgcttccccccgatcccgaattccacccttccggcctcctcctcattatacccccggaggaagtgttgcccgggcagctcgggactggcccaaggtcacctagcaagttggtgacaaccagagcttgttcctcagggttccagctcagggcttttgccacgattccttgtcgccctgtttcctggttcctcccctcaccacctccaagtcctagaaacagtagcccttgccccaagttttttcgttacctgagctctgctgattggggttcccctaggtgaacagagcatgtaggaagagccgtccaactggtttagggaaacccctgattcttgttttggaagtgcccgttggagaatgttttcctttggtttggggatctcccatagctctttccctcaaggaaggattgtagaaggtgttctggatctcccaggcattgtagtgagcaagacatctgcttattcctagcagtccactaaaatacaaggtcttcagcgcgaagatacttgtctgacttattcattgctgtatcccttgcgcttgcaacagtgcctggcgcacagtaggtgctcgataaatatttgctgattgaatggaccctcagattatggaaagagggagaattctaactaatagttaaaggcttgataattgatagcaaaatcactatcctatctttcagttttaatcatttaacaaatatttatcaagtgcccactgcataccaggtactgagaattcagtggggaacaagacggacatggtccttacccctatggagcttatactcgaatagaggagacaaaataattaattaagaaaataggtgaggtattttggaatactgataaatactattttgaaaataaaacagcaagatgtgataaagagggcttgaggactgctttccatggtcaggaaagtaatcttttccaagaggaaaagtaatcaggtggtcaggaaagtaatcttttccaagagggtgacacttgagctgaatactgaaaggcaagaactatccaccatatggagtttcagaagagagttcttggtgggagaatccatgcatttgaccagagctgttttcaagctaattcactgccccaacgtctttggtttggaatctgtaaaggcctgtttttcctaacaaaatgagcaaatggaaagtttgatttttagtcacatagtttgagattgttatcacctttctcctttcatttgctacaaagtatagagtagtgttcttttggcatttagaaataggctggtgaactttgcacttccctggaaagaaggtccctggctttcatcagattttcagagggccctgagactccctcaggggccaactattgatgcagaggtggtagtctagataatctggaaacagttgctagtccgtgaaattcaggatcagtggaaggaatttactgagatgtagatttttaaagcttttctcttccaataaccaaggctgttgggtattttatcagcaatgtgggataagcactgcaaagcagtttgttaggcaagagcctggtatttataactccacgttgaaatctgcctggactctatcttctcgatattgttgtggaggtttcagaatagttatttggcagaagagtttttattttttcttcagaaaacttcttaacataaaattttcaccaaagtgtgcatcatattattggaacctacttataaaattttcatctgggtcatgaagggccattaacgctgagaatttaatagatattttcggatcgtatctttgttcagaagttcaagttttcctaacacaagtagtggaatgcatgttttcagtttttagtagtgaattgtaaaaaatggcctagataggaagtaatttgactacaggttatatgaatcacaaattggggttgtgccaatggcataataggaactgtcataagggaacgtatgcatattgttaagtgaccatcttttttaagagaataattgtgtgtcattgctgttaaatagaaatgactgcttttacttagagtagaacacatagcagaatgcctggtgatatttctctctgtctctcaaggcccagtcttgtgtccagtagtcccatttaagaagagaaatttggggccaggtgcggtggctcacgcctgtaatcccagcactttaggaggctgaggcaggcagatcacgaggtcaggagatcgaaaccatcctggctaacacggtgaaaccccgcctctactaaaaataacaaaaaaaattagctgggcgctgtggcgggcacctgtagtcccacctactcgggaggctgaggcaggagaatggcgtgaacccaggaggtggagcttgcagtgagctgagattgcgccactgcactccagcctgggcgacaaaacaagactctgtctcaaaaaaaaaaaaaaaaaaaaaggctgaaacgagccagtgtataaggagcagctatgtggtattttagagattaccatgtatagattgttgttaattgtgataagaggaactgtaaatgacggctcaaagttgaaatgcttggatgatagagagcatttacaggaaacagcttctgtgatatgattccaccagctgtagcatattaggggagaggatcagggctgcagggactgtatagtgtagatgttagctaggagtgtattctttgggaccctagacttctgtgttcaaacctcctgccttccacttgctacgtttgtgatcttggacaagttacttccttataggattattgtaaagattaagttaattgacatgtgcaaaaaacttggcatgtagtaggtgctcagtaaatgcttgctattacttttttattattattattttaagctgtgacaaaccacagcagctgtaattactctggtttgatgttcttaaccttagttcctcgttcaggaatgacttactgctctatttggtttgtagatgcagtaaataagaatgtaattacgtgattgaaaggctgtgttggagtattaacttcctaaactcaatgaagacaggggttgtcctttgtaaaaattgtgataatcatgatggagcagatttggagtaatctcaatgattcgtccgcactatacaccaaaagcataaatagggactgcccaagtaggggatagtgcccttccaacctttatctggagaaatcaagacagcctgtgagagtattcatcgccccaaggatactgttgctctttaccttgttatgaaactttgatatatattaataatcttcaacctttcagccctctgttggagaatataattacattcttaaacctcccttttataattgtcttatttaagactcatcttctcccatcatgtatctttaagttatgtttctgctcttaaactatatgaagtttggaggcttaataggataatctatttaaaattcgatatggaaaaatttatctatggctgggcactgtggttcatgcctgtaattccagcgctttaggaggccaaggtgggcagattgcatgagcccaggagtttgagaccagcctgtgcaacatggcaaaaccccatctctaaaaaaatatataaaaattagctgggtgtggtagtgcatgcctgtagtcccggctacttgggaggctgaggtgggaggatgacttgaacctaggaaatggaggttgcagtgagttgagatcatgccattgcactccagccgagacagcagggtgagaccctcacacaaaagtgctaagtaatggctaggtgctctataattactagttgtcattattctcagccattatcaagaaaatttaaaaagaatagtaaacatacgtattttcatatgaaattgaatgacttttaaagatcacatgttgtattatatctcctatgtactaagcatttctgagttccaggcacagtaaagtgggcttttcatgcaatttagttctcactattatcatcattcccactgaggcccagagaagttaagttggccagggtaactcagtaagtgatggaaccagggtataaacacaggcaatctggctccatagtccaagatcttaactattactaccatgttttcttgcttctccatatgaaagttgttatgtttgaaatactcagtagagtttttaaaacaatcagtataccgcagtggagtttcaggagactgtattttctatagctgaattttgagatatgtttgaaagccttgagtcaaaaagatcacagctcttttcttcaggtttttactacatatatactaggtttactttaattaggggctaatggaaagaaggaaatgagagtaaagagctggttacacataagtttcatttgagttattcagtttttcttttttttttttgagacaggatcttgctctgtggcccaggctggagtgcagtggtggggtgcgatctcaggtcactgcaacctctccatccctggctcaggtgatcctcccatttcagcctcccaagtagctaggactacaggggcgtaccacccacctggctaatttttctgtttttagtagagacggggtttttctgttgtctgggctggagttaatcagtttttctaattgatgatatctcttcatcagcagtaaactccctcttattaattctggagttgtgacctgttattaattctggattgtgattcatttctttgggtacagcaggcaatgggagaccaaggctaaggaagagagcaacttgcccatccacatccacacagctgggtggggaaacgtagctgcagcacatgatgtagcttcacatagatcataacatccattcttagatttgctcctctgtttaatatacgagatttaggatgtggatgggtcattggtgaccttagcttgagcttttttgatgctgtgatggaggtgaaagccagactggcatgggttgaggcgtgggaggtgaggaaacagatggtgagcatagtcagctctcccaaagtttggttgtgttgtaaagaggaagaaggagtggctcctgggagttgtttgtttatttaaaggtagaaaagattttaactttaaatattgttaagggatccagttaaggaagtatattcctaaatcttagttgtatatgaatgtgtgtaagacatacaaatgggcatttatcatatggacatctgtgtgtccatatgatacataaattgctttttcttccatatgatccttttattctaattttgatgtgttcagaaaaaccattctcatcatgaggattactgtgaaacttgaaaaatataaaaaacatctctaaattgatgtaacgtggcggggcatggtggctcacgcctgtaatctcagtactttgggaggtcgaggcgggcggctcagttgaggccaggggttcaagactagcctggccaaaatggcgaaaccccatctgtactaaaatacaaaaattagctgggcgtggtggcgcacacccgtaatcccagctacttgggaggctgaggcaggagaattgcttgaacccgggaggtggaggttgcagtgagccaagatggcgccactgcactccagccttggcaacagagcgagactctgtctcaaaaaaaaaaaaattaaaaaataaataaataaattgacataacaagactttaaattgaaatgcagaataaagcctttaattttagcaaattctagtgttttgatgagacatttcgtttataagtgctatgtatcataaaaattttgagaaataacaggactcaggaccctggaagattactttttgttgaaaaccactgtggattcttcaggaggaggttatctgtctggaagcagcatcaaaaaactggattgttcttgattattgaaaagcatttatatgtaggattggcagagagttgattgagactttgaaagtttgatttgcttattgatagtccagtgatccctctttgggccgcagtttcccaaggtgataaagatagtaatacctttgtcacaggattattgcaaaggttaaatggactagtgcagtaagtaactggcacagtacctggcacctaacagatgacctgctgaaattcagaggcattggtgttgcaatcttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgcaatctttttttttttgagccagtctcgctctgtcgcccaggctggagtgcagtggcgtgatctcggctcactgcaagctctgcctcctgggttcacgccattctcctgcctcagcctcccaagtagctgggaccacaggcgcccgccaccacacccagctaattttttgtatttttagtagagacggggtttcaccgtgttagccaggatggtttcgatctcctgacctcgtgatctgcccgcctcagcctcctaaagtgctgggattacaggcgtgagccactgcgcccagccggtgttgcagtctttaaaggaaaaggaactgaatgcttgcctttctctacctcccctattagttggtttatagacctttttgtaagtctccaacatgagtgaagcagtggttggatagaatgaatttagagctctatcctgtacttgtaaatctcaggggagagtctgaaagcagtgctagggaaaacagtaagaccattcttcatgaaaaagagtgaacttgtgaaaatgtgtacttaatcagcaagaacatggagtgtcctatataaatagctcagagctgtgtttagctcttgccagtttcaccaggcttagggggcctgccaggaaaatacttgactttctttccagcaaggttatcctagaaaaaatagttttgcatttgctgattcatttctgaaattttccagtgagaagctcatttctgtttagtgccttgggtgtaaacaagccttctggcttgatattttattaggttttatacctttgtgaggagaacagccttcttgtgctaggacacaaaattcttaagttttccttccgtcctagggagtggtcagtgtatatttgtcgttctgaatatagcccttttgcctgttgactaaaccagacccaacatttattcagaagatatttatttgggtgtcacccctggtgtcatgatgcagagggatcaaaacaaacaaggaccatgttctgaaggagtttgcagttgaatggggtagatgggcattgttcagaggatatgccctctaggtcataataacaacccgagaagtactgaaggaaagaaacctggttctgccagggcagtgaacagtggggtgagggaagacttccctgaggaagtctcactcattcattgagaattaatgatgagtgagaattaagtagttgggggcaggaggcatttcagcagagggaacaacctgagtgaaggctctatggcagagaggaaaacagttgttggggaaactgaaagaggccagtgtgtggttggaacattgtacttgagcaaagagagtggagatggagtgggagtgggagaggtaggccaagaccccaacatgcaaggcctggaggtcatggctaggagttttattttttaggtcaaaggcagtgagatgacactgaagagttttaaaccgggaagcaggtgataggatgaccaggtgtattattttggaaaaatcatttggaccactgtgttcagaacatcttaggggaagaccagagggattgccaaggaaccaatgaagagactgtcttagtccattttgtgctgctttaacagaatgctactcactgggcgatttataaagaacagaagtttatttggctcacagtccaagagcatggcactagcatctggccagggtcatcctatggcggaaggcgagagaggaaatgggggttgaactcatctttttatcaggagcacactcatgcagtaacgtattagtccattcatgagggcagagccctcgtgacctaatcacttcttaaaggctccactcttacaccatcacagtggcaattaatttgcagcagagttttggtagggacattcaaaccatcgcaggcagttaccattgttcaggtgagagatattggtggcctggactagtggtgacagtagaaatagagcaaagaaaatgaatttccaacctggttagaagatgaagccaacaaaaccttgtgatggagcgagtaagagcatgggaaagaggattgataagcttgactctccgatttctgactcacccagctgggtggatggtgcctattttttaagatgggaatgtgggaagaggactacatggagtggtggagggaggaagttgatctgagttgggacttggatgtgtggagtttggtctgcctttgagcattcagttggacatgtgaaatgggaagtggccagttgtatgagcctgatgttcataagagaggtctgggcttaagataggaatttgggagtcagcagagtctaggtgggaatgggaagcctggtgagacggtatacagagggagaggcaggaggcctgggcctgagaaccctccaggccttttctggctgggcagaggaggctgagtctgcagacgaaatagagcagagatgggtaagaagcggaggaaagatgaggaaaatatgtggttatgaagcccgaagtcgagaaaatttgagagtgaggtcagtaaggtgaaatgctacagagaggtcaagtgaggtaaagactggaaaaatgcccatcagatttagagacatgtgggtcattggtggccttagcttgagctgttttggtggcatgatggaggtgaaagccagactggcgtgggaggtgaggaaacagacggtgaacatagacaactctttcccgaaggttggctgtgggaggagggagatgtggatgttaaaagtattttgttttttcttttttttaaggtagaagagacttgaacttgtttaaatgtcattggggagggagccagttcaaggagaggtttggtaatgcagaaagaagaaaggacagtgtttcattttttcaacaaatgttgagtgcctgccactctgtgctgaagaattctcagtacttgggaattcagcagtgaacagaacaggcaaagtgtctgttgtcatagagtttatgttctgctggggaaggcagatagtaaatgaactgatatataatatgtcaagggtgataaatactaaaaaaagactaaaaaaatgaattagtaaagtgagagaacaaaccaggtaaggagatacagggtgacaagggggtggcagtattaggtgctgaggaagtcccctgaggaggacatcagagcagagatctgaaggaagtgagggggtgagccatggagatatctggggggagggagggcattcccaggagcaggaatagctcatgcaaaggccccggggcagaaatgtgcttggtgtgttcgagcaagtaggccagggccagggtggtagaaggtgagagcagagggatagcaggggccagatcacatagaggtttggaggccaagatcgagagttttaattttacgcggagtgggatggaaagctactggagcattttgagcaaaggagtgttgtgatctgagttacattttgagggcatccctctggctgctgttgagaaaagctgtggggtggaagggaggataattgctgaagcatggagaccagttacaagaccattgtgatggcccaggtgggagataacagttgcttggcctagggtgatagtggtggcctagtgtggtaagaagggatcaggttctagatattatggatagtgtgaagttcctgagaaggcggatagggatgggaggtgacagaggtggaggggttggacacccactcccttatagcaggagagagcagagagtaggcccgaagtgggtcaggttgtaggtttgctaacagcaagctgagggagtctccttgtgcccacttctaatttctgagtgaagtaggaggccactccattggttgtgagtaaagaggacggcagcagaacagcgatgattgggaggggagagttgggccattgagggtggagaaatgtgcagtagccatcgtggagagtgagaggtgaccaaattactgggcagcatttcaggtttcattcgtggtgggtaattggggctctgtaggcctgccaacctgccctgttgtcagaggtctgcttaggcggagacaggtgaaaaggggacgctagtacaatctaagtttgggattttgccagaagttaagactaaaggtcagagagagtccaggctattgattgcgtgtcatctgataatagtcctgctgatgggatctaccctggaaaatgaggaaaaaggaaagccgagaggttggccatctcaaggtttgacaggacaaagacaggttctactgggagcaattgagagggtcagctggaaggagagaagaggaaggagctggaagttccccagttccatatagggacaagagtcagtgtgaccagcctcaccaggctggcttggagtggaggaggatgtggtaggtgactgggagctaaaggaatttaggggcagcgttggtttctgtgggggaagcctgcgacagatagaagtctgaggagtgtggaagggttactgtgggatctgggggcattggccactgatgggattgttgggcagtgctgggtttgaggttggtgatggtgattgttggacttgccttgggagtggaagagagaatgcgagccagtgtcagaggtgctggtgaatggaggtgtgtgacccgagcggtaacatccagaaaggatttcccgcaaagacagcgcggcttttcagctgcagctgccccaccctgctccagtctccctcatttccagcctggaaattgttgctaattgccccattggcagttgggaaggcaacgcctgttaagatgtggagcaataaagtggagcaggtatgctgtgccgtatgcccctcttcctgcaccgtcctccttctgtcatcgttgagtggctcaggagtgctggccctctaacagactgcctgggcgtggatcctgactgcagagtagcacttctggctgtgacgtgggcagatggcttaacctccctgtgctcagattcctcacctgtaaaacagttaatggatgattagagtgttcctgcctccctgggttgtggtgaggactgaatgagcacctgccactaggaggcaatcagtgagtcagctatcatcattattattattagggttccactcattctccttttcccttggcattgcttgatcccacggagatcccactagagattttgctttaatactgacttgttttaaaataagagcaagagaactgacatttattgaccacctgctgtgtgccagctgccgccttagtcaccaccaagacctctctcatggcggtgtcaagagaattatctgcactcttggtgcctagttatggtctctggagcatgtggggctgttttttatcactcccattttttagaataggaaatcaagattcagggaagttggccgggtgcggtggctcatgcctgtaatcccagcactttggaaggctgaggcgggtgtgtcacctggggtcaggagttcaagaactgcctggccaacatggcgaaaccctgtctctactaaaaatataaaaattaaccgggcatggtggcacgtgcctgtagtcccagctatttgggaggctgaggcaggagaatctcttgaacccaggaggcggaggttgcagtgagccaagaaggcgccactgcactccagcctgggcaacagagtgggacttcatctcaaaaaaaaaaaaaaaaaaaaaaaaagattcagggaagtttaataacccaataacccatctggcatcattcagctaatagatgtctgtgccaggacttgaacccagctctgtctcacacctgtatcttttctttctgccatatcaggctgtgccatgctatctgtgaggcaccctgccacacacactttttcgctgttcctttttctccctccgtttaaaaaaaaaattattacacttttaacttctgggatacatgtgcagaacaagcaggtttgttacataggtgtacgtgtgccatggtggtttgctgcacccatcaacccgtaatctgggttttcagcccagcatgtattaggtatttgtcctaatgctcttccttccccttgcctcccacccctcaacaggccctggtgtgtgatgtgtgcctccctgtgtccatgtgttctcattgttcagctcccacttatgagtgagaacatgtggtgtttggttttctgttcctatgttagtttgctgagaatgatggcttccagcctcatccatgtccctgcaaaggacatgaactcattcttttttatggttgcatagtagtccatggtgtatatgtgccacattttctttatccagtctatcattaatgggcattcgggttggttccaagtctttgctattgtgaatagtgctgcagtaaacatacatgtgcatgtgtctttatagtataatgatttgtaatcctttgggtatatacccagtgatgggattgctgggtcaaatggtattcctcattctagatccttgaggaatcgccacactgtcttccacaatggttgaactaatttacactcccaccaacagtgtaaaagcgttcctatttctccacatcctctccagcatctgttgtttcctgacttgttaatgattgccattctaactggcgtgagatggtatctcgttgtggttttgatttgcatttctctctttttttctttttttattgatcattcttgggtgtttctcgcagggggggatttggcagggtcacaggacaatagtggagggaaggtcagcagataaacaagtgaacaaaggtccctggttttcctaggcagaggaccctgcggccttccgcagtgtttgtgtccctgggtacttgagattagggagtggtgatgactcttaaggagcttgctgccttcaagcatctgtttaacaaagcacatcttgcaccgcccttaatccattcaaccctgagtggatacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccactgtcatcatggcccgttctcaatgagctgttgggtacaccttgcagacggggtggtggccgggcagaggggctcctcacttcccagtaggggcggccgggcagaggcgcccctcacctcctggacggggcggctagccgggcggggggctgacacccccacctccctcccggacagggcggctggctgggcggggggctgacccccccacctccctcccggacggggcggctggccgggcggggggctgaccccccaacctccctcccggacggggcggctggccgggcagaggagctccttacttcccagtaggggcggccgggcagaggcacccctcacttcccgcatggggcggctggccgggggggggggctgacccccctacctccctcccggacggggcggctggccgggcagaggggctcctcacttcccagtaggggcggccgggcagaggcgcccctcacttcccgcatggggcggctggccgggccgggggctgaacccccacctccctcccggacggggcggctggccgggcggggggctgacccccccacctccctcccggacggggcggctggccgggcagaggggctcctcacttcccagtaggggcggccgggcagaggcgcccctcacctcccggacggggcggctggccgggcggggggctgacccccccacccctgccggacggggcggctggccaggcggggggctgaccccccccacctccctcccggacggggcggctggctgggcggggggctgacccccccacctccctcccggacgaggtggctgccgggtggagatgctcctcacttcccagacggggtggctgctgggcggaggggctcctcacttctcagacggggcggctgccgggcggaggggctcctcacttctcggacggggcggttgccgggcagagggtctcctcacttctctcttttttttttgagacggagtttccctcttgttgcccaggctggagtgcattggcatgatctcagctcactgcgccctttgcctccagggttcaagcagttctcctgcctcagcttcctgagtagctgggactacaggcgtgcaccaccacgcccagctaatttttttatatttttagtagagatggggtttctctatgttggccaggctggttttgaactccctacctcaggtgatctgcctgcctgggcctcccaaagtgctgggattacaggcatgagccaccacatcgggccttgatttacgtttctctaatgaccagagatgatgagctgtttttcatatgttttttggccacataaatgtcttcttttgagaagtgtctgttcatatccttcgcccattttttgttgggattgttcttccctcttttaatggaaaaaaaaaagattgcattatccagatatatcaagaacccaacttttaggttgggccatatgagactactgctatttgagcatttccagcctgggtgagagggtgagactctgtctccaaaacaaaaacaaaaggtgctggtgtgcttcagactgtgccttctctccacctgcacgggctctgtcctgctctaagcccccattgctgctaggctggattattagcagtaacttcctgattggtttccctgcttctgtcctggccaccttcctctttatcctcacagcagccagagtgatctgtccgaagaaaagttgagtcaggccgccctctcccagcccctccatgggcttcctcccatcccttacaaagatgccgttatcatctgggcccctactgggcctagtggagaagacttttcaagagtgtctttctttctttatttcttttttattagatggactccaagtctttttaccatgttgctcaggctggtctgagctcctgagcttaaactgatctgcccacctcagcctcccaaagtgctgggattacaggcgtgagccactgggactggcctcaagatttttttttcttcaacaaaagagtagtttagaaagtgcagcaattcctaattcttgtgggaatacttaagggtaaatttagaaaaccaaagaaaatctgtgaacataggatttgcaactggagtttcttgggtttctgcagttactcttccaggtagcaactctttcctggtcacaggagagggctgctctcttcggtccctgtgccctgcactgctgctgctgccagtcctgtcaacgcttgctcattcccattccaaaaccaggttttacctttgctgtggtcatgccaggccagaaacagactttggagatttcagaaggcttgtaaactagccttcccagctggatgggttcacagagcagtaaaacaccagtgttttgaaccgtggttgtagctttcatggttagtgtcagtgctaggaaaaccacacatttaaactcttctgcatttatggtttacagagtaattccatatgcttgttcgagagtcgaggtatccaggagaacacagactctggagcctgattttctgggtttaagtcccatctccagtacttaataacttgtaacctctgtggatcttgattttcatctataaaatttataatggagtttggccttgaacttcagtcctctggctccttagttctttgttctttggctggacaacatttcgcttatagaaaacttgatgttttgtcctcatagcactgatcacagtccttaaaagccacttttagcccctgcagctacttttctgcagccactgaagcactttctcctcggctcttctccatcccttaaagcaaaattggcaaaccggtagcctcagggctaggcagcttgcaaaccagtcttatttaagccataatattttttaaatatatttttattgatacatatagctgtacatatttttgaggtgcattgataattggatgctttcatatagtcaaatcagggtagctgggatatccatcactttaaatatttattttttctttatattaggaacatttgaattattctttcctagctattttgaaatgtacagttggttaatgttaactgtagtcatcctactgatctaacgaacaccagatcttattttttctatttaacataattttaaaacaattgaaggtgtttgaattacaatcagaggtttcacttaaaatctggatttcgacctctggaaaaatcagaacaactagcacctgtgagctgagggactctaaagattccagtcagctggagctgaggagctgccgcaccccttcctgtactgggtggagagggggtcctgtcattctttgatcttacacccaccgtgttttttcttgacatttcccgtctggcctccatgggcctttgtagttggtgtaacttttgtgtttggtttgttttatgggttttttttgtttgttttttttttttttgagaaagtctcactatgtcacccaggctgaagtgcagtggcaccatctcggctcactgcaattactgcttcccgggttcaagcgattctcctgcctcagcctcctgagtagctggggttacaggtgtgtggtaccacgccctgctaattttcatatttttagtagagatggggtttcaccatgttggtcaggctggtctcaaactcctgacctcgtgatctgcctgcctcggcctcccaaaatgctgggattacaggcatgagccaccgcgcctggcctatagtggcatttcaaaacagattgttttagagctcacagcccagcaccaatgctagcgaagacctcattgctttagataggtttaggacttaaacttgactctaacaaggtaatggtgattggaaggaaaacctacatttgagtttgggcagcagcacccctctggcatgtcacagtgacatatcttgtcacccaagcagagccttggcattatagatacaggtttctaaaagctgatagcttggctgccagcctcatgggctggatcacccacaacttcatgggcctcttctagtggaagctggagcatttccttggtgaattcttttccctgaggggcaagatccatgccacacagctctctgaccctgtgtgtcacaacccttatggtccatgagcaaaatggttgctagtagtcatttgggcatttctcttctgttttcttatgtgtgtaataagatatacaaagtcgggcttgaagattagaaattgctacttccagtgagtcagtttacttggttttcacatcttcaagttgagtctagaatggagttacctaagaaaaggaaatttgcagccttcagtaccgtgtcctggggttgctagaataactagtgccatatccactctactggctctctagagattgtgtaaaggaggctggccttttggagatgatctgaatacatggtattgaggacaaacctccttcccaaggctgatttgataatatgtgagtttgtgggtctaacatgtagaaatacactcaactgagtggatgtggggtaattctgtgtatttagacagggtgttttgttgttttaatggtacgaaaccttgttttcctggaaataacactatctctgagattgtgatttctgaaaaatgacattttattcctataaccctgccaagggtagtgcaacctctgtggttaagattttaaaattaattttaattcaaaaaagtcacacgtgccttagcacaatgtgaatgtacttaatgccattcaactgtaaacttaaaagatggttaagatggtaaattttaggttatgtatattttattataattgttttaaaaagtgctgattaagaaaaagtatgtatgcttatcatagaaaatgtgaaaaaagaaaaaatcatcatcccactacttagacaactttcaatattttattggtttcaatactttgttatattcgtttccagtcttctatgcatatttgcacacagttgagatgttgtgatattaccatgttattgtgtcagctaactgtcatgaacatgcattctgcagaacaagaaacaggtaagaacgtggctgtagagccagaaagcctcggttcaaattctggctccctagttcttgatgtgcaacagtagccaagttacctaacctcctgtgccttggtttcctcatcaaaatcattgcttctcatcaagagcagttttgctcaggagacacttggcaatgtctacagacgtttttggttttcaagatggcagaggggtcaggggtgctcctggtatccagtggatggaggacagggatgctactaaacatcctagagtgcacagggcagcctcataacaaagaattcttcatccccaaatgtcagtggtgccaaggctgagaaatcctcctctaaatgagatggatataataagagtatggacctcataggatcgttgtgagggctaaatgagctaaaacacttacagtaatgcctagccagtcactccatgtaagtgttagctattattattgctgttacaattatttctttcacttcatatcagcatttttgtatttaaacatctcgttaacaatcttttcagtggtctccaaatatcttttagtaaagttttcctttacataaatgttgcattttcctaatgtgttttttcttccttccttaccagatgaaattaaagcagaaatagaaaagcagaggtaagctatagcactacctccttgctgagatacggcatgaagggagtaggtagcaactgggggagcctctttctctgcttggtttctcatatttctaatcctcaggggtggcacacactctgcaagcatggtgctaggcacacggcacaactctgtgtatgtttgaactgatgctaggttcacaggctactgcctcagtacttgtatacttggaaggaaggatcaagatcgaggtaatgctgttgtatcttttcttaacagaacaggcaaagcccttgtctcttgtatggcctgcttccttaggcatgaggacagcttgcaccatgagtggttactcctgatcttcatagtaaggaaggccgttagtcacgtttcagagatatagctctggcgtggctgccaccaggattcagtccaggatgttgttaattcagcatgccaatcagagaacttgctctctgcatgtggcacttcagtggtgtttttgctaatgcatgtattcaacttttaatgcctagccccaggatatagtttgcaggcactttaaattaaatggttgcagatggaatgggaagttagagtaaggtgtagaaaattcatttcttctcccgaccctctcttgcttttctcctaggcttggcactgctgcaccaccaaaggcaaacttcattgaagctgacaagtattttcttccattcgagctagcttgccagtccaagtccccaagggtagtcagcacatcccttgactgcttgcaggtaccatgtttaaacttcgtgttgtcaagggggttctctccaagccacagttggtccttacacagaactatgctggggaccacgctggcactcagtgctgtcagaggcgatgcagaaaggagcagtttaacgtattctttttggagatctcatgagggagggaaaagagaaaggtgtgagctctttagcttaaaaccagaaattttttcccctagaaatatcttatttgttcatgtcttgtgtatgtttttctaaatgaaacctttagcattaattggaatatttgacacacatgggcacataaggcatttttatacagcctcttttttattttttccattttgtagagatgcagtcttgctatgttgcccaggctggtcttacacttctggcctcaagcagtcctaccaccttggctttccaaagtgctgggtttataggcatgagccaccacacctcctggctcagcctttctttcttacttggtttttttttttttttttttttttttttggagatggaggtttgctcttgttgcccagactggagtgcaatggcgcgacctcagctcactgcaacgtctgcttctcgggttcaagggattctcctgcctcagcctcccgagtagctgagattacatgcacccgccaccaagcccggctaattttttgtatttttagtacagatggggtttcactattttggtcaagctggtctcaaaagcctctttcttaatggcgttaaaattcatatcaagtagagaaatagagacagttgaatctgttgtttttggtagttatgtgctataaagtcacctcccatactgaattagcaaacattgaatctttgttcctggaggaactacagggttaggttcctgcaagcctttagtcttcatgtgtttctatttaaagagactatctaatatctattgttgatgcattaacattgaactcaggggccacggtgctataacacatgcctgaacaaagcttatctaacacacataatttctgtgtgaggcacatcaccaccttcttgctgttaggaacactggaaagcacatcagcacaccctcggggtccattgtaaacagcaaaatcaccaacaaaaagcaccaaaatgcaaaaaacacagcactaactacaccactaaaaagatacttgttttcagtaggagagtgaaacaaggaggcatagtgttgccttgtttgacctcaggaacatgaacatcaagtgatttcaaattttttactgctctgtgcatgtctacaaatgaccaaaaaagccccagacgtattgatttgggcttataaataaattttagtgagtaggtgcatttgcaagtatagctgcaaataatgaagactgactgtatttagagtcacaagtaactttgttataaattaccttttactgaagaagaagcaagagtagagaagttaaggtgacttgtccagtaatatacaggtagtacgagaaacaggactataacttgggtttcttaattcctggcccaccattcttgtacttttgctcaggacctactccttaggtttctgattaccccaaagaacatttattctcttttttgtttattttgagtcagggtctcactctgttgcccaggctgtagtgcagtgccttgataatagctcactagagcctctaactcctgggctcaaacagtcctcctgcctcagcctcccaagtagttgggattataggcatgagccaccacacctggctcaaagaacatttattcttgacctcagtgggcagtccacatcaatgaataaagtttaataaaatttaaaaatatgttgaagtgatccacagcttgccaatactttctagaacaggaatggtgaccagattctgtattctgattgctgtgtagaagaggtgtctgaagaggtgtacagctttctcgagaaagagtactgtgattgattggttttatctaccaaggcacaggactgcaaagtggcagtgagcatgccacatttttggcatctctggtctaatatttactctattaatctctcttctttgttacatgtacttgagaattgatgagagtttcttcacggaaacaactcttccaaatgcaaagccattttgttattcagtgtaattctgtacagattgtcctatgtgagacatacagtgagccaagaattgttaaatggcaggcttcagtcctacttctatcctaaaatattttttgctgtgaacgtgttctgaggagatttggcagaatttgaattttagttgttctctccgcatgttaaggttttcttttgaagggagtgctgataatgtaattgacgttctaagaacagtggctgacatgcattgagctcttagcctgtagtgggccctgtgtgcttcattcaccgtaccgtgtgtagtcccctcgacagccctctgaggtacttactcttgtcctcattttagaatcaaggaaaccaaggcttagggaatgaagtgaccagcctagtccaaggtaggctgcagtgcagtggcgcgatcgtggctcactgcaaagtcaagtgattctccccgggctcaagtgattctcccacctcagcctctcaagtagctgggaccacaggcttgcacaaccacacccagataattttatttttatattttttgtagagacagggtttcaccaagttgcccaggctggtctagaactcctaagctcaagtgatcctcccgcctaggcctcccaaagtttggggattacaaacatgagccactgcacccagtgggtttctaggacttcttgactctgtgtctgtgttcttaaccaggggtcatcagctttggcccatgagccaaatctggcctactgtctgcttttgcaaataaagttttattggaacacagctgtcttagtctgcttgggttggtgtaacagaatatcatagactggatgtcttcaacaacaggcatttatttcttacagttttgaaagctaggcagtataagatcaaggtactggctgatttggttcctggtgagggtacactccttctggctgcagacagctgtgttctcacgtgtcatggagagagagctaggtttctggtttcttcttagaggacactaatcctgtcatgagggacctaccctcatgactgcatctaagcctgattatttctcaaaggcccagcctcctaataccatcacattgcaggcttaaggcttcaacatacaaattttagggggacacaaactttcagtctgtagcaacagctatgcccattcgtttatgtattacctgtggctgccttcctgctactgtgacctagcggagtagctgtaaaggagaccaaatgacccgcagagcctaaacatttagtatgtgttcctttatggaaaaaggttgctgctcttaactggcccctgctcttgactgtacccatgtggttctggcctgtttagtaacagaaatcgtttgtttctggaactccttgcatctgagtatgatttcaaacggaaacacaccctgccttgtttcaacccactgtgaatcttgagtcttatggggtatggttatctctctttttagaatggaagttctggctgggtgcagtggctcacgcctgtaatcccagcactttgaggcaggaggatcacttgaggccaggtatttgagaacagcctgggcaacatattgagaccccatctctacaaagtaaagtaaaaataaaaagttagctgggccatgtggtgcacacctttagtcccagttactcagaaggcagaggcaggagaattgcttgggcccaggaggttgaggctgcagtgagccgtgatggtgacacctaactctagcctgagtgacaaagcaagaccctgtctctttaaaaaaaggaaaaacacacagaaaggaatggaagttctctgagatgtaatagattctctgagatgtaataggtacactaggatttctttgtttagtatacaaaatgagtcatcctttttatgacatgagaaagtggctcggtgctccctgggctactgaatggaaaaaatgtacttccccatggtggctgcccttgccaagcctgtttgactggcttttcccagtgtgggcaaggtaacctctgtcttagaaatggaaggccagcatcggggtaaagtttggtttgggcagaattgaaaccagctgcagatacatcagtgctatgccctgccattccttgagcttggcgcagcagtaggagtggcaaaggtgcttctgggattgatttgccataagcacagttagctcaggcttcctctccactgggagaagcctggagacttcccctgcggcttgcttctaccaggtgaaaaagattctgtcttccctttctccagcatttggtctgctacacgcttccccgcagccagggctcagtgtaaggggggttaaggtcagtcttgtctaagctactaagtagtccccaagtttttctggtcacatatcaattttatatatatatatatatatttttattttttatttttttagagaaagataggtattttttagagaaaggaaacacctttcattctgttacctaggctggagtgcagtggcgtgatcaggcttccgaaaaccccgacttccccaggctcaggtgatcctcccatctcagcctcccaagtagctgggaccacgggctaatttttctattttttgtaaaggcaaggttttgccatgttgtccaggctggtcctgaactcctgagcttaagcccaccttggcttcctaaagtgttaggattacaggcgtgagccactgtgcccagccagtttttttggttttttttagagacagggtctcactctgttgtccagactagagtgcagtggcttgatcatagctcactgcagcctcaaactcctggactcatgtaatcctcccacctcagcctcccgagtagctgggactacaggtgtgtgccgccacacccagctagttattttttttactttttgtagagaccggggtcttactttgttgcccaggctggtctcgaactcctggcctcaagtgaataataaaaccatttttgaggatatcctgccaatatattcatatttctttaatttaaaattataggttagggccaggtgcggtagctcatgcctataatcccagcactttgggaggccgagacgggcagattgcctgagctcaggagttcaagaccagcttgggcaacatggtgagaccccatctctgctaaaaatacaaaaaattagctgggtgtggtagcacatgcctataatcccagctacttgggaggctgaggcaggagaatcacttgaacccaggagatggaggttgcagtgagccaggattgtgtcactgcactccagcctgggcaacagagtgagactctgcctccaaaaattaaaataaagttatgggttgggcatgatggttcacgcctataatcccagtgctttgggaggccaaggtggaaggattgcttgagcccaggagtttgagctcaacatagggagacctcatttctacaaaaacctctttatttacacatgttcctgttattaaagtatatatatggccaggcgcagtagctcacgcctgtaatcccagcactttggaaggccgaggcaggtggattgcctgaactcaggagtttaagaccagcctgggcaacatggggtgcctgtactaaaaatacaaaaaattagccaggcatagtggcatgcgcctgtggttccaactactcaggaggctgaggtgggaggatcacttgagcctgggaggcagaggttgcaatgagcagagatcgtgccactgcactccagcctgggtgacagagtgagaccccatctcaaaataaatatataaataaataaattacatatattgtaaagcatacaaaaatacaactttgacaggacaattggaaaaatataaataaaattctaacattttctttttacatcccagtgaaggctgtaggaaaccattaatctaagctgccctgtttataccataaacattatcttttagctcttatttccagaaaacttttgattttttaaatgcacaatgaaaaatcaatttttaattatgtaagttgtacatgactacagtctctgttaaaaggtttttagaactttacagataaaatgaagttccttgggccaccagccccaaacccaattgcctgtttaggtgtatacttttctttcctctctttttttttcaataagtgatatcacttgtacaagtttctctgcagctttttacattcaacaccgttatcaggctctagctatatctctccatgtggatctagtgcattcttttgactggcatatgacgtgtcatgccaccattccatctctcgctcccctgtacagaggcacacacagggttatagtgaacatctctgtgcaagcctccttggagacatgcctcagtttctctggtcagaggtgactctttggattcctatcactgaggcaaagtaaatagaaccaacttcagaagagaccagtgaggtagaagacttaatttgtaccaaatatattcattcatgtgggtgggataacttgtaatacagcttacttaccctaacctctgtttattacagtacagaggtacagtatgtcctattctgtaccaagaaaccaaccgcatagcattttccttcatgcagtgagtcctataaaggcctgttatagtgtattatattgtcatcatcttcccctccatggcagaatgtccctgtgcaagccctgactcatgtgtcagtgggccagctgcctagaggcctccctccctgtccgtcttcccgccgctcattgcgttagcaaggaacaaggtggggacatctacctgggggatagtgggagatagggggcagtatctacaagtcacacacagccctgtaggtcccagttaggactttgagctttggtgcacctccctggagaatatagactctataagaaaaataattacgtttgtcttactattgtatccccagtgcccagaacagggtctgtcacaaagaaggatgagaaagcagaaccagaaagatccacaggatacaggaactctcctttctcctggccttgtctcactgcacagatgaggggggaagtcatgcttaaaaccctttctgatttgaagagtaatgtgccccttaaggagtctggagaggggaggatactttctgtccttttcatactttagttaaagtgcgaaagtcgtaatccatgtccagcctgctttgtggcatcagtattgcagcctacttttcagcattcacatttgaggagttcctagaccaccccacttgcaatccagtgcacaaaacagacttgagtctgttagatgtaagaacaagcaatgtcaaaaccagagctcattttccaggtagacagccctgccctcctaggaagcctgcacctgcagcagcaatgtgaggggtgaggtaaagggcatctggacttgcccttcacaggccacacccctcacctggagatttgggggttggacttgagcagcagagtgtacgcaggcctctctcctgctccttcagttactccatccagtagtattgcatttctactctcagccactctctcaatccatttttctttctgcttgttgagtggtgacacttcactagctaaggaaggggaaaagccattgagaaacggtgtcggacctttgcagagcggccagtcttcctcccacagtggtggctgctctatagataacctcaggaacctgagtccccctggtgggggcagaagcatgtgaccagtagaagccaaaaaggggaaagaacagaacagcagttttaggagtcttcaccaagtcactggaggcagagaatgccttagagttcacatgtatatgtgccagatgagtgattcttttatctgatcaaccatcaatataacgtggatagcttggagaaaaacactgattcctgggctccacctggaagttctgcttcagtaggtctgggtcggagtccaggaacctgtgtttttagtgagctccctcaggtgattatgtttctcagccaggcttagaaatcatcctgctgctgacctttgaggttccttccagctctgtcctccatgctgacatcccggttgtgtgtgaggtggcacagaccaatttgtaacctctcagagagggcacgttccaagcagctgctcgtgggtgacacacactactattgatgtaggtgtgaaatgcagatgaagtttttacattaatttttggggtagaaaatacactgacaggattcaacgttgaaaaaaatgaaaagatgtactacagagtgtcttagtcccaccccagctcacagctacttagttctcctccctcaagcaaccatgttattagtttcttaggtatctttccattgaaagaaaatacatattcatatatatatataattttaacagctttttgagataaaattaacatgcatacaattcatccatttaaagtgtaattcaagccaggcgcggtggctcacatctgtaattccaacactttgagattacaggcaggaggatcgcttgagcccaagagtttgggaccaatctgagcaatatagcaagaccccatctctacaaagaataaagaaaaattagactagcttggtggcatgtgcctgtggtcccagctactcaagaggctgaggtaggaggattgcttgagcctgggaggtggaggcatcagtgagccatgaccgtaccacttcattccagcctaggtaacagaataagaccctgtctaaaaaaaaaaaaaaaaaatatatatatatatatatatatatatatatatatatgtatgtatatacatgcacacacacacacacacacaaaattttgtgatttttagtttattgacagagttgtgcaaccattaccacaacctaactttagaccatttttatgttatcattgacgatcactccctatgtctccctacgccgcccccctaactctagacaaccactaatctctctgtcttgagtatgtgtagctattaattcctcaggcttgcagagatggttgcgtactggggagtgctctataccttgcatttttcatcggatactgtatcaccattccaggcatcttttgctgtcaggcgacaggacgaaggttgcagtcacagagtggttatgcctgcctggctcctggggagcagaggactctgtaggaactggaagtgcctgtcttttgctcttgtgggctgccacggaaggcctcagtcctagccaagcagaaatgtataatctctgttctttctctctttagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggtatgcctatttgtttgcctgtctggtttttaaattagaaagcaagtccctgtgggaatctggatttctaatttactatgtgttagttgtctcaggtggtgctgaggtggaacagaaagatttaagcgtcacttagatcttttgttaggtgtcagaatttattagcgtggactgagacaagaaaaatggaaccaggtgtgttttcaaagtaaactgttcagctaataacaatgtaaatttcttgtgaattaaatcgtcttgaaatcctctggttaaccctggattcccagtctgggtttctcagtgggtctttgttgatattcttatctctgacttgcctctgtcctacttccctgttcgatttctgctgccaggaatggtttggcacagatagtaccatctgcttgtctgagaacaggatcaggacaggtgtagccaaggatccaaatattaagtcctgaaagtattaacattatgaggggagggctccatgctagataaacctttcttaaagctcccttgaaaacccactagggaattgggaaactgaccacatcgaaacgtatattttctgattaatctgggtgagatcacgttggagtgttatatgtcatgagataattgtctgtattattcattttaggtttttcagtcagtatgaaaattcagaagtttggcctttttttttttttttttttttttttgagacatagtcttgctctgtcgcctaggctggagtgcagtggtgcaatctcggctcgctgcaaactccacctcacaggttcaagcagttcttgttcctcatcctcccgagtagctgggactacaggtgtgtgccaccactcctggactatttttatatttttaatagagatggggttttaccatgttggccaggctggtcttgaactcgtgacctcaagtgagccaccctgcctggctggaagtttggctttttaaaaagtgagccagtagaaagcctgcttcaacacaatttaattgtttcgagtgatttggatttcatagaactgttcattgtttttcaactaacagccataggagttggctcttcataataatcacctagtttaatttgcagagccatcttacaatttatttgaaaaaagcacacagaaaagaaaaacaaaaccagaccctctagaaaagtgtggccataggagggcaggaaggtgatgtgcgttcctgatggtgaaggtcgcggatttctattttaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacgtcattttcacccgcatggaaaaccaagtggtgagtgacagcacttacgtgctaggggcaagacatcattgctctctgaactctatcatgtgtgaccttggtgcctgtgaagaatcactagcattttaaagctaccccttcttcctgtggattctctgtactgtgcttttgttcttgctttaaaaatcagagaaactaaagggttttgaaatttgtgttcagaatttgtttggagactgtcaaaggaatttatttccttttaaatatgttatccttttggctggaatttttctttctttctttctttctttttttttttttcttttttctttttttttggagagagggtcttgttctgttatccaagctggagcgcagtgacaggatcatggctcactgcaggcttgaccttcccagctcaagcaatcttcccacctcaacctcccaagtagctgggactacaggcatgtgccaccacacccagctaatttttttattttctatagagacagagtttcaccatgttgcccaggttggtctcgaactcctgggttcaagaattcctgctgcctcagccttccaaagtgctgaaattataggcgttaaccaccgcgcccagcccaggaaattttttaagtaataggctggcataatttttcttccttaccaaaatgctgtatcccccttttgttgccttttagttgcaggaggccagagaactggaaaaaccaatccagtcaaaaccccagtcccctgtgatccaagctgcagcagtatccccaaagttcgttcgtttgaagcacagtcaggcacaaagcaaaccaacaactcccgaaaaaacagatttaaccaacggtgaacatgccaggagtgattctggaaaagtaagcacagaaaatggagacgcacccagagaaagaggctcatcactgtcaggtacgggctgatacggtatggctctttttccaagtgtgagagggaatcagcctgtgaggggcagaagaagtgtatgtcataacatctgaaggaaacctctgataacagcttatctctttctgggcctttccctttgcttttctcttagggaacacaaccagtgaggcatgatgtcaagtgtcccgttgtcagctgtgctgttttctctaaatagtactgggatgtatctagctgctacttcttcatgtcagcctcagtgcaacaggttcaggttgggacacttatctttcagtagttaattgattgggtgattagtcactcagtgtccacaggaggacaagggcttagattctcatgtctacactggatctccatgccttgcccagtgcctagcagtagccactcatagatatccatggaaggagccagaaggtagcaggtggatggacggatagacagatggacagatagctttgttttcttcttctggtgaccatgtacatcacttgtttttgttgggtttttaagtgagagactaacccacacctgattatattcttaaagtaaatgaaatgaaatactggattgagttgttataagatgatacttctgactgttcatatctctccctgggcagtttgtaggaaccagatccaaaattggtattttttcaggaatttcctttcccaagtgattctgtcaaatgcttcttcactcaagcaggttgttctatacaaaatatctgacctgtcttcataactgatctcatttcttcttcagccacattactgataatgatttctgttggtagtatgttccctactggagtgcacatatttgagcaggttttattcctttataatttaccagactgcttgatgtacatgagaacagaccaagtgttgttgctggaatgttgtttggtattcatttactcaaggaaagcacaaaagaaaaaattgccaccaagaatggtgttgtgtctcagggtgagcacggagttgccttctacttacttctgctgtcgagagtcctaaggaaggtgctcagaatcccccggcccaccctctgtgtctgttatcatctttgcctttgtaactctctagggaaaggaccaggtttttactgtaacccttattaagctgtgatcagtcaataaatattaatatttaaatacactgtaataagcatagctgtgcagatataaaaccaagtctctctgacctgcataaaagtgcttccactttagcccattttctgtacagcagccaaagtgatctcttaaaagcgtgaattagagcatgacccctgctcaaacccctttggtaattccccatcctgtgccattctgactgaaatccatgccctgtcctcatagcttatacctctctttctcttttttgctacacagtgcacaggtgccctttctggttattgaacggctgtgcttgtttctccctcagtgcctttgcacttactgtcccttccctgcctctgaaccccttgtatcttcaggtctctcagttcagactgagagaggcttctctgatcaacttctgtagctcctcatcatatctgtcccattatcttttatttttttccatagtacttacaatacctgaaattactgaagggttctgttcacttgttcctgcactgaagcctaggctgccctgctcaccaccatattcccaacacctagaatggtgcctggcacacgcagcagacattgagcaaatacattttttgaatgaatggggaaaaaacgttattgctagaacataattttgtagaaacgcagtaacttgaagttctgctctaacaaagagaaaataatttgctgttagcatgttgctgtggattttgtggccaatacttggtgcatcctgtgagactttcccaggaacatgggaatcagattgcctgggagaagcaaaccccagacctgcaaatagtgggtcagaacggaagtgtgctgttacctttaaaaagagcaagtgggctgggtgccatggcacacacctgtattcccagttacttgggaggttgaggcaagaggatcacttgaggccaggagtttgaggctgcagtgtgtctgtgaatagcctctgtgctccagcctaggcaacaaaacaagaccccctctctaaataaataaacaccccatctctaaatcagtcagtcaatcttaaaggagcaaatgacttccagttctcaggactaggctctaaagaaagaacaggtccttcagaagagggagttgaacaagggagacacgtacccaggggcggagtccaggcatcaaggcccagtgaaaggcctgagctctagtgcctctgtggctattatttttacatattactaaagtgcatggatgttggacacaaccatggggctctcccacagactgtcctgtagtaatcaccatcacatggccaaccctaactggacactcactgtactgctgacttggcattcaacataatgttttccaatttaattaactgggaatcccccccacagccttcctaggataatttgcctcccatgttatttgtgtagatgaagagaattcaccaatagacctggacatctgtggtggctcacgcctccaatcccagcactttgggaggccaaggcaggcgggccacttgaggccaggagttaaagtttgtttttaggattctgacttttaactcccagcatcagacatcagtgtgtgtacatttttacagatactgtgtagaattacctatgtgtttgtgtggatttcttagctcactttttgcatctttttttttgagaatgagtctcgccatcttgcccaggctgtagtgcagtggtgagatcttggctcactgcaacctctgcctctgcctcccaggttcaagtgattcccctgcctcagcctcccgagtagctgggaccacaggctcacaccaccacgtctggctaattttgtattttttagtagaaacggagtttcaccatgttggccaggctgatctcgaactcctgacctcaggtgatccacccgtctcggcctcccaaagtaatgggattacaggcgtgagccaccacgcccaaccaggatctttgttttagacagcaatatgttccaaatgcctggaactgtgccggacacatacacactcagtttgttgattgaatgaatcttaccgccccaccatcccccatgctccctatttaactggacagagaacagggatgtggggaggccttatctcagactcctcccattttttccccgttattcttagcatgtgacttctatccttagggtcatcttatggctcaggatcctgtcattttgttccaggtaggaagaaagaggaagagataggactgaagaactctgccagctgagtcaccccccttctaaagaggagtcttctggagcttgttgccaaccctgataacttatgcttacccctcattggctataacttcatcacatgatcaccctttctgcaagaaaggctgagaaatgtaggcacattccctcccaaaacaaaattcaggatctgttaggaaggatatgagttagagaactggcagtgcctgccacagagtgttctccagctggctagggagggaatggcagcaaggtttctcctatgtgagcctattcaaggtggccctcttattttgcttcggggcagagtctgaaacagatagggtctggtgcctaatcagtagtggtggtgatatcccagggaagagcagaaccagtggtttttaagtagattctttgtacctctcaaaggtttgatttgatttaattatcaaacactttcacagcatgcttgaaacttagatacaatggacttagtagtggttatcacaacatccagaaaagcctcttctgagacctatccaaggctgtcatgtcagcaggggaagcagtccacagttactgggtggagtcttcctgctttggggcctctactgggatttttccttagcagctccctcttcaggaaccttctgctggtattcgggctttctgactctccttagctcttcctggcctgagaatgttttgattttgcataagtactattatggatcctgcctattaaggaatatgagttatatactctatccctccaaaaaacgttgctcttgatgctgtttaaatggaaaaactgcagtgagggaaagaggagatccatgctgatgtgaaattttgtttttctccttaggaatgaaagatagtgaaggttttaactaactggaactacttgcagtgtgattcgttggaaattttcattatggatttagtctgcagggccaggcgggtgacagaaatgagcaggcttctatcatgaggacatcataaatgtcttcacacaagcacctacatataaacacacaggcctaataaaaagtagcatttgagagctcacttttttcaggcactgttttaaatgctttatgtgtatcattctcacagggctttgtttactggtaaggaaactgaggcttggggaggttaagtaacttaagtccccacagtgggaagtggcagagcagggacccggaccaggcatgcaggctccagagccctcgctgttattcatcatgctgaattcacttctacaagggaacattttttctctgatgttcttttttttttttttgagacggagtctcgctctgtcgcccaggctggagtgcagtggcacaatctcggctcactgcaagctccgcctcctgggttcacgccattctcctgcctcagcctcccgagtagctgggactacaggagcccgccactacgcctggctaattttttttttttgtatttttagtagagatggtgtttcaccgcgctagccaggatggtctcgatctcctgacctcgtgatctgcccacctcggcttcccaaagtgctgggattacaggtgtgagccaccgtgcccagccttctctgatgttcttaaaacaccctgcccagtcagcctcccattttctctgctcttgacagacatgttactttcctgcttactgtgtagtaacaacagtggtccaagtgtgatggcacctcgcatttggccccaagggaagggagtcgattgggagtggtgaggactgaggcaacagggtatcagctgagttcatgccctggctgaagagggcagcttcacctggttccagccagttgtggcccagtgttgccacatagttgggttttttaaatagaagcccattctggtttttgtgagtagtctcctggtttttaaatgttggcagctaattcagaagttttaaaaagcagcacataggctaagcaatacatatgtacaggcagaggtacttgccagtcaccactctatagcctctggtctaactcactgaggctgtagcttctttgataaaatgagttgatatttcttgggtgttgaatgtaaatgaggtgctgtgtactttggaatgtatgatacagattggaaactgtcaccataattttattaatatcatagcatcagagaaggttgggactggaaaggaacttggaaatatctagtcatatgttttccaaattacaagaggtgagatgtcatgataagtgaacccttccttccctccttccttccctccctccctcccttcttccttccctccgtccctccttccctccctccctcccttcttctctccttctcttttcctccctccctccttccttccctcctttccaccctccctctttccctccctccctctgtccctccttccttccctccctccctccctccttccttccctccctccctctttccctccttccctccttccttccttccattttgagacaggttctcactctgtcacccaggctggagtgcagtggcgcaatctcaaatcactgcaacctctgcctctcaggctcaagtgatcctcctgactcagcctcccgaggagctgggactacaggtgtgccctgctgatttttatactttttgtagagatggggttttgctgtgttgtccaagctagtctcaaactcctaagttcaggtgatcctccccacctcaacctcccaaagtgctgggattacaggcatgagccaccatgccccaccagaacgttttatattttaatggttatttattttaatatgcattcagaaaatataactaatgtatgaaaactgttattttgtgaattttattgcttaaggtgagttaaagagcactagtaaatactcgcagtcatgcattgcttaacaacagggatacgttctgagaaatgagtcataggcagtttcactgttttgcgaaagaatattatgggtatacttacacaaacctagatggtatagcctactacataccatatgtatagcttgttggtatgggcatatggtatagcctattgctcctaggctataaacctgtacaccatgttactgtattgaatactgtacgctttggtaacacagtggtaagtatttgaaaaagtacagtcacaatgcagtacaaaagataaaaactgatatacctgtatggggcacttaccatggatggagcttgcaggactggaagttactccagtgagtcagtgagtgagcagtgagtgaatgtgaaggcctgggacatgaccgtatgccactgcaggctttataaacactgtacacttaggctaccctaaatttataaaaataattttcttttttttttttgagaccgagttttgctcctgtcgcctaggctggagtgcagtggcacgatcactgctcactgcaacctccacctcccaggttcaagtgattctcctgcctcagcctcccgagtagctgggattacaggtgcccgctaccacacctggctaatttttgtatttttggtagagactgggtttctgttgttgaccaggctggtctcgaactccagatctcaggtgatccacccgccttggcctcccaaagtgctgggattacaggcatgagccactgtgcccagcctataaaattaattttctggctgggcgcggtggcttatgcctgtaatcccagcattttgggaggccgaggcaggcagatcacgaggtcaagagatcgagaccatcctggccaacatagtgaaaccccttctctactaaaaatacaaaaattagctgggcatggtggtgcacacctgtagtcccagctactcaggaggctgaggcaggagaatctcttgaacccgggaggcggaggttgcagtgaaccgagattgtgccactgcactcgaccctggcaacagagcgagactctgtctcaaaatataataataataataataataataataattttctttattcaataataaattaattttagcttactgtaacatttttaccttataaacaattttttttaactttttggctcttgtaatagcacctagtttaaaacaaacacatggtacagatgcacaaaaatattttttctttatattcttattctatacttttttttctatttcttaaatttttaggtttttaaaactttaaaattatttttgttaaaaactaagccacaaaacacacagattagcctaggcctgcacagggtcaggatcattcatatcactgtcttccacctccacatcttgtcccttggaaggtcttcaggggcaataacacacatgaagttggtatctcctataataacaatactttcttccggaatgcctcctgaacctgcctgagacttttttacagctaactttttcttttttaaataagtagaaggcaatgacaataaagagtatagtataggctgagcacggtggctcacacctgtaatcccaacactttgggaggctgaggcaggcagatcacttgaggtcaggagtttgaggccagcctggccaacatggcaaaaccctgtctctactaaaaatacaaaaattagctgggtgtggtggcagacgcctataatcccagttactcaggaggctgaggcaggagaattgcttgaacctgggaggcggaggttgcagtgagccaagatcgtgtcactgcactccaacctgggcaacagagtgagactctctcaaaaaaaaaaaaaaagtataataaatacataaactagccgggcgcagtggctcatgcctgtcatcccagcactttgggaggccgaggtgggtggatcacctgaggctgggagttcaagactagcctgaccaacatggagaaaccctatctctgctaaaaatacaaaaaattagctgggcgtggtggctcatgcctgtaatcccagctgctcaggaggctgagacaggagaattgcttgaacctgggaggcggaggctgtagtgagctgggattgctccattgcactccagcctgggcaacaagagtgaaactccgtctcaaataataaataaaaaataaataaataacaaactaataacatagtggtttattaccaattattatgtactatacagaactgcatgtgctattcttttatatgactggtagcacagtaggtttgttcacaccagcatcaccacgaatataagtaataagttgtgctgtgacataatgacggctatgatgtcactagacgataggaatttttcagctccatttgtaatcttcctggaccactattgtatatgtggttcctcattgaccaaacgttgttatgtggtgcataacagtatatttaaaatacataataatatataatattatagtggtgcatgaatgtggcaaaagccatgaaggtggtttgagaatgactaaagtttgagtaacagtgatctagtctaaatcatcctttttagatgaagaagtgagtttagcaattgtgactgtttctggggttttctaatttcaagttccctttgccttctaggaaaagcttataacatcagtatttcccacacgaatttactttgccacgtagatagttccagagtgttaagtgcccagtggaaatgaaaatacttagcactgccctccgggaccttatagatcaagcatagaactcataaaaatggtggctgggttgaaaattctcattaatacacagtcaaaggattattttggttttgcttttttaaggtgatggcttttttggtcaacgtgatgttttataaatgagtaatgttaggccaggtacaatggctcacgcttgtaatcccagcactttgcgatgccaaggtggtagatcacttgaactcaggagttcaagaccagcctaggcaacatagagaaacctcatctctactaaaactacaaaaattagccgggcgtggtgaggaggcgggaggattgcttgagccaaggaggtggaggttgcagtaagctgggatggtgccattgcactccagcctgggcaagacagcaaaactctgtctcaaaaaaaaaaaaaagtaatgtttacttctaaatatctggtcaagaactgtttactttacgtaagctctttcccagagctagttttctgcggcggggggagtaagagatactgaacctcttctacttaaacagttaacattttacagaataatttcataaaagtttagtaaatccttaactatcacattggaaatctcatgccagattctgggtttacagtgtgagaaggcgaagcagcagaaggcatgtcatttaccaaggctcgttggtccccgaggctaaggcacaagagaaagctccatttgttctgccaggaactctggctggataaaatcgagctcctgcctccaagttgggggtggtggggagggccctgggccgagccactgggacttaggaaggaagagagtagtataagccagtggggttttagtgttccacaaagggaacctcaaaagcagaacagatgctgcctaagtttccagatttcaaggaagttgtcctccattgacacaatcagatttggccttggggagaacttatttgcaccctttgccttctgaaatgtaactccccataatctccttttcctctcttcctttgtttttcctgaaaatgcccacgtgtgttttgtatatttggatgtgtgtgtagggactgatgacggagcccaggaggtggtgaaggacatcttggaagatgtagtcacatctgccattaaaggtaagaaccaaggacaacccagcctttcctcttccctcattcctccaaaaagtcctcagcaaaatattttagtggtggagtttcctcttccctgccctaagaactggtggagctcatggaaactgaatcttcccacgtctgcccatcttttatatgggattcaaaaatgacttgtttttactgactgattttagtctcatttgggttgggtttaggaaacatagtctgggccaggcgcggtggctcatgcctgtaatcccagctctttgggaggccaaggcgggcggttcacgaggtcaggagttcaagaccagcccagccaatatggtgaaaccctgtctactaaaaatacaaaaagtagccgggcgtggtggcgcacgcctgtagtcccagctattcgggaggctgaggcaggagaattgcttgaacctggatggtggaggttgcagtgagccgagaacgcaccactgcacttcagcctgggtgacagagcgagactccatctcaaaaaaaagacacatagtctgactgtgttaggcttagatgctccacatagagatgccaagggccattccatatgccttgtagattaggggatgtccaggtttttctaggagtgggctggagccctgagatccatgtccattggagctgagttttcatggccagccattgatgtgtcaaggggacagtccacatgtcagcaggtatcaggtgtacagggaagctttgttttgttaggcttcattcataagtgcctcatggtatggtttcagtggaattaaacttgtatggctcagaatgactgttagatgatcttttttctttgtttctgcccaaaatctcaggtcagtgggtatatgttgaacactttgttccaatgccagtaaattatgaatttgtccagaaatcaaaatcttaatgggttttcatcagcttttttttaaatgaaagagagtaaaatgaaacagagtacaaatgatctgactgtatcacatataatgttaagtattgtttcatgaaatgtgtttcagttacttatgtgcccatgtctatactgggatacagttttataaattaatttcttacagaggtcaagatttgaaagccacttttctaagccctatctttttgtttaggtaccacaaagctatatacatattctattatttatttaacttcttatagaaatgcctgtaaaatagaaaaattttatttcatacctttagatttgtttctgggatctatacaagaagtcatcacataatggatgtttgtcttgtttactttgtgtcctccagccgctactgcagagcctggtacataattggcacttgataaatatttattgaatgaaatatgctttgtagggctattattgaaaattgttctcattgtttcatgtccctttatagaaccacattataaatttttcttagagtttcattgctctgctgatcatcagatatgctttccttcattaaatgatgaaatctgtgtaattctttattttaattcccttttttcacatggctgccaagaagctcaggtttacattttttctctgtgactaaggttttctgtcataactggctcttctctaattcctttattaatggtactttaaaaaaatctgtacctttcatgtttagctgcttctaatctttttcaaaagtgaatgggggtgggtagggctgctgcattgcacagttctggaggcaccattgatctggagagaattgtatattgctgtggccctggcagtggggctgtggataacaaacactcgtaaggcttaagcatcactttggccaaggcttttccaggattatgtcagtcatgggctggtggcacaggaaaaggggaaaaagcaacagctgggaggttcacagataacttctttttggtgtcaggcagccctttagggtaagtacagtactaatttggctatgactttgtacttgtgttttaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggtatgttggtgatcatcctctgtggacttattgccatttttactttttcaaaagatgcagaattaagtctttcctcaaaagaagcaactaaaataagcaagccctgttcctttattagtcacacagtcctgggctgatattctttgtattagcaggttcagttcttagaacgtgctaatgttgcttggtatataacatcattattaaaccctgtttactcagacttctaatacttaaatttcttgccacttttcttctctctcaaaatagtatacattcattatagaaaaataaaatatatagttacccgtctttccttctctgtattgaaaagtcagtatgactgtattgaaagccatccataacccatagattgcccttgttaacatcttacttaaatccatctagatttttctccatctcacgtatttttccacttaaatagaataatacagtatgtatcctgtgttgcaacctgctttttaaacaatttatattatgaacattctctcaggcccatagatatgtctgccacattatatttttaaatagccttactgttctcttaaaagttgctttaaaattaaatataaacattcaaaataggaagtaatatgatgtgagtgtccctctagaccccattttctttgtctttttaccagtgtttctcaatctttttcattattgccccttcctccaagaaaactttgtagacattttttcctaatcatcattccccattaagttgtaatgccagcaataaactggatatccatatgctacatgtatatctgtgctttatacataaaaataataagggtttgttgttcttgttgtttgtttgagacacagtctcactctcacctaggctagagtgcagtggtgtgatctcgactcactgcagccttcacttcctgggctcaaatgatcctgccacttcagccccctgagtatctgggactacaggcatgcaccaccatacctggctaattttttattattatttgtagagacatggtctcactatattgcccagggtgatcttgaactaggctcaagcaatctgcccacctcagcttcccaaagtgctgggtttacaggcttgagccactgtatccaaccagaataatgtttttttccccccttgaggatgcgcttaaatctatacaagggactcgtgttatatgctaagctgcaatttgctttgtttactcaacactatatgatgggcatcttcccctgtcagtatatgtagagctaacagaaatttttaatggccatgtaaaattctgtatggatcactgtaatctattaaccaattccctattgggtttttagattattccagttttatcataggaaatggttctataatgaatatccttatagataactcttaattctttcttaggaataaatgcctgcaagtagtattgatggttcaagagttggaagttttagctgagtgtaatagcatgcttctgtattcccagctactcaggaggctgaggctggaggatcgcttgagcccagaagtctagccaggggaacatagcgagaccccatctcataaataaataactgtagcaagatcatgtctcataagtaaatgaatgaaagagagtgggagttggaagtgttaaggcttttgacatttaacaccaagtcagtcttctgggaaggtactacttgaatacctgtccacctttaatctctcaatacccattttcccattccctcattaaaactaggcagcagcctttattcaaatctttgctagtctgataggagaaagctcctactctaatgatgagtaataaggtcatttagatttctttatcatttgcatctattggtacattgcttatccatgttgttttcattttggaggaaggttttcatatttccttaatgaattatgagaacttttatatgtgggggatattaatctttattatatgtttttaaaatttttattttatttttttgagttggagtctcgctctgttgcccaggctggagtgcagtggcgcaatcttggctcactgcaagctctgcctcccaggttcatgccattctcctgccttagcctcttgagtagctgggactacaggtgcccaccaccacgcctggctaattttttgtatttttagtagagacggggtttcaccgtgttagccaggatgatctcgatctcctgacctcgtgattcgcccgcctcagcctcccaaagtgctgggattacaggcgtgagccaccgtgcctggccaaaaaattttatttttatgttttgcttttaaatgtaatttaccttttttttaggtgaaaaaagtttatttcgtaatacctatactttgttacccgtttatcctgcaatagttgcaatagtattcttttttttactttttttttttggtcacccaggctggagtgcagtgccgcgatctcggctcactgcaacctttacctcccaggttcaagcgattctcctgtcttagcctcccaagaagctgggattagcagagatgaggtttcactatgttggccaagttggtctggaactccttacctgaactgatctgcccaccttggcctcccaaagtgttgggattacaggcgtgagccattcatcgcacctggcttacaatagtattcttagaaatatctttcttacccaagctagtataattacctgtattagttttggtttttttacagcttaacttttgatcatttttcattttaaaccacccataccaactctgaagaacaaggaacaaggttgtagaattgctgtgatggcttctccatagctcctattttgtcatatccttccctcccccacatccctcatctctctattaaatagaagaatttgaatttccaagagataattacatttctaatttttgataagagttagcttttgttttgtcctctccctttttattttttgagatacggtctcactatgttccccagattggagtgcaatggtgccatcatggcttactgcagccttgacctcctcggctcagtggatcctcctgcctcagcctctggagtagctgggactacaggtgggtgccaccacacccagctgatgtttgtttctgatcctaggaatcggatgcacaaggacatcaagtggctgccaggttctcccacgttctgcagaaggatgccttccttgtgttccgctccctgtgcaagctgtccatgaaaccccttggtgaaggccctccagacccaaagtaagcagacagcagttcttggccaccttcagtccaatgatccagcagcacatggtactgtgtttcacacttcccttgttccaagaagtttcagtgtcatgtctctttgtcagtgtaagtgcaggaacggttttacaacttttcagactcatgcagtctctagagtcctttcatatggaattgtctctgtatccccaccaaccaagattttgcccagttttgcttttcttggcatatgaatgctaaaaaagtctgtttattgaacacataaaaaacacatttttactagctagtggattgaatctcttgatgtggggtgtggagggacaggatgcctgcaaacctcagttccctgttctgttggaaacctctgcttcatcgatacagatgtaagccccagattcgacacagggaagccaaacatttctttgtagtaaacaaactactacaaggatgtcagcgctgtggagtgaagaaagcagaggcttcagagccagagagagctgcatttagatcttggatcctccacttgagagcagttccttggctatatgacttgccaagcctcatctgaaaaatgggaatatggaaaatcatcttacaggattgattaaatgaaatatcggtgttgtcctgagcatggggccttgtactttataaattatctctattgttcctgtcattagtcattaataataatcctcaattcatctattactaatgctgctaatactgtgataggtattaggaaaataggctgggtgcggtggctcacacctataatcccagcactctgggaggccaaggcgggtggatcacttgaggccaggagttcgagaccagcctggccaacaagatgaaaccccacttctactaaaaatacaaaaattagctgggtatgctagtacatgcctgtaatcccagccactcgggaagctgaggcaagagaatcgcttgaacccaggaggcagaggttgcagtgagctgagatcgtgtcactgaactctagcctgggcaacagagcaacaataaattttaaaaaataaaaataggccgggcgcggtagctcacgcctgtaatcccagcactttgggaggccgaggcgggcggatcatgaggtcaagagatcgagaccatcctggccaacatggtgaaaccccatctctactaaaaatacaaaaaattagccgggcatggtggcaggcgcctgtaatcccagctactctggaggctgaggcaggagaatcgcttgaacccaggagacggaggttgcagtgagccgagatttgtgccattgcactccagcctggacaaaaagagcaaaactccgtctcaaaaaaataaataaataaataaaataaaataaaaataagtgttaagaaaatagttcatgaaaatgtaccatttcttaccatacctgaactccggcatgggcagtggggagggagggctgtgaggtaggtggataaagagcgccatcttcatggtgtgtgaaacagagtgagccaggtgtctcagcctcccacaagtgatgtaaagtcattgattcttgcagtacagttgcagaactcgctctccagaatcagttgacactttgctcctgctgtattctctactttgtgatggaaagagacaaataggagttggcagctcttgttctcaaagggcctgcgattccagaaggacccaactcatgccatctgccctcattctcctgacatttaggtgctattaattctttaaaattctactcattggtaaaggagcaaggccttctcaagaaacatactgtttgacattttttcttttagcactgttgtggtttttcattttctttgccagatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtacggattccaaagttttttcatttcattatttactattattattagtcattaattataatactcaatattgagaatgctgctaatattacactaagcattaggaaaatggttcatgaaaatgtttcatatcttaccatcctggaactcagaagtgggcaggggcagggagggtaaatggcatattcatcggctggcaccccagtaaatcagaactttttgaatgagtaagagaatatctttttataaaaagttactgcccccagcctgggcgccatggctcacgcctgtaatcccagcactttgggaagctgaggcgggcggatcatgaggtcaggagatcgagaccatcctggctaacatggtgaaaccccgtctctactaaaaatacaaaaaattagccaggcgtggtggcaggcgcctgtagtcccagctactcgggaggctgaggcaggagaatggcatgaacccgggaggcggagcttgcagtgagccaagattgcaccactgcactccagcctgggcaacagggcgagactccatctcaaaaaaaaaaagttactgcccccggatcttatgtgcctttcattttaaccaatatggtctgtctgctgggctcagccccctaaacatatctgtttggtctgtaaattgtttgaaatcatttagattagtcgccaaattgagaaatcctattttacatgaaaatccagatttctggtttctctccaaaaagtcacagtatgggtcctgcatttccacttggcagctccccagtgggccccaccctgccagccgtccccaccaaggccagggtcccgttgctgcccagccaggtgggcactccactcttcttctgcccagggtgctttacttactgcacgactgggttggctgctgaagactttggaggttttgagccctggttgaaactgttaattagtgtcctcctttgtctttatgtcatataggtctttttcaaagagattttcctgaacattttagaaacatcaacaagttcttttgagcacaggtggatggtcattcagactctgacgaggatctgtgcaggtatttccacctggggacactcatccactggacttctgatgctttaatttgccacagctcagattaagacttctaacccctccttttagagttttaaaggattggcaataaaaggctaattctaacctagtcctgccccacctctccttttttagaggatgaccaacttaggctggtttgccaaggacttcctggttttagcactaaaagtctcatgtcccagaaaccccctaatctcgtcaaactgggacacttggttacgttacctacaagctgagtactgttaatcacaggacctaagatactggtgctgccaatttttgattgggtgctacggtaaatgtggatttaccttacactatacaattgtgtggcctcaaagtaagcatcctgcttgtctggcatcaaatgtaattttgtaagagtgacacaactttaagaggtgggtcaggcaattgttaaccccttccttgatgagaaaattgaggcttggatgggtggaatgaactgcctgagatttcaatttgctcagaagcaggcctaaaaacaacctcctgtcttccagcttcctagtacttccaacatgtgtttcctgagtgagatgtggccaccggagtctgtagttcactggggaaatttgttggcaaacatcttgtttgataagaaaacctaactgctatttgatcagaatttctgatacttgtatgttattttccaagatgcccagtgtgttgtggatatttatgtcaactacgactgtgatttaaatgctgctaacatttttgagcgccttgtaaatgatttatccaaaattgctcagggaagaagtggacatgagctgggaatgacacctctgcaggtaaaaacactgtggacactcaattatattaaagtttattcattccaataaacatttattgagtgccaccacatgccaggcactgtccttgatacagcagtgaacaaaacaggaatgcatattcacacacttcctgccatcatgaaacgacattaaagaagtcagttcagatgatcataggggctgcagagaaaaataaagcagggacggcagagaggaagtgctgaaggtggggtgctgtaattcttaatggggccattagggtagtatcccttagaaggtgacctttgagctgagacccataggaagcaaattcattctcagtcacccttccaaagatagcgtggaaaacaggatcccagtctgcaataggggcaaaggagattggctagtagcagaatacctcattagagcacctacaaagaaaataggatgcttaactgtaggtttctgaatgaactggtcagagggtctccgagctccctggaattgtgtgtagaattttggtatatgggcatttttcctaaaagatggtcatagttgtcattagaatcacagagatctatgctgtccgagttgctgttttgaatctaaaatatttgcattttttttagatgatctgcaactcatattcaacttgttatttaagaatgctgtttatttttgaaaatcagtatttttatttacttaaagggtgagccttaaaattgaatgcatttgtgggtatttaggggatacgttgtatccagagtcacttacagcataattcaaggttcttttctcctttttttcagtcactggttgagaccttgttatttattatttgagtgtgaatttttttttttttttttttttttttgagacagaatctcactctgtcacccaggctggagtgcagtggcgcgatctcagctcactgcaacctccacctcccaggttcaagtgattctcctgcctcagcctcctgagtggcagggattacaggtgcctgccaccacacccggctgatttgagatggggtttcaccatattgtccaggctggtcttgaactccttacctcaggtggtccacccacctcagcctcccagagtgctgggattacaggcgtgagccacagcgcctgcccaagatcttgttatttttttaaaaatagaaaaatttaaaatttttttttaatcacataagcaatgaatgaaaacttcttttgaaaatccaaataacattgttcattttaggaaaacacatatcccatatttttgctgctggggtgtttataatgagcacctttagagatgtccagggcttttgcaatgtatccttgatacttgtcacttcttagctctgggtttgtttcattcttaatagcactgactgtcagtgatttctttcttagcctcactggggtcccagaaagcctcgtagatgtctgttctcttcatttttctgttaagtctctttcctgtgtgacttcgtcccttaggagctcagcctgaggaagaaaggcctggagtgcctcgtgtccattctcaagtgcatggtggagtggagcaaagacctgtatgtgaatcccaaccaccagaccagcctcggtgagacagcattgctgccacacccacctccattcataataggctcctacgactgctaggaacagttgtcttagtatagttgtcttagaattgaaaaagcctttttagtttgctaaatacctatattattttgaaagtcctgctttttattgcatctggagttgtgtgaagttatgctgtaacttcattgtttcaaatacagagccagttgctctagtgcctttttagtagttgttcattccctcactgattcaaagcatcacctttatgatataccacattttcctatgtacgtaagtctgtttctggagttttaatttttttaaagagacagagtctgtttccattacccggctggaatacagtggtgcaatcatagctcactgcagccttaaactcctgggctcaagcgatcctcccacctcagcctcccaaagctctgggattacagacgtgagccactgtgcctggccttctttctggattttctattctgttctgtttatttgtctgttttaacaccagtaccacacttgtttttggtatcttgtagggcaagtcctcctattcgttgttctttaagttgtcttgatctttttttgccttttttactctttcatgtgaattttagaattagctcatcaaggctgggcacggcagatcatgcctgtaaccccagcactttgggaggtcgagggtggtggatcacgaggtcaggtgttcaagaccagcctggccaacatagtgaaaccctgtctctactaaaaatacaaaaaattagccgggtgtggtggcaggcgcctgtaatcccaggtgctctggaggctgaggcaggagaacagcttgaacctgtgaggtggaggttgcactgagccgagatcgtgccactgcactccagccagggtgacagtgcgagactccatctcaaaaaaaaaaaagaattagctcatcaagtttcatgaggaaacaagtttttaagtaaagtatctgaatgatactaaggtttcatgcttataatccttatagtattgacttgttgctattacaggtttgggaaagggagccgtgcagccagacctagctcggctgtgtctgtgtcccacttgcttatttggcttcctttacttttgtttctccgcaggtcaggagaggctcacggatcaggaaataggggatgggaaaggccttgacatggcaagacggtgtagtgtgacgtccatggagtccacagtgtcctcggggacccagacaactgttcaggatgaccctgagcaatttgaggtcatcaagcaacaaaaagaaatcattgaacacggcatcgagctgtgagtggggctgccgttaactagcagggattctagcaaagccatattttctctgggaacctggaactgattcctaaaaaggaaatgcctgtttacaaaaggctggtgctggcacttgtagctaagcctgattgagccaggcaatcagtaaatgagcgtatgtgtgtgtgtctgtgcacacagagagagaaaactttaatacctttgtgtggttgatgcagccttttttccccccttttctaatgaaaataataaaaccaatttagaaaatacagaaaagtataaagtaagaatgtaaaaatcactcataaaattactgcctgagatggcccggcgcagtggctcacgcctgtaatcccagcactttaggaggctgaggcaggtggatcatgaggtcaggagatcaagaccatcctggctaacacggtgaacccctgtctctactaaaaatacaaaaaattagccgggcgtggtggcgggtgcctgtagtcccagctactcgggaggctgaggcaggagaatggcgtgaacctgggaggcggagcttgcagtgagcagagattgcgccactgcactccagcctgggtgacagagtgagactccatctcaacaacaacaaaaaattactgcctgagggaatcaccattggtgcatttttttccaactatatattacatgaaaaatttcagcataccaaaacattactgtttgtcttatttgttttatttttttaggcattttattttattttattttattttattttattttattttattttatgttgttttcttatactttaagttctagggtacgtgtgcacaacgtgcaggtttgttacataggtatacatgtgccatgttggtttgctgcacccattaactcgtcatttacattaggtattactcctaatgctatccctccccctgcgccccaccccatagcaggcccccctgtgtgtgatattccccgccctgtgtctgagtgttctcattgtttggtacccacctatgagtgaaaacgtggtgtttggttttctgtccttgtgatagtttgctcagaatgatggtttccagcttcatccatgtccctgcaaaggacatgaactcatcctttcttatgaggcatagtattccatggtgtatatgtgccacattttcttaatccagtctacaattgatggacatttgggttgattccaagtttttgctactgtgaatagtgccgcaataaacatacgtgtgcatgtgtctttatagtagcatgatgtataatcctttgggtatatacccagtaatgggatcgctgagtcaaatgctatttctagttctagatccttaaggaatcaccacactgtcttccacaatggttggactagtttacattcccaccaacagtgtaaaagcgttcctatttctccacatcctctccagcatctgttgtttcctgactttttaatgatcgccattctaactggtgtgagatggtatcgcattgtggtttggatttgcatttctcttacgaccagtgatgatgagcattttttcatgtgtccgttggctacataaatgtcttcttttgagcagtgtctgttcatatcctttgcccactttttgatggggttgcttgtttttttcttgtaaatttgtttaagttctttgtagattctggatattagccctttgtcagatgggtagattgcaaaaattttctcccattctgtaggttgcctgttcactctgatggtagtttcttttgctgtgcagaagctctttcgtttaattagatcccatttgtctattttggcttttgttgccattgcttttggtgttttagtcatgaagtccttgcccacgcctagttcctgaatggtattgcctaggttttcttctagagtttttatggttttaggtctaacatttaagtctttaatccatcttgaattaatttttgtctaaggtataaggaagggatccagtttcagctttctacatatggctagccagttttcccagcaccatttattaaataggaaatcctttccccatttcttgtttttgtcaggtttgtcaaagatcagatggttgtagatgcatggtatttctgaggactctgtgctgttccattggtctgtctctctgttttggtaccagtaccatgctgttttggttagcgttgtagtatagtttgaagtcaggtagtgtgatgcctctagatttgttctttttgcttaggattgtcttggcaatgtgcgctctttttcggttccatatgaactttaaagtagttttttccaattctgtgaagaaagtcattggtagcttgatggggatggcattgaatctataaattaccttgggcagtatggccattttcatgatattgattcttcctatccatgagcatggaatgttcttccatttgtttgtgtcctctgttatttcgttgaacagtggtttatagttctccttgaagaagaggtccttcacatcccttgtaagttggattcctaggtattttattctctttgtagcaattgtgaatgggagttcactcatgatttggctctcagtttgtctcttattggcataaaggaatacttgtgatttttgcacattgattttatattctgagactttgctgaagttgcttatcagcttaaggagattttgggctgagacgatggggttttctaaacatacaatcatgtcatctgcaaacagggacaatttgacttcctcttttcctgattgaatacgctttatttctttctcttgcctgattgccctggccagaactcccaacactgtgttgaatgggagtggtgagagacagcatccctatcttgtgccagttttcaaaggaaatgcttccagtttttgcccattcagtatgataattggctgtgggtttgtcataaatagctcttattattttgagatatgttccgtcagtacctagtttattgagagtttttagcatgaagggctgttgaattttgttgaaggccttttttgcatctattgagataatcatgtggtctttgtcattggttctgtttatgtgatggattacgtttattgatttgtgtatgttgaaccagccttgcttcccagggatgaagctgacttgatcgtggtggataagctttttgatgtgctgctggattcggtttgccagtattttattgaggattttcacattgatgttcatcagggatattcgtctaaaattctctttttttattgtgtctctgccaggctttggtatcaggatgatgctggcctcataaaatgagttagggaggattccctctttttctattgattggaatagtttcagaaggaatggtaccagctcctctttgtacctctgataggattcgactttgaatccatctggtcctggactttttctggttggtaggctattaattattgcctcaatttcagagcctgttattggtctattcagggattcaacttcttcctggtttagtcttgggagggtgtatgtgtcgaggaatttatccattgcttctagattttctagtttatttgcgtagaggtgtttatagtattttctgatggtaatttgtatttctgtgggatcggtggtgatatcccctttatcattttttattgtgtctgtttgattcttctctttattttcttctttattagtcttgctagcagtctatcaattttgttgatcttttttaaaaaaacagctcctggattcgttgatttttttttgaagggttttttatgtctctatctccttcagttctgctctgatcttagttatttcttgccttctgttagcttttgaatttgtttgttcttgcttctctagttcttttaattgtgatgttagtgtgtcaattttagatctttcctgctttctcttgtgggcatttagtgctataaatttccctctacacactgctttaaatgtgtcccagagactctggtacgttgtttctttgttctccttggttccaaataacatctttatttctgccttaatttcgttatgtacccagtagtcattcaggaggaggttgttcagtttccatgtagttgtgtggttttgagtgagtttcttaatcctgagttctaatttgattgcactgtggtctgagagacagtttgttgtgatttctgttcttttgcatttgctgaggagtgctttacttccaactatgtggtcaattttggaataagtgcaatgtggtgctgagaagaatgtatattctgttggtttggggtggagagttctgtagatgtctattaggtccacttggtgcagagctgagttcaagttgtggatatccttgttaaccttctgtcttgttgatctgtctaatattgacagtggggtgttaaagtctcccagtatttttgtttgggagtctaagtctctttgtaggtctctaaggacttgctttatgaatctaggtgctcccgtattgggtgcatatatatttaggatagttagctcttcttgttgaattgatccctttaccattatgtaatggccttctttgtctctttcgatctttgttggtttaaagtctgttttatcagagactaggattgcaacccatgcttttttttgctttccatttgcttggtagatcttcctccatccctatattttgagcctgtgtgtgtctctgcacgtgagatgggtctcctgaatatagcacactgaggtcttgactctttatccagtttgccagtctgtgtcttttaattggggcatttatccccattacatttcaagttaatattgttatgtgtgaatttgatcctgtcattataatgttagctggttattttgcccgttagttgatgcagtttcttcctagcatcgatggtctttacaatttggcatggttttgcagtggcttgtaccagttgttcctttctatgtttagtgcttccttcaggagctcttgtaaggcaggcctggtggtgacaaaatctctcagcatttgcttgtctgtaaaagattttatttctccttcacttatgaagtttagtttggctggatatgaaattctgggttgaaagttcttttctttaagaatgttgaatattggccctcactctcttctggcttgtagagtttctgctgagagatccgctattagtctgatgggcttcccatagtgggtaacccgacctttctctctggctgcccttaacattttttccttcatttcaaccttggtgaatctgacaattatatgtcttggggttgctcttctctaggagtatctttgtggtgttctctgtatttcctgaatttgaaagttggcctgccttgctaggttggggaagttctcctggataatatcctgcagagtgttttccaacttggttccattctccctgtcactttcaggcataccaatcaaacgtagatttggtcttttcacatagtcccatatttcttggaggctttgttcgtttctttttattcttttttctgtaaacttctcttctcactttatttcattaatttgatcttcagtcactgataccctttcttccacttgatcaaatctgctattgaagcttgtgcatgcgtcatgtagttctcatgccatggttttcagctccaccaggtcatttaaggtcttctctacactgtttattctagttagccattcgtctaatcttttttcaaggttcttagcttccttgcgatgggttcgaacatcctcctttagcttggagaagtttgttattagtgactttctgaagcctacttctgtcagcttgtcaaagtcatttccatccatctttgttctgttgctggggaggagctgcaatcctttggaggaaaagaggtgctctggtttttagaattttcagcttttctgctctggtgtctccccatctttgtggttttatctatctttggtctttgatgctggtgacctacagatggggttttggtgtggatgtcattttatttgttgatgttgctattcctttctgtttgtagctttccttctaacagtcaggtccctcagctgcaggtctgtgggagtttgctggaggtccactccagaccctgtttgcctgggtatcaccagcagaggctgcagaacagcaaatattgcagaacagcaaatattgctgcctgatccttcctctggaagcatcgtcccagaggggcacccgcctgtatgaggtgtcagtcggccctttctgggaggtgtctcccagttaggctacatgggggtcagggtcccacttgaggaggcaggctgttctcagagctcaaacaccatgctgggagaaccactgctgagagctgtcagacagggatgtttaagtctgcagaagtttctgctgccttttgttcagctatgccctgcccccagaggtagggtctatagaggcagcagcccttgcagagctgtggtgggctctgcccagttcgagcttcaccagcactttgtttacctactcaagcctcagcaatggcagacacccctccccctgccaggctgctgcctcacaggtcaatctcagactgctgagccagcagtgagcaaggctccgtgggcgtgggacctgctgagccaggcacaggatataatctcctggtgtgccatttgctaagaccattggagaagtgcagtatttgggcaggagtgtcccgattttccaggtacagtctgtcatggcttcccttggctaggaatggaaaatcctccgaccccttacgcttcccgggtaaagcgatgccccgccctgcttcagctcaccctacgtgggctgcacccactgtccaaccagtcccagtgagatgaaccaggtacctcagttggaaatgcagaaatcaccgtcttctgcgtcgatcacactgggagctgcagaccggagctgttcctatttggccatcttgggacggaatcttacttgttttatttacgtatatatttttctgaaccattttgaaagtaattggtagccatcatgagaccttaactgaatctctttgaaaaataaaggacattctcccatataaccacagcaccatcatcacaatcattggcaaatctttatgtttctttccagtcttttacacacatcaacacatacacaatcatatattccaacttgtaaatgattagttaacttagtaagttcaacttaagagttgaaattacagtactcacttattaactgacatgtttgatcttctcatttctactgccgccactccacctccctctagtgtattctgcccacagcagctaaagtaatctttttaaaacataaatcaagtcttatcactctcctgcctaaatcattccaggtttcctgttctgcaccatggcctgacccagcccctggcctcccttgctgatctcatctcctgccaattcccctgagtcacacaatgtattttcagtcccttgaacaccttcagctctttttaccatggtgccttgtgcttgaaattctcttggcttttttccatccctcagacttggtaaaacatctcttactcaaagaggccttcagcaactgcactatctaaacaggtcccaagttaagttctgcccttgcccctatttgtatctttcatgacgcttgccagtttgtgcttactcatgaatatcaccctccagctcaggcctggtaaataataagttgagtctatacattggttagctttgccttcctttagcaggaaataaaaaatgggctgggcatggtggctcatgcccgttatcccagcacgttgggaggctaaggtgggaggatcacttggagttccagaccagcctggtcaacacagtgagaccctgtctcttaaaaaaaaaaaaaagtagagaaagaaaaaaataaatacaaaataacatgcttaactatgtatttctctctcaaggaaatccaaaagtggacagtctaaggctgctacggtggcccttaaggacatcagagatccaggctccttttatctgtctgcttcaccatacttagccagagagggtggcctcatggtataagatgactgctggagtaccagccatcccacaaacattctggagaggaggagggaaagaacaaaaagagaaaaaagcagacttcccacctgagtcagctttgtttaagggtccttcctagaagtacccacaccacttctgctcatatctcactggctagaagtttatcacatggccatcctttatttaagggaggcagggaaatgttctttttattccacatggcagtgtgtccagctaacacgtagggttctattagtgttggagaaggggagagtggatatgaggtgacaatcagcagactctgaccaggtatagctgggtcagaaattgaaggtggaatttagaaaagctgccaggacagacatgaccttgctagcttatacgtgatggcatgttcatagtattctattattatttatctcaaataccagcttttgctatcctccagattttgaaataagcaacttgtgtcccatctctgcttgaaacaggttcaacaagaaacccaagagggggatccagtttctccaggagcagggcatgctgggaacgtcagttgaagacatagcccaattcctgcaccaggaggagcgcctggattccgtaaggcttgggggtgtagcacttgcatgtgagttctgtcaggtgattgtgagcccttaccagttttaacctcgagattgtctggccctaagtacattgtctgttgtccacccccgggttatacattgtctattgtccacccccgggttacagcagtcctgtgtatcccgttggctagtgttgcagaaagctctttgatgggaataaactagcctcccagcaggtggctgcatatttgctggaagagagtcagagctggaagtgttccttgactgctagaaagttcttacggctgcctgtctgcaactaacctccttagtgtgccccgtcattctctccattttaagtctcttgtgccccctcctcttccttcatccatgcaggacaggctgcttctggaatgggtgggtgggtgggcaggtcagggagttccctagcttttttaccagtccagcctattctgggcagttagggccaggctattctgactccaccctttggctgctggcttttgctgagggttcgtatttgacaatttctggatataagtgagtgtgtatgtttcagacccaagtaggcgattttctgggagatagcgcaaggttcaacaaggaggtgatgtatgcctacgtggaccaacttgacttctgtgaaaaagaatttgtctcagccctgcggacattcctagaaggtttccgcctacctggagaagcccaaaagattgaccgattaatggagaagtttgccgcaagatacatagaatgcaaccaagggtgagcgccgattttgagtcccttccagatcatctgtttgcctgcctcagaacgctaattctaatttggttggggtttaatctttgtatatctgtgccaagcaactgaagcttttgtttaccgtgtgccaggcactgtgctaagggattatttcacataagacctcacagcaacctgtttatgtccctattctacagacaaaaagattgaggaccagagaggttaacttgcccaagatcacacagctaaagcccatgctgttagcaactataaaagagtagtttcataagttgagaggagacaattgggcacctcttccctaatcaaaaacagttcccctgatttaatatatggggtagatctcaaggattttggtttttctttaattgcatactgatgagcaggttacagaaatagctacataactaataaaaaccaccaaagtacatgattttatctggggaccttttttgatgggcggttcgtgattttgtaagaagtggaaataggaaggggaacaaaccattattaaatacctcctgtgtgtgggccatgccatgggttttacatgcatttaatttaattaatggcaagcccaggaatagtatccctgttttacagatgaggaaattgagaatctgagagattgagcaacctgtccaaaattaatcagctagtaaggagcagagccagggttgaatatggatttctctaactcagaagctcatgttcgggctggatgcagtagctcttgcctgtaatcccagcactttgggaggccgggacgggcagatcacttggggtcaggagttcgagaccagcctggccaatatggtgaaatcccgtctcttccaaaaatacaaaaaaaaattagctgggtaatcccagctgctcagaggctgaggcaggagaattgcttcaacctgggaggcagaggctacagtgagccgagaccacaccactgcacaccagcctggatgacagaggcagactctgtctcaaaaaaaaaaactcatgttctctccactgaacattaaattagaaatatgtctgaatatgctgtgaccatgatgtggaaattgttcagtggaaactattttttttgagacagggtcttgctctcttgcccaggttgaagtacagtggggtgatcacagatcactgcagcctggatctcctgggctcaatcagtcctcccacctcagcctcctgaactgctgggactacaggtgcatgccactgtgcctggctaattttttgtataatatttctgcagagatagagtttcaccgtgttgcccagtctggtcttgaactcctagcctcaagggatcctcctgcctcagcctcccaaagtgggggatttacaaatgtgagctaccacacctgattgaaacattttaataactgttttgcctctcaggtcaactttgttttcatattaattgctcccagtcttccaagtgtatggcaggctgtccccaggaggtggcaggattggcaaaggcagcatatcatcattttaaccaaatggacattagaactctctatgaaggcataattagatgctgtttactttaaacgtatctcctatgtggacctgggagccttggtctgttttgctcagtcagtaaatatgtgacccagtttcatctcatattaaaagacctttgttgtgttcttcaaaatttctactgttcctgttatggacagtttggacagaacagtttctagcttcagcctcatatcgtatgaagctgtacatccacatgttgtccttctcttcttgcctaaggcaaaaaagtcagacttcaccaacatattgtttagaacaacataaatattttccatggtatttctactattaaatgttataatgggtaatatagactataaataacagctaaacagcagttttagtcatctttatatctcatgtctagcacagtacatggcacaaaatagatgttctcaggaacaggacaaggtgggggaggcactcaagcgcttagtgtgtgaaatatagtgagatgccctctctcagggtcagcaccaagtgtaaggtctcctgatgtgctcacttgcttcaccctagtcttggccccagatgcttcttagagtctttttaaaaaaaattatttgaaattgctttattcaaagaagcctcaatttttattatttatttatttatttttgagacagtctcgctctgtcacccaggctggagtgcagtgtcacaatctcagctcactgcaacctccacctcccgggttcaggcaattctcctgcctcagtctcccgaatagctgggattatgggcacccgctgccacgcccagctaatttttgtatttttagtagagattgggtttcaccatgttggccaggctggtctcgaactcctgacctcaggtgatccacccatctcggcctcccaaagtgctgggattacaggcctgagccaccacgccctgccaaagaagctaaaatttgatacagattgttaatgagctttttctacactctgggttgctaagtcttgttcagtgatgatgaaagcgtaaaaactcttgcctcatttggaatcaaggggagtagtcggctgcttttctcgtgaagtgtgtctctgttagcattgtaccttccaaaccgcatcaccatgaatattgatgtctcgaatttttttctccaggcaaactctgtttgctagtgctgacactgcttatgtcctagcgtattcaattattatgctgactacagacttgcacagtcctcaggtaaagcactttaatgatttacatgttgtattagctaaataagtggctttacttgggcaattggatgttttttaaatggtttttaattttttttaattacaggtaaaaaataaaatgacgaaagagcagtatattaaaatgaatcggggtatcaatgatagtaaagatctgccagaagagtatctctcaagcatctatgaagagatagaaggcaagaaaattgcaatgaaagaaacaaaagagctaacgattgcaaccaaatctactaagcagagtaaggtctaatggcaaattatttcttttagttctaattttttagtgtatcagaatgcatgattaaatactctggtgataaatttaatgtgcatagctggatatctgaataggaaatgtgattgaattaattattgtgattatgttgggacttttataatgtcactgtcttgctagatttctgatgaggagcaagaaggaatttaaaattagtaatctgagaactaaattactcccaaaaagtgttctttaaaacttttctttaattcagattgtgtccgccttgattagaattctattagttatggcccctggggagctgtcagtttcactgtttgagaagcagcaaagggtagtggtttagagtgtggctctagagccacactgccttagatcaagtcccagctcctctacttagtaattgtatgaccctgggcaagtgacttaccccctctgcctcatttttcccatctgtaaaatggtaataataatatttgtaatggactcacgagatggttgggaggatttaggagttaatcattgtgcatcttttgaaacagtgtatggcatgtagccagccctcagtgactgctagccacacctatcatgctcttactttacagatgtagctagtgaaaagcagcggcggctgctgtacaacttagagatggagcaaatggctaaaacagccaaagctctgatggaggctgtgagccatgccaaagccccgtttaccagtgccactcacctggaccatgtccggccaatgttcaaagtgagtatcctgagaacttagcaagcatgtggctaagcctgattctgaagctggccagcgagaagtactctttccacgctaaaactctggatgttattgaaatcttccttccatgatagctggtgtggacgccactattggcagcctacagcatcggactccagaactgtgatgacactgaagtggcctccttgtgtttggaaggcatccgatgtgcaatccgaatcgcctgcatctttggaatgcaggtaggtgtaagtcagcaacactccagagatactggtgggttgtgctcttttagatttggcaaaacttagaaattatcagaaattttcagttaatcaagactcttagcaagctacttacttatgcctactgacaagaaatccgtagctttgtgatgacagctcgttaggggcaaaaatggagatacggattaaaactgtctttaagaatgggtaggctgggcacagtggctcacgcctgtaatcccagcactttgggaggccaaggcaggcagatcacctgaagttgggagttcgagaccagcctaaccaacatggagaaaccccatctctactaaaaatataaaattagccgggtgtggtggtacatgcctataatcccagctactcgggaggctgaggcaggagaccggcttgaacccaggaggtggaggttgcggtgagccgagatcgcgccattttactccagcctgggtgacaagaacgaaactccatctcaaagaaaataataataataataataggtagggtccaagcttcttgactggatttgacaaagcagacttcgtgttcatctgcctaacttgcctgctttggtgcttaaaaatactatttcctttttaacatcagtttttattataatttcgcatatttccaactcttccctggagaaacaagtagttcaatgcaatatgaatatgtctgtaaacctttgaaacttgaaaagttcaagcaaataaatgaaatgtaattctgaaactgttacgaaattaggaggttgacaatcccatgcatcactttgtaagtcagaagttgcaccccatttatttttaaaaactcaatcttctgttcctattcattttacagttagacattttcttttataccaagaccacaagctttgacgttagaccatctaggtttcaagaccccactctgccacctctccaaccatgtgacattggctcagctaaagtctctctgagacaccaattcatttcctcatttgtaaacttgagaaaacagacctgcctggcagaattgttgcagatgtcaatttgtgtgacagtcttagtattcaacagacatagtggaacatgggacaggtgagtttgactgaagtcaattagaaaggagagagctgcttctcaaacatgtggcagtgcatagatacctctgcaagatgttccaaaagcaagagggcattagcatggaataactgttgtgctaatgtgcagaaagccagtcaatgtgcatacaaaaagtatcagagaagcccagtgtgccagccctgcagatgtgagaatggccacactaaggttggagtcacagtgttctctcttgggtttctgttacagctggaacgagatgcctatgttcaggctcttgctcgcttctccctactcacagccagctccagcatcacagaaatgaagcagaaaaacatcgacaccattaagacgcttatcacagtggctcacaccgatggcaactaccttgggaattcctggcatgaggtacgtgtctctttgaattgccttttctcagttaggatgactcctggcttccttttattcattgttgatctcatttggtcagttctgtttttcttgaagtcaaatcactgtacctcatgtatctggaagtcaccctctctggggctgtgaaaggcgggggcgagttcaggcgcaccagctcacagtgagcacccttgcacccagcagccagtgtcccccatgaagtgtacttctgttgttgcaactttctttccatattagtgccatttttttttttttttttagtccttatgtacctcttgggagcttgggagctcctgtgatcaatgtgtaattttaagacaaagccaggagcctgattagaaatggttgatagtcacaatgagctgttagggagagtgccagtgaattcacatgtttttaaaacagtattctaagattctcacccaaggatatagttacttatgtgtacaacaatgtatttaaaaggatatttgttgcagttttagttgttctagggaaaagtttgggttaaaaagagctagatgtcccaacaatataagagattgctactttttttaaaaagtatggtacagcattttttagaatgttatgtggccatttaaaataatgttgtggaaaaaaaagacaggcagatagtatgtgctctctgatggaagtacacaatactacctaagaaatgttctagccccaactcaaatctgaattgattcaagcctatattgccagtttacaggaaatacagtggacagagaagcatgttagatatgagggtgcagcttggaaattctaggtgtgacagacctgcagagcagatgaccaggtttttcagcaaaaaaattgcaagaaaaataagggaggagggttacctatgaattaaaagagatttcagaaaagaagataaaagatgattttaaagactattgtgggaaaatggtcacagtaaaattacaagttgttataagagattgtgaggcattgtctctcgtggcaaaatacacagagaatgcagtttgaaaggatagaccaaagcattaacattctgtctgagaaatagaattatggaaactgttttattcttttttttcttaatttctaattttttctgccatctacatgtattacttttttgtttagagagaaaactgtgaaagaatagagatgaggctgtggagaatgtaaaggacagtttgacatagaaaattgctgtcatccttcttccccatgtggaccacatggctcagattcagagtaaaggctctagagcctggcaactggggtctgatttggggctccacctcttcctgcctggatggcacaggcaggttacttagtcaccgagtcccaccttcttcatctctacaatcttcacagggtggttatgaaaatgaagagggcttgggactgtatttggcaagtaataagaactcaatagtgttacctgctgtcatctccgtggcgtatggctttgctcctcttcaccagcctttcctctctctgtcacaactctgagtagtccatgttagaaataactgagttatggctgggcacagtggctcacacctgtaatcccagaacttttggaggttgaggcagaaggatggcttgaggccaggagttccagaccagcctgggcaacatagcaagaccccatatctttaaaaaaaaattatttttttaattagctaggcatggtggttcatgcctgtagtcccagctactcaggaggctgaggcagcaggattgcttgagcccaggagttcaaggctgtagtgagccttgattgcaccactgtgctgcagcctgggcaacagagcaagacctcatctctaaaataaaaaaatatatattttgaattgtgtgctttttaaaatcatttcctgccttctaaggagccataatacgtagagaatcaatgaatagttgctttttcttctaaaacatttttttagcctgggaggtattatcaatatgaggttcctgctgccagccaagtatatggcagaatctagaaatgttaaaaattaattagctacctctgcggttgtcagaagccctgagaaatcagcttggaactaataagcccttgacctttcagtattggtgacgtacttgagattccagctgtccccagcttctgcaaaagggaggacattactagcttactaataataatttaatagtgtgtgaagaaatcaggggatgattctctttggtggaattaagtctatttctcagtcaagaagaaagcaatttataagtaaagatactcggcagtgctcagtggtatagtggagtcctggactctgggactgagttgtaaggtcagcgtaaaaagcaacactgaagttcagtcagaagttcccatgaaaattccttagggtttccctggaggtctgtgtgccattccttggtaagtttcatgtagccagtgtttcctctgacagaagttgggaccagtttctgtttctacagctgagcttcaggtaggagggcccgtgtgcagatctgcattctcaagcaccagaggcacccctcaggaccaggagatccagcctcatctcccactgcatgcctgatgtagagcatattctcattccttcagttaaaccaattaacgattgccaacaactttaagtgccagggacttaagtgttcagcagtgaacaagacagagttaatgccctcttggcacctaaggcaggaaacaaacaaatagatatatggtataatgccaaaaagtggtaagcactaagaaaaaaaaagtatgagcaggacatggtaatgggaaggtacgatctcacaagaaagatctctttgagagggacacacatgtctgagctgggaattgaaggagtgagccatggggagacaacattccaggcataaggaacagtgagtgccaaggccctgaggtgggacaagagatgacaagttaaaggagcaacagtgaggccaatgaggctggtgtcttgtcgtctcacgaggagggtggaaaaaggaggtgggggtgactaaatgatgtgcctattaagtgacatggtgggaggaatccgccgccccagtcaaatgctttttctctctttattgagagcttactaaatttgcataaacatctatatggcataactccattgaaccaacttttttttaatgactaacttaagattacagtgccctttttctagctgtaaggtaggaactcatttcttcatgccttctttctcttagatcttgaaatgcatcagccagctggagctcgctcagctgataggaaccggtgtgaagacgcgctacctgtctggatctgggcgtgaaagagaagggagcctgaagggccacacattggcaggagaagagttcatgggccttggcctcggtaagacaccaggccccacagctaacagtcacggatttgcaagctaacggggatgaaacccttcttgtctcatcaggactgtcctgtaaaccgtctcttccttttgtgccatctgacagtgttcatgaatgcaagtggacgtgctgctttggcctcttaattgtgattaaactgttgagtaaaatgtctattttaccaaagtcagtagggtgcattacttttctttctatacctatcactatattggggagaaaaaccatttgctttaaaatgttcagatctctagtgcctgacattagaggggtgtgtatttgtgtctctaggttttaaagggtaggttcaacatttcttccatctttattggggggcttttattaaacagtattcttatgcaagtagaattatttctctggctatacattggattgagaaactcttctgattgatgtaacatggtaataatagtaaatagggcaaacagatgtgccaagtcatattctgagcactcagtttatatattttaactcatttaatgctcaaaacaatccaatgagaacagggactgttatattccccattttgcaattgagaaaactgaggcacggagtgaaaagatatgagcagcatcatactgcaaaggagtggcagaggtaggattcaagccctaagccatccaactacggagtgtaggcttctaggtcccatttagtgagtggaatagtacagtgtcatggttaaaagtatggactctggaaaaatggggaattgtaatagcacccacttcttagggttctcgtgaggatgagtgtaatgaaagtctgtgaagcacaccaagcattcagcaggtgtgagccattaatgttctaggagctctggattaatatcaattgattcaaatttgttttcctaaatataggcctttaatactataaaaatgtaaaagattatagagaaaggtagatggttggtagaaacaagaaagcttatactaaggatatattttaaatgcccaatgccaaaacaaaactttaattttatcatcagtgggtttttgtttcttttttgaacttgcagagtcattcccatttatgtcccctgtccctgcgtgttgacataacaggatgctttgttctaaatacttgactgtttttgaagtactgctgattttgtgcattgtgtttcaggtaatttggtgagtggcggagtggataaaagacagatggccagcttccaagaatcggttggtgagaccagctcgcagagtgtggttgtagctgtggacaggtaatgattttattcttcagtgaccctgaactacacagtggtttggtggcctctctgtagttactggacatgaatgattcctaatttctttaactgatacaagtgttgttagctacaaattgcttaagtgtcacatttatttgcattttgaccttttagaaaaggtataactttaacattgtgacaaattatgtcaaaaataagagtttttcgcttatgttgatgttttaaattaccttgtttccttagtagaaattatttttttaaaaatcacaagaagagtttaggattaaaagcctacccatgctcacgcctgtaatcccagcactttgggaggtcaaggcaggcagatcactagatcaggaaatcgagaccattttggctaacacagtgaaaccccgttctactaaaaaatacaaaaaattagtcaggcgtggtggtgggcacctgtagtcccagctactctggaggctgaggcaggagaatggcgtgaacccaggaggcagagcttgcagtgagcggagatggtgccactgcactctagcctaggcgacagagtgagactccatctgcaaaaaaaaaacgcctacccatgctcatgcctgtaatcccagcactttgggaggcaggtggatcacaaggtcaggaaatcgagaccatcctggccaacatggtgaaaccatgtctctactaaaatacaaaaaaaaagaaattaactgggcatggtgacgcatgccagtaatcccagctactcgggaggctgaggcaggggaatatcttgaacccaggaggcagaggttgtagtgggccgagatcgcgccattgcactccagcctagcaacagaacgagactccgtctaaaaaaaaaaaaaaaaaagcctacccatgaatgagagttggctgagttgacagtttccttttttttttttctcccctcaaaacttttccattatttctctttactcaaaacttgacctaaaaatccaggagagatatttcccataaagaagcttcgtacttattagcaatcactctccgttttcttttctttccttcccccattccttagtcactgtaaccactgatctacagatttgcctgttctggacattgttccattgtccatctttccctttttattattttaatattcattatattctatttattaaccacgtagtttccttatactaacatctttccctttaattctatcctttttcaactcatgtatgttgcctctattgttaagtgcatataatgtcgtgtcttttgtgttcccatcttcttccactgttactgccttctgccttctttgtgttaaatagatattttctagtatatcattttacttctggtcatttcttgtactatatcttatgtattgattgattgattgattgattgattgagacagtctcgctctatcacccagtctggagtgcagtgatgtgatcttggctcactgcaacctctgcctcccaggttcaagtgattctgctgcctcagccgcccaagtagctgggactacaggcatgcaccaccatgcctggctaatttttgtatttttagtagagacagggtttcaccgtattggacaggctggtctcgaactcttgacctcaagtgatccacctgccttggcctctcaaagtgctgggattgcaggcatgagccactgcgcctgggctcccccgtcttttgatgtgtcactttctcttctgctcactataggtttttctgctttcaactcagttcactttccttgaaccgttctatacttgtaataccacatcatttatttcggtggaggtgtcagacctgatgtttcctctctaccttgtctgagagtttgagaaacttcagcttccaaatctaattaaaaagaaaaaacctgtgtgaccagagatcatctggcttttatgcccagtactaagacagaagcagaattgccctcagtctaccaaatctaatgtttattttttgtttttttgagacagagtctgtctgtgttgcccaggctggagtgcagtggcgcaatctcggcttactgcaacttctgcctcccgagttcaagcgaatcttctgcttcagcctcccaagtagctgggattacaggtgcccgccaccacgcccagctaattttttgtattttttattagagacaaggtttcaccatgttggccaggctggttttgaactcctgacctcaagtgatacaccctcctcggcctcccaaagtgctgagattacaggtgtgagccaccacacccggtctaatgtttattttgtctggaattatcttcctaggatttttactgggtctaccagactggatggaaatgcaataggtatgtatttgacttacctgtgaaaactgcagaagcctcacgctgtgaccgtctgactgttcctaacgaggctttgcttgtgttgttgggtctggcctgtagttgactttgtccgctggctgtgtgctgtgtccatggatgaactggcttccccccaccatcctcgcatgttcagcttgcagaagattgtggagatatcatactacaacatgaatcggatccgactacagtggtctcgaatatggcatgtgattggagatcacttcaataaggtaactcttcaaatttaaaaaccattcctgttaaaaaaaaaaaaaagtagacaactgaattcaaaaaaagaagtgataaataatttgccctgttttttagatgcctctaattcattttccctgtgcagtcaaggacagcttgataggagtaatatcatacttatatattggtagcattcatgtagaatgaattaaaaatccagtggtattgaaaatactttaatatcccacatgcaggatgtaggctaagaccacaaagattattacagccactagacaaatacactgatgcttggaagcattgtgaaatgaaatccagaaaggccttttaaatgacctaatgttaagttacgttccaggtagttttactcttcaatgtcactgcttcttgtattccggcacctattgccaccattcttctgaaacttttattgaaaaaattaatatttgggccgggcgtagtggctcacgcctgtaatcccagcacttcgagaggccaagatgggcagatcacaaggtcaggagtttgagaccagcctggccaacatagtgaaaccccgtcaccattaaaaatgcaaaaaaattagctgggcgtggtggtgtgcacctgtaatcccagctactagggagattgaggcaggagaattgcttgaacctgggaggtggaggttgcagtgagtcgagatcgcaccactgcaccccagcctgggtaacggagcaagacttcgtctcagaaaaaaaaattaataattgtttttaaatcagtaacaagccaaagacccatctgggttctaaaactgacaactgttgggaataaaccagactgaacttcttcctcgttaccagaagttttattatatacatacagacatatgcacacatgttgaataaataaaatgtcagatatgtgttttatcacggccaaaaaactgggaacaaagcaatcaaaagaaatgtatgtggccgggcgtcatggctcacgcctgtaatcccagcactttgggaggctgaggcaggtggatcacaggtcaggagatcgagaccgtcctggctaacatggtgaaaccccatctctactaaaaatacaaaagtttagcccggcgtggtggcgagcgcctgtagtcccagctactcaggaggctgaggcagaagaatggcgtgaacccgggaggcagagcttgcagtgagctgagatcgtgccactgccctccagcctgggcgacagagcgagactccgtcttaaaaaaaaaaaaaaaaaaaaaagaaatgtatgtatgtatgtatctgtgatgtcatttgcctcttaagggaaaggtaataataacagcttcctaccaaaacacatttcatgatctcaagaaaattttctcaaacctggtggtgaagagttataataccaatgcttaaaaatagtgttagtaaaaaaacaatccagaaattctgtacattgaatagaggaaaatcttaaaaagtagtctaccattggggtatagaataatcaatggggtgctggtaaatgatttgtagcatctgccagtttctgtgtgtaaacaccctgccacagccaatttaaagttagcaatatgatgtaactagggaagagatgggcacctcattacctcttgtggacaggtgctagtctactccaccactcccctgaaatgaagcattgtcatatgtaggcttgcttctaacttggtgcatcagctaatgaaagttccttgtttttccatcagctcaaattaaggcacctcacagcacactgtctgttttacaaaataatctgagtgcttcatgctgggcagtggacagatgagacccctgcctgcatggagctccctgtcattttatgataagataactgatgggaaaggatcaagcatgtcatatatcagggttattgagaaaacatggtcagggaaggtccctctttggaggtggccttgagaggcacaggagcctgtggatgatccaggggaactatttgttgagtggatggtatcactttaaataatcaactaactcagcaccatcttacccactattctgagtaaacaaattcctaattggaccaattgaaataattgatgtgaatttgcttgagaaagaaaatgtgaatcattgcgactactgtaccttgtattcttgtccaaacatgtgacagctaagccagaacaaacgctgctcatttattccacaagatcatttggctagcaactgtggaatcctttgttctctcagaaatgactagctaaaagtgttttggtaaacgttttcccaactctttaaagtctgcattttgtgttcattgggacttctgttttgggaggggaacatcagtttgctcaagttactcttcccacctgtgattctgttgtgaagaatctgtgtgtgccaattctcagtatgtatggaccacttacaggcaaggttgggacatagggtggcaggtgggaaccagacatttaattgtcatcaacttcattacaaatgtctgtttatttaatcagtgctgtttaagcaccaggtcatggaaaactcaggaactctttttttttttttttttttttttttgagacagagtttcgcactgttgccaggctggacggcagtagcttgatctcctctcattgcaacctctgccttccaggttcaagctattctcctgggactacacacatgcatcaccacacctagctaatttttgtattttcagtaaagacagggtttcaccatgttggccaggctggtctggaactcctgacctcgggtgatctgctcgcctcagcctccgaaagtgttgcgattacaggcatgaaccaccgtgcccggccctcactctgggactcttaactttttccaccaccttggaaagatgttcttcccattgtgaactggggcacttaagaatcttgcagatttgaagaaatagatatggctcaatccagctgtaacttagccctcaggttgctggcagagttgttcgcacagtcacatgattctcttgaactaggggcaccagccctgtgtcctggatgagcaaagcttcacactaagcatggtgtgtatgcctggagcatctgttttacctggatatttaagaaaggaatattctttttgttagtctctaattacattaacatactcccctttacacaaaaattacagctaaaacatctttggccaccctcccccacacatctggccctccccaaagctaattattcttactagtttgttgtatatctttccagacatttttgtattcatgtgcatatgtatgtactcatagaaatattacagataatattgtcttggtttgtttcgctttttaaaaaaattatacatagcattttgtaacttgtttcttccacttagcaaggaatcataaagatttaaccatgttagcatatgtagatttgttctcttttaagaaattgtaataaaatacacataacaggccgggcacagtagctcactcctgaatcccagcagtttgggaagctgaggcaggcagatcatctgaggtcaggagttcgagactaacctggccaacaaatacaaaattagccaaatacaaaaattagcagggcgcggtagtggacgcctgtaatcccagctacacgggaggctgaggcaggagactatctcgaacccggggggtggaggttgcagtgagcagagatcgtgccattgcacaccagtctgggtgacgagcaaagctctgtctcaaaaataaaataaataaaataagattaaaaaaatagaataaccatcttaacaattttaagtgtgcggttcagtagtgttaggtacactcacattgttgggcaacagatctcaaggacccttttcatcttgcaaaactaaaactgcatacccattaaacagtaactcccactttcaccctcctgaccacaggcaaccaccattctactctgtgcccctaggaacttgactactatgggtacctcatataagtagaatcatgctgtgtttgtccttttgtgactgccttatttcattcagcatagtaatgtcttcaaggttcatctgtgttgtagcgtgtatcagaatttccatccttttcaaggctgactttattatttatttatttatttttgagatagcattttgctcttattgcccaggctggagtgaagtggcaaaatgtcggctcactgcaacctctgcctgccaggttcaagcaattctcttgcctcagcctcccaagtacaagcaattctcctgcctcagccctcccaagtagctgggattataggcacccaccaccatgcctggctaattttttgtatttttagtagagacacagtttcaccacattggccaggctggtcttgaataccagacctcagatgatccacccgcctcagcctcccaaagtgctgggattacaggcgtgagccaccacgcttggcccaatttttatttttttaactttttttttttttttttttttagagacggatcttgctctgtcacccaggctggagtgcagtggcaccattttggctcactacaacctctacctcccaggttcaggcaattctcctgcctcagcctccccagtagctgggactacaggcatatgcaaccacgcacagctaatttttgtatttttagtagagacagggtttcaccatgttggccaggttggtcttgaactcctggcctcaggtgatcctcccgcctgagcctcccaaagtgctgggattacaagtgtgagccaccacacccagccccaatttttcattattacaaatgatattgctgcattctattaaaaataaaacattggccgggcacggtggctcatgcctgtaatcccagcactttgggaggctgaggcggttggatcacctgaagtcaggagtttgagaccagcctggccaacgtggtgaaaccccgtctctactaaaaatacaaaaattagccgatcttggtggcgggcacctgtaatcctagctactcaggaggttgaggcaggagaattgcttgaactggggaggtggagattgcagtgagctgagaccacaccattgcactccagcctgagcaacagagcaagactccgtctcaaaaaataaaataaaataaaataaaataaaacatcaggtcagaccacatatcaatgaaatggctcacttggagcaggcctctgcaagatatccccagatctcctggcagggggtgtgggtgggaaacattctcttgctgtttttagagattctccttgagagaaaagtctgaaaagcaccagccaaatatttacccataactccagttcctaaaagtaggcaaaccatagacaagtacaatttttaaggaaattgaaaagcctcaataattttgcagaagttttggagattgatgatatttattttatagtcatttgctttagatgacagacattgggaaagtgtgaaaaggctttccatagactgtaaaggcttttgacccttcatatatatatatttggagaaaattaaatagcaccttgggagatgttgtttaatggatatagagtttcattttttcaagatgaaaagagttctctgccgggcgtggtggcttactcctgtaatcgcagcattttgattgaggcggcctgatcacttgagttcaggagttcgagaccagcctggccaacatggtgaaaccctgtctcttctaaaaatacaaaaaaaagtagctggacggggtggcaggcgcctgtaatcccagctactcgggaggctgaggcaggagaatcgcttaaacccaggaggtggaggttgccagcctgggcaacagagttagactttatcttaaaagaaacaagaaaagaaaagagttctgattggcttcacaatagtatgaatgtatactactgaactgttcacttaaaatggttaagatggtagattttatgttatgtatattttacaattagaaaaattgggtatagttgcaagtttaatagcaaaagaaaaaaaaaagaaaagaaaaaaataggttgggcgcggtggctcaccctgtaattccagcactttgggaggccaaggcaggtggatcacctgaggtcaggagttcgagaccagcttggccaacatggtgaaaccccatctctactaaaaatacaaaaatcagccggcaggcacctgtaatcccagctacttgggaggttgaggcaggagaattgcttgaaccggggagatggaggttgcagtgagccgagatcacaccactgcactccagtctgggcgacagagccagactccatcttagaaaataataataataataataaaatgaaatttaaaaaagcagaaagtagcacattttaaatgcatatttaattaactatgcaatactgatttcgtcattacacttaaaataaaactggacagatcatagccaagaaatagcattttcttttctccttaggtgtgttttccctgaatgtttgttttgaaggtaggctgtccatctttgctgttgagagacccacgtcggtcattattacactatacctgtttcacatcagttcctgttcttgttcaggttggctgcaaccctaatgaagatgtggctatctttgctgttgactcattaaggcaactctccatgaagtttcttgagaagggtgaattagccaacttccgtttccagaaagattttctgaggccctttgagcatattatgaagaaaaacaggtatgtgttttgctctggaagacgcttggtcaaattccccgttggggctcccagaagccctcctaacactaaccacatgattaatttttttcctcccttgtcagtggaaacaaatagaatgaatagactgtgattcacatcgattttccttaaacaaatctcactaaaatctatgtgtagcctttcctaggaggacagatgtcaccctgcaacttgtagaaatatgtcgtgaaccggctgggcacagtggctcacacctgtaatcccaacactttaggaggccgaggcgggtggatcacgaggtcaggagatcgagaccatcctggctaacacggtgaaaccccgtctttactaaaaatacaaaaaattagccgggcatggtggcgggcgcctataggtccagctacttgggaggctgaggcaggagaatggcgtgaactcaggaggcagagcttgcagtgagccaagattgcgccactgcactccagcctgggtgaaagagcaagactccgtctcaaaaaaaaaaaaaaaaaaaaagaaaagaaatatgtcatgaaccccttttggggctggttctcagggagattaaaggaagagccactgcagaagcatcctcaaaccaggataagaattatgtgacccatcacttctcccccagggaggtcataaaagaggtcaggataccgggccctgtgaagcagccgtactgttcatttattcactcggcctggacttattgagacttgccatctgctaggtactataaagaagacattttaaaatcctgtgtttggccgggcgcggtggctcatgcctgtaatcccaacactttgggaggccgagtcaggtggatcacctgagcaggagttcaagaccagcctggccaacatggtgaaaccccgtctctactaaaactacaaaagttagccgggcgtggtggtgggcgcctgtaatcccagctactcaggagactgaggcaggagaatcgcttgaacccgggaggtggaggttatagtgagccaagatcacaccattgcactccagcctgggcaacaagagcgaaatgctgtctcaaaaaaaataaataaaaatgaaataaaataaaatccctgttttcattcagccttaaatagttgcacctgggtgtgatgggcatacaggagttcattatatattactctacttttctctgtgttttaaactttccataataaaatttaaaaacaaatctctgtttaattccaatagaaaaacaaataaatatcagtggtggtaatgggctctgaaggacattatatatatcaaggtaaggggatagggatggaagcactcttttatccagggcagccagctaacatgtgtttggtaagggcacccttaggaaaaggcctgaaggaagtcaggaataatctgagagtggccatatgctgccttggcatgagaattatgaacagggaagagcaaaagcaaaaggcccgtagcaggtagtgcttggcataggtggggaggccagtgtggcttgaatggagggaacaaggcaggtagtagaaggtgaagtccctcccagtggtggcagggtgcctagctcacataggagctgtcggccattgtcagcactttggtttgctctctgtgaaagatggaagccgttggaggtttttgtttttttttttgacggagtctctcctgacctcatgatccgcccacctgggcctcccaaagtgctgggattacaggcacgagctaccgtggccggcctgccattggaggattttaagcagagaagtgaaatgatctgacattttaaaggatcaccctgcatttatccatggaaaatgaggaccattaggatgaggtaggaggccattgtagttgtccaggtttggaccaaggtgggagcagtggcagtgatggattagattctgtgcacatttggaaagggaatcttacaccatgtgctgatgaattggccatggagcataaaggaagagatgtcaaggatgacttttggacctaattcctcttgtctgctattcccctaaaaagtgtacttcagatcagcctggatcttttttttttttttttgagacggagttttgctctttttgccgaggctggagtgtaatggtatgatctcagcttactgcaacctttgcctctttggttcaaacaattctcctgcctcagcctcccaagtagctgggattacaggcatgcaccaccatgcccagctaattttgtatttttggtagagatggggtttcaccatgctggtcaggctggtctcaaacccctgacctcaagtgatccacctgccttggcctcccaaagtgctgggattacaggcgtgagccgccacacctggtgttgcttttttttttttttttttttttttaagaaaatgggagctcccaagctggatgccagagcaggctgttagggtagtgaataaaagggtaccagaaaagtttccttgacatgtctctctttctcctagtgtctgtatgtctgctttattgctcattttaagagaaccaaaattaaacccagagtctggcatcaccctttactttagcaaatacacaaaagtattttcctacctttaggaacaccattgagagtgcctgaggagactgagtcctcacatggccaagccacgtgtgcaagcctaattgcacggaagccctcaactcctaactccaggccttccctgcctatcctattcccatttgaaaaggggcagagtgagtttagaatcacatgttgccaggcactctcagatactgttggtggaactgtaacttaactgtaacatttctaaaagcattttggtgataagtgtcaagaatcctgatatttttatgcccctttgactcagtaattccacacttctgtaattctccaaagcagttaatgtgaaatatagtaaagcgttatatgtcacagaaaatagttttctagaaaaaaacaaactatctaaataaacaagtgttaaagtaaatgttggtaccggtacaacatgggatattgttttgctgttaaaaatgttcacaatgtttggccgggtgtggtggctcacacctgtaatcccagcactttgggaggtcgaggcaggcggatcacctgaagtcaggaattcgagaccagcctggccaacatgctgaaaccccgtctctactaaaaatacaaaaattagccgggtgtggtggtgtatgcctgtagtcccagctactcaggaggctgaggtaggagaatcacttgaacctgggaggtggaggttgcagtgagccaagatcgcaccactgcactccagcctgaatgacgagagaaactccatctcaaaaaaaaaaaagttcacaatgtttataatgtgggaaatgactaatactttagagaaatggacaggttatagaattggacagacaatataatagagatagtgaaacgtgtatctctccatatgaaataccatatatcatgtaaaggtttttttttttttttttttttgagatgtcttgccctgtcgcccaggctggagtacagtggtgcaatctcggctcactacaatctctgcctcccaggttcaaactattttcctccctcagcctcccaagtacctggaatcacaggcgtgcatcactatgtccagctaatttttgtatttttagtagagacggggtttcaccgtgttggccaggctggtcttgaactcctgacctcaagtgatccacctgcttcggcctcccgaagtgctgggattacaggtgtgaaccaccatgcacaggtaaatttttttttatcatactttttctgtattttccaaaacttttactatcatcatatctttcttttaacaatcaggcaaaaaaacattataataaatatagttttgtcaacaagttgctttattctccatggggagacaaccatgaattcatttttattatatattggaagttacttatgttgtgtagtcagtcctttgttatctgcaggtgacatgtttactttgtgaactttcagctaatttttaactgttttgactttctccttgccttctctaaatggcctttcctgttattggttagtgtgagcctggaagacaaacatgaatgtcattctaagccagataaaatttgaaagtcatgagcctgggaggcagaggttgcaatgagtcgaggtcgctctactgcattccagcctgggcaacagagcaagaccttgtttcaaaaaaaaaaaaaaaattgaaagtcaaacctgtagtcccaaggccactgtactgacttttaaagatagtactatcgaagcagtaggcttatatagctttccttcttgctatttgtgagataataaggttcctccataattgtatgtcttaacaggttgagagacaattgcagctgttccagaaaatcagccattttctctgtcttcaggttttactttataataatttaggtaaacattgcaccttaaactatatatgtatactccaatccacatatatgtgtttatcacataggtatatccctacccaaaaatcttaagaagatacacacaagaatttagtaatgattatctctaggtggcagaattatattatttgaaatgtttttggccagaaaaactgaccagcagtgacttaaaccacaaggctatttattgttttcgtaacaagaaagaagtcagaggcaagcattcaactttggttccatggcctggatagggaccatttatttgagacccaggctttttccttttgttcttccattcagagggtcagcttctcaaccttgagtttattgtttcgtgattgcaggatggtggttgtagctctatgcagcatgctaggtttggaatggaagtgagaggaaacggggcagagcccaaatgtggattgctgtgtgctataagaaatgtttaagtgctgcttctaagggatgagctatgttcatttctcttcccattctccaaagtacagacgatatggccgtcccattctttcctcaggtctcccaccatccgggacatggcgatccgctgcattgcccagatggtgaactcccaggcggccaacatccgctcaggttggaagaacatctttgccgtgttccaccaggcagcctctgatcatgatgggaacattgtggagctggccttccagaccacttgccacattgtcagtaagtggctctgttccctccctactaatgtcccacctgcaagtctagaagagtgtcacttgctgtctattttactacctacaggggcttccctaccttggctctactgtgatatagtaatgtgccaggccgtgttgtaagcgcttgatgagtattaatcttgatcttaactctgttttgactttctccttgccttctctaaatggcctttcctgttatcagtcagttggggtccagcagataaacgtgaatgttatttcaagccagatgaaatttgaaagtcaaatcaatcccaaggccactctaatgactatgaaagaattacagtcaatcctcattattggtggattccgtgtgtatactcactaaaatgtatatacattaataactccacaaccagtactcatggtgcttttgtggtcatttgccaacatgtgcatgcacagaagagcaaaaacttgagtcacccaaggcgcacgttcccagttgtggtggaagaaggtggcaccctgccttcttgtttgagctgtcatgacataaacaagtgtgcttaatgtggcctatcgagtgccatgtttttttacattttcgtgctttttgttggtgatttcactgtttaaaatgcccccccaagcatagtgctgaatgctgggtagtattctacgtgcagaaaggctgtgatgtgtcttatggaaaaaatatgtgtgttagatgagcttccttcaggcatgagttacagtgctatattggctgtgagttcggtgttaatgaatcaacaatatgtattaaataaggtgtcttttcaacaggaacacacatacaacaaggttatgtcttgatcagctgatgaaaatgttctgaccagagacttgcaggaatctagttccttatctccatattttccctaagagccatggttcagtattcttgaattcagtgtttatggcaactttatagaatgtaactatcaggaataatgagaacagactatctcattatttcccccatgttactaaagaggaaattgaggcacagaaaaataaatacaacaacttgcctgaggacacacagtttcgatgtagtggaaccaggacttgcactcgggcagtcgagcccagagttagtttagtgtccccctcctctggactgaccaggagtcctgggttctgcctgcgagcacgtaacaagatgtttacttcatctctatggaaatttttaggcatcgagttatctttgcacatagttggcgttcaataaatgaatgaattgatatttgggcctttacatcattgcttgagcgcaggaagactgtctagcccaagctgtacccagtgcattcattcctgagtaatttaataagaaaaactgtcttccaaagatactgacatgcttttcttagattttcacagttaattatctctgatgtatgtgtgtgtgtgtgtgtgtgcacgcacgtgcattttttcatccccatttctaaatcctggtcttatgaaaaatgtgccttgtgttcccccagcaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggttcgtttttccccaccttactcagatgggcagtgaagggaaaaggtcatggagcagaaattcttgctcctaacaaagagctttccagctactcttttagaaatgtgtgtttgccctaaattaggtgtttatttcaaaatgctgccatgacagggagttaggccttttcattatttggtatatgtgaaattctgtattttattcatactgaatctatggtattctacaaattgtttttgtagaagttagttgtattttagcttttgtattttggcaaagctcaagaagctagacgtttctatttgaaagaaaacaaacctcccttgtaggaaatggcattatgtctttgtaatgtgcctgagaaatcatatttaaaaatcaccttttgttttctcctgaaaatgatggggtttttgtttgtttgtttgtttttttgatgtgtctcatctttctaaagaggcctatttggtttaaatgacagagtcccaaaacactgaaatagggtgaaaacaagtccatctaaactatgatgtcctgtgtagatctctacttaagtttcctttacagaaagagctataaacctgtaaggtgatatgtctcatctcttacaacagctcactaagatgtgatgataatgggagccaatgttgattgagcacttagtacttgttgggcaccattctaggtattttctgtatgttgattcatttagtccccatgtcagacctatgagatgtaattatatcccattgtacaggagagttactgaagcacagagagaaattgcctaacattacataaccagagttgctaaagaaatttcagtaccacttcaagagtggttacagagcagaggggtcaaaatcccagaaatagggcagagagtagggctatacatgcagactgtagaaagactgccaggtcctagctgtatgaccttgagcagcttactgaagctcttgatgcctcagttaattcatctataacctaggaccattgtttctacctgccacttggaatccttgtgagaattgttaatccatgaaaagaactttaacagtgcctggcccatagcaagcactcagtcaatagtagctgctggtattattttaagtaatgtgtatgacagtaacattccagaaagacctaagataatgatacatcctggatattttgtcaatactatttgacctttaagctcttcttagtataacacctcccacccccaggactcttgtgatctgccccccttcaacttgttctaaaacccgcagaggtccataggtttgtactgggaaactgctcatatgccctttgggacagataatgtctttgtgtagtctgttcccactgtacccttgctgaatggagatttttgggagagaaaaatgtgtggggccttaatctgcatatagttccctttcagttccttccttttgcatgcttagtttacacctgagatgtgatttttcatcctaggtgctacaagaatacacaagtgatgacatgaatgtagctcctggtgacagagtctgggtccgaggctggttccccatcttattcgaactctcctgcatcattaatagatgcaagttagatgtacgaacaaggtaaccatgttcccgtgcggtggccccttacatcactgaaatgaacctcagtcacttgctcacctgaccccactctcttctctgttgttctcttctccaccattctctcttctgtgcctgactttgtttcctccaggggactcacagtcatgtttgagatcatgaagagctatggccacacctttgaaaagcactggtggcaggacctgttcagaatcgtgtttcggatttttgacaatatgaaactccctgagcaactgtcagaggtaggtgataactacagcactgccctaggtatgatggagaggaaagcctttctggccggtatttgcctctgggggctgcatcatcgtctacccagagttcttaaatactgagcaacttaaggttttaaaaatggaaacacctttctgatactctcctaccagtatcagctagtcctgagtgactctccccatgttcagaagaatgagaggaaatacatctctgtggtctgctgcttggccctcaggcattgcaccttccagttcagcagggctcctgactggtcgttgtagttgttttgttcatatcaacctctgagcagtcagaaagtggaatgtctctggccccttaagggtttttaatgaagttgcatttggagatgatgttgaatattaagccttttttttaaaaggaagtttgatgcctgtaggtatttttatttgtcccttagaggtacagggatagtgaaagggtattctaggctcaggatttttagatggaaaagtaacctttttatttcttttgggaacaccattccttctctcaccgcaacataaaagtgacatatgcttaatatggaatattaggcaaacacaaaaaaattcttccttttaccatccaaaattagagttaatgtttttgcaaaattttctccatcttctacatggtttaaatatgattcggaggccaggcacaatggctcatgcctataatcccagcattttgggaaggtgaggtgggaggattacttgaggccaagagtttgggaccagcctaggcaacatagtgagaccatatctcttaaataaataaataaatatggttgaggtcatagtatagatagagttttctaatctttttaaatttaaatatgtttttcctcattataaaacaagtagaactacagaacacagacaaaaacaaagaagaatttaaacactcacagttgcggtttttcataggcagccaccgttaagaccttcaagtgttgctttcatctgtgtgtccacccacacatgcatttgtgatccacttttttcttctatgaaaatagaattccaacacacgtatataaactacttcttaaacttaatacatgagtattttttcgtagccataacttttcttctagaatgttttgtttgtttgttcctttgctttgtttcgtttttttgagacagagtcttgctctgttgcccaggctggagtgcagtggtgtgatctcggctcacagcaacctctgtctcctgggttaagcaattctcctgcctcagcctcccaagtagctgggactgcaggctaatgccaccatgtccaggtaatttttgtaatttaaatagagacaagatctcaccatgttggccaggctggtctcaaactcctgacctcaagtgatccacccgcctcagcctccaaagtgcagggattacaggtgtgagccaccacacccagcctttcttctacaatgttgttttaataatggctacaaaatagtcttagttgtggatgttccacagcttatgaacatttaggttgctttccggtttttctggacagcactgaaatgaacattttttgcagctacacttctagtggtggtgttttcttctttaaagacaagtggcccaactgccaggtttggggcctgcgtattactaagccttttgatacgtaccactaagctgacctgcagatatctctgtagccatttacacttctgtcagcaatgcatgagagttcctatttctccatattcattccaggtcttctcattttaatttgttttagtcattgctaatttgataagccaactgtatcacattgaaaaagtgtttcaaactgctagtgaggtggcatattttctctcataggattgatcattcttaagaattgccttttatgaattcttttatgaattactcttagctcatctactggattattcatctttctcctattgatttatgcatttttaaatatataaataatgtagcatatgcatacatgagttgcagatgatttgcccactttattatttccttttcattttggaaaatttagcttttaagtaaccaaatctatgcgttttttatttatttttttattccacttctggcttccacttttggcatcattaccataattttataaagatccctctgtatatcctctgtacatatgaatgtattaacatttttaagacgtattcttgatacatatcaccaaattgctttctacaacagttttgccaggagtgtacaagaatgcccatctcactgcagggagaatagcttttaagtgtcatctttttgttttcccagaaatctgagtggatgacaacaacctgcaatcacgcactttatgctatttgtgatgtttttacccagttttatgaagctttgaatgaagttcttctttctgatgtatttgcacaattgcagtggtgtgtcaaacaaggtactctttaagcctctaggcatcatttttcttacatagtctttaatgagaggttagttttttcaatatttaaaagcatggatgtagtgccatggagtacaatatataatttagttggtgaaatgtatacgttttaattacagtataaaaaacagtgccccccccaagtcagttcataaagcatttcttaaagatgggatatagttatttttgtattctacaagatgtaccttcatgtattatactgttctttttacttttgtatatgtttgaaattttctctagtaaaatgtttttaaaatgtattgtttcagtcaagatcaacagcttcatcaacagacaattattttagagtttgtcaggaaaaatacccagctagcacattagaactggattccatagataattttggcttagggcaagaaatttagttacatttttgaaaaagtgacttaattttaaaataaatgacaaaacatttgatattgttcaggtggcaaaaattggaaatgtaatgtatgagtgactaaatttttgaaaacctggtctaatgttttctctcttctattaccatttttcatacatgagccacttaatttaaagtagcaaaatgttgacctttcttctttagcaataaaactatgataaacaattttaactcttcaaaaaaattttaataaaaattttaatactgtctgtagcatggcttcattaattaaaagcctagaaactcaccagttgctgtctccaactcacaatatacagtatttgagacctggttggcatcaaaatagcagtagaagtttaatgatagatactgctttattttacagataatgaacagttggcgcgatcaggtacaaattgcttagaaaacttagtaatatccaatggagagaaattcagtcctgaagtctgggatgaaacctgcaactgtatgttggatattttcaaaacaaccatcccacatgtgtaagtgttcatgcagttgttcccgtttatctctgtgttcagtggatgtcttaaagctcctgattgcctttcacattgattattttttttctctatttttttcttcagtttgctgacatggagacctgtaggaatggaggaagattcatcagaaaagcatttggtaggatttggggtttttctttggttgtcttttcttttttctatcttagtaaaagatcaataagcctgtatagtttgtactttttttaatgggaagtgagtaaaattataagatctaaaaatagtatatattcataatatattttttagaaagtccagaaaagcattaagcaaataagtaacctcaccaagtaaaaagcacagtttacatttctagctgccgctttgtgtgaccgtgcatgcctaggaaaaccagccatatttgaaatgagggatcagttagcatataacaacatctgagcatttttccatattttaaacggttctttgagagcagtcttttcagtggctgcatagtattataatttctttacttctcccttatcggactctcaggttagttctaggctttcaacattgtaaatagtgctttggcgtaactgtgcttgtttgttgccctcctaaattaatagtgctttcctcttcaccaaagaagtggtagttcttactttttgtgtgagtccacataaagaagttttaattcagatctcacttttaaatactttggtttacagagaggagttgaattaacttttattcctaagtgactctaagaccattagattttaaaaagcatttgggatacagcaactgtcttctgctgttaaatttttttattttttattttattttatttttctcgagacagagtctcgctctgtccccaggctggagtgcagcagtgcgatctcggctcactgcaacctccacctcctgggttcaagcgattctcatgcctcagcctcccgccaagtagctgggattacaggtgcccgccaccatgtccagctaatttttgtatttttagcagagatggggtttcgccatgttgaccaggctggtcttgaactcctgacctcaggtgatccgccttccttggcctcccaaagtgctgggattacaggcatgagccactgtgcctggcctgttgtcaactttttaaaaaactagttactgcactagtaatttatctttgaacttgctcgcataaaaaatttgtcacacttattgttaaatcctaatatgtagagaaatgtcctctgggttggaataggaaaatagggaattttaatgggaggagaagtaatttaaattcttaatctctccattgcagcctgtgaggcatgctacattaagcatgtagtatcattttattttgagctaagcaaggcacttaaatacaggctggaccagccgtgttaaaacaggcacatctctgcccaaattatcatgaagaaaagtgagcattgtgtttccctctggtttacatttaggatgtggatctggaccgccagtctttaagcagcatagataaaaatccctctgagaggggacagagccagctctctaacccaacagatgacagctggaagggtagaccatacgcaagtaaggccactttttaatttgttttaaataagtaacatgtttatgtgattcatatattcagaaggcacaaaagggtaaacatgataagccttcttctgccctgtgcctcagtctgccagttctctgtagcagccaaggttacctgtttctctgtacctttccagagtcattttatccatgtgcaggcaagtacatgcacatatacattcatatacatacatatatagtacatacgaattttctccttttaccagttatggaatagtacattccatatacattgacatatacattcacacacatacatatatagtacatatgaattttctccttttaccagttatggaatagtatgccttattcttttttcagttaatatattttagagatcattcaaaatcagtacataaggagctttcacgttgttttatacgattgtctattattccagtttgtagacatgcatttattgcttaattgagttgctcttaacagacatttatattacttataatcttttgctgttaggagcaatactgcattgaataacccaatacatatgtcatttgtgaatttatgtaataaattcctaaaaatgtactggagtcagtggataagtgaatttgccatttttaaatatttccacattgctatctattacatttgtagctgtttacgtgatctttttagatgaaatacaactttggactaatttaacttggaattttcaaattatgagtcaaattgaatagtttttcgtatgttaaagcaccacttctgttttcttctctatgaactctgtaatctttgctcattttctgttgattgttggccccttttttattggtttggaggagctcttatgtactagaaatcctttttctgatatgagtttcaaattatttttgccaaattgtctcttaatgttgcttatgatgtgttttactgtcatttaaaaaaataagtttaacagctgtcatgtaccaggcactgtactgtgtgttccatgtgtattgtttcatgtaatcctcatagtagcctttgaagaggtactgtcttacgtttgagggaactggggcttagacagatcatagaacttgacaacatgtagtagagtggggattcagacacatttttggcagcctgaggaatgggaacttgtgaaggttgttctggtcctttgaaagttgtgtgccccattgtttgcctttatagcagtcccaccctgtcctcaacatgctaggccatagctgttaacattgaagttaacttctgaagcagcacatttgaccaaaacagtgtgcggtcacctttttctttagaaggaataaaagtagtcacccttgaaattcattaaagaggtatcgtgttgggactggcatgctgtctttcactaactgctgcagccagcttctctccaatgcccagtgatagaatgatacctttttcattttctctttttttagagacagggacatactctgtctcccaagctggagtacactagtgcaatcatagctcattgcagccttgaactcctgggctcaagcaatcctcctgcctcaggctcctgagtagctgggactataggcatgtgccaccacattcggctaattattttattttttgtagagatggggtctcactttgttgcccaggctggtcttgaattcttggactcaagccatcctcctgccttggcctcccaaagtgttgggattacatgcgtgagccaccatgcccaggctctttttcttcacgagctccagataaagtagttagtttctgtgtggaggccaagtatacatttctttcaataggagaagcactctccgtgcagtgagagtctacactctgagaagtacctaggactcaatccacctcccattcccccagggaacagtgcctttgctgctcccagtctcccagctcagccataagctcaggcagacaaaaatctttgcactattattatcgtttcctttttatttttggcccaaaatgttttaattgacttggcataagttgaatgtacatcttctggaactccactgtattaaaaaaaaaaatttaaaacaatctacatggagaattgttacgtgtttttataatttcataactggcgaggtgcagtggctcacacctgtaatcccagcactttgggagaccaggaccaatggatagcttgagcccaggaatttgagaccagcctgggcaacatggtgagaccccatctctaagaagaaaaaaaaaattttttttttaatgaaaaaaatgaaaaaataatttcacagccactttcaaaaacttaaagacaactcaacctccttgttttctatcactgaaatatttaatgttttcaacattctgattttataaaataagttgggaaaggaatctctactgttactgtagacaaaccagtgaacacttatgatgtatttgacatgggccacccttgggccctcagggattgagaacacaaagaggatatagttagtctactcagtaagcagaaaccacaccgctaatttgaacagggaaaattcaatattaagaattgttggggccgggcgcggtggctcacacctgtaatcctaacactttgggaggctgaggcgggcagatcatgaggtcaggagttcaagaccagcctggccaacatagtgaaaccccatctctattaaaactacaaaaaaaattagccgggcatggtgccgggtgcctgtagtcccagctacttgggaggaggcaggagaattgcttgaacctgaaggcggaggttgcagtaagcaaagatcacgccactgcacttcagcctgggtgacacagcgagactctgtctcaaaaaaaaaaaaaaaagaattgttggcgaggcacagtggctcatgcctgtaatcccagcactttgggctgaggcgggcagatcacctgaggtcaggagtttgagaccagcctggctaagatggcgaaaccccatctctcctaaaattacaaaaaactagctgacacagtggcgcacacctgtaatcccagctaccagctacttgggaggctgaggcgggagaatcacttgaacccgggaggcagaggttgcagtgagctgagatcatgccactgcactccagccagggtgacaaagcgagactccgtctcaaaaaaaaaaaaaaaaaaaaaatgttaactagtcaaaggttgttaaccactaagaggaataaaagaccactcttaagggatacagaagtagaaaatgcagaaagcaacaaaactgagcttcttggccaggcaagcaatggctcacacctgtaatcctagcactttgggaggccgaggcaggcagatcgcttgatattgtggcacaggagttcaagaccagcctgggcaacatgaggaaatcccatctctatttaaaaaacaacaacaacaacaacaaaaaaaaaaaacccacaagcttctggcctcttcagaggggctggctactgcaggaacctgaaacgtcctctggttagggcacagtccagtggtggtctttaggagtagcccactgggtggcagagaaacttgctggaggacacagaacctgcatagctgattccctcactttcttcaggtctttgctcaaatgtcacatttttatagagacttttcccaactagtttgcttaaacgtgcagtcctaccctgacactttctatccctgtctctacctatcatcaatatttaatatataatattcttaaaatatttcatttattgtctgtcaacaccatgggagcagagatttttttttgtccagtttattcattgctgtgccacaacatcaagaattgtgccttgactgggtgtggtggctcatgctgtaatcccagcactttgggaggctgaagtgggagcatcacttgaaaccaggagttcaggaccagcctggagaacgtagtgagaccccatctcttaaaaaaataaatcatgccttgcacatagtaggagctcagtggatatttcttcagtattggctgaatcattattagggttaatctttatcatctaacatagatcagaaactgtttgccagcctcctcatcaagtgtgtggtccagttggaattgatacagaccattgacaacattgtgttctaccctgcgacgagcaaaaaggaggatgcagagcacatggttgccgcccaggtaagaacaggaggcctcaggaagagcatccctgtccatagggaggttgctttgatgtagtggtgtgcggaagccagcttgtactggctttccagagcctgtcatgctcatctctttccaacctcacattcagtgatggcatgttgatgcttaaaattggccttgatgggagttatttacatcagagaaaaacagcaaacactaaacatcagggcttcattttttttatgtatataccccagagagtgagtttatgagcataccactgctcaaatgccaccccactagtgttagttatcacaggaactattccccacaattgatatacagttttttttctggtttttttttttttgtttttttttttgtttttttgagacggagtctcgctctgtcgcccaggctggagtgcagtggcgcgatctcggctcactgcaagctccgcctcctgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctgatatacagtttaatcacaaataagtgaggaggaaaagatatatataaagatcccagtttttccttcaagaatttcgctttttttgttttctatatgcaactttctacatatgggattcttttcctttttttctttttttggcgagacaaagtctcactctgtcacccaggctggagtgcagtggtgcaatcacagaatcacaggtaactggggtttcaacctcccaggctcaggtgattcccccatctcagcctcttaagtagctgggactacaggcacatgccgccatgcccagttaattttttacattttttgtagagatggggttttgccatgttgcccagcctggtctcaaactcttggactcaagcaatctgcccacctcagcctcccaaagtgttgggattgcaggcgtgcaccaccatgcctggcctacatatcagattcttgaaaacatagagaattcagtgtccaaaagttggacagttatcctacaccatgggttacaaatgtcagtgcttcaggggctagcagatcctgtgagagtgagtgagtgaggcaggctgggtaaggattgtggtaaaccagaaatctctagcccagtcaaagcggctgccacctctcagctttagcgcccgattaccatccaagtgggttaagttgtgacagtttctcgtgtttcaagagtagccaaaatcaagattttttttcatagaggaagtcatgttttaaatactagcaaaagtaatgtaaattttattactgctggaaaaaatacagctgtgagccagaggctgtccttttgattttaaaattttaggcagcttgttcagtaaagtttcctagggtttcatacatgtttcaagaatgcattcctgggctaggtgcagtggctcacgcctgtaatcccagcactttgggaggccgaggcaggcggatcacgaggtcgagtctgagatcattctgaccaacatggtgaaaccccgtctttactaaaaatacaaaaatgagctgggcatggtggcgagcacctgtaatcccagctagtcaggaggctgaggcaggagaatcacttgaacccgggaggcggaggttgcagtgagccaagattgcgccactgcactccagcctgggcgacagaaactcttgtctcaaaataataataataataataattcattcctgtaatgaaataattggagacacacacactcctgcttatgcagtggaggcagcactgatgaaactgaaactttggccagccaagcctgccatcatggaacggctcagtgtgttccttcaccagccagtgagcagagtctaaatggaaatgtttcagggtgttggggaataagtgtgtcttatagacagggatgacttttggagagtcatgactgccgttgtctgcaatcacaatgcccagagcattccatcttcttcattagctcttctatcctctgtcctgtcctctagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggtaaggccacacagcagataagatagatggccacactggtcaccttcctaaaacattaaagtgcttggaaaatgcccaaaattttaaacatagctagaataacttaacagatattttcatgcttgagggggagagaagggaaatgttggataggtttcatcccagtacatggtagattctcagtacgtatttgataaaaagacaaattgaggccggatgcggtggtccatgcctgtaatcccaacactttgggaggctgaggcaggcctcagccaagatcacttgaggccaggagttcgagaccagcctggccaacatggcgaaaccccatctctactaaaaatataaaaattagccaggtgtggtggtgcaaacccataatcccagctacttgggaggccgaggcaggagaatcgcttgtacccggaaggcggaggttgcggtgagccgagattgcgccactgcactccagcctgagtgacagagcaagactccatctggaaaaaaaaaaaaaaaagacaaattgaaagttggagaattgaattgatctagcaagtcaaaacattttatgggctgggtgcggtggctcacgcctgtaatcccagcactctgggaggctaaggcaggcggattgcttgagcccaggagttcaagaccagcctgggcaacatagcaaaaccccatctccacccaaaaaaaagtatatgaaaattagctgggcattgtagcacacaccatactcaggaggctgaggtgggagaatcacttgagcctaggaggtggaggttgcagtgagccaagattgcatactgcactgcagcctgggtgacagggggagaccttgtctcaagaaaaaaaaaagaaattttacattaaattaaaagttaaatatgacataaaaagtgtggtagtctaggaaaaacagaaaccattcatcaattttccaagccttatatttactttcctacctccaaaaataaatacaaaaaccctggaggtaaatacattttttttccaagatggtggtgggattctcattattttgaactttgcatacaagtgatactttatataatttttgtattgttaatttttaccattactttttttttttttttttttgaggcagagtcttactctgttgcccaggctggagtgcagtggcgcagtctcggctcactgcagtctctacctcccgggttcaagcaattctcatgcctcagccttccaagtagttgggtttacaggcacatgccaccatgcctgactaatttttatatttttagtagaaacagggtttcaccatgttggcctagctggtcttgaactcctgacctcaagtaatccactcatcttagcctcccaaagttctaggattacaggcatgagccactgcacctggccttgttatcattactttttgtccccaaatatttattttaacccacaattaaagaatgtcatttttctctacagccttaaaatatccagctcttttatgcctttgcctgtaataagattttgtttgtgagagtcgtttgcatatctcttaagctgattggtactagtttgtttttaagaatgtgttcttttttttttattatttatttttttattttttggagatggagtctcactctgttgctaggctggagtgcagtggcgtgatcttggctcactgcaacctctagcctcctgggttcaagcgattctcctgcctcagcctcccaagtagctggaactacaggcacgcaccaccacgccagtggtctcactctcttgacctcatgatccacctgccttggcctcccaaagtgctgggattacaggcgtgagccgctgcgcccagcctagaattcttaagagctgttacatttgaaaagacaaaactaatggtttcgccagccaataagcaaagtctaaatggagagcaggccaggcaaggtggttcacacctataatcccagcactttgggaggctgaggcgggtggatcacttaaagtcaggggttcaagaccagcctggcaacatggtaaaaccccatctctacaaaaaatacaaaaattagtgaggcgtggtggcgtgcgcttgtagtcccagctacgcaggaggctgaggcaggagggtaacttgagcctgggaggtcgaggttgcagttagtcaagattgtgtcactgcactccagcctgggtgacagagcaagactgtctcaaaataaaataccaataaataaatgaagaacagtacagggcattgaaaaatgaagttatcttgtaatacagaggatgacttctggggagtcgtaactgccttcatctggtatcacaaacgatctgtattaagaatatatataaaatgtttcaggccaggctcagtggctcatgtctgtaatcccattcctttggaaagctaagacaggaggattgcttgagcccaggaatttgaaaccggccagggccacatagtaaaaccctctctgtacaaacactaaaaaattagctgggtgcggtggctcccgtaatcccagaactttgggaggccgaggcaggcagatcacttgaggtcaggagttcgagaccagcctgaccaacatggagaaaccctgtctctactaaaaatacaaaaattagcccggcatggtggtgggcacctgtaatcccagctactagggaggctgaggcaggagaatcgcttgaacctgggaggcggaggttgcagtgagccgagataatgccattgcactccagcctgggcaacaagagtgaaactgtctcaaaaacaaaaaaaaattagccaggcatggtggcacacatctatgttcctggctactcaggaggctgaggcaggaggatcattgagcccagaaattggaggctgcagtgagctatgatcatgccactgcactccagcttaggtgacagagcaagactatctcaagaaaaaaacagatgtttcatatttcataaaataactagatttctagtcatacacagttatcagcattatcttagaaatgtgcactaattatatgactgtctgatctctaggttttaagggcaagtctaaacccaatcttctaaaacaagaaaccagcagcctggcctgttgtttgaggatcctgtttcgaatgtatgttgatgagaaccgcagggattcctgggaagaaatacagcagagacttttaacgtaagaaaattagtttctgattagatttctatctgctatatacaaaatgcatcacagcaatactgtggattgaaaagagtaagagaaaaatacatgctgacactctgacaaatttttttttctttctatttggtgactctcccatttcacttttcttaatgccctgaagagggcagagcctcatctgtttcactgttaagcccttgcttgagcccaggagtggaagggtgctgtgagctatgcatagaaacatggacagtgaaaagtgctccgagcggtcagcaggctggatggaagtcctgactgtggctagagccctgtggccttaggcaggttactatccctcttgggaccaggtcctctttagaattgttgtcagcaataacatcccatcattccttctttccaagaagagtgtaattgaaatcatataaccaggatgtgcctacaaaattatctagaaatccaccaatggggagagagtggaatactgatgaggaagccccagccagaaaagtaggtctttgtcactcagcttcctgggcatcagcaagattctgatgcctgagctttcttttcttcctctaaggtataaaaacagtaacacacagtgctggcaaatgtgtggtaagaatgcactctcctgcgtagctagttggagtgtataatggcatgatctttctggaaagtaggtgagactatataccaggagccctaaagtgttcattctctgtgactcagtaattccactgttatggaatctgcttcagaaaatattttagaaataggaaccaggaataccacatggaatattcactgcagacttatcaggagaaaaaattttaagcagctcaactgtggaatgaataactaagctgtaatatgtcctaaattatgatattatgaaacatagtcattaaaagtgaattttttttttttttgagacggagtcttgctctgtcgcccaggctggagtgcagtggtgcaatctcagctcactgcaaggtccacttcctgggttcaaccaattctcctgcctcggcctcctgagtagccaggattacaggcgcgtgccaccatacctggctggttttttgtatttttagtggagatggggtttcaccatgttggtcaggctagtctcaaactcctgacctcaggtgatctgccgacctccgcctcccaaagtgctgggattacaggcatgagccaccgtgcccagcctaaaagtgaatttttttttttttttttttttttgagacagagtcttgctctgtcactcaggctggagtgcagtggcgtgatcttggctcactgccacctctgcctcccgggttcaagtgattcttctgcatcagcctcccgagtagctgggactacaggcgtgtgccatcacacacctggctaatttttgtgtttttagtagagacaaagtttcacgatattggccaggatggtcttgaactcctgacctcgtgatccccccacctcggcctcccaaagtgcagggatgggcgtgagccactgcgcccggcctaaaagtgaaatttttaagaaataattttacttaatgtgggaactttttcataatacaataatttttaccccaaaaaaagctgcaaaagtgtttttacttggaattttcagcaattggggcattttatttgtttttttagagtcagggtcttgctatgttgcctaggctggtctcgaactcctgggcttacgagctcttcctgcctcagcctcctgagtagctgggactacaggcgagcaatttttcttttgaaatcttagcaaaaaaaaaaaaaactggaaggaaatatgccaaaatattgtcatgtatcccttagaatgatgtagctatttttctttataatttttttcataattttttacatatatcagttaccttacaatgagaataacaagtcataaagtgaaaaaagaattaattaattaaaggaggcaccaatggctcatttcagcttaagcccaaaagacaaatacctacagtctcataaagtttctctaaaggagatatgtagggccgggcgcggtgggtcacatctgtaatcccagcactttgggaggccgagccaggtggatcacaaggtcaggagtttgagaccagcctggccaacatggccctgtctctactaaaaatacaaaaattaaccaggcatggtggcaggcgcctgtaatcccagctactcgggaggctgaggcaggagaatcacttgaacccaggaggcagaggttgcagtgagccaagattgtgctgttgcactccagcctgggcaacaagagcaagactccgtctcaaaataaaaaaaagagatatgtaaatgtcaagtttttggcatgttttttaaaaaagcaattaaatgtgattgtgaggagagaaaggcagttatataattatgagtaataagctcttgtgctacagacattgattgagttcagccctagccatgtgccaggactgagccaagttatgacttaacatatttacttcatttaatcctcacaacaaccccttgagtttggactttttttttttttttttttttttttttttgagatagtctcactctatcgcccaggctggagtgcagtggtgcaatctcagtttactgcaacctccacctcctgagttcaagtgattcttgtgcctcagccacctgagtagctggaattacagatacgcaccaccacacccagctaatttttctatttttagtagaaatgggggtttgctacattggccgggctgtctcgaactcctggcttcaagtgatctgcttgcgttggcctcccagagtgctgggattataggcatgagtcactgcacctggccaggcaattttttatctccattttatagctgaagaaactaaggctcagtgatttgcccaagatagcacagccagagtgggtgctcaatagttattgcagtggctgggctcagaggctcaggctcacatctataatcccagcactttgggaagccaaggcagacagattgctgagcccaggagttcaagaccagcctgggcaacgtggtgaaaccccatctctactaaaaatcaaaaaaattagccaggcatggtggcgcaagcatgtagtgttagctgcttcagaggcagaggtgggaggatcagcttgagcccgaggaggtcaaggctacagtgaaccttgatcacaccactgcactccagcctgggccgcagagcaagaccctgtctcaaaaaaaaaaaagtaattaaaaaaaacatgttaaaataattttaaaaatagcacaagaatgaatagttctcccctgaatgtgagatgttaatcaattgtttgatatgcctccccctctctaattcttctagtgtttgcagtgaagctcttgcctatttcatcactgtgaattctgagagccatcgggaggcctggacaagtctcttgttgttacttctaactaaaaccctcaaaataaatgatgaaaaggtatgaacaagtaaactctgaccaattttcactaggacataaagtttgggttggctttttactcaagagtttgcagtaactattttctcagttctcccaaggatggttacgtgactagcaccattctagatgcattggagagaagttaatccgttatggacaatgggtgccacaggatattagggctttttgcctggaagaacagtagttgagaacggctgaagtgtagacctcatgtgttgctgttaggaatggtatggtgagtttcagtgcaggaagagagggttaagattgtgaagcaccagttttgacctaggaacctgctttacaaaataaaagagctgttgacttttggcagcaagactatccaaatttaattaaagttaaatataactgaaagaagctttaatttgcaaggtttcttcaacttctttttttttttttgagacagagtcttggtctgtcacacaggctggaatgcagtgacgtaatctagctcactgcaatttctgcctcccaggctcaagcgatcctcccacctcagcctcctgagtagctgggaccacagacacgcgccactatgcccagctaagtttttgtatttttggtagagacagggtttcaccgtgttgcctaggctggtctcgatctcctgagctcaagcgatccacctgcctcggcctccccaagtgctgggattataggcgtgaatcactgcgctcggccccaactttctaatagcaagaaaagcaccaatattgtaataagttccagggtgagattaacacttctgaaaaactggtgcccaaaaaaaaaaaaaattgtctaattttatctgtttctctcccacctcaagttcaaagcacatgcttcaatgtactacccctacttgtgtgaaattatgcagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgtactggcagttagtgtcactgctttgcacagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttaatgatggtgcaatactctcacctgcagtagaactgagttctgctgcagcttgtgtaaaagtgggcagtacacaagtacgtcccaaagcctgtgagcagtatacgtggatgctcacccatgagaaggagcacacacgcctcattctctgccctcacccactgctcacctagagcatcgctgagcgttagacaaagtgttacacagaatgattaaaactttcagacttctacctatgctctttagtcctgtaaattgggttgtattgatgtcaactctggtgccttagaagttagtagtttgggaacctatctgtaaaatcagatgttttttctttgtagagaaggatttctggtgcttttgcttactaagagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatatgtgctgggtctctagagaagtttttatttgttacaatactgctgctttgagcaattttgtttctcttcattgtctgttagggaaatcaccagctttggcatcttaacaacaaacagtggatgggtaatttttatttctgatacgcatctttagagtcaaatatatcttttccctgtactcctcatgtacaaccaaagaacatacattatgaaaattgtattataatatctggaaacacaacattttcctctggcaggtgacttttgtacgaaatgaaaaaaaaaaaacctgtattttttttgttgttcttttgtgattaaggatatacatttagtagtctttgttattaaaggaacctgctgataagtacaagtgtgaccatctcattcaaatgtttgttgttatgatgcaaatggatattggtttcaatagaagctggatccttaatactgcattttctgaattctgttttaatatttgtgttaaagtagacatagctgaactcacatggaatcctggagttttgttatcagcagctttgcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttactttggtttaacctatacacaatgattaagtgcatttaatattggtaatttaatgaaaaccattccttgcccaatggatgtataaatttttgaaagaataagcagaattatataatatgaaatgctatgtaaagttttctatgtaaaaatattatgtataatactattaaaatatcccatgctttgatcaggtggtacatcaataaaattttaaaaagtatagctgtttctaatgtgtagtaatttaaaaaacatatatcaagccgtagttttgggtcagtttatgtccctcaccaatgaaagggggaaaattctagtcatgagattctttatatgcctcttgaatctattaactttgttgttgctagttacaaaatgtaattgtaaggatcaagtagtggctattggttcagccagtacacattgacagctttgaaatattcagatgctaatttatttatttatttttgagacagggtcttgccctgtagcccaggctgagagcagtggtgcaatcacagctcactgcagccttaaccttcttggttcaagtaattctcccacctcagcttcctgattagccggaactatagggccagtagtgagacaccttgcctggctaatttttgtatttttttgtagagttggggtttcaccatgttgcccaggctggtcttgaactcctggcctcagtgatcctcccaccttggcctcccaaagtgctgaaattacaggtgtgagtaccacgccaactgagatgctaatttttaagtcaatgtgacaaatactaatcagattcccataacagtgtttaggatctacataaatttgattctggacatagttctatacacaagggtaagagactgacagtgtaattccccaataattaaactaaaggtataattttccaaatcacttttagtaacacaataaattctaactttttttaaaaatagagatgggggtctcactatgttggccaaattggtcttcagctcctgggctcaagtgatcctcccacctcagcctcccaatgtattgggattataggtgtaagccactacatccagccaattctaactttttaagtctagggtctggcatggtgggaggattgctagaagccaggagtttgagaccaatctggggaatgtagtgagaccctatctctacaaaataataatagcaagtgtggtggcacacgcctgtagtcccagctacccaggagactggggtggggaggactgcttgagcccaggaggtcgaggctgcagtgagctttgtttgtgccactgcacttcagcctgggtgacagcctgtctcaaaaaaacaaaaaccaaaaaaaccttctggccacaaagcaaaaagttgcatagccacggtaaagatttagttggttataaagttgtagttattgccactttaagctaatacttcgttttggagcttttatacacagtatttttgttagggatcacagttctgcaacctctgctccaaaaagaatgagttttcttaaagggagcttaacttctgaagtcttagtgattcataggtgtgcatagaatgtgtgattccacatcccaggtggaaagaaagcaatctttccacctcagcctcccaaaatgctgggattacaggcacgtgccaccatgcccagctaggtttttgctgaggttaacctcttatctcttgtccctccctccaccacaaaaaccacaaacaaaaaacacttctacagcttccttcttcttggctgtctttgtcaatgtttccaatttttttttttaagagacgtgatcttgctttgtcacccaggctggggtgagtggcctcattgcagctgactgcagcctcaatttctcgtgcccaagccatccaaagttctttgttctattatgtggacagacacgaagggcatggcatttgttaagttctgttaaagtcttctctgcctctctcatgtctgtatttttgtggcccatgtcttctatgtggttgagttgttccccttgtttatccagtattgtgatgatcttgattcctgcatcctgagactcaatggctaaacccaggattctccttgtactttctagagactcatcagcaacttggtgaaccctcagatgaattctttttgattcaggatcttgctgtggctcccaggctggagtgcagtggcagtggcaccatcatagcttactgcagcctcaaattcttgggctcaagcaatcttcctgcctcagcctccccagtagctgggactacaggcacacctcactatgcccagctaatttttttaaattttattgtagagacagggtcttgctacgttgccccagctggtctcaaactcctaggcccaagtcatcttcccacctcagcctcctaaagtgctggaatttacaggcatgagccactggacttggccctgaatttcttttaatgacagattatccatgatgaatcaaaactatcaggcatgggccaggtgtggtggcttacacctgtaatcccagcactttgggaggctgaggcgggcagatcactagaggtcaagagtttgtgaccagcctggccaatgtggcaaaaccctgtctctacgaaaaatacaaaaattagctgggcatggtgacacacacctgtagtcccatagtcccagctacttggaaggctaaggaacaagaatcacttgaacctgggaggccaaggttgcagtgagctgagatcacaccactgcactctagcctgggccacagagcaagattcctcaaaaaaaaaaaaaaaaaaaaaaaattacttggctaatttttgtatttttagtagagactggctttcaccatgttggccaggctggtctcaaactcctgacctcaggtgatttgcccgcctctgcctcccgaagtgctaggattacaggcctgagacactgcgcccagcctctgaagacccacttctactgcacacctgtcataggcagaaagcagccctgggctcctgctgccctctgagagagtcctggaaggtactctgtccttggcctttgggccacattccatggactcctggtaaagtctcacttctcccttcccttccaccaaaagaggaaagaaggagaatttaatggctgggcacagtggctcatgcctataatcccaacactttgggaggctaaggcaggaggatcacttgaggccagaagtttgagaccagcctgggaaacggtgagaccccatctgtccccctccccatctccccatcaatgaactttagtactttctcctgctaggctttccatattgatcatgtttttgactcttgctatttcaaccattcttcagccattaattcgcacaataacccccgtaaagtaggtactattatcatcatcaccagcatccctcctttttatagaggggtacgggctcagagaggttgacaaacttgacttaggacactcagagggatttgaagccctgcagcctggctctagagcccgcctcctaaacattgcccagatctagcctggcaccgtgcctcacacctgtaaccccagctctctgggaggccaaggcaggcagattgcttcagcccaggagttcgagaccagcctgggcaacacagtgagacttgtctctatttatttattttttatttatatatatatattttttgagatggagtctggctctgtcgcccaggctggagtgcagtagtgcaatcttggctcactgcaattttggcctcccaggttcaagcaattcttgtgcctcagcctcctgagtagctgggactacaggtgcgtgtcaccgtgcccaggtaatttttgtagttttagtagagacgggatttcgccatgttgatcaggctggtcttgaactcctgacctcaggtcgtctacccacctcggcctcctaaagtgctgggattacgggtgtgagccatcgcattcggccttgtctctatttaaataaataaataactgcccagctccacttccaatttatttcttccactgcaaccttgatgctcccttcaagtcttgccctggagaggaatctcacacaggggaagggctgctctgatgtgctggagagcagatggacagcggtagataatatggggccctggctcctgtggacagagaacacacttagcacaggactaacatttgcaggctctagggcagaaatacaaatgtcggctcccatgctctgagggtcaacattgaaaaactatacgtaaaacttttgaataagacagtctatcttccttcctttataaatgtacctttgtaaagatctggaagggcaggtcaaagatggaattctcaggctcctcagagctccacaccagaaagcagcagcaccgggtggctggcccaagaccagcaccctgctctctccacctcaggcttcaccctgcaccataaggctttgcatgtgtgcatggaagcccattcctgtccaaactccctgcaaacccctttctgacccaagtcacccttccagcatgggagtgctcacaagctgctgtgcagcccaccctctgaagaagtgacccaggcaagggtatccacaggccagggccctatgggttgggaattccagggccctgtccaactgcagtgtggtctcaaagggagtggcatgggttctagatgtgcacacccattcggctaacgggcaggagggagcagctggaggagggccaggacgaagccctctaaagcaagggcacggcaaaggtctgcaggcttgcccaggtctaaggcaggtctaaaaatcccacttgaagggatggaaaaaatataatttcccatcaagaagcatgaaaaatacacttctaggtcaggcgtggtgcctcacacctgtaattccagcactttgggaggcggaggcaggtggatcacctgagctcaggagttcaagaccagcctgaccaacatggtgaaaccccatctctactaaaagtacaaaagttagctgggtgtggtggcacatgcctgtaatcccagctatttgggaggctgaggcaggagaatcgcttgaacctgggaggcggagattgcagtgagccactgtaatcccagcactttgggaggccaaggtgggtggaacacttgagcccagaggtttgagaccaacctgggcaacacagagagacccaatccctacaaaaaaaaatttaaatatatacatttaaaaatttttaattaaaaaaatataaaataaggaaatagaggacataatatattacctacaacttatatcctaattaataaaggagatttcccattttgtatgagtagatttgtttttttgagatggagtctcgctctgttgcccagctggagtgcaatggtgcaatctcagctcactgcaacctctgcctcctgggttcaagcaattctcctgcctcagcctcccaaatagctgggattataggcacacagtaccacgcccggctaattttcatatttttagtagagatggggtttcaccatgttgatcaggctagtctcaaacgtgtagatttttataacatataaacatatatttaaacagaaataagccaggtgcagtggctcacgcctgtaatcccagcattttgggaggccaaggtgggcagatcacctgaggtcaggtcaagaccagcctggccaacatggtgaaaccatctctactaaaaatacaaaaattagctgagtgtggtagtgggcgcctgtagtcccagctacttgggaggctgaggcaggagaattgcttgaacctgggaggcggaggttgtagtaagccaaaatcgcgccactgtactgtacagcctgggcaacagagtgagattccatctcaaaaaaaaaaaaaaaaattaaagtgcctccattttaaaaaagataagaaacaacaatcagatacttctcaatgtttagctgttaacactcttctgcatctcagttgggctttaaaagcgagattgagacataagacttgttctttcccagcataaccagatgtgtccacgcccttctggatccaaataaaatgtaaagttatcttcctcaaggagcacaccatagacaatgtgtcttttcagaatgtctttccttacattagacagattggggttttttttgtttttgcgcggggggacagaatcttgctttgtcgcccaggctggagtgcagtggtgcgacctcagctcactgcaacctctacctcccaggttcaagtgattctcctgcctcagcctcccaagtagctgggattacaggcacccaccaccacacccggctaatttttgtatttttagtagagatggggtttcacaatgttggccagactggtctcgaactcctgacctcgggtgacccatcctgtcctcccaaagtgttgggattacaggcgtgagccaccatgcccaacctagacagattgttttataagggtttagaaagaaaggaaactacatgaatgagtacttagtctcctgctccttgaagtggatgaattgttttctttggtttccaacacagtctgttaagagttgtagcacgccccaagagtatgtgcatgtagtggagctgggatggggaggattcccaagggaatctttagctgtcacccatgaaccatgcagagtggagaaggacactcagcctttctgtggctctcacctgcatgattattctggtggctgcaaagggcgataggcagtaggaggagacaccccgtgacaccaagagctgtgtccagacatgatcgtcttggcacagcttgagggttttctacagaaactggtagagatgctagacagacacaagatgccagccagcctcctttgcgattggctcttagaggtggaaaatggtaaagtcatcaggctcattctccctaggactagaggaacatgttaattatattaaagtagattagtgggccgggtgtggtggctcacgcttgtaatcccagcactttgggaggccgaggcgggcggatcatgaggtcaggagatcaagaccatcctggctaacacggtgaaaccctgtctctactaagaatacaaaaaattagctgggcatggtggcgggcgcctgtagtcccagctgctcgggaggctgaggcaggaaaatggcgtgaacccaggaggtggagtttgcagtgagccgagatcgcaccactgcactccagcttgggcaacagtgtgagactccgtctcaaaaaaaaaaaaaaatgcagattagaacgattaaaatgattactggtgattactggtactattgctgcaatagtaaaaatacatctttttcaccaatgtctttgtttttttttaaaatgttccaccgtcttctgaccatcatggtttatttttatttttattttatttatttatttatttttttaagacacagtctcgctgtcacccaggctggagtgcagtggctcgatctcggctcactgcagcctctgcctcccaggttcaagcgattctcctgcctcagcctcctgagtagctgggactacaggcgcatgccaccacatctggctaatttttgtatttttgtagagacagggttttaccatgttggccaggatggtctcgatctcctgacctcatgatccgcctgcctcagccttccaaagtgctgggattacaggcatgagccaccgtgcccggcctcaccaatgtctttcactcatgtatctttctccatggacttcacttatttatatatggcatttcattcaacatgcaacaaacatttattaagcagctactgtgtgcctagtgctgggggtacagctgtgaataccatcaatatggggctagatgtggtggctcacacctgtaatcccggggctttttttttttttgagatggagtttcgctcttgttgcccaggctggagtgcaatggcaagatctcagctcaccgcaacctctgcctcccgggttcaaacgactctcctgcctcagcctcccaagtagctgggattgcagacgtgcgccaccacacccggctaattttgtatttttagtagagacggggtttctccatgttggtcaggtctcaaactcccaatctcaggtgatctgcctgcctcggtctcccaaatcactgggattaccggcgtgagccaccatgcccagccctatcccagtgctttaggaggcggaggtgggaggatcacttgaggccaggagtttgcctgggcaacatagtgagagctcatctctacaaaaaaattcaaaattagccaggtgtggtggcaggtgcctgtagtcctagctactcaggaggctgaggtgggaggattgctttagcctaggaggtcgaggttgcaatgagctatgattgtgccattgcactgcagcctgggtgacagagcaagaccctgcctcttaaaagaaaaaaaaaaaaaaaaaaaaagccctggccaggcgtggtggctcatgcctgtaatcccagcactttgggaggccaaggctggcggatcacaaggtcaggagttcaagatcagcctggccaatatggtgaaaccccgtgtctactaaaaatacaaaaatcagcggggcatggtggcgggcacctgtagtcccagtaacttggggggctgagtcaggaaaattgcttgaacctgggaggcagaggttgcagtgagctgtgacagcaccactgcactccagccctccagcctgggcgacagagcaagactctgtctttaaaaaaaaaaaaaaaaaagaaaagcccttgctgtatagaatcccttaggttatggatggggaggagggcaggggtttaggaggggagaagcggaaggaggaacaaaataaagaagagacaattagttggagagtgataaataccataatgatatcatggaactaggcttaccagatcaaacactgggcacccagttcaatgtgaatttcagataagcaatgcatgatttttaagtataaatatgtcctacacagtatttatactagaaaattataaatttttttctaaaatttacattgacctgggcagcctgcattttatttgctaaacctggcaaccctaatttgtgtgctgggtggtggtgagtgggcaatttcagataggcctcttttgtggaggtgacatttgagctggaacctaaatgtaaagaaggagccaatcattcaggaatctagaacatcccagcacagggaacagcaagtataaatgctctaaagtggaaataagcttggagcttagaggaacaggaagaaggtggggtggcggagctgagtgagggtgaggagaggagggaagcggaaggtgatgagggcaggcaggctggcaggggccagatcccatatggtttgtgggctgtaataagagtaccaaaacttacataccaggccaggcgcggtggctcacgcctggaatcccagcattttgggaggccaaggtgtgcggatcacttgaggccaggagttcgagacctgtctggccgtgtctccctctaaaatagaagctccaagaggggcaggaagttctcttccgtcttagaccctatgtgcacgaccttggatcgatcaacattgaacacctcctacgtgccaagccctgacatcaaaatgggtcagaagccagcagccgctcgctgaatctgtgttcctctttggaaaacgagaaccgtgaagcctgctggcatggtcagagccaaagagcattgtcacttgtgagatcagcgcagaaacagagcggggccccgattggcccttcgaacttgggtggggccagagcattcctggccccgccccctgcagcgggccgctcgctcatgcgctctggcctcaggctcgctgtcgcgccattttgccggggtttgaatgtgaggcggagcggcggcaggagcgggtagtgccagctacggtccgcggctggggttccctcctccgtttctgtatccccacgaggtgaggcgcggggcgtgcacggcctaccagagtggctcttggggcccagctgaggaagggatgaggcgctcccggtactaacgagcgctagggagtgagaaccgcgcctctgggcgagagcggaatgtgggcccggggttcgggtggtgcgctcaggcaaggtcttcggcttccctagggagcgcttgccgcgcctcgcggcatcctaggtctctggcccaggtgcggcgaccccagggcctgtgagggctgagggcaactgaggcgcggcctaacgcgagcctgcggattgcccgccctttcctctccatcacggcgctgattggctgcgccgccgcctctccgctcgggaaggccgctccttattggtcgcgctcgcatgtccattctctgcgacggtggctgctagccgcgcgagctgagtgtgcggcggcgaggcctgcccgggcggggactgcgggcgcgtggagctgcggctgcctcgcgtcgtcccttgccctaactctagtgaagcccccgaactcacccttctctaacctctgtacttgtatccctgactgtaaaacgggcatcgtgatctcactttgctgaattgtttgtgagaattctagtcggtacacccgggacatagaaatcccctgtaacgcgggttgggggagggttccctcgttttgggagaaacgctgtgctgtggtggttcggagcatagactttggaattagatcgcctgggttcattccagacgtagcctctcgttaggggtgtaacttgaggctggtcacctcatctcactgagcctccatttccttagctgcaaaatggggttaataacagaatctacctcggaaagtggctttgaggatgcgctgagttatttaccgtggtttacaaaggttccctgggagctgacggttgtttattcatctctcccacccatctttctccttagccagtgtggctttctgtttcttccatattccagggttattccgatttaaaattatttgcacatgccttttgtttgctggggaagtaccaacatttttgcaaggcaggccgcctctcccaagtttccctcaccttaggcctcccctaaccaacctcttcttttgttttctttttctttttcttttctcttttcttttttttttttttttttttttttttttgagagagagagtctcgctctgcctcccaggctggagtgcagtggcgcgatctcgactcactgcaacctccgcctcccggattcaagcgattctcctgcctcagcctcccgaatagctgagactacaggtctgagactacacgccaccacacccggctaatttttgtatttttattagagacggggtttcaccatgttgatcaggctgtctaatcaacctgtctaggacctttctcccatggctctccatcaacatcacctggttttagttacttcatagcatttactaacacttacttattgcttacttgttatctttctcaactgctagaatgtaagctgtttgagagcaaggaccttgtctgtcttgcttacttctctctccctggtgggtgccatcccacctgtgcttgccacatggtagatgcacaagtattattcttccttggaggcacagaaggggaccctttagtcttggattccaccaattgctctttttctcaccttgggcccacatagtcatatctttggcctttctctgtgtgtgtctctctcttttttttttttttttttgacatgctttcagaggatcctaatggacctcgtctctccgctcctacaaccctttatctttcacttcttaccatcagtgcaagggaagtctctctccccttctgattacttctgctggttggggtctgggacaggattggatggatgcaagagcagtgctctagttttggaattaatttgtttctttattcatttaataactttattgagcatccacttaatctctgggaatatagtgaaaaaacaaaaatggacaaggtcccttcccttgaggaccatgtattctcgtgggcgaaagaaaaaacattagataatttcagatagtgacagaattatgtgacaggtgaagaaggcttttctgaggaggtgacatttgggtagagaccagccattaaaaggtgaggggcagaacattccaggtagagggaatagaaggctcaaggctcaaggacaggaaccggcttggaatattgaaatatttaaggaatatcttaggttcctagagtgttacatgaagaagggagaaatatccaggacccggatcatagaaggctttgtaggcaatgtaaggagtttggatttgattctaagtggtatattcctatggttagaaagcagagggtaggttgaggtgttgggatatgttcttcatgtgtgggtgccagatagttttcattcattggatctctttccctcttcccaaatgtaaggcctcgggaatggttctctaatgtgttgaggacatatctaagaaaaaggcagacatcttggatcagcttatgtcacagatgtctgtgagatggctttggaaaacaaagcttttattccagaaatctccacctgtaattgagggcctgtgggaagatgctagacttaggtctggccattcattcaacaagaagaacttggaaatttagatgtctgccataactgatttattgtgatgcttttttaagtttcttaattgtgtattggtagagatttccaaagatagttacgtggagaaagaaaagtatcaccccctcatttaaaggtgataaaaatgaattcttatcttctccctcccttttttttttggagacaccatctcactgtgttgcctgggctgacctgggctcagtctatcctcctacctcagcctcccgagtagctaggactacaggcgtgcaccaccacactcaactaatttttattttttttttgtagagatggcaccatgttgcccaggttggtctcaaactcctggactcaaccaatctgcttaccttggccccccaaagagctgggattacaggcatgagccaccctacttggccaaaatgaatgttttgtttctagtttgagtcatttttagatcagtaacactttttgcatttatatattgctaatatttcagagtgtcaaagtacctttacttgtggttgcataagataattagagcttgatcttgttgataattatgaatacctgtaaaatgttctctaaaagtccctgatttctcttattttctcaaattaaggataagcttagaattcggttttatagactatatctgcaaggcgatataaaaaggatttgttgacaaatagttccttaaagaatattcccaaagaataaactttggaaggccaaggtgggcggatcacttgagctcaggagttccagaccagcctgggcaacactggaaccatgtctacagaaacaacacaaaaattagccaggtgtggtggtgtgtgcctgtagtcccagctacttgggaggttgaagtaggaggatggcttgagcccaggaggcagaggtttcagtgggccagaattacaccactgcatttctccagcctaggtaacagacccagaccctgtctcaaaaaagagtattaagattctgggatctatgtagtattttaactttgagggattataacatgcatatttatataacccctcacttttttttaaacttaaaaatagtcctaccctagcatctcaacttaatcattttaggtttcattctattatgtggttttatttatttatttttattttattttattttattttattttatttttggagacagggtttcactcagtcacccatactggactgcagtggcaagacctcagcttattgcagcctagacctcccgggctcaagcaatcctcctgcctcaacttccctagtagctaggaccacaggagggtatcaccaagcccagctaatttttttttttttttttttttttttttgagatgggagtttcacttttgttgcccaggctagagctagagtgcaatggtgcagtcttggctcattgaaacctctgcctcccgggttcaagcaattctcctgtctcagcctcctgagtagctgggattacaggcgcatgccaccacgcccggctaatttttttttttttgtatttttagtagagacggggtttcatcacattggtcaggctggtctcgaactcctgacctcagatgatccgcctgcttcggcctcccaaagtgctgggattacagacgtaagccaccgcgcccggcctgagcccagctaatttttaaaattttttgtagagacaggatctcactattgttgccaagtctggtcttgaacggtccttggggtcaagtgatcgtcccatctccacctcccaaagtgctgggattacagaagtgagccaccttgctcagcctgttgtggttttagaatctagaaggttgtgtccacctctttctgtttgacacagtcaaccaaccaaaataaagatgaagaataatatttttgatggaaacatcaaaggtatctagctttttaaaatagtacaacaaatatataacgggtgctcatcactattgtaaggctctagggagagagcagtgaacaaagcacaaagtccctactatcagtggagtttacaatctagtgaagagagaagcacagtaaatgacaaaagaaattaatatgcctgataaaatgtacttggaaaatagtagagtaagggcatggagagtaactgaggtgaatgctcttttagataggatggtgcagcaaggcatctctgaaaaaaagatgacatttgaaaagagtccttccaggccgggcacggtggctcatgcctgtaatcccagcactttgggaggctgaggcggcagatcacctgaggtcaagagtttgagattagcctggccaacacggtgaaaccgcatctttactgtatataaaactcagccgggcgtggtggcacgcacctgtagtcccagctacttgggaggttgaggcaggagaattgcttgaacctgggaggcggggactgcggtgagctgagatcacgccactgcactccagcctgggtgacagagcaaagacccctgtctccaaaaaaaacaagagtcctgaatgagaatgaagtgggcagtgcaaaccttgtagctttccgtgtgcagagctctgcaggcagaaggaatggtaagtacagaaccctgaaacaaaagtaaaatcactggcatgtttgaacaggtaatacaggataaattttatcttttttcagagacagagtcttactctgttgcccagattggaatgcaatggcatgatcatagctcactgcagccttaaaattctgagcttaaccagtccttctgcctcagcctccagagcagctgagactacaagtgctcgccaccatgcctggctaatttttatttattgtagagacagggtctcactatgttgcccacgctggtcttgaaatcctagcctcaagtgatccttccgcctcggccttccaaagcgctgggattacaggcatgagccattctgccaggccagaacaaatctaaaaattcactttcttgaagtacttttgaataaacaaatttaattgtggcagttaagttggtcatttgttcatctgacattcatgcaactgagttcccacattatgttggggctgctaatgattgatctgaagggatagtctccagtcttgactggaaactcatgttttgctgggtgactgacatgttgtgacttatcctttagttcatacaacaaatgcttactaaatatgtactgtgtgccaggtaatgctgaaggtcctgagcatacagacgaaagtccctgccctcaggagcttgcagtctagtgtgtgtatgagacgacaaagaagtttatttcaaatgagggtaattgctaacacagtaaaacaaggatgatgtagatggtaatcgtagaaggcctttttgaagagttgacagtgggctgagtgctgaatggtgtccattatcaaattagaggatgagcattattatggtcagggagaactcttgtggccagtttgtagaacagaaggcttttgtgcctggaatgtagcaagagccaggaggaggtaggagatgaggtcagtagataccagattgcttagaccctgctgtggtaagggatttggtggtggtggtggtggtggtggttgttttggagatagggtctcactcccattgcccagtctgtagtgcagtggcctgatcacaactcacagcagtctcaatttgctggatctacaggtgtgtgccaccacacctggctaattttttgtatatttagtagagacagggtcttgctgtgttagcccaggctggtctgaagccggctgaagcaatccacctgccttggcctcccaaaatgctgggctaacaggcggcagccactgcacctggccaggagtttgggtgtttaagacaagtaattatgaggaatctaaggagttttagttgagaaatatacaaatgctagagaaacataatgaagaaagtgaaatgcagatttattaagaagtgtatttttaaaaatcaagaaaataagccctgtgtggtggcatatgcctgtagtcccagctattccagaggctgaggcaggaggattgtttgagctcaggagttagaatccaatctggacaatacagtgagaccccctgtctctcttttttttttttttttttttttttaaagacaaaatagatctgtaaatctgcccctgcaccctccccacccaagtttctaacaatctgccttgcatgaatccccaaaggtagaataaatttgcatatggcaaagaaaggccaatttcctttaactcagatacactgatgttaatgatttaacttgaccacagcaaactaacttttttttttttttttttttttttttttgagactgcgtttctctcttgttgcccaggctggagtgcaatggcgcaatctcgcctcattgcaacctttgcctcccaggttcaagcaattctcctgcctcagcctcccaagtagctgggattacaggcatgtgctaccaggcatggctaatttttagtagagacggggtttcaccatgttggccaggctggtctcaaactcttgacctcaggtgatctgcccctctcagcctcccagagtgctgggattataggtgtgagccaccacacctggcccaaactttcatgatttcataactgatccaccatttcaatacagaaaaaaggaataggaaaataaatggattaaatcattgctttccaaagtgtgttctattgaaaaggagttctatagccaaataatgggagagactgggcaatcctcccaccttagcctcccaagtagctaggactacagggccacaccaccacgcccggctaattttttgtatttttagtagagatggggttttgccatgttgcccaggcaggtcttgaactcctgggctcaagcgatcgtctgcctcagcctcccaccagtggagactctggattaattgatgtgaaccagtaactttgtgagtttaaagtgctttgtattgtgaatctccaaagtggggcaggatataatgtgtagcattttccaaacttgtgatataaaaaaccataaagggtatagcctctcaatagattgtatgtgtggtttaatgggacttgattttcacacctatagagtggaacacctggattagagggagtgattaggtaggtggtgggatctactcagtcagaacattagcttcctgtgataaacacattttctaattaaggggaaggactgcagcatgtagaatacagataattctctttagaaggttggggtttctggctgttggggagtgccctgcataagcacagcattagataatattttcttattttctggctccccaccgctcagttgtcctctggctgccctcttttcacatcagcctttctattgtgttgtgagtgctttcactcttggtcagccgtctgtcatttccacctaagaggcagccttgggtaatagaaagagggtagacctacggagttggactgatttaaatctgatctttatttattaaccatatatagttaatatatgtcaacctgagtgcccttctttgtgtgtaaaatcattgtgtggaataaatgatatgaagcctatgaaaacatctagcatcgtgtgcctggttcatacatgtgacacttcccccattctgcaaaccattaccagcccaaaggtcctctactccactttcattacatttttacccacttaagaaaaccttcatgacttccccatacattaaatcatggcactcttcagccaagtatggaggaacctatatgatctggtcttgatctcctagcccactattctctcttcccatctctgttactttgctctcacaattcattttggcagatgcgccctcatcctactttgcctattcagatacacatatttttcaaggttcagctcaaggctcaggctctgggaaactcttggatggccacataaccccgtgactcccttcttaattttctaacgtttaaggtgctgtctttgtgattcatttggcacttcagaggacagatgtttcagaatttgggattttttttggatgcatgtactgtggattatacaacatccccagtggggcttggggtagcaccctgtaatcaaacgtattgatatttctttagtgaaacaaatttgcatactaagtgagataaatctatgttgatagcctcaggcagttcaggctggttttgctgccaagtgagtttgccacaaacttgttaaaaaacaaacttttaagtttttttatttttggatttcatcactttagtaaagggtatataggcctgtacttggcatttcagttgtgtcttgtcttctgaactattacagaagctccttctaggacaggaacttgattgcatattgtcataggcattttaaaaataaatgggtcccggtatggtgggtcatgcctgtaatcccagtgttttgggatgccgaggcaggaaaattgcttgaggtcaggagttcaagaccagcctgcgcaatatggtgaaaccccatctctacaaaaaatacaaaaattagccaggcatggttgattgcgcctgtagtcccagctactcaagaggctgaggtgggaggttggggcttgagccctggaggttgaggctgtggtgagctatgatcatgcccctgcagtccaacctgggccacagagcaagactctgtctgaaaaaataataaaattttttaaattccttactgtaaatgtataatagatatgtgattgtaagattagaaaagtatgaagagaataaaactctccttatatctatcaccgagatgttatcactgttctacattttggagtgtgttttttgttttcttctatatgtgaagttttttttcataatttgaattatgatatccttgaactttttccactgaccttttttacattttacaaaaattgtgtgtttagtttttttcttctttttcatagaagcctctggttaatttggtgcatgatttccctgaaagggctccactttcccatctacatgtggctatatatctaaaagctgcctaatggaatctaagcataagtggagttttctaaaatcgctttttttttttttggagacaaagtctcgctctttctgaggctggagtgcagtggcacaatcttggttcactgcagcttctgcctccaggttcaagcgattctcctgcctcagccacccaagtaactgggattacaggtgcatgccaccatgcccggctgattttgtatttttagtagagacgggattcaccatgctggccaggctggtctcaaactcctgacctcaggtgatccacccccctcagcctcccaaagtgctgggattacaggcgtgagcaaccgcgcccagcctaaaatagctttattgaagtacaatttacatactataagatttatccattttaagtgaactgtttgggaaatgttagtaaatttatgtagattatgcatgtgtcaccacagtccaattttagaacactctgtcacccccaaaaagttccctcagtttgcacctaattttatcgtctcaccaacaagttggagaccataaagctcaattgataagattcccaggatttgtgatctgttggtaatcatgcacatctgacacttgtactctgtgtatgtgctgtttctgtgtgttttttcattttccttttaattgagtgggttcagactcctttttttcccatttttaatggacaaaattgtatatatttgtggtatgcatgttttgaaatatgtatacattgtataatggctaaatcaagctaattaacatattacttcacatgctgtgtgtgtgtgtgtgtgtgtgtgtgtgtgtgtgtgtgtggtgaaagcacttaaaatatacccagtaattttcaagtgtacaatacattattatagtcaccttgttgtacaataaatctcttgaactgtgtatttcttagcctatgttgttagtagttaaatcgacgtaggccatttagttagcttaaaatttgtgggctgggcacggtggctcacgcctgtaatcctagcacactgggaggccaaggcaggaggatcacttgagtccaggagtttgagaccagcttgggcaacattgtgagaccctgtctctacaaaattttttttttaatttgtcatctgttagatgtgaagttttttggtcagttataagcatattatgtgatttagttttgtttaagctttaaatatgaaaacttctagaatcataatcttagctgtcatcttctgaactctagaatttatctccctagatgcaaattcttagcactttgtagtatttgcgattacatgttgtacatgaaggaatttcttgtttctttaatctcagaactttatgtgggatatttatttgctgtttaaaattttaatttctcgttgtggggccttttttttttttttttttaagacaggtcttgctccatcacccaagttggagtgcagtggcaccatctcagctcactgcaacctctgcccccaggctcaagacatcttcccacctcagccttccgagtagctgggactgaaggcacccactaccatgcctggctaattttttgggttggttggttggtttgttttgagacggagttttgctcttatcgcccaggctgcagtgctatggtgcgatctcagctcactgaaacctttgcctcccgggttcaagcgattctcctgcctcagcctcccaagtagctgagattacaggctcctgccaccatgtccagctaatttttgtatttttagtagagacgggattttaccatgttgaccaggctggtctcaaattcttgacctcaggtgatccgcctgcctcagcctcccaaagtgctgggattacaggcatgagccaccatgcccggcttcaatttttttgtagttttggtagagatggggtctcaccctgttgacaggctggtctcttaactcctgagctcaagcagtccacccacctcagcctcccaaagtgtcgggatttacaggcctgagccactgcccgggctccttatggggcttctttaataagttcctccagtgattttttttttcttaacctttattagccctttcccatagcattaaatcatataaacttcttggtgacttcgagcagtccttcagcttttttttctatgactatctttttgaaattttgggattttttttcatctcccttatcacaaaattgtctcactattgtttttgggggaaaaggcacatctcatttgctggactcttgtctcagagtcaggtttactgcccatataaaaaacaacagatggatgactttcagagagaataacccataatataaacggatttctttaaatgtaaatcactttttccgtaagtgaccagttatccaaaccttattttatattttagatcctatagcaatggaactcagcgatgcaaatctgcaaacactaacagaatatttaaagaaaacacttgatcctgatcctgccatccgacgtccaggtaaagaaaataaacgttttttggttgattaattccttcaggacaggtgagagaaacctatgtattatctgcctccttataaatatattttaaaaaattcatacttgggttctcaagcgtagtttataagtgttacagctgctataccatggtgtgttgtttcttttttgagtaaaatagcttttatttggcatcttctgggattaaaaagtactagttttcggataaaaagtactgacatgtttagaatgctttgtctttgaccttttccaaaatacccacttaaaacatgcctgctttaggccggatgcggtggctcacacctgtaatcccagcactttgggaggctgaggcaggcggatcacgaggtcaggagatggagaccatcctggctaacacggtgaaaccccgtctctactaaaagtacaaaaaattagccgggcgtggtggcgggtgcctgtggtcccagctactcaggaggctgagtcaggagaatggcgtgaaccccggaggcagagcttgcagtgagccgagattgcgccactgcactccagcctgggcgacagagcaagactccgtctcaaaaaaaaaaaaaagcctgctttagagataaaataattagggcatagaaaggagagtaattgcctaaaaagtgattaagtgaatgaagccaagtaatcagttactgtctcttaattttaattttctattgggtttgatttaactaatatattttaagacctagagctttttttttccttcctgaatctgaccagattccattaaaaacgtagaattaaaatattgaactcaggtgttcacaggactcagctgttaagttaaatgagggagataggccaagtggagactggtaatatcaggagaatacatgccctgattaagtggcaagtactttttggaactagctaattttggggattcagactagttttgcaagatcagatttccagttttgcttgaaaaataaggatatttatatgaagtgccctcatttttaaatgttagcaagtaacttcaaaagattttggggccgggtgcggtggctcacgcttgtaatcccagcactttgggaggccgaggtgggcagatcacgagggcaggagatcgagaccatcgtggctaatatggtgaaaccccttctctactaaaaaatacaaaaacttagctgggtgtggtggcacacacctgtagtcccagctgctcaagaggctgaggcaggagaattgcttgaacctgggaggtggaggttgcagtgagttgagattgcgccactgcactccagcctgggtgacagagcgagacgtagtcccaaaaaaaaaaatattttgaaacacagccagggttggtggtcacgcctttaatcccagtaatttgggaggccaaggcaggaagatcccttgagtccaggagttcgagaccagcctgggcaacaaagcaagaccctgtctctacaaaaaatttaaaaattagccaagtgtggtgatgtgtgcctgtattcctagcaactggggaggctgagacaaaagcttcacttatacccaagaggtcggagctgcagtgagttatgatcatgtcagtgcactctagcctgggtgacagagggaaatcttgtcttaaaaaaaaaaaaaaaaaggccaggtgcatttgctcacgcctgtaatcccagcattttgggaagccaaggcaggcggatcatgaggtcaagagatctagaccatcctggccaatgtggtgaaaccctgtctctactaaaaatacaaaaattagctgggcgtggtggtgcacggctgtagtcccagatacttgggaggctgaggcaggagaattgcttgaatccaggaagcggaggttgcagttaaccgaggccactgcactccagcctggtgacagagcaagactccgtctcaaaagaaaaaaaaaaattggacaggcacatttgctcacgcctgtaatcccagcactttgggaagcccaggagggcagatcacctgaggtcaggagtttgagaccagcctggccaacatggtgaaaccctgtctttactaaaaatacaaacattagccaggcatggtagcatgtgcctgtaaccccagctacttgggaggctgaggtgcaagaatcgcttgaacccaggaggtgaaggttccagtgagccaagattgcccaactgcactccagcctaggtgacagagtgagactttgtctcaaaaaaaaaaaaaattgaaatacagtgcaagccaaactacttctgggccagatatatcttgtgagcagtcagttattgatccttgatatgggccatattaaaatgctcttgacctgtttcttcaaaacttaccaatgtgcatgctcatagaggatgttggaagggttccatgaggaagagaatgtgtgttatatattatgtatgatgactagaatcatgaacatgttaatgcatctatcctcttctagaaaagtctttgtgatttttgagaggaaaaattagtttattagtgtataaagaagtaatgtgttcctggataaagggaagttaatggctctaatctttaatcttcttagactttcaaagaaagctgttgccaacactattaaaaattttttttttttttttttttttggagacggagtctccctctgtcgcccaggctagagtgcagtggcgccatcttggctcactgcaagctccgcctcccgggtccacgccattctcctgcctcagcctcctgagtagctgggactacaggcgcccgccaccatgcctacctaattatttgtatttttagtagagacagggtttcaccgtgttagccaggatggtctccatctcctgacctcgtgatccacccgcctcagcctcccaaagtgctgggattacaggcatgagccaccgtgcccggtggaaaaattattattattatttatttatttatttatttatttatttatttttgagacagagtctcactcttgcccaggctggagtgcagtggcgccatcttggctcactgcaagctccacctcccgggttcaccccattgttgtgcctcagcctcccgagtagctgggactacaggcgcccgccaccacacccggctaattttttgtatttttagtagagacgggtgtttcaccaggttagtcaggatggtctcgatttcctgaccttgtgatccactcgtctcggcctcccatagtgctgggattacaggtgtgagccaccgcacccggcaattattttttttttaataatgtgtgaggcaagagttctgttgctttatgtattcaggacagagtataaaaataatctggtatttctgggaagttaggaacatagcatttctcagggatcgagactgactgactagactgactcaactagaccttttgagactccttgagtgcgcagaaacatatgcatgtgaatattgtgataagttgaaagaaatgaacacagaaaggaacagactcaaactcacttcctggatattgattacaatttaggaaagagacttggcaatttatatgggcttttcctcaaatcatggatgtagtgtgttgccctgtacaaaatgctggctactaagtggaggaaacaaattgttctgtactcatataaaaccatagtatgtcccctcctgaaaaacatttttcagtttaacaatcttcatccttcaagaaagacatgataagcacaaagcaaggagagtttgaaaatatcagtgaaactcttgggactcagtcagaaagagggaaggtgttaaatgatacatgaaattaatttttcaaaaaatattggaatattgggtgttgccctatgaagccaaaggtagaaaaaaattaagagaaatactgtactgccatcacatgtgatcattaacctaggaaatttatcccagaatgtaatctgggttgaaaatctattggtaaattttttggataaattcattgctggtattaagaagtttttaggtttttttttagttcgacaagaaagcttagggctggtaaggtaaaataaggactgcactaaaactttcagtagtgaagcctagctgtgtgatcttgaacaagttacttaaccttagtgccttggttttttaaatgctatctacttttctgggtaatagtgacaactaaatgaaattttataattttacatatataatatatatgtaaatcgttggacccatttggctaataataatatattaggatgaattgactcatttgctcttcatcactagcctataaaagaaatattactactaatagtactaataatactcctttctgaaataagacctgggtatatgaagtcttgaagccacttaatctgcctgggaagcagcttctcttgcagatgagatgatcatccaattaggccactgtataggtttgtgagaatcatgtgagttaattgatggtaaagttatttgaaaactgaagcattatataagtttaatgtaacatatataatccacttaatagataagaaaagtgaggccctgtagacccacaaataacctaatcttttctctttttttgatttttttttatatatatatatttgatatatataaggtggaaagatttttatcttagtcttttaacatgaaaattcttttacagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgtaagtattttgtgaatacataatttaataccctgtatgtttataaggtttatataagcagtgttcttcaaagataaggcacgtgcttgtagtcccaactactctggaggctgaggcggaaggatcacttgagtccaggagttcaaggctgcagtgagctatgattgcaccactgtactctagccttttagtgacagaatgagaccttgtctcaaaaaaaaggattcagatatggatcaaagataaaattaaacaggacccttttccaaagcttctgttatttcatttgaatttatataaatttgtccagcttcatacctcgggttgctagggagtgagacttggtcttaatctccattatgtttggaatttatgctttactcaccgcctactgaagagacattgtgggaagacagtctgaataaatgaagtgatttctgatgttggaaaaataaagctgagaagaaatcagatacataaaacatttgcagaatgcaaaataatttagatttcaactttttgataaggtattttgccctatgtcttgtgggatatgtatatatatactaattttgagattaaacctattttataacaggtttaatgattagtaaattataaattaagaaacaggcattttttttccttagcttaggacagtgattctcaactgggggcagtttggctcaccaggggacatttggcagtatatttggagacatcatagctggaggattgctactggaatctagtgggtagaggccagagatgctgctaagcatcctacaatgcacaagatagctttccacaacaaagaattatctgagccaaaatgtcagattgagaaagcctggctcatgatagagaaaaagatgaggcttttctatagtgatagcagttatgatgttacaaagtattagcagttgacaaaaatcatcagtttatctaaaaagtcaactttaaactgctcaaaaacatcttagagtcttactttttttctcattccataaaagagagagtaaatattgttttaagcctgtatgatttctcaagtatcaccatgagtggtaaagaaatcttagaggccgggcttggtggcccatgcctgtaatttcagcactttgggaggctgaggtgggtggattgcttgagctcagcaattcaagaccagcttgggcaataaagtgagatcccatctttccaaaaaatacaaaaattagcgaggcatatggtggtgcacggcctgtagtcccagccattagggaggctgagatgaggggatcacttgtgcctgggaggcagaggttgcaatgaactgagatggtgccactgcacttcagcttgggcaacagtgccagacactgtcttttaaatctcagaatgtttaaaagtccatctctactggtagacatgccagccctctccctctattttgatttgtaaaactagtgagacttaacagaatctctttgggtgatataatctaggatgcattctaactagtaatggtcaagaaattttcacagagggctgggtatggtggctcacacctgtaatcccagcactttaggaggctcagatgggaggattgcttgaggccaggagttggagaccagcctggacaacaaagtgagacccctcttctctacaaaaaaatttaaaattagccaggtgtggtcgtgtgtggtgtgcatctgtggtccttgggaggctgcagtgggagggattgtcttgagtctgggaggtgaaggctgcagtgagccaaggttttgtgctaccctccagcctgggtgacagatggaaacccagtctcaaaaaaaaaaaaagaataaaaaaaattggaaagatttttgttctaaagtgagagttaaattgaagcttttgaggatgtgtatggattaagtagcatatatctgtaaagattttaattatgtgtcctgattagtttacatatgaaatgaaaaaaaaatttttttttttttttttttttttttttgagagggagtcttgctctgttgcccaggctggaatgcaatggtgcgatcttggctcattgcagcctctgcctctcaggtccaaatgattgtcctgcctcagcctcctgagtagttagtgttacaggtgcccaccaccatgttcagctaattttgtatttttagtagaaatggtttcaccatgttggccaggctggtctcaaactcctgaccttgagtgagccatcgcacctggcctaaaatggaaattttttttttttttttttttttttttgagacagagtcactcttgttgcccaggctggagtgcagcggcaccatctcggctccctgcaacctccacctcctgggttcaagcaattctcctgcttcagcctcccgagtaactgggattataggtgcctgccaccatgtccggctaatttttgtatgtttagtagagacatggtttcaccatgttggccaggctggtctcaaactcctgacctcaggtgatccacctgccttggcctctcaaagtgctgggattataggcgtgagccactgcgcccagtctaaaatggaaattcttaattggcatcaaggagtaagggaagttcactaatttgtatgtaaaatatttgcatttgggaggcaatgtacgtttttctgggaaaaggattcacgctgtcatcagattattgaaggaatctgtgacccattcatgtagagggaaactgaagaaagaccaaaccttcctctatttgttttcttagaaaattagtaaataaaaaaacagttatgttttacctaaaatcatgtggacatgaatgtggattttgtgttacttcctcagttactgctttgcttttaggttgaagatgaaccaaacaaaatttgtgaagccgatcgagtggccattaaagccaacatagtgcacttgatgcttagcagcccagagcaaattcagaagcaggtaatgtcgctccactttttagatgggctcctctgtaaagctctgatctaattaatcttttcctctcctagttaagtgatgcaattagcattattggcagagaagattttccacagaaatggcctgacttgctgacagaaatggtgaatcgctttcagagtggagatttccatgttattaatggagtcctccgtacagcacattcattatttaaaaggtattgatgcatagattcatgtttttaaaatactttctaaagttttatttgcttgtgtaaacagttgtgtttttgtgactgttgtcattcctttgaatctgatcatcttggaatgagagcagaagtttctgtattgcgtttgtttcttctcaactaggatgtttatttcatattgctctattacctgtgaaatacttagtcttgataaactgcttgatccctttaaaaagaaaactggctgggcatgatggctcacacctataatcctagcactttaggagggcaaagtgggcggatcacctgaggtcaggagtttgagaccagcctggccaacatggtaaaaccccgtctctactaaaaatacaaaaaaaactagccaggcatggtggtatgtgcctgtcatcccagctactcaggaggctgagacaggagaatcacttgagcctgggaggtggaggctgcagtgagccgagatcaaaccactgcactccagcctgggcgacagagcgagactccgtctcaaaaaaaaaaaaaaaaaaaaaaaaagaattccctttgaatttcggaatttcggaaacccatctattcatagatgtccaatcagcatctctccttgaagacctaaagtgagtaaataaaaaaaacttgtaaatttatctgttttaccttaattttctagataccgtcatgaatttaagtcaaacgagttatggactgaaattaagcttgttctggatgcctttgctttgcctttgactaatctttttaaggtatggaatgcatcttggtgatatttttaaattaatattttaaattgcttgaatgtttgtatacatgttaagagaatgctttgaaagcttatttgatagataatgtttagagcatttcttttgaaaaatttcaaacctacacagaaatagagatgctatagtgaactcccatctattattacacaaatttaatggttagcaacgttttattttctctgttccctttcttaggaatgttataaaagcaaatcccaagcatcatatcatttcacccaagtattttaaagtatgtgtctctaaaggaagaaatacatatttttatttgactatgtttggagtttaattaattatatatttatacattattttacagtttacaggatactttcctgaatgtgttcttggtgtttgtgaaaatcctataagatttaaagaaatatatatatactttttttcttttttcttttttaaagacagggtctcactctcattgcccaggctggagtgcagtggggcatgattatagctcactgcagcctcaactacccaagctcaggtgattctcccacctcagcattccaagtagctgggactacaggtgcacactaccatgcctggctgctttttctctttttttttccctctctctttttttttttttttttttttttttgagatggagtttcgctcttgctcactgcaacctccgcctcccgggttcaagcaattctccgagtacactgggattacagcctgtgccactgggcctggccagtaaaacctgttaatcgcatttagaataataaagaattggaaacaacctaaataccaagtggcagatgaattgtttaataagagcatataaagatagttttgtgtaatatatttttatatatgcacagattgggaagacgtagttcagaatattaacactggactttttagtgccattatgaacagttcaaaaatacatactttaacctattttccacaatctcttaagtgactgtattatttaaaagccaaggctgggcatggtggctcacgcctgtaatcccagcactttgagaggccgaggcgggcggatcacgaggtcaggagatcgagaccaccatggctaacgtggtgaaaccccgtctctactaaaaatacaaaaaacaaaaacaaaattagccgggcgtggtggcaggcacctatagtcccagctacttgggaggctgaggcaggagaatggtgtgaacccaggaggtggagcttgcagcgagccgagattgtgccactgcgctccagcctggacgacagagcaagactccgtctcaaaaaaataaataagtaaaatatgaatagtctcagcttagtgcaaggctgtttcactaagatcagcatgctgggtttatgatgcactaaaaccatgttgctaaattcctttccaaggccactattgaactctgcagtacccatgcaaatgatgcctctgccctgaggattctgttttcttccctgatcctgatctcaaaattgttctatagtttaaactttcaggtaagttcatttgatttcttgcttttggttcttactctttgattttaaatagagttttctttctgtttgataaagacttctttgccagcattgatttttctgaaagaaaaggttttttctgactctatttatctatagtgttctgttctacagtagttctttcagatgctaatgagatgtttcatggaaaaaagcagtattctcttatatctagtaggttagcaaaaccccacatcctaactcactcttggagagtcaccctgtacactgttttactggtggcattaagaagctagatttctgaggccttcctctttcgttcatttatatgggtattaacatttggggaatcatgttttggttaggggttgctgtccagcttatacaaaatgacttttattggaagccatatgagggagacaaaagacttgaagtaccagactttgaaaggggtaggaactagtagtatttcagaggaaacatagccacagggctatagcagggaatgcctagttaccctgttgctactgagatagtggcctccaatcattctttctgttcttaatcattaattcaagattcaggaccaagaaaggggtgttaattggtacaaactgttgctatactgcgatgcaaggagggcctagcccattcattgtttgtagccagtacctggacttaccttcacaacatgaataaactcatagtggtagggaaagcattccccaaaaggaaattgggttgttttagctagaataggagatgaacagcccaaaaggacatgtcccacatcagtgttcagctggatagcagtttgagaagttcttacttaaatgagtactactatttttgcttacaccttttgaattctgagaagtcaggtttaatgaagctcttgagaacttgtctggcagggagaccaaggaaagaggcataatctaccctcaggggacttgtaccctcattaagaaggcagtactatgccacaagaaatcagtaactaaaagacaattagtttatctgccttggtggtcatcttacaataaacgtagttcagaaaagaaaggggatgtattagtatgcactgagcttgagctttgtaaggaaagtcttcatatagtcttagctgaaccttgaaggaagatttagattaggatgagaactagaggtggcatcatttatagcatacaaacagaggcagaagtcagaatgctttatgcagctgccagatgtagctggagcagagaattcttgtcagaataggtaatgctcaggctgtgaagcctgtgtataaaatgttttgtccacgtggtaagggaacttataaaagtggtgttcttaatattttaatcaaaagtttcaagtcagtgtttattctgtaggatctccctgaattttttgaagataatatggaaacttggatgaataattttcatactctcttaacattggataataagcttttacaaactgatgtaagtatttaaaatgttgcctgagtggtctttttctttcattaagagttatttggctacagtctggaaacctatttactcttgcattgttaaaagataaaatttcaatactgtaataatatttgattctatttgatgttacatgtttggtgtgtgtagtatacagaattactcttatcatgggcttggcttaagccatagtgtacatataaggctgtttcattacattattgaaagtaggtctttaaagtagtgacattatggatatttcatgaaataaaattatttttcattgaagatactaagaaaacttaaaactctataatggtagcccctttttaaaaatcatctggctaggcatggtggttcacacctgtaatcccagcactttgggcggccaaggtggggaggatcccttgagcccaggagttcaagaccagccttggcaatgtaaggagacccccatcactacaaaaaataaaaataaaattagccagatgtgttggctcatgctaatggtcacagctactcagaaggcttagttgtgaggatcccttgaccttgagcccaggagggcaaggctgcaatgagctgtgaccatgccactgcactccagcctgggagacagagggagacctcgtctcagaaaaagaaaaaattatccacagctcgagaaagagagaaaatggtaaaagattgtaatttgtaaatatttctgatatgggttttatattgtgtacttttaaacatataacacttattctgtgctactcatttgttaatatatttatgaccttctttccgaagagacaaaagacaaaatattaaaaatatttcaataccaaataaactaaaaattagaattggtgattcaaatcaggttttaagagtggggtacagaaagaaattgttactatcgttgtacaacagattttgtctcagagtttgactatattaataggaactttaaaagatgtagctctcataaaataattatttcagtccaatgggagggaaaaacactccttcagaaaacaaaacttttcttcacacaaaagtcacaaggaaattttttggatagaattcttacaaggacctttttgcccagttaaccatgtgctaccttgtgctactatttatgccttaagtaatcagtgtgagggagttttggttttggctttggtttttgttcttactctgatgtcttcccttgtctcactctgtcaccaaggctggagtgcagtggcatgatcatgacttactgcagcttcgacctccctgggctcaagtgatcctcccacctcagcctcccaagtagcagggactatgggtatgcaccaccatgcccagctgattttttttattttgggggcttgctgtgttgcccaggctagactcaaaactcctgggcttggcccgtcgcagtggcccacgcctataatcccagcactttgggaggccgaggccatcctggctaacacggtgaaaccccgtctctactaaaaaaaaaaaatacaaaaattagccgggcgtgatggcgggtgcctgtagtcccagctacttgggaggctgaggcaggagaatgacgtgaacccaggaggcggagcttgcagtgagctgagatcgcgccactgcactccagcctgggcaacagagggagactgcgtctcaaaaaaaaaaaaaaaaaaccactcctggcctcaggccatcctccagcctcagcctcccagagggttgggattaccggcgtgagccactacactcagccagaatatactgtttgaatctaatacggaaatattttgtaattcagcaacttatttgaaagacttggtgaaaagattggtggtggcatagctgtagtttacaataactgatttgatttggatttaattgataaagagtctagttcaggaatttcagttactcctcttacttatgttagcattagagttgtatgttggagtttttgttttcttttatgtgaggatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttggtaagatgatggtggagacaaataattaaaagacattctctccctatctcctccaagaaataagctgttgagttttgcttttaaaaatattcttgtttttgtgttttgttccagttggtaagtaatgcaattcaatttctggcttcagtttgtgagagacctcattataagaatctatttgaggaccagaacacgctgacaagtatctgtgaaaaggttattgtgcctaacatggaatttagaggtaattatggcaaaagtatattagtataaatctactaagtctgtgtttgttttttgtaacatattcagtctaattcatttattactggataaaacttgtatgtcatttatttcttattttctaaaccaagacagaaaatgtagtatctgtaatgagttttgttgtgccctgtgagggttttctcatggaaatattaaataagacttcaaaaattcctttacactaagaagataaactatctggaatttctatttagagaaagaatttgattttgtttcatttattatttcaatgaatttttagctggctttatttatttatatatttatttgagacaggggtctcgctctgtcacccaggctggagtgcagtgatgcaatcttggctcactgcaaccttagcctcccaggctcaagtgatcctcctacctcagtcttctgagtagctgggaccacaggcacacatcaccatgcctggctaatttcttgtatttttggtagagacagggtttcaccatgttgttcagggtagtctcaaactcttgagctcaagcagtccacccgctttagcctcccaaagtgctgggattgcatttctgagccacctcgcccagaaatagctgtttttaaacaatcgacttgagaatagaaatgataactttataaatacaaggttgaagcccacttagtttgtgcttaaggttaaactatagtgctaagagcctatatttataaaatgtatgtccttgttctaacagttgtgaagaacaagtaatgaaggtgggagggattgtgttttttgttttggggacagggtctcactgtgtcacccaggctggagtgcagtagcacagttatggcttactgcaacctcaacttcccaggctcaagtcattgtcccaccctggcctcctgagtagctgggactacagacgtgcaccaccatgctcagctagttttttattttttataaagatgggggtcttcctatgttgcacaggctggtctcaaactcctagcttcaaacaatccttctgcctcagcctctcaaagtgctgggattacaggcatgagccaccatgccaggccaagattttgttttatatcaaaatagttattagatcagtggttttcaaattacatctggaacaaaataaggaaattaaggacaatatagcgtgagattttatttcctgttgtgttttcataaaaatatgtttaaaggataaatcttctggctgggtgtggtggcccatacctttaatcccaacactttgggaggctgaggtgggaggaacacttgagcccaggagttaaagaccagcctggccaaaatggcaaaaccttatctctacaataaataaattagttgggtatggtggcatgggcctgtggtcccaggtactcaagcagcttaggtgggagttttgcttgagctcaggaggtggaggctgcagtgagacatgatcatacaactgcagtgtgtgtgtgtgtgtgtgtgtgtgtgtgtgtgtgtgtgtgtagacttttttttttttttaatttatatgataaaaatagagatgagatctcgctgtgttgaccaggctggtctcaaactcctgggctcaagcgatcctcccatttcagcctcccaaagtgctaggttacacgcgtgagccaccatgccggccatttctgacattgtccactctacttatttgttgttgaaatgactttaatgaaataatagtgattaaaattaggttgttggtattttaatgttcttatttggtgaaattaaaagttagcattctgatactgatccctaacatttttgacagttgcaggtataatccaattctggggaaactgtcacattagaacaagtgagcctatctcatagttgtgtgaattacctaatacctcacctttcagggtagcatttgctgctctagataatgattaagagtatatgaagtagtcatctgatgggaacgaattctttgctgtagaacaaggcagttttacatactcttctgcattctcagctgtaaagtacagtgacgtcttttggagtgttatctgaaatatcatctctccttgtagctgctgatgaagaagcatttgaagataattctgaggagtacataaggagagatttggaaggatctggtgtgtatcttggttttttagttactagtctcttagcaagccagttttaaggtggttctctttctagtaaatgggagaagtgggattgagaataagagtgttttttcagcgggctttcattgagaactgttgtctttcttcaacttgtcttaaaaagctcttatatgacctgaatgaaaatatcaaaagttgaatcatttgtctgttcttacatagtatttatcaaaattctgtgattctgtgacctctttagtttcattttgattttgtatttcttgggggcgggaatgtttttttcattgtttgtgttgctgatagctattgggtggccctttgtttttcgttcttttttttccgttttacaatcgtagccaaattattccaggcaatttgttttcttataaattggatcagcttgttggtggttgttttttttccccataatatattttcttttcatttcatagatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaaggtaaatatttttaatgtggttttgtttctaaaacagacatcagtgacacccacacaagtcaaaaagaaataacgtctctgataatagagcttactctgccagataacctattctgattaagatttatataatctctgaagatggctttatgttgatgtattgagcacttaagtttcttatagaccagaaaattgatagatggccacacttgttaccttagctgagacccgctgtatcaaatatgcttaacttaaacttagctgttctttaattgaggaaagtttctttattgtctattagtatagtcttattttacatttttatatttttgagatggagtctcactttgtcaccaggctggagtgcaatggcgtgatctcagctcactgcaacctccacctcccgagttcgagcgactctcctgcctcagcgtcccaagtaactgggattacaagtgtgcactaccacacctggctaatttttgtatttttagtagagacaaggtttcaccatattggtcaggatggtctcaaattcctgacctcgtgtgatcctcacacctcagcctcccagagtgctgggatacaggtgtgagtcaccgtgcctagacagtatagtcttattttatattttatacataagcaggttgtgttttgttgttgttgttttgttttgttttgttttgagacggagtttcgctcttgttgcccaggctggagtgcaatggcacgatcttggctcaccgcaacctccgtttgccgggttcaagtgattctcctgcctcagcctcccgagtagctgggattacaggcatgcgccaccaccctggctaattttgtatttgtagtagagatggggtttctccatgttggtcaggctgttcttgaactcctgacctcaggtgatccacctgccttggcctcccaaagtgctgggattacaagcatgagccaccatgcctagcctaagcagttcatgttttgaagtgtccctctctctctttttttttttttttttttttttttttgagacgttgtcttgctctgtcatccaggctggaatgcaatggcaacatctcagattactgcaacctctgcctcccgggttcaagcaattctcatgcctcagcctcccgagtagctagaattacaggtgcatgcaactacacctggctaattttttgtgtttttagtagagacggggttttgccatgttggccaggctagtcttgaactcctgacttcaagtgatctacccgcctcggcctcccaaagtgctgggattacagccgtgagctcctgtacacagccagtacagtctcattttatacataagcaatttgtattttgaagtgttcatctccattttaacatggttttctaaaattgcctgaatttctaatgtgatagatatatacaggtattttgttattttactatgttatgaatttgcttttcagcatggaattacacaagcaaatgaacttgtaaacctaactgagttctttgtgaatcacatcctccctgatttaaaatcagctaatggtgagttgtgaaattcttgctttttttacagcttgccacactatacctgaattcaaaaaacagcttcctatccttgttcccttttgttctttttttttttttttttttcttttgagatggtgtcttactctgttacccaggctggagtgcagtggcacagtctctgctcactgcaactcctgcctcctgggttcaagcgattctcctgcctcagcttcccaagcagctgggactacaggcacgtaccaccatgcccggctaatttttgtatttttagtagagacggggtttccccatgttggccaggctggtctcaaactcctgacctcaggtgatccacctgcgtcggcctgccaaagtgctgggattgcaggcgtgagcctccatgccctgcctattatttcttttattgaataaaatctcaaatggtttccccagatcttgtccatgtgaaattaattattgataaagaaaatattgcttgattaggaggaaaataggaataaatacaactaaactgtaactcagctttgctacctagtgtataaataaggattatacattggcttccttttcttttttatttgaaagacgaattcttaaaaattggagtacatttcaaagtactagaaaattgataaatattaaggatatcttttggccgggtgcggtggctcacacctgtaatcccagcactttgggagactgaggcgggaggatcgtgaggtcaagagattgagaccagcctggtcaaaatggtgaaaccccgtctctactaagaatacaaaaactagccgggcgtggtggcgtgtgcctgtaatcccagctatttgggaggctgaggcaggagaatcgcttgaatccaggaggcaggggttgcagtgagccgagatcgtgccactgcactctagcctgggatacagagcgagactctgtctcaaaaaaaaaaattaaggatagtttctgatgtttatgaatgtattgatctagatccagatatattcctttttaaaaaaaatattttaatgtaggaaatttatgtacacccaaaggtgaagagaatattgtaatgagctcccatgtgaccatcatttagcttcaagaattattaacatttggtgatctattcctttcattaatttatttccctacccactagaataatgtaaagcaaattccagctagagagacatgtttctaattcagaatagcttcacttctgggaatgtaggtagacatgctcaccgatgcatggtccagctcatttttactcaattatgtaatatgtgttccttagtcatgaaacaggcatggggaaaaataaaatcatttataatcctaccaaaattaatgactaaatagtaaatcataatataattaactgtgctttaattacttgacattttatctttttttataactctgatgatgtcactaatttggaagtaatgatccttaccacttaagtaactgtggctttctgtttttttatatagtgaatgaatttcctgtccttaaagctgacggtatcaaatatattatgatttttagaaatcaagtaagtagctttttatttgttacacgccacttaatctctttaagagttttattatgtaccaccttctcatctactgtgcagtcattttatatccacatctaacaaaattaacaatgatttctttataacttagaattttagaccatgcttaattttcctcagatgtctttttgcaataatagtaatagaattgggatctagataatgtccacacattgcttacagttgattgtgtcttaagtctcttaatttacaatagagaggtccttctctgccactttttgtttgagatggagtctcattctgtcacccaagctggagtgcagtggcaccatcttggctcactgcaacctctacctcctgggttcacgtgattctcctgtctcagcctcccaaatagctaggattacaggcacctgccaccacacctagctaattttttgtattttcagtagatccggggtttccccatgttgaccaggctggtctcaaactcctgacctcaggtgatctgttcacctcggcctcccaaagtgctgggactacaggtgtgagccactgcacccaactgccttcctttccttttatttatttatttaaaaaaaatttttttttatttttttgagacggatctcactctgtcacccaggctggaatgcagtggcctgatctcagatcactgtaacctctgccttccgggttcaagtgattctcctgcctcggcctccctagtagctgggattacaggcatctgccaccacgcctggctgattttttgtatttttagtagtgatggggtttccccatgttggccaagctggtctcaaactcctgacctcaggtgatccaccagccttggcctcccaaagtgctgggattacagctgtgagccactgcacctggcctctaccctttcttatgcttgttgttggagaaaacactcatttatcttagagactttctcacattttacttttggctgattgcaccttgaatctctcagtattcaaggggtattggttccaggacgcctgaatatcccaaaattgatgaatacttaggtcccacatttgggcctgcggaatcctcatatatgaaaagccagccttccacatacagattttacatcccaggaatactgtgttttctatttgcatttggtctaaaacaaatccagccaggcatggtggcttgtgcctgtaatcccaacactttgagaggctgaggcaggcagatcatttgaggtcaggagttcaagaccaccttggccaacatgacgaaaccccatctctactaaaaatactagctgggtgtggtggcacatgcctataatcccatctactcgggaggctgagacatgagaatcacttgaacccaggaggcgaaggttgcagtgagccaagatcatgccattgcactccagcctggacaacagagcaagactcaaacccgtgttgttcaagggtctcctgaagtttatgttgtccctctagtccccatatttctatattggtaaatctgggggcttgattagacttagattccttggtcgggggtgacacaagaaagcatcataggtatactttctgtttcattttatcaggatatacacaatatctggttgttttgtttttttttattttttttgtttttttttttttgctcactgcaagctcagcctcctgggttcacgccattctcctgcctcagcgtcccaagtagctgggactacaggcgtcaggcaccatgcctggccctggttatcaatttttaatgatgttaagacagatcagtggattcagatgaaggagaacgttacattgtcaacattttttaaatagcattttaaaaattgagatatactttattcttttttttggagacggagtttcgctctcgttgcccaggcaatggaacgatctcggctcaccgcaacatgcgtctcccgagttcaagcgattttcttgcctcagcctcctgagtagctgggattacaagcatccaccaccacgcctggctaattttgtatttttagtagagacggggtttctccatgttggtcaggctggtctcgaaccccctacctcaggcgatccgcctgcctcggcctcccaaaatgctaggattacaggcatgagccaccgcgcccggccttattcatttatttttgagacaaagtcttacagtctgttggccagtctagagtgaactactacaatcatagctcaatgcagccttaaacttgtaggctcaagtgacccttttgcctaagcctccctgagtagccaagactataggtgtgtgccacaccacctggctaattttttatactttttacttagtttattgtttctttctttctccttcttttttttttttgagaggtagttttgctctgttgcccaggctggagtacagtggtgtgatctcggctcactgcagcctccacctcccaggttcaagtgattctcttgcctcagcctcctgagtagctgggattacacgtgcctgccaccatacccagctaatttttgtcttgttagaagagacagggtttcaccatgttggccagactggtctcaaactcctgacctcaggtgatccacccctgcctcggtctccgaaagtgctgggattataggcgtgagctaccacgcccggcccatttctttattttttgaaacagggtctcgttctgtcgcccaggctggagtgcagtgacatgaccacagctcactgcagccttgaactcctgggctcaagcagtcctcccactttcagcctcccgagtagctggaacccaggcacgtgccaccacacccagccatattgcattacttttaaaaaatcaattgagaaaaattatagagaatacctgcttccccagttagagtatgttggaattttgccaatcttaaatggtatctcattgcagttttaatttacgtttgttttattttgagttcagttaagcatctttccacttgaagggtccattttcatttcttttcggtgaactgtgaattcatcttcttttgcccatttttctatctgattattggtcttaatttttagagaacgtgtagtttttcttctgattctgaatgcctaggtcactttaattgtactgagaaaaaaatcaaaacttgcactcatcttatttctttgatgtctttgcccagtaacaatggtgccatcttgcaaaatattttaaacacacaagcaggaataaaacaatatgatgattactgaaataatcctcacaaatcttaaaactccaggccatatttatgtatacatacatatacaatggaggtattccaggtgctccctgcccagtcagtccctttctctctataggtaattactgtagtgaattcggtgtatttgacacccatggaagtgcttttcttacgctttcactacgcatttatgtttctgcaaaaattatttagtattatgtaggttttaattttttttttttagatggagtcttgctctgttgcccaggttcaagccatgctttttttatactttcactatgtgtttatgtttctgcagaaattatttagtatgctgtaggttttaatttttttttagatggagtcttgctctgttacccaggttcaagccattctcctgcctcagcctcccaagtagctgggactgcaggtgcccaccaccacgcccagcaattttttggtagagacagggttttgccatcttggccaggctggtcttgaactcctgacctcaggtgatccacccgccttggcctcccaaagtgctgggattacagtcgtgattcaccacgcctggcctaggttttaaatttttgtttgtataaatgacatcatactatgggtttcatttttctgttttttgttacttgtttgttttgagacggagtcttcgctctgtcgctcagtgcagtaacacaatcaagtcatgcagtggcacgatcttggctcactgcaagcttcacctcctgggttcatgccattctcctgcctcagcctcgcgatagctgggactacaggctaccgccaccatgcccggctaattttttttgtattttttagtagagacggggtttcactgtgttagccaggatggtctcgatctcctgacgttgtgatccgcccgccttggcctcccaaagtgctgggattacaggcatgagccaccgtgcctggccttttctgttttattttgagaatgaggtcttgctctgttgcccaggctggagtgcagtggtgcgatcatagcttacttcagccaggaaattctggactcaagcgatcctcctgccttagcctccctagttgatgggattacgggcatgctccaccgtacccacctacatcatgactgtttgtccttaacatctttttttttttcttttttcttttttttttctgagatggagtcttgctctgttgcccacgctggagtgcagtggtgcagtctcagctcactgcaacctccgcctcctgggttgaagccattcttctgcctcagcctcccgagtagctgggactacaggcgcatgccaccacgtctggctaattttttgtatttttagtagaggtttcaccatgttagccaggatggtcttgatctcatgacctcgtgatctacccacctcggcctcccaaagtgctgggattacaggcgtgagccgccactgcgcccggcctaacatcatttttgagttattcatttagtgcctaaagcgatccagctacctcagcctctcaagttgctgggactacaggaattcactaccatgcccagctaattttttatttaattttttcttaatagagatgaggtctcactatgttgcccaggctggtcttgagctcctgggcttaagcaattgttctaccttggcttcctgaagtattgggattatagacaggaatgaaccaccacacccaggaggcttttctagtttagactaatgaatgtttcaaatttagaggtttttaatgaagattgttctcgtatttgttgctttttgggggtgggaagagaacaaaaaatgagacacaaaaaggttaaataactttttcaagaaatatctgctagtgatgattcttaagtttggtgaaatcttagtctccttctctgtgatattattattttatggtatgttgatttatctgcaagatgttatcctcatagttttgtgctctgaaaaggagaatttagaaagtggaaattgaaccattatgtgcaagtgaaagttttggtttctgggcagcagcatctcctattataacagagcttaaaaatagcaaattgttctttaaatcaacaggtccttctcttccaattgtcttttactcaaatatggaatcattgcatttagagcatgtatattattgtgttttttaggtgccaaaagaacatcttttagtctcgattcctctcttgattaatcatcttcaagctgaaagtattgttgttcatacttacgcagctcatgctcttgaacggctctttactatgcgagggcctaacaatgccactctgtgagtattttattctaaagttttttagcctggggtaggggctgtactgtgctggtcaaagatatctgaatgttttcataatttcactagtgggaaaacaaatgtctgctttctattcctttatactctgtttcattctaaaagcatttgaggctgcttactaaaataggtgcattatgacaatacaatttaataaactggagccaaggaaagtaactgagataaagttaataaacagaaatgtgtgtcaaaggatcctatatagtagtccaagaaactccaaattttatttggagtctcttagcagccagggcaaagagggaaacttgggaagttaaaattttcacagggtctatgagataaaagttaaagcagagaatactgtacaatagtagtagtagtgttctcagcaacaatcatgtaacagttattttcatgtggctatttgcgtaaggtcacttatttctgagatatgacctaaccgaatgaaagtaattcactggggaccaagaaaataggtcttctggcctgaaccaggatgaaatgtagaggaatggatggtctgcatgtctttcaggccactattcaacagtattatttcttgaaatgagctttgggtaagagatggaaaacagttctaggttctttccttcatcaagaacttgaagtacagatactctcagtggccaattaagggtagaaaggacatcctttgaggtgagtcaagccagtacctatcttcaggcccagaatttatgcagaaaacagttctgaatcttggctccacctccaaaaacaaaataaatgacagagtcccctgagattctgagttctttctcagtggtaatagatataaaccagggacaactgtttcaacttcagatgttgttgggtttagctggctttttggttcagttgtgtttggttctcgatgtgccttcttaggagcctaacatgagcacatgtaaaaaaattattttcctaaactgtctatcaattgtcagtggtgggagatggctcagttttatgctgagaagggtgacatagtggttgccaagggtaatctgcagtgacaagctcaagagttggtagtgactgaaagctgttttttcatctatagctttacagctgcagaaatcgcaccgtttgttgagattctgctaacaaaccttttcaaagctctcacacttcctggctcttcagaaaatgaatatattatgaaaggtaggctgtttccctggtgtgcagactacaggtatccaatctcagattgtaagggtgagcactctgagttatacttcaggttatacagtctatgaaccagataatgtttaccaagtagtaagttagtttagatatttcaaaatgaaaaacattatcttgtttactactaacaataatttttttttttttttttttttttttttgagatggagccttgctctgttgcccaggctgaagtgcagtggcttgatctcagctcactgccacctctccctcctgggttcaagcgattctcctgcctcagcctcccgagtaactgggattacaggtgcactccaccatgcccggttaatttttgtatttttagtagagacagggttttgccatattggccaggctggtctcaaactcctgacctcaaatatctgcccgcctcagcctcccaaagtgctgggattagaggccactgcacctggccaacagtaatcttaatttgatatggaacttctcattacagaaaatgtagcaaagcccttttttccttccctagattgagtttctttaaggcaaagaagagatcatgcaacgtttattaactgcatgctcacctaggtaggggtgaaatgtgggtgcctgtggtagactctgcacaaatcgtgtcttcttacgtactgccaaggacacaggcagctgtatccatccacaggctggtgtatccatccaccaggcactacattagttgagtgtcctggtgccagctctgaatttagagatagtctcagtgtttttcactgttgcatcccaaaagcctagcacattgggttgtaggaagcacttttcagagaaactccctgatcttttcagtctggatcagaaatcctagagtggatgtgtgtatctgggtgtatgtttccaacactatccttcccccaacaatgatgtataattgtgtaattattgttgtttaatgtcctttttttttttttttttttttttgagatggagtttcactcttgttgcccaggctggagtgcaatggcacaatctcagctcactgcagcctcactctcctgggttcaagcgattcgcctgcctcagcctcccgagtagctaggattacaggcgtgtgctaccatgcccagctaattttgtatttttagtagagacagggtttctgcatgttggtcaggctggtcttgaactcccgacctcaggtgatccacccgcctcagcctcccaaagtgctgggattacaggtgtgagccactgcgcccagccttaatgtccatttctatgagagcggctaactagtctgtaatcttcattactgtgtttttagggtatgtaagaatacacagtatgtaataccttctctgtacggttgtatgagtgaatgaaataattctgcgccagcctagtggaggagcaccaatttatcctctagcccttttaacccaggtcagggaaggattttctctaggaagtgatctctaagctgagatatgacctaaccgaacgttaggtgtgagggataggtagcaatctgttgaagggtggatgagtctttgactccagtagaggaggaaacatgatgtgcagagttcaggaggcaagagcagatagctttctgtcctttatgcttggcatgtatttggggctctgcttagtaaacatttattttagaaatgttatttgtggaaagagagcttttatacatttttagctgacaaatttatttttctcccatgcttcctatttttaacccatttatggtcttttgagcaatatttttgcaatttggactctgtggctttacatgtatttttagaatttttttaggctcctaatctctttttttgagggaggtggataggcagttttctcttcagtttcctgtagtttgtgatcatgtttcctttaggctagggctaaacattttctgatgctggtttctttttctttttcttttttttttttttttttgagagagagagggagtctcgctctgtctcccaggctggagtgcagtggcatgatcttggctcactgcaacctccacttcccaggttcaagcgattctcaagcctcagcctcccgagtagctgggactacagacgtgcaccacatacctggctaattttgctatttttaatggagatgggttttgccatgttagccaggttggtctcagactctagcctcaagtgatccgccagcctcggcctcccaaagtgctggggttacaggtgtgagccaccaagcatggcctctgctactgatttctaagagaaagagaccccaaacagttctctctcagactcacctgctccattcatgtcagctcactgtttcttcctcttagtcaacctctttaattattttttaaaccttgagccttctagaaatactcagtatttcccagctaaattttgttgccaacccgtcctaattttaaaaggaagggaaatttagattatttttaaatgtagagagctatctcggggttgtctaagcatcttaaaatttagttgatgaattagtgcgcttttttccccccagtcgctctcttattctgaagtttaactaaactctatttgtttttgctgtttttgtattttacagctatcatgagaagtttttctctcctacaagaagccataatcccctacatccctactctcatcactcagcttacacagaagctattagctgttagtaaggtaatagagccaattttgaaagtggggttccttttttatttgctccaaactgtttgggcctcagaactctttggcattacgtgaagctttagagaaggtctgtgaattcttcctgaccagccactaatggacttttctgaaagtgtgggcatgctgttagattggagacgtaatagcagtcacctttaagtgtgtgctagaagcttgaatacattttcattctcattacaaaagtaacatgtttattgtagaaaaagaaagtgcagatgatccaaaattaccttaaatggagttaagtaggctttgcactaaatggatataaaagaggctgtctggacttctatgaaatgatgattaaaatcctttgtgttgtcttttcttccttactcttatttctcaaaaggaaagttcactctgatcaaaattttacagatacttagattcatgtttattaacactaaattttagaaaataaatccgtttaaggctgacagaattcctttttagatgctattcttgatcttatgagaattagatcaattcataggaagtgttggagggattttggagaacagagtgattattattcaactgagttagggctaagggtctttggactacttagggccttgagggatggagcggggagggaacccaagtctccgcctcccatatgtattaccatctcatgttctgattgagttagatttgtatgctagtagccttccaagaacttgtttaaagaaaaatggggttttgttgcttaaaaagaacataaaaaactactcatttgggggattatcagtaagtagacatagacattgaggcccacagaagttaaggctagtggcattactaggacttagtatttcttctctgcgagggcacgtgggcttaagacaagttacagctctgggatctgaggtttgtataagcaactctgtaactctgaagtatttttttcatggtggactttgggccatttaaaaaaaaattcaaatgaacaagcactagggtataattggtgtttttttcttaattttgatttttaaaaaataagatggcctctattttaaatgtgttttataaaggttaggtgtggattattagcataattaggttttttttttttaatttcagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaaggtaagttaacggaaattattttctttgtaatggaataaaattaacatggctataaaatgcagcccacctaagcgatgtgggccttttgtgtcagtcattccttctgaagctcacagctctgtttttacttttatcaacagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattgtgcgtcaggttttgatataactgtaattttataaagtagcttggagaaactggggatggcagatgtttgaaatttttttatttaaaataaatttaaggctgggggcagtggctcaagcccaccactttgggagcctctagtgggaggatcccttgagccgaggagtttaagaccagcctaggcaacgtggtgagatctatctctacaaaggaaaaaaaagctttttaattagttggacacagtggagcatgcctgtggtcccatctacttgggaggctaaggtgagagggtcgcttgagcccaggagtttaaggctgcagtgagccatgatctcaccattgcactccatcctgggcaacagagctagaccctgtctcttaaaaaaaataataataataataacggaaataattagtagaaaatgttatggtatgttttatcagaattctgtatcctttagttatttatatccatgatggaaaattttaaaaacagagccaaacaggttgattttaagaacttaactttggtcgggcgtggtggctcacacctgtaatctcagcactttgggaggccgaggtgggcagatcacctgaggtcaggagttcaagaccagcctggccaacatggcgaaaccccgtctctactaaaaataaaaattaggtgggtgtggtggcacgtgcctgtaatcccagctactcagaaggctgaggcaggagaatcgcttgaacctgggaagcagaggttgcagtgagccaagatcgccccattgcactctagcctgggcaacaagagtgaaactccgtctcaaagaaaaaaaaaattactttaatggctacgcgggaggaattgttccccatatgtttcagaaataattaaagagaaaaggatagattattacagtatgaactctgttttaagacatatatcatgtttaacttttcgaataattattcctgttaaccattttctgttggatctcatttcttaacagcctgggttactaggtgtctttcagaagctgattgcatccaaagcaaatgaccaccaaggtttttatcttctaaacagtataatagagcacatgcctccgtgagtatgactagaactttgtgcatttatttagaaattttgttaggtgctcagaaaagtcctaaatttatattgttgattttttttaattctttagtgaatcagttgaccaatataggaaacaaatcttcattctgctattccagagacttcagaattccaaaacaaccaagtttatcaagagtaagtaaaatcatctggatgttctacagaagtaatgaaagaaggtagctaaaacccttagactttatggttgcagatacattttttatccgttttaaactttatgcaaaaaatacttggccacgtgtggaggttcatgcctgtaatcgcagcactttgggtggccaagggaggccgatcgcttgagctcaggagttcaagaccagcctgggcaacatggcgaaaccctgtccctacgaaaagtacaacaaaattagccaggcatggtggcatgtgcctgtagtcgcagctgcttgggaggctgaagtaggagcatcacctaagtcccagaggttgaggctgcagtgagccaagattacacccactgcactccatcctaggtgacagagtgagaccctgtctcaaaaaaaaaaaagaaaatattgtaagggcctggtgcagtggctctcatctgtaatcccagcactttgggaggtgaaagtgggagtattccttgagtccaggagttaacgaccagcctgggcaacatggtaagaccctgtctctacaaaacagccaagcatggtggtgtgtgcctgtagccccagctactcaggaggctgaggtgggaggatcacttgaccctgggaagttaaggctgcgtgagctgtgatcacgctcctgcacccagcctaggtgatagagtgaaaccttctcacaagaaaaaagaaaatattttaagatgtttgtgttctccaaacattaagttagtgttagtcatattgtgttccagaggttggtttatggttggataccaaaacattttttcagtagagagaatattataaggaaatataaatcaaagagagacagcatgtaaaggtctatgacagaaagacaagttttctatttactagaaggcaggtattgatgccacagcctttggatgttaatgattaagcataggtttattttgcagacttatcagttaccagtttagtgcgtgagttctctatgctgatattctgcatcttctttcaacaggttttttagtctttattaatttgtattgcataaaatatggggcactagcactacaagaaatatttgatggtatacaaccaaagtaagtttgtttttattattttttaaaggaagaaaatgttttgactttttttttagtacaaatcagtatctctgtcttatagatgatgatgtggttcttggtatggagatagtgtctatggttttcaaaatattcttaggtattgggagtaaagaaaaagtaatcctggcccagcatggtggctcacgcccgtaatcccacactctgagaggctgaggagggcggatttagctcaggagtttgagaccagcctgggcaatatagtgagactccatctcaaaaaaagaaaaaacaccctggaatcattgttctaatcctctagattagaggaccatctactctacacactggcattctccacagccagtgttctatattatgttaaatggtcagtgttgtctccaggagcctgccttattaaaactaacagcagaaaacaccacatgttctcactcataggtgggaattgaacaatgagaacacttggacacagggcggggaacatcacactctggggcctgtcgtgggatggggggcaggggaagggagggcagagggagggatagcattagcagaaatacctaatgtaaatgacgagttaatgggtgcagtaaaccaacttggcacatgtatacatatgtaacaaacctgcacgttgtgcacatgtaccctagaacttaaagtataattaaaaaaaaaaaccagaattttccttcccccttttttaaaaaatcgtgctaatccatatcgttccaattttagtatatgtgctgctaatgcaaacacagcagaatttttcaaatgagaaatacttaggaccaataaattaactttgtttttgacttatctggtatatatgcaaagaatgtatttaggtggcatttcccattagtagggaataaaacaattataacgataagataaagaacaactcttagggaaaatttcttcggggacagttagatccctgtacctcagttatgtctcaaaaattctacattgactaaaaaatgaattactctggaaaggagaccagaaaacatggcttccggcagtaggggattttgaggaaatctcatgcactgctagtgggagcctgaattagcctgatctttctagagagcaaaatgtatgcactttttatccagagcattagaattgccataccctttgagccatatttccacttcaaagaattggttctattaacgcataaactgaggattttgcatcatttagaattacggaaaacttcacttctagcatgtttgcaacaacatagaatgattggccgaattattttaaatagccattagcatttatgtacctgcaggtatgtaagcaaagacagttgggaagcttataacccaaaaatgttaaaactagttgtttctgggtggtgggatgattccttttttccctccttgctcctctctcttttttttttttttttcttttttttttttgagactggccaggtgtaatttttaaagaaaaaagcagagagggccaggaatggtggctcacgcctgtaatcctagcactttgggaggctgaggcaggtggatcacctgaggtcaggagttcgagatcagcctggccaacacaatgaaaccccatctctactaaaaatacaaaaatttgccgggcgtggtggtgggcacctgtaatcccacctactcagggggctgaggcaggcaaattgcttgaacccaggaggtggaggttgtagtgagctgagatcacaccgttccactccagcctgggcaacaagagcgaaactccgtctcaaaaaaaaaaagaaaagaaaaagattatggcatttggctacagggtagaggtgtgatggggtttttttatgttttgactttcagtctcttcagatgatcaaaaacagcagtcttgttatttagtaatttatcatattcataagaagtaactaacatctaagcattttactatttcattatagtgataatctaatattaagttgatttattttgctttaatagaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggtaagtacttcattttaatatttttgtaagttacagcttccttcccatatgactgcaaaattaacaaagcttattctcttgggggccaagagaatcttggtctgatctcagcttctccacaatcagatccaagacatgatttctggatccttctgggcttagaatgatcttgtttcctgcttctttttcagggggattcatggacccctttaagagtctgatctaggtgatctctaagacaattttatgacagaagcccaactaaactgacttatctttaaggggaagaactgaataagccaagaaaagaaccatcttaatttcaaaggtccccttttattcttgagactatgagtctgtaattttgtgtctctgagcaattgctggttttaagtcttccgagtattttcttgacctttttatctcttgctttcttccaatccaggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggtaagtgtgttgtcaaagaactctgtgataaatggagactttaatgggagggcaaaaggatagtagtagttctggtgtctgttttcattggtgggcgtaataaaactaaatctcattgagttacagcaagcttattttctttaattaaaaacactgagccctttttttcttgtattatgtactacaaatatattttaagtgaatggatttaggagtgagaacaaaggaggaaaaatcccttcaatagaaatgtaataaggctgtatagttgcattttgtcagcactttataataagagtttatttcccagatcgaagtaatccatctattattaaaatgtggtagcatttttttatttttatttttatttatttatttttttagacagggtctcactcttatccaggctggaatgcagtagtacgattatggctcactgcagcctcaacctcccaggttcaagtgatcctactgcctgtcagccttccaagtagctaggacccactatgcccagctaattttttatttttttgtggagacagggtctccctatgttgttcaggttggtctcaacctcctgggctcaagccatcctcctccctcagcctcccaaagtgctgggattacaagtgtgagcctggacacagttatttttttttaattgcagcatactcagaaattaatagatcatggcataaacctaataatgactgtatagttgcattttgtcagcacttattatagagttcttacatgttacctgataaaatatatatttttcaagccagacacagtggtttatgcctgtagttctagtgctttgggaggccagggctgcagtgagctattacagtgccactgcaatccagcctgggcaacagagcgaggtcccgtttcttaaaaaacatatatgtgtgtggcgtgtgtatatatatgtatatatattttttcattgtattattacggagactttcaaacatatatagaaagagcataatgaagcctgcatgtgcccagcttcaataattaccaatatcttgccagttttgtttcgtttctccttttattctctgtattgagcaagtcttagacatcatacgtttcacgcgtaagtaccttattctacatcattaaccagtaaggactttttaattaaccacaataccactatcacacctaataatagtaattccttatggatcttttctttagacctatttttgaaggcataaaagcagttgagtttctggagaatttttggatggtgattaatgacttgactggctgctcttcccagagctgtggcagctctcccgtagaagatggggtttgtattggcgcaccaagatctccaacagccagtgtgtgtttcccatctcttgtaggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaagaacatcttaagggcaggttttcagtgctctctcatgcttttataaaaatgaagaatttctttaaatttcttccttttcctttcctggactctgtaaaatcctaatttctaaatcatgtaaactcagattatttagtctttttttttatatgggggaaggggacattaatatagatttggggcttatttactagaattttctgtagcagttcctaggtggcagtgtgagttttgggtaggtggctcctctgggagaaatgctctgcctcgcttaatgggatggcggtcgagagtacttgagactgtggatgttttgatctctttcatctctgctgttccctggagagtggaggttacttggaacttttcaaaccctgacaccttagaaccgtgaagtccagtccagtggtggatccggccggatgcctggtgagcttggttgcactggctccctcccttggcctggcccatggaattgtacagcattcgtttctgaggaatgaagaatcagaatatctaaattttgtgaggcacagtttatgctggaattgttcattgtccattcagtgtagttaaactggaacttttgtcttcccagctcaagtgatttgtcacaggagttatcgatatcccttttttttttcttttttacccccaagataagagtcttgttctgttgaccaggctggagtgcagtggcacaatctcagttcactgcaacctccacttcctgggtttgagcaattctcctgcctcagcctctcgagtagctgggattacaggcgtccgccaccacgcccagctaatttttgtatttttattagagatggggtttcaccatatttgtcaggctggtctcgaactcctgacctcatgatctgcctgcctcggcctcccaaagtgctgggattacacgcgtgagccactgtgcctggtgataacttttttaatcttaggcacttgactcgaatggtttttcttattttgaatttttttttttttttttttttttttttttgagacggagtctcactcttgcccaggctggagtgcagtggcacaatctcagctgactgcaacctccgcctcccaggttcaagcgattctcctgcctcagcctcctgagtagctgggatacaggcatgcatcaccatgcctggctattttttgtatttttagtagagacagggtttcaccatgttggccaggctggtttcaaactcctgaccttgtgatccgcctgcctcggcttaccaaagtgctgggattagaggcttgagccactgtgcccagccacttgtttctgtaatgttgcatgagaaatttcaagttctcttaagtctatttgtaccatctagtcatttaagggctttttgttgttgttgttgttgttgttgttgttgttgttgttgttggttttgacacagtaatgggaatactacattttacgttattactttggcttaagtggtcgttggtagaaagatactgaaatattactgaagccatttttaagccacaatttatttggaaagtctgggacaacagggaattgctagtgatggtttctgtatgtttttcactcacatgagctccttaagtatttatttggctttgctcttcctgaagctgcttgtgaacagtcagtcagataccgttctggaggctgcttgattcaacatcttaaactcagatcgagttcgaaacgttttccttcttcagttcaaaaggctgagtagtagatggtgtgccttttaaaatagttactgaacagcaagactagtacatttacttactttagcacagttcattaattatcaaataatttttttaaatgccttctattgaagttgcttattcaatcgtccaagacagtttttatatctggctttaaagattttaggacatggtggacagaaactgctggagtggtttttttcttttttcttcacaagccttactgactgtagctcagtggtgatgcacactgtgggtatgaagatcagggtttgagttacagcactgctactgactatgaccttgagcaaatgagttgacctctatgccttttttttctcttctgaaaaatgagcatattatttaccttcaaggtggttgtaagaataaaatgagatgatgcatgtagagtactcaagcagagaacctgtgcagagtaagcacacatcaggaaaagctgctgggggagcagagggcttgggtgggaggaagcgtttgttactgagcacacttaccaatgtgctgcatacctggaaggcgggaaggctttgtggagaagagtcctggcatgggcggccccacctgtaccccagggtgtttttacagaagggaagtattgccaggtttctcatcagagcttcctgctaggtgcattcattctccatggtattcaatcatgtcttttaacaagctgatttttaaataattgagtttttaaattatttttatgtatttatttttttgagatggagtcttgctcagcccaggctgaagtgcagaggcgtgatctcggctcactgcaacctccacctcctggtttcaagtgattccccagcctcagcctcccgagtagctggaattacaggcacgcgccaccacgcccagctaacttttgtatttttagtagagacagggtttcaccatgttttgtcaggctggtctcaaactcctgacctcaagtgatccacctgcctcggcctcccaaagtgctgggagtacaggtgtgagccaccacatctggccaccgactttttattttaaatgtattttctttgtgggaaacttggaaaataaagaaaaaatatttaaaaattaaaaataattcatattcctacctacattaagcattttggttcatttgagatcattctgtatatagttttgtaatttttttaaaccatatttacttggtaaacattcagtggatatatgtgatttatcattaggatatatcattaccagattatgtaattgtagtcattgctggatgtcttggaggttttctgattttgtagacaactcttgagatgaacatctttatgcatcaatttttagttcctgaaggtggaattagagccaattttcttgtgcaaagttcatgtcagtttctttaacacacctttacctacactgggcattatttggttgccattttgataagtaaaaatggtacttttccttacttctgaggcataatcagattggcatttaatcaaactattacatacatgtggtagaattcattttttttaaatttaactttgttgttgttgagagggagtcttgctctgccgcccaggctggagtacagtggtgcaatctcagctcactgcaacctctgcctcctggtttcaagcaattctcctgcctcagcctcctgagtagctgggattacaggcaccttccaccatgcttggctaatttttgtatttttagtagagacagtttcaccatgttggccacgttggtatagtggtgagcatagctgctttccaatttactttatttatttatttatttatttatttatttatttatttatttatttgagacggagtctaactctcctacccaggctgtagtgcattggcacgatctcagctcactgcaacctccatctcccaggttcaagcaattctcctgtctcagcctcccaagtagctgggactacaggtgcacaccaccatgccgagctaattttttgtattttttagtagagacgggggtttcaccatgttggccaggctggtctcgaactcctggcctcaagtgaactgcctacctgggtctcacaaagtgctgggattactggcttgagctaccacacatggcctcaactcttcattattaaattggttttgtgttaggtgattttgcccagctgtaggtgaatgtaagcgttctgagcatgtttgaagtaggctagactgagctaggatggtgggtcggttaagtgtattaaaatgcattttaacttatgatattttcagtttatggtgagtttatcaggatgtgaccccatcgtaagttgaggagcatctgtaatagcattttgttttttaaaaatatttaatcatctttgtcaatgtctcttgaatcctcagcgttgacaacgaagatgtgtccctaccctctgcctctcaggcttgctaattgctgggttctgctttcactttcacattgttgaaggagatatttccagttgttttctgtgcattatctgtagttcccttttaaaaggtgaagctgataaacacttgttatgacagtgtgaactgggcttaatgctgtgtcaagcagtgtgcaaagattacatttccctctcctcatgtcttgacttctgcatccctcaagagagaatgaatgttcgtaaggttaaggtcaaatggaatggagtttgctcctcatatttcatcagttgctcaaaggtactccccattttagcttgtgttctgtttggatcctgactttctcatggtggtttttctggacttttattagctttctttttcatcctgggtattacatggcgtgccttccactctgcccctggatttctttttacagccctggctcttgtgggccacaacagttcttgaggtaggctgctagggttccccattggagcctctccattccagtgttccagggggcagatgagctcctatccccactggcctgtcttgctggtgttcagggccctggcttccactttgcgaggtcacctttcaggattcatgtgtatccactttgctgtgtcagaaactccctactgctgacctccctctcctctttgctgtcattaatggattctcattgtgggagataaacgtgtgctcagcctagaataccacatgattttttttttcttgattcattgcttttgcctgttagccttgttgttctaaagtagttcatttttctactctacttttcctttcccctcaatgacccccaccccaaaactgtgcctaaatactattcatgcagtctttgagaatcaaacaggttcacactcttattcctgagtacagaaacttaccgaatcacacagctggataaagccgggattgaaaccctggcagtctggtttccagagcattctggcttagccacttatgccatggtttggcaaaagttagaaacagctaatcagctaataagggcatgatcacaaggcattttgctaataagtttttaaaatatacactatgggtgttttttggttgtgacaattcttgggtccctattcataggagcatcccccgcaccaatccctaggcacaatcctgtatccagcctgctggacatgaccgtttattccatttcgtaaaccctaagcatttgctctgcaaacctcctcctgcttggtccttgctcttactccttgtctgagaaacatggtggctgagctttgtgactgcaaggcagggctcatccttagggtctaccctgaggtattcttagtaggactgctctttgatagggcaaaggagtttcatggaccctttgaaaataatttagaggcattttcctttggtttctctgaatgagctaagaacccctgataataaggaactgctgtgggctgatggtcagttcctccagcccctccattctaggaaggtgtctggtaaagcagctcactgtgtggttggggaagggagacaaactatgaagttgtgccgatttctgggttttttcccttacacatgggatggtgtgagataaaaatctggcaacatagacgcagtgttcatgtcaagaaagagccacaataggtaagtcccaagactgttttctcagacctcatggaaaaggagacctcttggagaagtgagaagcaaaacgagaacaggtttattcaccttggactggaaagataacgccttgtaagcagttagaggcaacgcttttggatccagaggggaaaaggatcgctgctcccagcaacctgtgcttctgcagcaaatagcagagaagacagatcccgagtccctcttaagtgggtccagcagggcacggggaggagaagcttggcactcgccaggtcctccccatccaagacagaggaagtcttggtgtcctggaaaggccaggcaacccctgccacaggtttgatgtccaggtggaggcagccccacacaaagagcctcctctgccatgtttatcgatctcaggcgggaaccagggaagacgtctctaaagtggtgcctgcacagcatcctggccagtcaggaggaagcagcaacctaagccaactgccacaggttggcccttccaaaccccagccatgggaacacctggccctccccactgtgcttaggaactgagtgcttaggaaactaaaggatggatttggccacgggatgggccagaggtgctccagagccagctgaggcacatcaggccaaagtcaccctgcacttcccctgaggcagcagttcccaccaggattcacaagatttggagtgctgtcagaggaaccgcagtcatttatggctgtatattttgtactagaaaaaagtcactaggaattcatgggtgatattgcttaggacagtggttcttaaagtaccgtcaacatcacttagcacctaagtgcttagtagaaactacttcatcaaaaactctgggaatgagacccagcaaccttttaacaacccatccaggtgatgggatgcatgttcaatttggtgagccatgacttaggataaagctaagtaaaagtaagtaagacatagacggtagcaaaaattgtgaagatcaggtttgagaacagtggtctaaagcttcatgaccacaaaaattggaagggaccacattttaaagatgtgaaattaacagctttacttttgtgcaagaggtggcagaaaaaagatgagctgtggtaattagggcccatggggctgagcatcatcaccccgggagctatgggcctcgctgggccaaaaataatgtggcccctgggctgcagaagttctgagcatttccagttttcttagctgaagtttgattcagccttgaacggtgtttacattgtacttgttcataaatccaaggaaccaggaaagaaacttactaagactcagaattttcaggcacacattacaaagttgccagcacattttcagccacccaccaggtgcacatacactctgcgtacagaacagacaccagtcagaggtttgcacagcaaaagggccaagcgacttccaaactacagagaatctcaggccatctgccttgggaggtcttttggcagccataacaaatagactcaaaaaggcaactactacaaagaacagagtctgaagaagtgacgcacaggatgctgacagacccttagtagagatccttattccaaaggggcatcagctgcctgctaatccatccagggtcaggaggagattcctagtgaggccgctactgcagtctaaggagtgggaacaatcactagccagactggagcagcccagctctgaagaggaggggctgtcacctgatcctgcctgtgccccatcaagctctggagaccaagcaaaatcaaagctccaggcacacctcaaagctcgcttgacaactgaaagagccattgtgtgtgcactgtaggtaaggtcgtggtagagctgcctgggaaagggtggaagacacactaagatttatgattggatacagggcttgtgggcaacttccaaatttttcataatctacttttaaattaaaaaaccatcttaggccaggcatggtgacccatgcctcccagcactctgggagccaaaagtgggaggattgcttgacctcaagtttgagaccagcctgggtacacagtgagaccacatctctacaaaaaaaatttttgtaattagctgggcataatggcacatacctgtagtcccagctattcagtaggctgaggcaggaagatcagcctgagcctgggaagtcaaggctgcagtcagccatgatcacactggtctgagcctgggtgacagggggaccctgtctccaaaaaaccccaaacaaaaaataattttaaaaattactggctgggcatggtggctcacacctataatcccgcactttgggaggccaaggcaggtgggttacctgaggccaggagttcgagaccagtctggccaacatggtgcaaccctgtctctactaaaaatacaaaatgagcctggtgtgagggcacgcacctgtaatcacagctactcaggatgaggcaagagaatcacttgaacctgggaggtggaggttgtagtgagctgagattgtgccattgcactccagcctgggggacaagactgaaactcggtctcaaaaagcaaaacaaaattgctactatacatagactgctttactgttgtcattgcagacctgatgtttgtaggtttcagtgaatgtaaaagaatgtgtggatgaacggttttgttgttgtttttgagacagagtttcgctcttgtcacccaggctggagtgccatggtgcagtctcggttcgctgcaacctcagcctccccagtagctgggattacaggtgcccaccaccacgcccggctaatttttagtagagacggggttccatcatgttggccaggctggtggtcttgaactcctgactgcagctgagccactttacccggccagatgaatgcattttttaaatattaaacttaggttagaagcacataataaagctgtacacatctcctacagttttcactaatgaaaattgggatgccatttaaattacaaagaagtctgaggagaatgtcctacagactagtttcacatgcacatgctgtccttacatgctttgtatacagacattaaacacatcagtacagtacacaaagtaacaagttccacgaactcagcaccacaggaaaggtttacaaaaaatccaagaagatggctatgctgcccattaacaaactcccacctcctatctttgagttagccattgcttcttaaaacaatgtatctctttaaaagccctatttaagaacattggccaactcctccactcttccctctgctaatcctgctctgattaagtgcttgacaaatccagtatttattgatttggaatttcaagtaagttttttgtttttaagagcacacaggcatttaagcccttaaaccagaagtagtgataaatactgctgctttttattgaggctgagtctccaacacctaggctatagttgcagtagcgtgatctcagctcactgcagccttgacctcgggctcaagtgattcttccacatcagcctcccaagtagctaggactacaagcccatggtaccaccatggtgccatgccgggctagttttctgttttttttttgttttgtagagatgggggtctctatgttgctcaggctggtttcaaactcccgggctcaagcagtccactcaccgtggcttcccaaaaggctgggaatacagggatgagccaccatgcccagccagtggatgcttctgacatgttatgtgcaaacaaagccagacctctcgggcctcaggtttgcttcctgggatgatcctattctactgaactcacactgatccctataaagcaagcagcaacatcacgcttttgggaaaggccaatatgttttcctgtcgatcataccaatcccaggcgccctcctaacaggagggatccagactatggtgtccatcactgagcattcacccaacaaagccacttaaaaaaacagctcagtaaactagattcagaagtgatacttgtttgtaagacctatccacattactctggcttaagaaggcctgaaaacccagaaaaacacccagctatgggtgaaaatacttacaggtgaatgttttagtctaggattagcattaagatacttcaggaaaaaaataatggggaggatgagacaagaacaacaaactcaagacagctatgaggaaataaccattacccgttaagttttccctttaatgaccatgaggacaaagtcatgacaatgcagtcaccacccactttttgaaaaaaaaaaacaatgccaatgtgggaaccgactgagtcccaagcttatctactgtaggatccaagagagagacaatctcagtgttggagaatgcactgagaacatagaggagaaggctacaaagaacactgagtatacaaatgcatacagatagatgtgtatagatatatatacacatagatttcctgtccgctacagaggtctagaaacaataacaccccagtagcagtaagccctcagagcattcagatcttggtttctaaatgctgtcttctagtagagggaaccagggctccttaggaaaatggctgaatcaggctaggcgtggtgggtcacgcctgtaatctcagcactttggggggctgaggcgggcggatcataaggtgagaagttcaagaccagcctggccaatatggtgaaaccccatctctactaaacataaatacaaaaattagccagatgtggtgtgcacacctgtagtcccagctacttgggaggctgaggcaggagaatcgcttgaacccacgaggcggaggttgcagtgagctgagatggtgccactgcactccagcctgggcgacagagtgagactccatctcagaaaaaaaaaaaaaaaaggctgaatcaggactaggggaaggaaaagaacaagatgaaccccaaatatctcaatgtgtcaagttagtcttcaaaaaatgatggggacaaatgacagtttttgtggacatagaaaagcccatcctaaaatttataaggaatcctaagggaccctgaataaccaaaaacaatcttgaaaacttagctgaaggactcataggttaagatttcaaaatttactacagtaatcaaatcagtgtggtaccagcacaacaacagacatataggaggctggttgcggtggttcacgcctgtaatcccagcactttggaggctgaggtgggaggatcacttgagcccaggagttcaagaccagcctgagcaacttggtaaaaccttgtctctacaaaaaaaaaaagaaaaaatcagccaggcatggtgacatggtgacacacgcctatagtcccagctacctggtaggctgtgagccaagactgcaccactgcactccagtctgggcaacagagtaagaccctgtctcaaaaaaaaaaaaaggccaggcgcggtggctcacgcctgtaatcccagcactttgggagaccgaggcgggtggatcatgaggtcaggagatcgagaccatcctggctaacaaggtgaaaccccgtctctactaaaaatacaaaaaattagccgggcgcggtggcgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaatatatatatatatatatacacacacacacacacacacacacacacacacacacacacacacacaccccccccccccccaaaggaagagaatccagaagtccttccatgtaatttttgacaagggtgccaagaccattcaatgggggagggacagtcttttcacaaatactgttgggaaaacagtgtgcacttgccaaggaatgaagctggacccttacctaacaccatacacaaaattagcttaaaatggatgaaagacctaaatctaagactaaaactaaaacatgaggcaaatccgcaaatcttcatgagttggacttagcaatgttttcttaagtatgacaccagaaacaggcaacaaaagaaagtaatagacaaactagacttcatcaaaattaaaaccttttttgcatcaaaagcttttctgcaaaaagcttttgcagaatgaaaaaacaactcacagaatgggaagaaaaaaactgcaagtcacatctgttaagggattaatatccagaatacacacaatactcctaaaattcaacaacaagcaacatgattcaaaaaaaatgggcaagacttggacagacatttatccaaagaagatagacaaatggccaataaatacgaaaagatgttcaacatcgttagggaaatgcaaaccaaaacccccatgagataccacctcatatccactaggacagctactatttaacgaaacaataaacattggcgacaatgtggagaaactggaaccatcatgcactgttggaaagtgatggctgcagtgggaaactggcagttcctcaatatgttaaaaataataggtcagacgcagtggctcacgcctgtaatcccaacactttgggaggccaaggcgggcagatcacttgaggtccggagttcaagaccagcctggccaacatggtaaacccccgtctctactaaaaatacaaaaattagccaggtgtagtggtgggcccccgtaatcccaggtactcgggaggctgaggcaggagaatcacttgaccctgggaggcagaggttgcagtgaaccgagatcgtgccactgactccagcctgggcagcaaagggagactccatctcaaaaaaaaaaaaaattatatgcagcaattccacttctgggtacataccccaaagagttgaaagcagggtctcaaagattttgtataccaatattcacatgtggaagcaacccaagtgcttttttttttttagactgagtctcactctattgcccaagctggagtacagtggcacagtctcagctcactacaacctccacctcctgggttcaagtgattctcctgcctcagcctcccgagtagctgggactacaggtgcgcgccaccatgcccagctaatttgcatatttttagtagctatggggtttcactatgttgaccaggctggtcttgaactcctgatctcagggaatccacctgcctcggcctcccaaagtgctgggattacaggtgtcagtcaccgtgtccaaccccaagtgcctactgacaatgtattgataagcaaaatgtggaatatatacacacaatggaatattactcagccttaacaaaggagggaaattgacatattacaacacggataaaccttaaggacattaggctatgtaagataaaccagccacagaagggcagatactgtccatttataggaggttcctagagtgaaaatcataaacaagtggtggtttccaggggctggaaggagcatgcgaggggagttagtgtttcatgggaacagtttaagttttacaaaatgaaaagttatggagttggattgtggtggctacacattatgaataaactgtacacttaaaagtagttagcagtctgggcaacatagcaagacctcgactgtacaaaaaaaaattagctgggcatggatgtgcacacctgtagtctcagctattcgggaggctgaggtaggaggaaagcccaggagagcaaggttgcagtgagccaggatcacactgctgcactccagcctggatgacagattgggatgctgttttaaaaaaaaaaaaaaaaaagtggttaataggatggtaaattttctatgtgtcttaccacaattttttacaattttaagatggaaacatgccaaaaggacacaagagtcaccttgacaggtcttctgatgtccaaatttgaagtaatttgaacatcaaataaatggttgcaatggattgcgacccagactaggagtccattagctgacacactgcatcaatggggagggaaggcgcctccatgcaggggcagggtgtcggcagaaggaacattggacatggaagctcatggatgggcagtggtggtggattcacatggaagttgtaagtgaaggacaaggatggagggtagaggtctgaagaggaacaggctggtcatgtgctttgaggatgcctccccacaaaatactccttgattaccaagagacatagtgtgacctgactgacagtggagcaatctgcctgggtcaccaaggttaacaaactgtatgcccctggagtgacatacagagaagagcgcagcatttctgtggctttcctgccacaaaagtgctgcctaggtctggtcaccatcatccagacccaggctgagggtgtactacagagaggtctgcgggcttcaccccactaggacgtgaaacacagatgccgagaggactgatgcagacagcaggagaaaactaaaggcaacacacacctcttgacagggaccctggaccaggaaaggacaagacactgttgggacagctggcgagatctgcatggggtccatggactggatgcagtgttcactccctgacttgggggaatatctaaattttgaagagagagggagaccaggggagacaatgtacacataatttcagtaaaatgtaccttttatctgtgaaattattttaaaataaaattttaaaagttaaaggactaggtgcagtgactcacacctgcaatcccagcactttgggaggatgagatgacaggatcacttgaacccagttggactggcctgggcaatgtagtgagaccctctctcttaaaaaaaaaaaaaaatcattagccaggaatggtgtcatgtgcctgtagtcccagctactcaggaaactgaggtgggagaatcacctgagcccagtcaaggctgcagtgagctgtgatcatgccactacactccagtgtgggtgacagagcaggacactgtctttaaaaaaaaaagtagtaaagaaaggctatatactgctgggtgcagtggctcacacctgtaatcccaacactctgggaagtcaaggcaggaggatcgcttgaggccactgcaacccagcctgggtaacagagcaagctactgtctcaaaaaggaaaaaaaaagctatattgtaatgtcttactatgcaaagctactcatgaaaaacttaagccaggcgcagtggctcacacctgtaatcccagcactttgggaggccgaggtggccagatcacttgaggtcagttcgagaccagcctggccaacatggtgaaatcccatctctactaaaaatacaaaaattggccaagcgcactggcacgtgcctatgatcccagctactcaggagggaggctgagacaagagaattgcctgaacccgggaagaggaggttgcagtgattccagattgcaccactgcactccagcctgggtgacagagccagactccatctcaaaaaaataaaaataaaaagaagaaaaacttactactgtttttgaactataattttttattgtaatatttttaacacttaatgcttacttgagtgtattaccaaagttaccccagggcaccccttcttcaatgaagtacccagaatgagttttttttttttttttgagacggagtctcgctctgtcgcccaggctggagtgcagtggcgcgatctctgctcacggcaagctccgcctcccgggttcacaccattctcctgcctcagcctcccgagtagctgggactacaggcacctgccaccatgcccggctaatttttttgtatttttagtagaggtggggtttcaccgtgttagccaggatggtctcgatctcctgacctcatgatccacctgcctcggccccccaaagtgctgggattacaggtgtgagccactgcgcccggcccagaatgaatttttataaatagtcgaagacacaaaagatcacactggtcggcttccagtgttgccgccagcaagtacgctccctgcgaaagtgcatcaagtcagggccccaggctcagcttctctaagaaccttcagtctgggggagggttgtgatgtgagtcacaggtccatgaattctttttttgttgtttttaaagacgtaaagacactttttctcctttcactgcttttctcctcaaaatgttgcatttccttctgcccttagtgttttccataaccttctgatcactttcagttattccggcagtacaatcataggctggctttacagtgaagcctttataatcttcttccacttcttctaaaattaaaaaatgaaaaccaactagcccaaccctcaaccaggctggaacgcatgtcctcctcagtgctcagttatggtgagagatgaggatgccctgggaagtgtccggcagtctcctctcagctccttggggtcatttctttgggtagcaatgtcaggtctggacggggcacaagtccctacatccaggtacccaacatgcctctgaggcagcaacgcttcccagaggggctggccctggtccccccacgacgagcttccatccccttactcacatcttcccttattttagttactgctcaacaggaccaaacacttcattagtagctgtttattgatcaatggtttgatataaagttatttcagatcttcagacttttgcccagatggaatcacaagcattacaaagtttttttcttaaaaataaaaaaaggataggggcaagttgggaggggaccaacctagcagtagtggcatttgagaataaattaacaaaaaaatttagtattaccatttattgatgacaaacacttaagttttacttacattccatggggagaaaaattccagcgtaaacaatgaatggaagcagtacttaactcgcagggctaccaggctttccatacggaccacacgcagagcctcagtgcacacacttctgtgtacagtaacacaacatcaaaagcaacacagctgtatacagaaacgtaggtcattcttttcagccctaatggagatgtaattaacagtatcgagcactctggaaaatcactctgcaggtttatatggactacatggagatcatatcctgtagtgtagtgaaagctaagtcctcaagagccatatgtatagatacacaatgttttttaataatctttaaaacagagatcaaagttcatttaagtcctgtttgcattaacaaaaataaaaatgaaataaaaatggaaccaaatgatcatctaaagtttaaaattcctaaattgtccaatttatacaactgtgggagacttattcaaggtttttgaaagtccaggactgtttcagctgaaccagagggcacacaatttgcatcactgaaactgtcctgggttagtcaatgaaataaaaatgtctaaccacatacacatggatatgatctttgtcggttagattattgataaagtcagtctcagacaagtttccaaactgtgctatttaactagatacaattgagaaattctcaaatgaaaattttatatagtgtcatatcaatcaaaagaaaataatgaaactaagaatacagatcactgttggaagagaaagcagtggtgatggtgtgggtactgcaggaggtggtggggccgtggcacactagaaaagttgggtcacgctgagtaggaagcatttgattttctctggtgcttttagctctggggccggtcaaaggcctctctctggcatggctgtccagggtttgtcccaatgtgtctgagtgagccagcttgagaaggggtcgtgccgtttcttctttcacacaggggaaaaaaaagaccaaacacggaggtgcccagggtgtggatctgctggtgtcccgggagaaccagctggctgggcagcccttcttccccacaggcagctgctattgcgtagggaccgccaggtcaccgagtggccatcacaacaaaccccagcacagtccagcccggccacagccgcctccttgtgtttctgttgtcttccctgctgctgcccacatcctttacccaccgtgtctctcggcccactggaggtatcagaaattccaaattttcaaagcagtttcagtattttcagtatatatgttgggattttataatggttcatggccagaaaaggttcagcacctcccacacctttaaggaagaaaaatgaaaatgacactagttttgaaatgtaagagaattaaagtactgttaaaaatgaaaagaaattggcaaacatcaggaagtacaatactaaaagccccagtttatgataacaaaagttttcccagggtatgccagtaagtaaaatacgcaaggagagtgtgtgtacttatctctgtggggggaaaggaagaaaatgagggaagaaatatatgtctatatttgtataaagaaacatacaggaaagatacaggagaaactagtaaaaatgtgatctatgggggaggcggtggggagaataggagggatgggatgggggctgtccgaggggaagattgtaccttgtaaaataatgcagagttctgaccatgtgaaggtatgaccaactcaaaaaggtttttttgtttttttttgggacggagtcttgctctgtcgcccaggctggagtgcagtggcgctatgtcggctcactgcaacctccgcctcccaggttttaagcagttctctgcctcggcctcccaagtagctgggattacaggtgcctgccaccacacctggctaatttttgtatttttagtagagacagggtttcaccatcttggccaggctggtcttaaacacctgacacctcatgatccacctgccttggccacccaaagtgctgggattacaggtgtgagccgctgttcccagcctcaaaatgtcttttaaaagtagagctttctgcccagagaatctggaaaactttcaggcaaaagggccagaaagtaactcaggcaaatatttccccgctgagtcagcagatagtgtaaactcaacacaaacgaggggcagcctccccatcatcagcgccttccccttcatcagtgcactcacacagacattggtccgtttcctgttcttggcatctctgtactttgttggtccaactcagacagcaactttaagatgttcagcgcagcctagtggggatggaaagaagggtaaagccacagccaccgcttgggaccacagcataatacactggtcaggcaggcaagagagttcctgctgcccagcaaacaggtggcaacttcttcaactctggtactactaaataaaactttgaatttttaatttaaaatacaaattaaaaaatattcagttacctcactgaatcataacctctgaaaatgttatatttttccttctagtatttttaaccatgtggtaaccagactgtataaatgttatatcctgctttctaacaaaaatctatcatgtatttttctttctatagagacagggtctcactaagttgcccaggctggtctcaaactcctaggctcaagcgatccttccaccttggcctcccaaagtgctggaattacaggtgtgagcctccacacccggcctatcatgtatttttcttcttattacattatcttcggagacactgttttgttttgaaacgcagtctcacccagctgcccaggctggagtgcagtagtgcaatcttggctcactgcaacctccacctcccgggttcaagcgattctcctgccttggcctcccaagtagctgggattacaggcacccaccaccacacctggctaatttttttttgtatttttagtagagatggggtttcaccacgttggccaggctggtcttgaactcctgagctcaggtgatccgcctgcctcagcctcccgcagtgctgggattagtgtgagccaccacaccccacccagagacattaatttcatgcatgcatgacatcccatcaagtgaatacatcacagtttacttagatttgttgatctgatcaattccttttctcagttttcttataacaataatttcatctgaacagaagaccaaagcaagtggtttttacagctgccagaacgtggacctgcaattccttgttctggtgagagatgaagtgagtgcagtctctgggtgagctgcaggatcccagttgcccctccaggccagcagggaaaaggaagggaaaggtgggctaaagctgatgagttctgatcaagagtgagaaatcgatccaatcagctatgacaaaaagtcttcaaaaatatgaacactatcaaacgattcattgctctcaaggtctatgggacaatctttctcccatcttcctcaggctagtaacaagctgaaccaaggcaggctccacataaacacacaacaccccaatccctcacccaaggtgtgacgtaccatatcatggcaggactccacatccttgccgataccatggctgatcagaggtggctgagaggagcaattgataagagatacaaattcgttcttgttgtttttggggaagtctttgtattcaacctaagggggaaaagagagctgaggctaggtagggaacagcaagtatgagtgggctggagggctgcagctccaggccccacaagcaagatcaccagctcttttttccaactcagccccactgtggccatactaacacctgccctgtcagcccagaaccttccaggaacctaggtgtctgctcagaagcccaagactgggagaagccatatcctttcctaccagacagaaagtgtcagcacgatgagtctgttctttgaaatccaaatttacaaccactgctagtggttagaagcttttagggttggcttgcatgttgaaatcttactaccaaaggataaagatatttctcttaccacatatgcttacaatacttctatacctcctacccttccatcactgctccccagcccatccctggacagaacttgatttaagaaaaaagtacaaagttcaaagttcattttctgagagaagccaaaagatgactgtcctgaggcacagccatcacagctcaggccagacagttacctggaatccctggactctggaaagatagtccagttgctcagagggtctcgtgagaggtccatggggtacgtggcctgaagagatgttattctttaaaatggtctcggctgtgggcgaggtgcccccatacaacaactctcgggctatcatggcagttaccgtggccttggcaggattcggagctgccctggtaaaatctttggtgtgatgtccttgactaactcctacagcctgggcgacctcgggcaccatgggaagaattccagcaggcagctgctgatgacttagataaggcatcctgaactcatcctctttattacctgggagggacatacacggtaaacacgaatccacatccacagcctggaaaaacgcaatgacaccatcaaaccccacgctggccctccccttggcacgcatggcagcgcagggaatcagggaatgataaagacactttgcatgcgggacctcactggctgggctcctgctgttattcaggacccatgcaaatcccagaatcacgttcagaggaagacgatattaagatcacacttactagtcccattttcatccccagagccaggttcaaaaaaggttacttttcttccatcccctggtttctttatgggtgtcttaaaaaagaagaagaaaaaaaaaaggccatgagcataaatcagatcactgaaaaattagctcctgctgtctaaatctacacaaagtccagtcagcaataactgtggcaatcggcagaaaaaccctgccccacctgaccactggcaccctgacagacacctgggcagagcctgcctccttctcctaatgcaccctcctgcccacacccctgcccacaaagagcatctaacaaagtgcactaacctgtgaatgctgagctgcactctgcacccacaggaagacgggaagcatttaaccagaaagagcagagatgctagacggtagagcccaccaaggtggggaaagaagctttcagactgaagctaaacaaataaatcaagaatatttcctggagctgatatccaattaaaaaataaggtgacattccaaaattaacacccttacggggaaaatgttattacctaagaattttgtctaacacaacatcacctttctaagaagtaacaaaggacactctgaatgtcctacaagattctgaaatgaaaaaccctaaagccaagtctaagatctatactggtggtatctggggtcccagtcagttattaactggccatgactgatgctgtttctgtcaatatgactggcagacatgaatgaatcaggcctgatttcaagtttatctcaccaggaccattcagtgatgggaaagaagaaggtcagccatggcttttgctgaggtcctgcttaccacttctggcagacacgaatttttctttttacgttccttttttgttgttgttgagacagggtctgtcgcccaggctgagtgcagtggcatgatcacagctcactgcagccttgaccttccaaggctcaatcctcccatctcagccttgtagctcgggctacaggtacaagccaccatacctggctgatattttaattttttgtagagacagggtttcatcatgttgctcagactggtcttgaactcctggattcaaggcctcagcctcccaaattacaagtttgagccaccacacctggccgtgaatttttcaacaggggattattttcatctgatgtttaactcacataggaaaaaagaaatcccaaacctaaactttggatttggcctgtctctactgtcacactgtcttattttgccagaaaaatcaaagcctattccacaattaacgaaagcctaacagttataaatctttcacacaggcttcatttctagagtgcaaatcacacttagtaatttcagtcctaattacccttcatcctcatcctacaaatagagaggagcaagctgccctccacaaagcgtccccagaccacaaagatactgacacaatcaacgatctaacccagagcctcctggggccagtggacatgcgaggcccctctgagcacattatggtccaaatggatgagacactcctcagcaggactccttgaactgtcaggcagataaagccttgccttgaagcctgcccctggaggtgccccagttccctagggtgaggcgagagaccatcttgcaatcagagagcccacagcactcaccttctcctctgacttgagtgcgggtttggtgggctgcgcctgcgggactttgaaaccaaggatctccagcatgttctcggctgcattgcgcttggccaccttcttgttggtgcccgttccttctgcagtgtggtttccaaccttcacctgcacaaagaagtcaaaacacagaccagtgcttaaaccttcagaataacaaccaggcaggaattggtgtgtcagcaaaataaccaactatggtcagaagcaagataacagcagtgccccgaacctggcctccttgtctctgagagctaattattaaatagtcaggagtttgggaagctggctgttaaacacagccagtattaaacatttaattatataagctgataattattttaacagaggtaatttttgactgcattttataatcatctgtgttctgagggtctgcccagctattgcatttgtacaatggaaacagtctgtgatggtgaactactgtacatctattcccagcattgccattggaagtatcactttgagagcttgaaatcagccatggtgggactatttataccacagaaatatacaaatgctacgtatcaaagatcataagctgtttattgtctaactctaaacctacaatgatgaaaaggttaataaagcaggttaatcttaaaagcatgagaagtctgcagccattacattgtaactagcacaaaaaactgaaatatcttcccgtctttgaaaattatctaattttgcagagaagccactcatatcatttacaaatgagtgatgttacatgtcttcattgtttcactttttcttttttcttttttgggatagacagggtctcacttcttcacccaggatggagtgcaatggcatgatctcagctcactgcaacctccacttcccaggttcaagcgattctcctgcctcagccacccgagtagctgggattacaggcgtgtgccaccatgcctggctaacttttctatttttagcagaaatgagggttcaccatgttggtcaggctggtctcgaacccctgacctcaagtgatccgtcatgctgggattacaggcgtaagccatcaagcccagcctgttttactttcatcttacctattaacataaataaaaaacatcaaccagccgggcgtggtggctcacgcctgtaatcccagcactttgggaggctgaggtgggtggatcacctgaggtcaggagttcgagaccagtctggccaacatggtgaaaccccatctctactaaaaatacaaaaagtagctgggcgtgatggtgggcacccgtgaatcccagctactcgggaggctgaggcaggagaatcacttgaacctgggaggcagaggttgcagtgagccgagatcacaccactgccctgcagcctggacaacagagcaagttgactccattcccctctaccccaaaaaaaatgtatctcaaccagtattcatgctacaaccaaaatctcaaatctacagtatgtatttgtcagtgacatgagcaacacctttgctgaactggatagtaataaaccattatgtgctgtctgattttataacactatcgttggtaactgtcacactgaaatatgtatgaaatttacaataaagtgtatattatttataaattgtactacacatcctttctgtcagtaaaatttataaaacacacatatatgtcagtataatttataacacacatcctttgtgtcagtaaaatttataacacacatgtatataacacccatgtatatatctataacatacatattcagctcattccaccaaaccaccctccccgaagaagagctggttgttaaacatgttccagcacatcactacttacaacccccttccaagttgattgtaataacaggcacctggctgctaaaaccaaaagcccaggtcacaagactcagagagtcaaagaaaccattccctggcctgggactaaattccaacctggccatctaccagccatttcatcttgggcaaactactgatcctctcagcaaactgcaacttccttttgtggaatgaaaggatcattcttttcctaccttctgactgcataggtaaaatatacgaggtcaactttctaagttataaattgctatacaagagataaggattctgtcttacatcagaaagcacttaaattcaaatcacaattaagttaagctgcctatgtgaaatgaccacttagctttgaacttaatcagctaagtacaaagaaatgttccatactaatctgaagtgtcacccaatctaaggaagaggtaaccctagattccagactccataagaattaggaggaagaggaacagatctcttgatactacttacaaaatttacctttggtaaagagcaatgtcataaaccttcaaggagatgtaatgaagaaaaacttctcccagcacccaccaccccaggactctttcttccaaatttcagtgcaacacacccacattcccaccagtgcacccagcagtagtgctggtgtgcagacattacattcatttttttaagcattaagataaacaacttaatctttgatatgtagcctttacagatttctgtggtatgtttaagctatcaaattattgcaagccacaaggtcttaataaggatcacagttggctgggcgaggtggctcacgcctgtaatcccagcactttgggaggctgaggtgggaggatcacaaggtcaggagatcaaaaccatcctggccaacatggcgaaactccgtctctgctaaaaatacaaaaaattagctgggcatggtggcacgtgcctgtaatcccagctactcgggaggctgaggcaggagaatcgcttcaatcagggagtcggaggttgtagtgagctgagacagcaccactgcactccagcctgggcgacagagtgagactccatctcaaaaataaataaataaataaataaataaataaataaataaggatcacagtcgctggcagaacatggcccacaggatccagcctcctcaggaaggtgtccagaccttgaaccgccatcagcccccaaggctggacgtggtcagaggaaggggcgcccatcatccatgcggacccacctgcatcacaaactccctgcggcgcgggaggcctcgctctgtgaggagcgtgtactctggctccttctccttttttgcctgctggatctgggccagtcggctaatcggattgatcccctggccatattctgggcttgtctgtggctgaggaacaaacaaggcagaaactctgtaatgttattcaccgcatgaacttggtcaactcagagatcaggatatgagaggagataagagattttgggttgacctaatggctcagaattcgattttttttaatttaacattttaacaatgaaaagatgctttattttttttatgattgttctaggtgattttaaggtcttagcaaaccaacatcaacatttcactataacgaagcgtcactatgactgcgacggctgttttttaacatatttcaacatatgacagtaaatgggcagaaaaaacataaaacactattcctacaactccccaaaagtctgagctatgatgggttcccaattttcttgaaaagaactcaaaatccaggaaccacttttttaaaaaagctcaagctgatgccacatggcaagaagaacctcagaatcccagttacttccttgaggccaccttttgtgccaaggaaccctcactctgctgatcagaagtgacttccaggctatattaagcaaaaaagggaaacaaaaggtatacatagtatgcttttatgtaagaaaaatttggatcttgatacagcatgaaactacatatactgaaaatcacaaagttccccatggaattatgtcccctttctggggttggggaaggggtcaatataatgctttgatagatccattagtgtggctcaaaaatccaaaagaaaaggcacacagcaaaatgtctcactcctaccctcccactatgggcctcctgcctggcacaaatctcctccaccttcagaacagcaacatggtcactgagacacaggcactgttatttcaccacgcgccccacagaccggcatggcgttcctgcccaataccccactgtgatcgccagggctgtgatgagcgccctcctgcacagatgtgtgtgcccgtctgcgggtacctctactgaactgacacaatgtccttatcttacctaacaggtggctcttgcagcacctctaaggggtctggcaggcctggggtgtggcacgttggtctcatcccctttcaccttggggacagcgaccagccttctaaaccccccacccatctataagtaatgaaaacaccttctgtgttcagaaaagttctcaccttgactatgggttttgttttctttttgattctaggctttactcgttcaactgcaggcaggggcggtaacttcttcagctcctcaagaacagctatggcggcatttttctttgaaatcttcttgcttttcccttcaccttcccccacaaactccccaaccgaaaccttggtcacaaagttcttcatgtggggtgggccactctcccgggccacctgtttcagagggaaagactgagtgaaagcggacagacacttattaaaagctccaaggcacactggctggcacacttcacacagacacagggaaggggaaccaaggacaagacctactaaatgaaaggaagcggggatcatttcaaatgctttctcgcctttcttcttacttctcaaactggtttatgctcttgagtctggtgagtcccaaacagtcaggcatgaaatagggagacctttttactcccatgcccctggctcacaggctgtcctgagtttagtgtggtccactgcaactggcaaaaaggaagctagcccagcaaagtccagaaataaatgcagtacaaatgctcaagtttagtatctgctctgagcctccagccaggactaggcctactaaatactggttgctatgtggccacaaaagagaacgagacaaatctcttaagcactgataaagagggattccccgcacacattaagtaaaaaaaaaaaaaaaaaaaacccacaaaagagtatatggtatggtagctttagtttaagaaaaataggattttatacaaatatctacacatatataaacagacacacatttataagctcatttttgcaaaaaaaaaaaaaaaaaaaaaaaaaacgaaggataaaaaaaatcaatgggctggacatggtggctcacacctgtaatcccagcaatttgggagaccaaagcgggtggatcacttgaggtcaggagttcaagaccagcctggccaacatggtgaaacccccatctctactaaaaatacaaaaattagctaggggtggtggtgcacacctgtaatcccagctacttgggaggctgaggcacaaaaaccccttgaacctgagagacggaggttgcagtgatccaagatcacaaaactgcactccagcctaagcgatagagtaagaccctgtctcaaaggaaaaaaaaaaaaaaaaaaaagcaagcaatgggccaggcgcggtggctcacgcctgtaatcccagcactttgggaggccgaggcaggtggatcacgaggtcaggagatcgagaccatcctggctaacatggtgaaaccccgtctctactaaaaatacaaaaaaaattagccgggcgtggtggcaggcgcctgtagtcccagctactcgggaggctgaagcaggagaatggcgtgaacctgggaggcggagcttgcagtgagctgagattgcgccactccagcctgggtgacagagtgggactccgtctcaaaaagcaagcaatgaaattagttacctacaacaggtgtgagggattagggtagacagacgggatgagacgggaatgatagttttgacttctggaagcatttactgttttacatattaaagaaataaaactaagtcaacaaagatggggaaagaatctaaaattaaacatgaacagaaagttagctgcatattaaagtgattacaatctccaaatggaccaaagacctacacagaggcgctaacatgcacaactctcagaagcaaaaacaggcgagtcttcatgactttgggtttggcaattggtttttaagatatgaaactaaaagcacaatcaacaagagggaaaaaaaaaagtcacacttaatcaaactttaaaacttttgtgtatcatggacattatcaagaaagtgattacaataacacagatagaaaatcaggctgggcagggtggctcatgcctgtaatcccaacgctctgggaggccagggtgggaggatcacttgagctcagaagttcaagaccagcctggccaatacagcaagaccttgactctacaaaaataaaaacaaaattagccaggtgtggtagtgtgcccctgtatgtagtcctagctatgtgggaggctaaaacaggaggatcacttaagcccaggagatcaaggctacagggagctatgatcacacaactgcaccccagcctgggcaacagagcaaaacctcgtctcaaaaagcaaaaaaaaaaaaacaaaaaaaaaacaaaaaaacttaaaaatctaaccgatattagccaagacactcaaaaagaaaaatagaagacttacactaccagattttaaaacttcctataaagtcacaacaactaggatatggttttgtgtaaggataaatagatcaacagaacagcacgaaaaagacctgcacatataaggtcactcgatttttggcaaacacaccaaaacaaattaaaaatctcttaaaaaaatagtaccagagcaactaactaggtatctgcatggagcggggtggggggaagaaaaaaaaatcaaaccatgatctctaactcataccacaacaaaaattagacctaggatcacttaaatgtgatctaaactaaaattacaaagactttataacaggagaaagcctcaagactgtaaggctggcaaagagttgaacacaaaagatatccaccataaagaaaaaagaaattcctcaaaattaaaaaccactggccgggcgcggtggctcacgcctgtaatcccagcactttgggaggccgaggtgggcagatcacgaggtcaggagttcgagatcagcctggccaacatagtgaaaccccgtctctactaaaaatataaaaaattagctgggcgtggtggcgggcacctgtaatcccagctacttaggaggctgagacaggagaattgcttgaacccaggagacggaggttgcagtgagctgagatggcaccactgcactccagcctggacaacaagagcgaaacaccatctcaaaaataaataaatgaataaaataaaaaataaactgctcatcaaaagacatttaaaaagtaaaaaagggggccaggtgcagtggctcacgcctgtaataccaacactgtggtaggccgaggcgggtggatcacctgaggtcaggagtttgagaccagcttggccaacagggtgaaaccctgtctctactaaaaatacaaaaattagctgagtgtggtgacacatgactgtaatcccagttacttaagaggctaacacaggagaaatgcttgaaccccagaggcggaggttgcagtgagctgagatcgcgccattgcattccagcccggatgacagagcaagactttgtctaaaaaacaaaaaaaactaaaaaaggggccaggcacattggctcactcttgtaatcccagcactttgagaaggccaaggcgggtggatggcttcagtccaggagtttgagaccagcctgggcaacatggcaaaaccccgtctctacaaaaaaaatacaaaaattggctgggctcggtggctcacgcctgtaatcccagcactttgggaggccgaggcaggcggatcacctgaggccaggagtttgagaccagcctgaccaacatggagaaaccccatctctactaaaaatacaaaattacctgggcgtggtagcgcatgcccataatcccagctactcgggaggctgaggcaggagaatcgcttgaacccaggaggcagaggttgcggtaagctgagatcacgccattgcactccagcctgggcaacaagagcgaaactctgtctcagaggaaaaaaaaaaaatacaaaaattagcccagtgtgtggtggcgtgtgcctgtagccccagctacttgggaggctgagacagcaggatcacttgagctcaggaggtcgaggttgcagtgaggtgagatcatgccactgcactacagcccgggtaccaagtgagttcttttctctaaaatcaaataaaataaacttgttatttcaaaatatacatatttcctagctctatctcctaaccgagagccatggctctccagcaggaacaagcatgctagcaccctgtcctgtctctacacaccactcccaattagaaggaaccggatcttcttggaggaatggccaagaccatttctattagaaatttatgtttccactggggctaaagctagagcaggggaagttcaaagtgaggctaaaacattttgttgtatcagaaagcatggaagttctcaaaatgtgaagaggggaggtgcaaaggttatttaataaaggactgtctcagccaggcatggtggctcaagcctgtaatcccagcctgggcgacaagagcaaaactctgtctcaaaaaataaaggactgtctcttcaacaaacagtgcaggcacaattagacatccaaatccaaaaaaaaaaaaaaaaaaaagacaaaaacatcccttatgtcacagtatatatgaaaactaactcgaaatgaattataaacctaaatgtaagagctaaaactaaaatttctaaggaaaatgactttaggttagccaaatgtatctcagcatacacaaaaattattaactataaaaaatttaacaaactacacctcaccaaaattcaatacttctgctttttgaaagtcacttaaaatcaaacgacaagccacagacttaagagaaaatatctgcaaaatacttatctgagaaaaaacttgaattcagaatatatatagaacctccaaaactcaataataaaaagacactcaaaaaaactggcaagatataaacctatatttcatcaaagaaaatagtaaaataaaaacacgaaaagaagctcagtattgctagtcttcatggagatatataaattaaaaccacaacaagatactactgactacctgctagaatgactttaaaaaaaaatttttttttttttttttttttttttgagacggagtctcactctgtcacccagggtggaacgcagtggcgcgatcttggctcactgcaacctctgcctcctgggttcaagcgtttctcctccctcagccccctgagtacctgggactacaggtgcacacaaccatgcccacctaatttttgtatttttagtagagaaggggttacgctatgttggccaggctggaataactaaaattttaaaagctgacaatacccaagtgttggagaggatgtagagcaactaagcctctctcatatattgcaggtgaaatgcacaatgatacatctggtttagaaaacagtttggcaacttttttttttttttttttttttttgagacagtctcgccctgtcgcccaggttggagtgcagtagcatgatctcggctcactgcaacctctgactcccaggttcaagcgattctcatgcctcagtctaatgagtagctgggattacaggcacatgcctggctaattttttgtatttttagtagagacgaggtttcaccatgttggccaggctggtctctaactcctgacctcaagtgatccgcccaccttggtttcctgaagtgttgggattacaggcatgagcccatgagcccagccaacttcttataaagttatttatttatcatgcaactcagcaaatccactcaagtatttattcaagaaaaatgaaaacatgtctccacagatgtatataaatgtttacagtagatttattaataatcaccaaaaactcacaacaatacaaatcttcaactggtaaatagatacactgtagtgtgtacacactatgtaacactcttggtgataaaaaggaacaaactactgaaacacacaacagcatgaataatgactccaagctaagttaaagaagtcagacaaaaggcaatatactctattttccatttatgtaatattcttaaaaaggcaacactatagggacagaatgagatcaatgcttgccagagcctgaggacagaggggagagactgactgcaaagggacacagggaactttactgggtgggagatgttctgttttgactatggtgctggttacagaaccatatacacttatcaaaacacatcgaactgtgcacttacacagggtgactttcactgtaaattatacctcaagaagcctgaccaccccttcatccaaaaaataactgatgggggcatgttaaagggcacaagggccaatttaaaggacaatttggacatcaaaatgggtgacgataacaatggagtaatactttgggtttaaaaaaaagcagcaatgcatctataccgatataattactataagaggggaggaaggaaactttttctttactgtagaatgccagcttggaaatgccaaaaatcataattttgacatctaccacagtgataatcaatgccagcaagaatcatcaagatccctgaggggtgggtgtggtggctcacgcctgtaatcccagcactctgggaggccaaggtgcatgcctaatcctagctacttgggaggctgaggcaggagaatcatttgaacccgggagccagaggttgcagtgagctgagatcacatcactgcaccccagcctgggcaacagagcgagactccgtctcaaaaaaaaaaaaaagattgctggaaccaccggggagacctgtgaaggcccagccttcaaacatctcctcagaggttaggagttaattacaaagtgacatgaaatgatgctctgagaaggatcaatatcactcccatggtgatcctgccaaaaaacacataaccagacctaatcataagtaatccatcagaaatacccaaattgagggccactgtacaaaaataactgacctttaaacatgtcaatgtcatgaaacacagagaaaggctgagaatgtactgcagatactaaagatactgcagagactaaagagaaaggtcagctaaatgtaaggtgtgagtctgcatcagacactagagcggaagaaacatttctataaaggacatcattgagacaactggtgaaatgtgaatgtaggatgtgtattaggtaacagtactatagcaatgctaaatttcctctacttaatagattgtggttatttaagagaatgtccttgctcttaagagatacatgctgaaatattaggagttaaagggtatgatatctaccactttctgtcaaataatccagcaaagtaaaaaacagaaaataatatgtatatttatggaaaaagaaaaagcaggctgggtgcagtggctcacacctgtaatcccagcactttgggaggccaaggcaggcagatcgcttgaggtcaggagttcaagaccagcctggccaacatggtgaaatcccatctctactaaaaatacaaaaattagccgagtgtggtggcgtgcacctgtaatcccagctactcaggaggctgaggcaggagaattgcttgaatccaggaggcagaggttgcagtgagccgagatcatgccactgttctctagcctgggcaacagagttaggctccgtcacaaaaaaaaaaaaaacaaaaggaaggaaggagcaagcaaatatggtaaaatgttaaccactggttaatctaagtgaaagttatattcattgtcctattcttgtaacttttagatagatttgaaatttttgaagtaaaaaattgaaaaaatgtctaggtaagaaaagtgagcctccaaaatggatgcactctttttttttttggtgtaggggaaggaggtagcggagaatggggggtaggaattcagcacagtggccaggagcagaggtgtgggaaggacctggcctgcttaggcacccgtggactgattttaaagaactcccataggtgccgcccacacccaagggcagagattctgaaacacttcttcccacaacagtgctttccctgtcctcaggttagactttggagggacaggtcagccaccctgatggctcacttcaaatgcacagcccaccctggccctctccaacggcttgcattgtctgcccacatcaagatccccccaatctaaatctggaggatcacctggattgcatgtggtgtgagcatgtcacaattgtctcccgatgaccgtatccatcagcaccatcacattttctaactaaaactgtatgttttatcagaagtcaaactggctgggcacggtggctcatgcctataatcccatcactttaggagatcaaggtgagtggatcacctgaggtcaggagttcaagaccagactggctaacgtggtgaaaccctgtctctactaaaaatacaaaaattagtgaggcatggtggtgtgcacctgtaatcccagctactcagggggctgaggcaggagaattgcttgaagccaggaggtggaggttgccataagctgagatcgtgccattgtactccagcctgcgcaacaagagcaaaactccatctccaaaacaaaacaaaacaaaacaaaagtcaagctgtatatatttttccaaaaaactgttcctgtcttcccctattaaaacacctaacgaagcttcctatgtgacagatttaattaccaaaaacttaatcaaaaattattctgttcatttattcagtaactatttcctaaacatctaatacatgccaggcaaccttccagcggcaaaagaaaggaaagaccttgctcaacataataatgcaagctagtaaaaaattcctgatatttgagttaatgaatataagcactcacgccaccaactacatgcaagctgtgataaattactttaaaagatcaccacgagagggcactcctacaattcttttatgtgactactgtcaagattcctgaacacagagttgagagccagatctgaaaccttaacaaaagtgaaggaggaaaggaagcaatctgaccccaaatcccacagaacaaaaacataaaatagcaatctctaagtttccagaaatctcagtgactctgggtagcagcaagagtgagcaggtggtaagcttctcaggaatccaaggctctggcccaagccgtcaactctgcacatgaggtgacccgggaagccagccaggcatctcccactccccacggtcttggtacccctcccccacaacctgcaaaaatccactctcatgacagactaatctgtcagcaggggagaaaagcaacacttctcccctttcctgaaacaggtgccgggggagacctcatgactccttgggatgcagctcccatctttttcccactcaactgtgagcccaaacagccattctgaatgtcccctgtctcattccctccccaagtgcatcccagcctccactgatggagggagaaaggccagggagggaatgtagggccaggtgagaagattccagccctagatccatgtcggtgctctggactccaagagaacagtgtaaacctgctcttacccactgagggtggaggggcaggaatgagtgtcagaggaatggagaggaacaaacaagccctcgtacccaggtgggccacagtagggagccctggcaactacaatcccacctctggcccatggcaggcagagaggcatcagcagggtgaggtgagaaatcatcatcactcggccaaaggatggagcactgaagctgggttaagtttagggtgctagcacataggaggagaaggtatacatcacctgtaactgtaaagaatacttcaaagatattttacaggaatataagcttcagataggctttttaagaaataagccataatcaagcacgtaaatcaaaagaatctgcaaagaatctgctgtgggtcagaccttatttctaaggtaaacattaaaaattctcccttactgggccgggcaaggtggctcacgcctgtaatcccagcactttgggaggccgagatgggtggatcacctgaggttaggagttcgagaccagcctgaccaatatggagaaaccccgtttctactaaaaatacaaaattagctcggcatggtggcgtatgcctgtaatcccagctactcaggaggctgaggcaggagaatcgcttgaatctgggaggtggaggttgcagtgagccgagaacacaccattgcactacagcctgggcgacaagagtgaaactcatctcagggaaaaaaaaaaaaaaagctctgggttgaaacccgggcgccgccaagatgccggctcattactcttctctcatggatcctgacaccaaactcatcggaaacatagcactgttacctatcagaagtcaattcaaaggacctgcccccagagagacaaaagatacagatattgtggatgaagccaactattacttcaaggccaatgtcttcttcaaaaactatgaaattaagaatgaagctgataggaccttgatatatttaactctctacatttctgaatgtctgaaaaaactccaaaagtgcaattccaaaagtcaaggtgagaaagaaatgtatacactgggaatcattagttttcccattcctggagagcctggttttccacttcacgcaatttataccaaacctgcaaacaaacaggaagatgaagtgatgagagcctatttacaacagctaaggcaagagactggactgagactttgtgaggaagttttcgaccctaagaatgataaacccagcacgtggtggacttgctttgtgaagagacagttcatgaacaagagtctttcaggacctggacagcgaagggagcccgggcagccgccatctccagagccctgggcagcattttccagcaagatgtacacaatcttttgcctttattcgtaacgttttatatagaagagagaagagcatgtctttacttgaaaaactcttgatcaagaatttgggtgggagaaaagaaagtgggttatcaagggtgatgtgaaattttctgcagcattaagctggcgcttaataaaaataagtaacaaaaaaaattctcccttacctccctcgtccatttggatgaactatatgtcttttaaggcaacatatattaaaatgtaccttatttcccactttgatcagacaattcattgattattgtttttagaacacaaggtctcaacaacaaatgaagttattaaacaggaattgagggcagacgctagacaatgacaaaaactgagtccttttcaaaattactctgaagagacctttagggaccacaaatgcttttgagactgatctaagtgatgaactagcccctccacccttccctatccagaagaatacacatatgaacactaacacaaccatcttcagactgcttcaggaggtccacacaccaactgaagccatcatgaactctctacacatccatgaatgccccttagttacggactcccagaagaagagaataaacactgcttcactaaatataaagtatgaatcttaaatttggaggttcacattatgtgaagattattccaatgatatttaggggaaaaaataactcttatgatgaatgctaacaggattttagaatacaaagtcctacatgtaaaattagcttacctcgaaattcacaggcaagttccgtttaagtgcaatctcaaacacttgacttatttcagatttattgagattttcttcttcggattctcttccattcacctgtaagaataattgtttagtagttagctcttattaaaatagtcaatggccaggtgagttggttcatgcttgtaatcccagcactttgaaggctaaggcaggaggatagcttgagcccaggagtctgagaccagcctgagcaacatggcagtttgagaccagcctgagcaaccttgtctctaaaacaaaaacaaaaacaaaaacaaaaaaacaaaacttaggtggatgtggtggtggtacatgcctgtagttccaactacttggagggctgaggcaggagcattgcttgagcccaggagatcgaggctgcagtaagccatgatcatgcgccactgcactccagcctgggtgacacagcgagacgctgtcccccacaaaaaaacacccatcaacatcctagctgcaatggtaaaccttaaaagcactgagctttggctttatgaatttaaccacacacataccaagtgtcactgaatttaagaggttaaaaagatacatgtcctgtcaagtttgagtcaaattgtacctcataagttcaccaaaaacaatccgcacataatagacctttggatatgtgtcagcctgactgtggttcagcaagatgtcactgctgctcggaacagtgacttccaaaagtccttctcaagtagtgggaagccacattttggaaaagtcaaaatacagacagatatatgtgggacgtggcaaattcagattaagtctgtccacatgagtatgcaggcttatttgaacataaattccctggaaaccactttttttttttgagatggagtctcgctctgttgcccaggatggagtgcagtggcgcgattttggctcactgctacctccacctcccaggttcaagcgattctcctgcctcagcctcctgagtagctgggattgcaggcatgcgccaccacacccagctaatttttgtatttttagtagatacggggtttcaccatgttggtcaggctggtctcgaactcctgacctcatgatccacccacctcggctcccaaagtgctgggattaaggcgtgagccaccacgcccggcgggaaaccactttaagagaatgcagccatgcgcatggcagtacacgactattgccccagtactcagcaaggtgacagttgaggatcagttgagcccaatagttcaaggctacagtgagctgtgatcatgcctgtaaacagccactgaactccagcatgggcaacaaagactctctatctctataattaaaaataaagaaataaataaggatgcgatgaaacacattacaaaactgccatgtatctcatactcaacggctgttggcaaaaaaatacaaggcgcaaactaataaagtctcctcaacaaaggcagagattccatctttggaacaaggttcacttaagagtcgtccaatcagggatgagattaaagaggagcaaggatcttacttctgcgtgctgataacatggattttatactgtgctgtagtgataataagaggaactagataagctcaaagcttatctagcaaagtcccccaaaacaaaaagagctgtttttcttcacattattgcttattttgtcaaagaatttataaagtcctgcttctgagattagaactatctgaaaaggaacccatggctgaaactgctaaataggcaaggtataggactatccaagattttatctgttgtgcatttccttatgtttatcaggtatattccacctacactcaacttttttttttttgagatggagttttgctcgtgtcgcccaggctggagtccaatggcatgaccttggatcactgcaacgtctgcctcctgggttcaagcgattctcctgcctcagcctcccaagtaggtgggattacaggcacccaccaccacacccggctaatttttttttttttttttttgtatctttagcacagatggggtttcaccatcttggccaggctattctcgaactcctgacttcaggtgatccgcccaccttggcctcctgaagtgctgggattacagacatgagccaccgtgtctggccactgaatattaaaagctgtaattggctgggcatggtggctagcgcctgtgatcccaaaactttttaaggacaaggtgggtggattgcttatgcccagtttgagaccagcgtgggcaacatggcaaaaccccatctttataaaaaaaatacaaatattagcaggtgcggtgtcgcacatctgtggtcccagctacttgggaggctgaggggagaggatcacctgagcctagggtgttgaggctgaggtggctatgatcacgccactgcattctagcctcagtgacagtgtgagaccgtgtcacacccaccaaaaaaagctataattaaaataaaacaaactctaggttaaaaaaatatatatataaccaagggtataatcctggacaaataaatttattccagatgctctttgtaattccttctatccttccataatcttttctttccaatctggtttcagtgtatctcacctgagtcaaaactactttcatagcacttgtggtggtttattaacctacacatacttttttttgttttttggagacagtgtctcacactgttgcccagtctgaaggacagtggtacaaacatagctcactgcagcttcaaactcctgacctcaagcaatattcccatctcaccctcctgagtagctgggactactggcataggcaccactcccagctattttttttaatgttttgtagagatggggtctcactatgttgtccaggctggtcttgaactgggctcaagcaaccctcccacctcaacctcccaaagtgttgggatttataggtgtgagccaccatacccagcccacacttgtatttttgtttaaatcctaagcagaaaaagggtctacttttttatgagtgaatccttaaaactggcaatttgcaagcaaggtaccttaaaggctggagttctacagaggtttggcttgaaatttacaggttggtgcaaaagtaattaccaatctaatagttaaatagatattaaacttaaaaaaaaaatactgtaagcttgttcaacaaatggtgctaggaaaactagatatccacatgcaaaataataaggcaggacccttaccccacaccactaaaaactcaaaatggatcaaatacttaaacataagagctaaaacagtaaagttcctagatgaaaacataggggaaaagtgttatgacaccatctggtgatttcttacatatgacatgaaaaccgcagacaacaaaagaaacattaatattagacttcatcaaaatttaaaacattcatgcatcaaaggacactatcaagagagtgaagaaaacccacagaatgggatttgcaaatcatttatctcataagggattaatatccagaatatataaagaactacaactcaacaataaaacaacccaattagaaaatgggcaaagcacttacacaggcatttctctaaagaaatacaaatagtcggctgggcacagtggctcatgcccgtaatcccagcactttgggaggccgaagcaggtgggtcacctgaggtcagaggttcgagaccagcctggccaacatggtgaaataccatctccactaaaaatacaaaaaactagccgggtgtggtagcagacgtctgtaatcccagctacttgggaggctgaggcaggagaatcacttgaacccaggaggcagagattgcagtgagctgagattatgccactgcactccagcttgggcaacaagagcgaaactctgtttcaaaaaaaaaaaaatccacagtaagataccactcacacccataaggatggctgctatcaaaagaaatggaaataacaagtttttggatatggagaaatgagaagcttccagtcacttatgaaaatgtaaaatggttgtaccagatttggattttattaaaaataaaatagaaaatgggcagtgcgtgcggtggctcacacctgtaatcccagcactttgggaggccgaggcaggcggatcacctgaggtcaggagttcgagaccagcctggccaacatggtgaaacaccatctctactaaaaatacaaaaattagctgagcgtggtgacgcgcacctgtagtcccagctactcgggaggctgaggcaggagaatcgcttgaacccaggaggcggaggttgcagtgagccgagatcacgccactgcattccagtccagtgagactccgtctcaaaaaaaaaaaaagtaagttaattaatttaatagaaaatgtaaaatggtacagttgctatggaaaacagcttggtagttcctcaaaaaattaaacatataattattatatgatccaggaattccacttctagatatacacccaaaagacctgaaagtagcaacttgaacacatttttatacaccagggttcacagcagcattcacaatagccagaaggtaaaaacaacccaaatgtccatcaacagatgactggaaaaacaaatatttactattcataccataaaacattcacccttaaaaaagaaatgaaattctgaaacatgctataacagagacgaaccttgaaaacattacagtaagtaacataagccacacattaaaaaaaaaatccatttttatgaagtgcctaggctaggcaaatgcatagaaacagaaagtaaagtagaggttaccaagggccacgagcaagggagtggggagtaactcttcaatgagtccagaatttctatttggaatgatggaaaggttctgaaaattagtagtgacagttgtgcaaaaccaagaatgtattttaatgccactggtgcacttaaaaatgtttaataattttagatgtatattttgcctgaattttttaaaaagcagcaacaaaaatgtttcacaccaaatattaagataccagaaatcatcaacacagtaacttgtgctaaccccagattaactcatttttgtgcacaacagaataaagcttgacagctgtttccctgaagagcatccagagttttttttaatagatgatctgtttaaaaaaaaaaaaaaaaaggtccacatgctaagaactgtgccaatgagaatgctctttatgagcagccagaacacaacttggaaataaactaggtgctcagactgtcgtaagactttgaatgccacgtacatgccccaattttcaatgttttgttcattgtatcagcccaattaggtttaacttttatttttatttacaacctatttcaaacatacagaaaagtacagataataacataacaggcaatttcctggatttatccaatgtcaatagttaagtactactgacgtcggactgtttttttctgttttaagaaaaacaatgagccacgcatggtggctcacgcctgtagtcccaacacttctggaggctgagatggatggtttgtttgaagtcaggagttcaagatcagtctaggcaacaaagtgagaccttaatctctacaaaaaaattttaagattacccaggtgcagtggagtgtgcctatagtcccagctactggggtggctgaagcaaaaagatcacttgattgattgcccaggagtttaaggctgcagtgagctatgatcgtgccactgcactccagcctgggtggcagagcaagactccatctcaaaacacaaggcaacgggccaggcgaggtggctcatgcctgtaatcccagcactctggaaggccaaggcaggcggatcacttgaggtcaggagttcgagaccagcctggccaacatgacgaaaccccatctctactaaaaatacagaaagtagccgggtgagactctgtctcaaaaaaagaggcaatgaaggccatctcactatcattcccagggcagttaatcactatcctaaagtgggactgtatctttcccagccgtgtttttaaatgaatataatttggtgtttttgaaaactcatatacctcattctcagaaattgcctttaccattattataaatccaaacttataagtttatactaataactgtaattccagcactttgggaggtcaaggcgggagggtcacttgaggcctggagtttgagaccagcctgggcaacataataagacctcatctcaacaagaacaacaacaacaacaaatatttattttttattttgtttttgagatgaagtctcgctctgttgcccagactggagtgcagtggtgcaatcttggctcactgcaacctccgcctcctgggttccagtgattctcctgcctcagcctcccaaggagctgggactacaggcacaagccaccatgcctggctaattttttgtatttttagtagagatggggtttcgtcatgctggccaggctgatctcgaactcctgacctcaggtgatccacccacctcggcctcccaaagtgctggaattacaggcgtgagccaccgtgcccagccaaaaaaaaatttttttaaataacaatttatactaacgaaatgctccttttctattttatatacatgtatcaaggttccacgtaagactgatagaaaacaatgggtctactgctccgttctacaccctaagccagtggttctcaaccacagcagcactacaatcacttgggagcttcacaagttcagattctggagcccgctccagacaactgaactcaaatttttgagggcatggcctggatagcagttttatttatagtatttgtttattttttaaataagtccccaggtgactggagttgcgattcactgctctaagccattgcttccagaggagtatcattaggaacaaagcagccagtaaaataaaaatgcaaaaaaacatatttgaaaatgaaattattttgctcttttacacaatttttttcttttgagacagggcctcagctctgtgccctcagctgcagtgcaatggcataatcagagctcactgcggccttgatctcccaggctcaagcaattctcctgcctcagcctcctcattagctgagactacaggtacatgccaccatttcgttttttcaaatatttttggtagagatgaggtctctccatcttgtccaggatggtctcaaactcctaggctcaagtgatcctcccacctcagcctcccaaagtactggaattataggagtgagccaccgtgcctggctcattaaaaatttcctattatccagactgacaaaatgttccaagtagggaggcagcaaatggttcaaaactaatctacaaaaaccattcccagtaaaatgaggaaggtttagtgggcacttagtcttatcttcacaatgtaggaattactgttaacactgattccatagtgtatagttcagcaataaaatctaggcaacattaagaaagaggccaggtgtgatagctcatccctataatctctgcactttgagaggccacggtgggcggatcacttgagcccaggagttcaaaaccagcctgggcaacatggcaaaacccgcatctctacaaaaaatacaaaaactagccaggtgtggtggcatacacctgtagtcccagctacgagggagactgagatgggaagatcacttgaggccaagaggtcaaggctgtagtaagccacaatcgtgccactgcactccagctagggcgacagaggaagaccctatttcaaaacaaaacaaaacaacagaaaagaaagaaatgctctgaaccacacttaaccctcacagtatgctaggaaaattagccatcaccatttattatctggctccaacagactcttctgtttttctatatctaaagtcattttacaaataatttaccaaataaaaggatgacaaaagccattttattagacattttaataagaacttaaacacagcaaacccagcttcttatcccaatgtttctaatttggaaggcatatatacctgaaaaaaagcaaggtcctctatatgcaactaactgctcatcacctgatgcacctgcagctggggcacagcccacctgtagcgatgtcagattccaagtccatctccaacaggttctaacttaacaggacttcagattcttcgtgtactggcactgtcaaacacactacttttgaaacagactcataattctgttgaagagaaagcagccatttccttgctccattaagtgcaaaatgctttcatttttggattataaacaccaacagaaggatcaatccagttatttttgtcatttttatatctattttcttccaatcacctttggacacacacctccttgtgcatttgtccagttattttgttgacaataagtggtaagaaataaatgttggcggccaaacataaaagataaaagaatgttgtcacacgtacttttttttttttaaatgcaaacaggatgggagaggttcttgtcgaaaaatgttgcatgatgaagtcctttctgttgaatgactagatgagaatataccacatttcctttccatacatcagataaataatcactagctgattcttgagtttggggaaattcatctatgctagcatctgaagactcacagtctgcgattttgcttagacaatctcaccatcatcattacagtctggagtgctgccatctatctgtctttttgtgttcatcttctgatttgttaatcatcagaaatgtcttcctctgtcaattctcttctccttgacattacagatgaaaaatagaaaaattctggattctcacctgggttcaatgaaagcaaaaaggagactcaaaagatggtgtctctagtcttctttttttaacctcttggaagacaatgcaatagcctaggcaaggccataggacaataaaagaaggtgtcatcatgacaattacttcactattgtatatccaccccagaggctttatcattcttccattttcttatgattttcatctcatctggcatatttgggagtagatgatgaatagtattgaaataattatgtggaataacaaatagcaaaacgttcaaaacacaggaaaattaagatccctaagatcccatcatgtaaagacttacaaaaggatccaaaagacccctatgataattgtaagacagaaagagttttgcactattttaaaatataagtatactttctctcagttctttgtaatacctctaaaaaagaatacaactcatgcaatatcattccttaaagagcttgaaaaagcagcttaaaaaatgaaaacctggctgggcgtggtggctcacgcctgtaatcccagcactttgggaggctgaggcgggtggatcacgaggtcaggagttcgagatgagcctggccaacatggtgaaaccccatctctactaaaaatacaaaaattagccggcggtagtggcacgcacctgtagtcccagctacttgggaggctgaggcagaagaattgcttgaagctgggaggcggaggttgcagtgagccgagattacaccactgcactccagcctgggcaacaaagcgagactccgtctcaaaaaaaaaaaaaaaaaaaaaaaaaaagaccaagcgtggtggctcacgtctgtaatcccagcactttgggaggccgaggcaggtggatcacaaggtcaggagattgagaccatcctggccaacatggtgaaaccccgtctctactaaaaatacaaaattagctgggtgtggtggcacatgcctgtaatcccagctactcgggaggctatggcaggagaatagcttgaatcagggagtcggaggttgcagtgagccgagatcgcaccactgcactgcagcctggcaacagagcgagactccgtcttaaaaaaaaaaaagaaaagaaaacctgagccaggcacaagcatgcctgcagtcccagataatcaagaggcaaaaggatcacttgaatccaggacttcaaggccacagggtactatgatcatgtctgtgtacagccactgcactccagcctgggcaacaatagtgagacctgtctctgttagaaaaaaataaaaaagaaaaagaaaactaggtccaatgaacactgaggaaacaagaagggttaaagtctccaatttcaggccaggcgctatggctcatgccagtaatcccagcattttgggaggccgaggcaggtggtggtcacttgagctcaggagttcgacaccagcctgggaaacatggtgaaacctcgtctctaccaaagatacaaaaattaggtgtggtggcatgcacctgtggtcctagctacttgggaggctgaggtggaaggactgcttgagtccaggaggcggaggttgcagtgagccaaaatcacaccactacactccagcctgagtgacagagtgagacaccatctcaagaaaataaataaataaacaaatgggtctctaattttaactttactcctaattaagtatgcacctatcccaagtgaagataaagactcaaaaccagaaagagctgcatttattcatttttacaaaagtataaaaaagtattttaaaaacttcaggatgtttacggtggctcatgcctgtaatcccaggattctgggaggccaagctgggcagatcatttaagactaggagtttaagaccagccagggcaacatggcaaaaccccatctctacaaaaaatacaaaaattaacagggagtggtggcatgaatctatagtcccagctacttaggaggctgagatgggaggatcacctaagcccagggaggtcaaggctgcagtgagcctgcatggagggcctccgcactccagcctgggcaacagagtgagaccctatctccaaaaaaaaaaaaaggaaagaaagaaacaaaaatacatacacactgaaacaccaacaggatcacactgtatgcacagtaacagctctgcatcttcatcccttttcatgcctgcctatatgagatatctcactctggtactcaggggataaacgtagccaagtttttaaccactttcctagtaacagacatttaagctagcccccgtttttctctattacagatactgcagctatgaccatactgctcctaatagctcagacactgagtaaaactcatacttcattagcacaaaccttagattaaataaacaaataacccatgcactttcttaacttggggcctttgcaactgccactccctctctgggcatacactgtccctgccctttgctgatctttagtatcagccgaaatgtctcttcctctgaaaagactgctctgaactcaccaccattattccaacctaaatgagatactttacgttcttctaattcttgtcatttttccatccttgcactaaatgcactttttgctgatattaatgttaatgtctggcagctccatttgactaagttcacaggaaaagggatggcgctgactgtttcaactcagggtctagcacagcgcctggcatggagggcccagactatgcctgccctgtagacagcaagcgctggctttactgcatatcttctagagaagatgcactgatccaccacacaatcacatgctccacaaatatgccacagctaaactgacaatttgtttaaaatgatcatttccaatgctggcaggctgtggacagacgggctgcttatggcctgtcagcaggttgtaaaatggcaccctctttctgtggagaacttggccatatgtaccaccatgcatacccgctggttcagcaattccacttctaggaccgtggacaaagactttaactgcaacgatgttcttcccgacccattttataagagggaaaatgcaaacaacctaaataatcaagtccctgttggaaaataaagcagtgcattcacatagtggaacattttgtagccattagaaagtgcttaggtgtgtgctgaatttgggtcctccaaggaattttaagtaaatgacgtaacatattcaagatatacacatcagtgaaaaaaggtggttactgtacactgtcatgccatttttatgaaatagataggcatctgtatttacttgtatatgtgcttgtcagtgaatatacaccaaatggttacagtgattatccgcaagtggtaaatttataaatcattcattgttccttgtttttgaatttaaaattttttatagtccatatgcactatttttaagaaaaaaaaagttatcttttaaaactgtctctctttattcccctactgcctgctatcagagagcctggtaaaatcaagggcagcacatttacgaaagaggccaagtgtttcacttattgcaggctgagcattcctaattcaaaaatccaaaacctaaaatgctccaaaaatcaaactttttgaacaccaacacaatgccacaagtggaaattccgtacatgacctcatgcaacgtgtcgcagtcaaaacagtttattcaatacccccaagaaaaaaataaaattacattcaggctttctgtataaggtgtatacgaaacacaaataaatttcatgtttagacttgggtcccattcccaagatatcccattacgtatgatggaaatattccaaaatcaaaaaaagctctgaaatccaaaacacttctagtcgcaagcgtttagggtaagggatattcatctagtacttcaaataagtcttttctgaattaatgactcttcacttcactggctaaggccagtctttaagccatttctgacaggcacggtctctacttccaactctacagagctagaaaaggggcatagagaagaaacgccaaagggcacaagtagatttaaacaccactcccagcaaagctcctcagagatttcataggacccggtgaaaactcagcccagaagaacatgtctacaacagccgctgccctcaggactgtgccaaccaacgctgctctagtgagtgaaggcgggagactcagaaacaccaacaggcacttatcctttgtagcaatactgtgatcactctcatggaggactcaaggggaggaactgctggggaagtgctgacagctcttagatctgtggttccccaaccttgaccatacctcagaatcactccaagagctcattaacaacaacatggccaggtatggtggctcatgcccataatcccagcactttggaaggccaaggtggtcagatcacctgagctcaggagcttgagaccagcctgggcagtacagtgaaaccccatctctactaaaaatacaaaaattagctgggcgtggtggtgagcacctgtagtcccagctactcaggaagctgaagcacaagaattgcttgaacccaggaggtggaggttgcagtgaaccaagatcatgccactacactccagcctgggtgacagggagagactgtctcaaaacacacacacacacacacacacacacacacacacacacaccagcaagaacaacaaaagcagggagagactgtctcaaaacacacacacacacacccccaagcaagtacaacaaaagcaaaagccagattcctgggtctcaccctacacctattgcattagaatcccggggttgggcctagaatttatttttttaacttctcaagtgattgtgatgcagaaaagccatatagcagtgtccagcaattgttcatcaactattggctggaaggactagaaatacctactccatctgactccaattagattagcaacagtcaagtaaaaagctgaaaagcctccaaaataactcaaattacactacctttttggtgttttaacaaatctcaccactgaaaagctcattcttttaacttcactaaatcctcctcttttagttacagcctcattttctttgatttggtccttagtgagccctggaaacagatcatctgttagaataggtgattatagcggaaaatggaaatgcagcgtaacaaaagaaaaacaaatcgctcctgtgcggccagccatgaagcccaagttgggtcaccctgggtggcagctggatacaacagactcagcaggcaccctgcccaaggtccactcgggtctacacctctcatcacatagcccactgttctgtgcaggatcctcctgttctttgtgaacatgtttcctggtgaagaaaagtcaaatgctacccagagatattttcaggtggcatttcctgttgtgattaaacagaattatgaaatctcaatgttttcaattcactggacttcttctagactttgtgactctatctgtgataagattctgcctggccaaagatattcactaatgctttgacccctcaatggcatggagttactgattccctaagaattatattgctatttagtcacaaaaatgttaaaatccttttcctatcatggtggttttaaaacatggcccctaattctttgacaatcctttcatcatctggaaatgggattctccatattgtgaacgtactaaaatccactgaattgtacacttacaatagtcaatttaggttatataatttttacctccatttttttttttttgagacagagtctcgctctgtccctgaggctggagtgcagtggcacaatctcggctcaccgcaagctccgcctcccgggttcatgccattctcctgcctcagcctctcgaatagctgggactacaggcgcccaccaccacgcccggcgaattttttgtatttttagtagagatggggtttcaccatcttagccaggatggtctcaatctcctgacctcatgatccacccgccttggcctcccaaagtgctgggattacaggcgtgagccactgcgcccagccacctcaattttttttttctaagtgacattctatatctccttcctttgaatctgggctccatgactgcttgacctgtagaatatggcagacacgatgctgtgatttctgagcctaagccttaagaaactggcagctgcttccatttcccatcttctaggatgcttactcttggcaaccagccaccataacatgaagaagtataagcaatccttccataggtcacccagggatgaactgaggtcctggggccagaacccccagctgagctcctagctgacagcaagcaccaacttaccagccacgtgagtgagccaccttaaaagcagatcctccggccccgtgcagatccacttcaaccaaagctgtgtggaacgaagacaagctacacccttgccaagcccagcctcaatcacagactcataagcaaaataaatgcctggagatgtttaaaccatcactaaattctatgatggtctgttatgaggcaaaaggtaactggcgcttctatataatcaagagtggctggtaaaaaacagcttcagaaaatcctctaacctggtacccatatatcacagtagattctggcaagcataatcttgagcaccgaagacttcatccatacatgttcttcacaactcaactgaatcacaaactttctaacgtgttcacaccgtatcatgtcactcaaaaccatgctacagactgaaaaagaaggcaactgactttcttgttaagaaattttaaaaggaaaaaaggagtaaaaagcaagaaagctacagagcataaaatcttggaggcattcaaataaaaattatggacagctgtcaatgtgccttcttagaaaagataatgtgcggtgacatctccccactaccctcctaccctgtcgaagcgtcagggagcctgggctcaactcctcacctccagcctctctggcaggggctcattctgcaggatcctcaacgctttggcagcagcatcgtgtttcgcagcctgtcttgtctttcctttgccattaaattgctgtcctcccacagaaagttccacttgataaagtaaaggtggaactggaaatgggtaaaagtacctagaaataaaaggaggttaggcaaattacagtctcaagttgataagtcacctatacactctctggcaaatgcaagtatttccttcatcacgatcctactcacattagtgtttgatgctaatcactcttcatcaatatatccagagatttcataaaagcttaaactggattagaattgctacacagtataagcaaagagtgtttagcaatccaaacttacatctcacaaaatacaatggcttataaattatgagtttatcacactaacctgcactgacaaaatctaaaatgaattaggctttggctgagacaaaaacttggcttgctctgccttctcaaaccttagctttaaatttgcatgtctccaataggaggctgggaattttaatgcacaagtctttcaaaaggaccctcatttcaagaaatcccaataagctgtagcctacctagcagaacccagtttcttatccatttccctagcagaacccagtttcttatccatttcatagcttatatttttaaaatgactatcccccaacagagagcagggaaatgaagaattccattttgctcatcatctatccactaatgtcttttttttttttttttttttgtgagatggagtttctcttgttgcccaggctggagtgcagtggtgcgatctcggctcactgcaacctccgcttcctgggttcaagcgattctcctgcctcagcctcccgagtagctgggattacaggcacctgccaccatgcctgtatttttagtatttttagtagagacagggtttcaccatgttggccaggctggtctcaaactcctgacctcatgatccgcctgccttggcctcccaaagagctgggattacaggcgtgagccaccacacctggcctccactaatgtcttattactgccagcagaagatttttaatccatggcattttcaggtttcaattaatattttattgcaccaaagctatttacaaaacgcacaagttcaaaagtcaaaaagtacccaataatcaggtaatctacaaatgctgggaatcattgtcttgcaggaatcatgatgctatgggaatcatgtttaaatatgattcagttacacaaagcagttacaagggttatctttagccaggctgcttgagggcacaagccacactgccagcaagaaatatgctcaggccctacccaagagcagtagttaaagaagcacaaaggagccgggcgtggtggctcatgcctgtaatcccagcactttgggaggccgaggtgggcggatcatgaggtcaggagattgagactatcctggctaacaaggtgaaaccccgtctctactaaaaatacaaaaaattagccgggtgtggtggcaggcgcctgtagtcccagctacttgggaggctgaggcaggagaatagcatgaacccgggaggcagagcttgcagtgagccgagatcatgccactgcactccagcctgggcaacagagcgagactccgtctcagaaaaaaaaaaaaaaaaagaagcacaaagggccgggtgtggtggctcacactttaatcctagcactgcgggaggccaagacaggaggactccttgagcccagaagttcaagaccagtctgggcaacatacggagaccctgtctcaatgaattaaaaaaaaaaaaaagaggcgcagccaggtgtggtggctcacgcctgtaatcccagcactttgggaggccaaggtgggcagatcatctgaggtccggagttcaagaccaccccagccaacatggcaaaaccccgtctctactaaaaaatacaaaaaaaaatcagccaggcgtggtggcaggtgcctgtaatcccagctattcgggaggctgagacagcctcctcacttgaacccaggaggcagaggatacagtgagccgagactgcaccactgcactccagcctgggtgacagagcaagactctgtctcaaaaaaaaaaaaaaaaaaaaaaaaaaaaaaaagaaagaaagaaaaaaaagaaaaggcgggggaggggcacaaaggcacaagagtaattaagaccaacttcaacacttggcaggcccaaaccaaatcattactccctccacaatctagaggtactggtttatgtaaaagatcagacacgttttctcctgtattttacaaaaaaaaaaaaaaaaaaacacatacctcgggggataagcacctcctctcatgttgtagttataggtggactgcatccgagagtaagggtcaacaggcttatacattggtttttttccaagtttcatgcacagtgcatttagttctacagtaggggttatgctttctgcaagaaagaatcgacaaagaactgtttttttctggtatgagaatgatactcactaaaataaaatgtaatagcatgctttctgctaattggattcatgatactttacataaaaggacctgggtggctcactgctaggcatcagacaaggaaatccaagaatatgctgtgatttctagatatttatacacagtcgacagcacaaaatctactctgagggttaccagaggagccacaatttaacccaagacattatcagtgaaagctatatggtacagctgtcagaaataagttccaaaacacatcaaatttcacgattaaaaaatcccatgtaaatgtccaaattgttttactgtttgagaatacttaatcaatataaccttggttgtactgatttacaggattattggcttgcactcagaagtatgtccgtacacagtattgaacgatgcatttattacattactaactggatgcaaagcactgtgctaagcttaagaaacacaattcctggccaggcgtggtggctcacgcctgtaatcccagcactttgggaggccaaggcaggaggatcacaaggtcagggtatcgagaccatcttggctaacatggtgaaaccctatctctactaaaaaatacaaaaaattagccaggcatggtggcgggtgcctgcagtcccagctactcaggaggctgaggcagaagaatggtgtgaacctgggaggcggaccttgcagtgagggtggctcacacctgtaatcccagcactttggaaggccgaggcgggtggatcacctgaggtcaggagttcgagaccagcctggctaacacggtgaaaccccgtttctactaaaaatacaaaaaattagccaggcatggtggcgcatgcctgtaatcccatctactcaggaggctgaggcaggagaatcgcctgaacccaggaagcagaggttgcagtgagtcgagattgcgtcactgtactccagatgaggaaacaagagcaaaactctgtcttaaaaaaaaaaaagaaacacaattcctgccccagaggagttcaaaaaacacaaagcacactcaaagagttacaatacaacatgatgtgcaacttaaaggtgaaaaatcagtgaggaggtggcaacccaattctcttcacagaagtcacacaaggcccacaaaatattcaggtatttccattcttgacatttctaatgaatttgacctgtggtcatacttgctacgaaaatgagttccattttcatacacaacaagttatctcaaaattatcaacttcagaaaatacatgctattcattttccaatttttttttctttcagttcatccaatccataaacctttaaaaaccatttaaaaagaaaaccagcctggaaagattagtgtcagtgcacaatatttaaaaacaacactttcatatcaaaaacagaacactagaaatggcaaaatctaaatgcacataaaaatccactttaaaatgcctctttaggatgtatatagagagaaataaaaaagacctgattctgtactataactggttcaactaaatttaatgcatgaatcaaatctataagaatatctttggggtttgcacagagggccacatgaattacagatctctctcttccttgcattagaattatattttttacaaaattcatataattgcattttaagtacagtctgaatcattttaagagcagctctgatccacagaatttgtctgcaatagagaataaacatgaagaaagtatactgcaaagaaatcaaaagtaacaagaaagatgtgactggtaacttcccagattccttcctacatacgaagacctgggatgacttcatgcatgtgagggggtctctgctaaaacagccattaatgacacagcctccaggtcactgatccccaacccttcaccagccatgccttcttgattagtatgctccctgaatgggctccttgtctgaggagatactacctgctggcttgtatttaagtaatatttacatttttctcattctttttaataactaagagacatacaactggcaataagcacttctgaccaacaaaattacaatcaatattaccacactgacttgatgtgactctaaattaaacttatattcttgctaatctatacactcttatcaaaaatatattttcattaaacttcggaaatctttgaaattatctggtcacccgccatccttcctatgaccgcctttccagattgtcaggcgttaaggcatcatagattggaaaccactgctttacaatgaggttaaggattcctaaaaaataagcatttgtcactggtagtgtagaatctgtgctttcaaaatcaacaagttaagaaaccattcatatacatactacatggtacctctagacacacttttgaaaggtacctgtttggcccatgcataagacctggattccttccttcgctaccaaaagggctgactatgggcttaggaaattttgttccctccaaagctttagcagcagctgtgtgtttgacctttttaataccagttcactcagctccccattgctgatttccaagtgtcagcagtactgtaaattcctagaaatgaaaagtgtgagctctcaaattcatgaaacctgacattgactgtaatatgtcacttgaaccttgaacactttctatggtcatggtttaagaggcctggtcttatcttgataattcatcctgtcatccccttcttatccttttttgttgttttttataaacaacaacaaaaaaaagagattgtgtgtgtatgcactgaaatttttttttttttttaagagacacagtctcactctgtccccaggttagagtgcagtggtgtgatcttggctcaatgcaacctccacctcctgggttcaagaaattctcctgcctcagtctcccgagtagctgggattacaggcacctgccaccatgcccggctaatttctgtacttttagtagagacagggtttcaccatgttggccaggctggtctcgaactcctgacctcaagtgatccacctgcctcagtctcccaaagtgctgggattacaggcatgacccaccacgtccagcctcaaaattctcttccaattacttctcatgaaagatattttgcaaacttgatttaaacacacagcagtacttcacacaaattaagacaatgtttgttttgatgctgcaatgtgtttgtgggctcttgtttgaaaacataaccaccctttttttcagtttttgaaatggggtcttgctctgctgtccaggctggagctcaaatggcacaatcatagctcactgcagcctcctgggttgaaataatcctcccacctcaacctcctgagtagctgggactacaggcacacaccaccatacttggctaattttttttttttatttttttgagacagtcttgctctgtcgccaggctggagtgtagtggcatgatctcagctcactgcaacctccgcctcccaggttcaagcgattctcctgcctcagcctcctgagtagctgggactacaggcatgcaccaccacgcccagctaatttttgaatttttagtagggatggggtttcaccatgttggccaggatggtcttggtctcttgaccttgtgaactgcccgccttggactctcaaagtgctgggattacaggcgtgagccaccatgcccggcccatacctgggtaattttttaatttttgcggaggcagggtctccctatgttgcctaggctggtcttaaactcctgggctccagtgatcctctcgcctcagccttccaaagtgataggatttaaggcatgagcgtttctatttttattaagttctcaaagtaattctgatgcaccccaaagatttgagattcactactttggaatttaacaaatcaattgaagcggccgggtgtggtggctcacaactgtaatcccagcactttgggaggcagaggcgggcagatcacctgaggtcaggagttcaagacccgcctggccaacatggtgagaccctgcctctactaaaaatacaaaaattagccacgtgtggtagtacgtgtctgtaatcccagctactcaggaggctgaggcaagagaatcacttgaacccgggaggttgcggttgcagtgagccgagaacacgctatggcactccagcctgggtgatgacagagtaaaactccgtctcaaaaaaagaaaaaattaattgaagcttttattcttctgatgtaatcactgaatatcactttatctcacttacaaataatttacaagggaaacctggatttcagtatgtctaggtcatttaaatttggtgccttaaggggtgaggcaacttgccttcatagctgatttttcttgtaggtcttacttttaggattccctcagtgcacggcttccactaaaggaaaaaaacaaagaatcctttattggccaggtgcagtggctcatgcctgtaatcctagcactttgggaggccaaggcaggcagatcacttgaggtcaggagttcgagaccagcctggcctacatagtgaaaccccatctctactaaaaatgcaaaaattagccaggcgtggtggcatgcacctgtaattccagctacttgggtagctgaggcaggagaatcacttgaacccgggaggcagaggttgcagtgagccaagattgcaccactgcactccagtatgggcaacagagactccatttcaaaataaaaaaaagccgggcgcggtggctcatgcctgtaatcccagcagatcgcgccactgcactccagcctgggccacagaatgagactccatctcaaaaataaataaataaataaataaataatcctttaccccccttgacacttcacacatcaggacatcaggggtctcctttattatatgttctgcagtccatcaggctactcatttaagtacaaacaacagcatgaactcaaaaccctggcaggcaggaaggtcaaatggcagaagcctgcaacgcagtacaatccctgggtcatcttggtgattgtctcatggataaatgctgaaggggaaaaagctaaaaaaaaaaaaacacacaaagttattctcgtgaaccgtcttgcctttctctaggactttccccatccggtgctacctgccactctgctgcattctgttggtgtagcaaggctagaatcttggttttgatagaaccaaaagtataccacatctcttgatttttcaaataatctaaatcacccaagagagaacaacttctcctctttgaacaacttgtgggtaaaaagaaaatatgcggttagagatgaacacacagccaaactacctaaattattaaaagttcaagtgagaaagtgcattagccaaaatataataaaaagttaataaagggaatcccgaagttaaggtctgcaaaaaaatcctggagaggaaatacaacagttatagaaaaatgactgacttctatttttattttaattaattattttttgataaagggtctcactctgtcacccaggctggaatgcagtggtgccatctcagctcatcacagcccccacctcccaggttcaggtgattctcctgcctcagcctcctgagtagctgggactacaggtgcgcaccaccacatccagctaatttttgtgtttcttggtagatacagggtttcaccatgttggccagtctggtctcaaactcctgacctcaagtgatctgtcggccttggccttccaaagtgctgtgaatacaagcatgagccactgctcccagtccctagttgcctaaatgtgtctataaagacacatttcaaatagaattatgttttaaaacaacatttttaagctagttttgtgtgagtggtaaatactgtttttcttaaatgcttaattaaatgcttaatcctgcctcagctacccaagtagccagaattacagctaccatttctcaagcatttactaggcattgtgctccacaggttaacatatatgctctcatttaattctcacaataaacctatttggtgggtattatccctgttttacacatgaggaaacaacgacaacaaaaaagtagtaacttgcacaagatcacacagctagtaacaagctgagactcaaacctagatgtgtctgacttcaaaggcaactgaaccgtattatgctacggtgactattcatgtttgtgccttatgttactttcagtcaaatgaaaagaaacacttgattttattcaaggcttgaggtttgcgtgtgaaggaaaatgaggcaaaatgagataaataactcatccttaattatattatctttgctgcaaggttaggatcagaaacagacagcgtcaattccttatctctcatactatatcatcttacgctacagctgcaaaagacaactccgtatctccgtgtccttagatggttgggaaaaaagttaactccagatatgcaagaattaagttccagaatgtgctgttaatacagataacaaacaagtttcaaagactgaattatttttttcctttccatgttctaaaaagactgaattcttgaataatgattagcaaattttaaaattatagtcagactttcattctctaagataaggggaatgacaaggataactgaaaccaaagacaatacaaaatactcactttgagactacatggtgaaaccccgtctctactaaaatgcaaaattagccaggcaattgcatcttcaaaccttttgcccagattgctaacaagtgaaaaaactgttttcccatcacctcttctccctgccctaaggtccttgtgcaaacaagcaggagaggagccagaagtaagctgcagacaagaggtggcccaaagctggaaaacttacgggcaatcaatcacaggtgcttgagaattgtctctgttcagaatcccaaacaaccatacactatttggagttttaaaagcaaaatatggccaggcggggtggctaacacctgtaatcccagcattttgggaggccaaggcaggcagattgtttgagcccagcaactcaaaacaagcctgggcaacatagtgagacttcatctccacaaagaattaaaaaaaaaaaaaactagctgggcgtggtggcatgcacctgaggtcccagctactcaggaggccaaggtgggaggattgcttaagcctgggaggtcgaggctgcagtgagacatgatcacaccactcactccagcctaggcggcaaagaaagactctaaaaaaactaaaacccaaatattccaaaaagcaacacatattttctttgacccattggcaaggatgaaaaaagaagcaacttcaaaaatctataatcttgtctaagtatagtttttgtttaagacaacctcatcagtttgaaaacatgtattttgaattacagcaccactttcaagagtataaaaaatagagaacattccaggtgggttataaatgcacaagcagtatggacaatatttaccttacagtgagctggaccttgctcacacaaaagcctatactcaagctggatcttgctgaaacaaactaactcattcacaagacacaactgggatttttctctatggggttcgccacatgagaaggaagtgaaaacgttaagagcactgaagtcaactagcagtatataagactactattctcctagggatatgaaaatagaggaaaaacaaatggaaggtctacaaatgtaggcagccatgatacaaaactgcaaatcattccaggagtacactcccagagaagacgcaactagggtcttttctgaaccagttgaagccaggtaatctaggagagggtgtgtcttcaaaagagagtgaagtcaggggagtaactaacccatggcaggcaagcaagatttgaaatcagatgaatcactgctattaaaaccaactggaatacaaggtcttctgagcagacactggttactgaaacagccgccagctgtaccccgcccattatttcgctaaactcaacatgccactaccatctctcaaacaacacttgtcatcttccatacagtgaaactctcattcctgggcatcctctagtcttttctccaaaggctgccatcctcagaccttatctatttctaacaattatataaataaaataaaatgatgttggtgggcaggagttttacaaagtcaataggatttggacaccagaattcattagaagaaaaagcaataaatcccagaggacggaaacagtctgtgccttttccttttaagagagtctcacatggcaaatatggggaaaataacatctctccaggactacaaaaaatcaagaatgctatctggtgaaccagtccaaggaattgtgggggtggcatggaagatgccacgcagctgagtgggagaagcaaacactctaagaacagatttataggccagacatggtggctcacgcctgtaatcccaacactttgggaggccgaggcaggcggatcacgaggtcagaagatcaaaaccatcctggctaacaaggtgaaaccccatctctactaaaaataccaaaaaaattagccgggcatggtggcgggcgcctgtagtcccagctactcaggagactgaggcaggagaatggcgtgaacccgggaggcagagcttgcagtgagccgagaccatgccactgcactccagcctgggcgacagagcgagactccgtctcaaaaaaaaaaaaaacagatttataaagtaaaggaaatgagaagacaaaggaggaaactgaaaggaaacaggcacaaggaaggggatgaaaagactttgttataaggtaactctggtatagaaatacccacatactaggctggatgtggtggctcacgcctataatcccagcactttaggaggccaaggtaggcggatcacgaggtcaagagattgaaaccatcctggccaacatggtgaaaccccatctctactaaaaatacaaaaattagctgggcatggtggcgtgtgcctatagtcccagctactcaggaggctgaggcaggagaattgcttgaacccgggaggaggaagttgcagtgagccaagattgtgccactgcactctagcccggcgacagagcgagactccatttcaaaaaaaaaaaaaaattgacactgacaccccatttatttcactggtcttgccatgttgcagggagggtgttgggaagcagaatattgtttttatttattatccccactccctttttttttctagtcagaccctgtctcctattcataagaatattggttttaggttttctttctttagccttagtttcttgtctataatatttttaggtatttttcaagtgtttaaaccttttttttttttttttttttttttgagatggaatctcgctctgttgcccagactggagtgcggtgacatgatcttggcttgctgcagcctctgcctcccaggttcaagcgattttcctgcctcaccctcccaagtagctgggaatataggcacacaccgctacacctggctaatttttgtatttttaatagagacagggtttcaccatgttggccaggctggtctcaaactccagacctcaggtgatccacctgccttggcctcccaagtgctgggattatgggcatgagccactgcaaccggcaaggtacctttagttcattttcctaattatcagatttgaatgtttctatactttttgttttgagtcagtctcagtctgttgcccaggctggagtaagacagcacgatcacagttcattgcagcctcaaacttctgggctcaagcaatcctcctgcctcagcctcccaagtagctgggacaacaggtgcacaccatcaagcccagctaatttttaaattggcctcgcagcctggcacaatgactcacacctgtaattccagcaatttgggaggccaaggcaagctgatcacttgagatcaggagttggagatgagcctgggcaacacagtgaaaccccatctctactaaaaatacaaaacagccgagcgtagtggcaggcacctgtaatcccagctactcgggaggctgaggcaggagaatcgcttgaacccaggagccagaggttgcagtgagccaagatcacaccactgcactccagcctaagcaacaaagtgagactctgtctcataaataaataaataggcatcccaaaacactgaaattacaggtgtgaaccaccttgccagccaagaaggagactttttttcttttgagacagggtctcgctctgtctcccaggctggatggaatacagtggtataattacagctcatggcagcctcgacctcctggactcaagtgaccctcctgcctcagcctctggagtagctgggaccacagctcagccaatttttgtatttttttttttgtatagatgggatttcaccatgttgcccaggctggtctccaactcctgggctcaagcaatctccccactcggcctcccaaagtactgggattacaggtgtgaaccaccacgcctggccatgacgcagaaaattttaacaagaaaataaatttgggcattgtagctcacacctataatccagctattcaggaggctgaggcaggaggatccacttgagcccaggaggttgatgctgcagtgaaccataatctcacactaccgtactccagcctaggcaatagagaccccgtgaaacaaacgagagataagaaaggaaagaagagaaaaaaaactctgcttctttattccatttctaattgatcctcattatgatttctaaactacttctggaaccttccagacttaaacttacttgttcaaaacaaaaataaaaataaataaatgtcaatgtacttttttgctttctagtaaatctggctgcccccttgcttgggataaaatcttacggacattcaaaaagaaggcttatgtagatttaagagctcttcgtcagttgtgggaattttatttatttattttttatttatttttgagacggagtcttgccttgttgcccaggctggagtgcagtgccatgatctcagctcactacaacctctgcctcctgggttcaagtgattcttctatatcagcctcccgaatagctgggactacaggcacgcaccaccatgcccagctattttttgtatttttagtagagacggagtctcaccatattggccaggctggtctcgaactcatgacctcgtgatctgcccgccttggcctcccaaagtgctgggattacaggcgtgagccaccgcgcccggcctattttttctttttttgagacagtgtctccctcttgcccaggctggagtgaagtggcacagtctcagctcactgcaacctccacctccagggttcaggcaattatcctgcctcagcctcctgagtagctgttatgggcgtgcatcaccaagcccagctagtttgtgtattttttgtagaggcagggtttcaccatgttggccaggctggtctcaaactcctgacctctgctgatccacctgcctcaacctcccaaagtgctgggattacaggcgtgagccacggcacctggcttgttctgggaaataattttaaatgcagaattatcccatacaacgatgaatatccaaggtggtatttactgctcaattctttctgccagccaccgctctttaacagatgaggctttatagtgtgagtagttttcagctttcaattctctttctcacaacctacaatcgtctgtcaactgaggcccctgtcaaccccttacacaaccagtgttctatatctgggataaagaagtgtgggtggtgatactttcttttgctttttgaaggtaaatgtgagagctccctaaatctgcaacctatcagatcagaaaacagggtaagaaaacatttgaaatagaagacacttggattcatatgcttacctgcagctgcactggtggatgtaatagatgcagagggtaaagcagagttttgaatgggtctacctgcattttcagagggcagagagctagtagtagaaggaatactcatcaaaggctgtgagagaagagactggttcttgttcagtatttggctccctgagagagcagcagatgggttctgaacttgcacttgaacttgagacatggtcactttcaacaaaagtgaacaaatgcaggtaaacagctttcagtgcaggttaattcagtgctatgaagtctaaagttctacctaaaagttgtaagggaaagaaaataaaaaggtaaattatagaggagatatgtaattgccaatattcagtcaaaatggtgtcacctactgacttatgaaaatagctccatttagcatgtagctatgttgatttattcgaaatatgtttctccttggtatacagtaagtttcttggccttgtgactttcccacagtgttttttaagtgatttacaatacctgtgtgctctgcatattcattatacaaagagaatcagtagggtataatatttattggtgagtattaagaattgcaaactatagcttacattcaaaaatgcaaatttgaaagtatggagaggtttccatagtaattggggcacagtaaggtttctttctggtctcaaaattacaagaaactgaaagcaaactaggtttatcataccaggaacaggtgaatgtgaacactgcttcctcttaaggaccaaggctcagactgacaaccttagggccttaagttgacagaaggaaggtaggatacttctgctgtttctttttctttatggtgatgagagatgtattgttttcctaaaaggcttgtttgaggtctcatttaattatagaacccaaacaaggaaactatcacaaccctacccaggctcacagatcctgagaagtgatgtgagtaacaaagaccatactagagaatttatactattaaaagcaaaagtggagatgaagaagacaggaatggattttagactggcaattttactggtgtggttgggtgggggagcactggagcttgtttacttcatattgtaaattaagagaataatgaaggcattacttctaaatacattaaatttcttcacgagacaaaaataaggacagttgtgttcattttcatggccatcctttaaaagctgaaaatgtttttaatgagtcaaagtacttaaaaataaccagtggcaacaaagaacagaaatgacaggtctctcaggaaatagccaaccaatgcagaaaccagcaaaccaactaattagaagttctattataaagaaacagttactttaattttttttaagtatcaaaatgatttttaaagctggtcctcaagaaagagatgaatgaccagagcaattaagctacttgaggagtcctaacacattctctcttactgagagcaaaaaggactgcaaaactcaaaagaaactcaagcgaaatgtgactctggatagcagaggcataagtattaccttattcaacaaaattccccaagagtgcagttgttcctttttactttcagaatcagaacaaaataacagaggcgttccattgaagatctacataatggtcttagaagacaagtcgccagtgtcaagaaacaagtccagaaccattcagaagtcagctatgaccttatttcattgggttttttttccgtcagctgctaaaatagaaacacttttttcctcctctcttcccctctcttcatttattcactcactcctccttttcctgctttttgtaaactatcttgagagcactttttaaaacaaaaaagtcacttgtgtatgtacgacttcacaacaccaaccacaggtctcaaggtcaaaaaatgagctaggagtaaagtatctgctccagaatctacccccatcccagaaagagcaacccaactgtgtcctgagtggctcttagagtttaagactctgaatgaatgcctaaatttagaaagggtgtggaccaagggatttttggttaatgttctctaaagcaggctgactgccaggatttcaagtcagtgataaatttttaattttttttttttttttccgagacagagctttgtcgcccaggctggagtgcagtgttgcaaacttagctcactgcaacctctgcctcctgggctcaagcaattttcctgcctcagtctcccaagtagctaggattacaggcatgagccaccatgcctggctagtttttgtatttttagcagagacagcatttcgccaggttggccaggctgctctcaaactcctgacctcaggtgatctgcccacttcagcctcccaaagtcctgggattacaagtgtgaggcaccgcactctgctcaagtcagtcataaatatgtaagttttctagaagctgagaaaggaataggctttttaaattaagactgcctcaaaaatgttacccttaaattcacttaaaggacttaacatctaacagttggttgaaatatgtagttcaaaacaaaacaaaccaaaaaaaaaaagttaaactctccaaataagactaggtaaatttaaatttccaacatgataaatatgaaaatgcaacaaacaatactcacaaattattagtcacctgctagtttaaaatttttatgtgtcttatttaagcctgaacagagcatctaaggtagtgattctcaaaagggagcaattttgttcccccaggagacatctgccaatgtctggagacattttttggttgtcacaaccagtgtgcagaatggggaacctactgatatttagtggatagaggagccagggatactgttacaagcacacatatactaacccacacaatacaatcttactaatgtaacaagtagcttatattcttagacaggaaaagaaaatcccctttctatctcgaaaggccctaaaaaatagatgctaattttttttttttttttgagacagtctcgctctgttgcctagggtggagtgcagtggtgtgatctccgctcactgcaaactccgccttctgggttcaagcgattttcctgccttagtctcccgagtacttaggattacaggcgtgtaccaccacacccggctaattttgtatttttagtagagacagcgtttcaccatgctggccaggctgatcttgaactcctgatctcaagtgatcctcctgcctcagcctccctaagtgctaggattacaggcatgagccactgcgcctggcctgatgctaatgttttagcacccaaacagatgctcctctcccaaagagaagccggaacagacatcacagtgatgaatgggggaaaatatatcatttgcccacataactcaaggaacaaattaagtttttcattactgatatagatatagttcatagcagccttcaaggaactgtggaactttggaaatagaacttctgtgtaaattctaaacctgttgctcaacagtactgtcctgaagactaagtccttaaatgcaaataagtcttttcctttaaacctgtctttaaggattgttttccaccaggtaaattaaggacttgagagatcaaaatgttttgttagagtcttcttagagacaaacactattttatacacagtaaaattaggttgagaagtttgaaacgcaaagattcttcagatctcgctggtgctggaaaacacctcttactgtgaattgtgttgtgctgccattttcctgcctttctgcctcccacacagatgaggacctttcatctcctggttctttccctatttgaagggctttagacaccagatcaacaaaacatactcatcttaggctcaagccctaattttacatagcatacataagcaccataatacaagctgcaaaatgatagagttataggtgtttcttttaaaagattccttaattccatgtcctcctggttcttaagattggcttggtaacacaaaaatcttctcataaaaacagaatcttgctttggctggcagttaccgttttacaagtgccaaatagtttctatgggttgtggtgaaggagaatctgggcacatgagcgctacgaaagttttttttaaattatacatgatgtactaaaaagtggtcacaaaatgtgtattcagcactcagcagtgaacctaccaagactagaccatactgagcacagtccgagtgatttaatatacaagaaggcagacccttctagaaatggtttacagaactatctgcaatcgtgcttagtcttttaattatcttgtgctactaatacatggttagtcttatccactttcaacttacagactgttaaatctttgtactatgaaatacttaagcaattatggaaaaacattttttttctggagacagtctcactctgtcgtccaggttggagtgcagtggcacgatcttggctcaccgtaacctctgcctcccaggttcaagtgattctcctgtgtcagcctcccgagtagcgggaactacaggtgtgtaccaccacacctggctaattattttgtgtttttagtagaaatggggtttcaccatgttggtcaggctggtctttaactcctggcctcaagtgatccgcctgtcttggcctcaacaaagtgctgggattatagacatgagccaccgtgcccagccagaaaaacatttttaataagtaatttttaaaccggattaacacaacttataatgcagtagctatacttttgtttaatcaacatatcagtctccttcataataagtgatatttccaaacaagatgtgtctgggaaaaaaaaaaaaaaaaagaaggaaagaagtcatcccaattctggagaagcctccttttcagatcatcacaaacatttcactaaatgtctccccttgcaagtcctttggtaaatctgatgtaagatggatatacagatacaaaggagcactcctgtgcctcgctgttataaagcaatagcaattctaaaatatattcactcaatagtctacaaaaacttattaagcatctattacatgtgaacccataaatggcagattgcacattcttaaatgctggaaaggatctgtgtgttaaactcttcctcaaagacacaagacgacatctttcagcaatcacatgtaaatctattattctgttctctttagtttgttgagaggctccactcccagagaaacttggtcaattaaaaaacatcaaggaataaaccactttttctacaaaataaagtccttttcaatagcctttaaatacacctaaaatacccacatcattccttataccagttatttatttatttatttttattgagacggagtctcgctctgttgcccaggctggagtgcagtggcacgatctcagctcactgcaagttccgcctgccaggttcacaccattctcctgcctcagcctctccaagtagctgggactacaggtgcccgccaccacgcccggctaattttttttttgtatttttagtagagacggggtttcaccgtggtctctatctcctgaccttgtgatccgcctgcctcggcctcccgaagtgctgggattacaagcgtgagccaccgcacccagcctataccagttatttctaagattcttttctgacacatctttcttgctgcaatatggttgaatgttttctgaaagtaaactcactctccaccattacttctccctcccagccccccaaaatagtaattcattgactccaaacattatccaaatacctgcaggcagggcagacgctagtacagaagcatgtcaatcactatcgtcttataggatcatttccaaaatgaccgctttaaggtcaatgtcaagcaaataatgtccaatagcaggcctatatatactaaatcacccaataataaaacgtttttgaaaagaaatatgaccaaactactttaaaaaaaaaaaaaaaaagaaacaaatcactaagtacctgatgctcaagacaaagacagagattagccctgaggaggcacactcacttgcaagacagtaaaattaaccaaaaataatgcctggaaacaacccaggctgttcaggatctttgcacttgcaatacaagtgagactgaatgtggtccctgtctcacacttggcccaatgccatgggcaatggaggactttctttccacacaaatgtaacagttgggaggtcagatggtctgcttaaagaaacacttcctaaaagagattttcattattttcatcctagaaaacccatcacaccatgctaaagtgaaaaacaatttacctctatagcctaaaaaactataagccttattttcttttctagttttaaaactttatcaagcttccgtctctccttctctaggagacattctcaaaaataacaaaattcaagcacatacatttgtaaacagtttttaatctaaacttatacaaacatagaaaacttttaacacaataaaaatgaatacctgttcatgatctgctggagacttttaaaagtagttctgtgtgatattttcttgactatgaaggggcttggttcaacataatggttaacaggcttttcctttcagaaaagggaaactgtaatctgtaaccatgtgccatctacctagaaacacgactgcatttaccaccatcttcatgcaaaacagaccagtgccaagactcagtttctaagaaaccacccttgctgctaagtagcaaccaacaatgttaaatcagatcaaacttctgagatgtagctttcaattccactcccagctcttggcaatccactcccctgtgcctcagtttccccaaaacactttataataggatatttgacaaagcctcacttgtagcaatcactgagtcaaaacactaaaggaatcctgaggcatgataatacattttttttttttttgagatggagtctcgctgtgttgcccaggctagagtgcagtgaaacaatctcggctcactgcaagctctgcctcccgggttcacgccattctcccgccccccaacacctggctaatgttttttgtatttttagtaaagacggggtttcaccgtgttagccaggagggtctcgatctcctgacctcttgatccgcccaccttggcctcccaaagtgctgggattacaggcgtgagccactgcgcccagccgataatacaattctttaaaaagaaaagcattaggccgggcacagtggctcacgcctgtaatcccaacactttgggaggccaaggtgggtggatcacctcatgtcaggagttcgagaccagcctgaccaacacggtgaaaccctgtctctactaaaaatacaaaattagccaggtgtggtggcacacgcctgtaatcccagctacttgggaggctgaggcaggagaactgcttgaacccaggaggccgaggtgagccaacatggcgccattgcactccaacctgggcaacaagagcgaaactccgtttcagaaagaaagaaaagaaaagcattatacaaatccagtgtggtgagtttaaaaccattcactgagctttgtacaacttcaataatttccttatgcttccatttcctcatcctcaaagtaggttaacttgtctactaattactacctcagagatatggtacagcaatgtgctttcagcttctagagggaaagtgttaaaagcaggaagcagtattaacccacatagtgtattttgcattgccctgacaaaagaccagaaaatcttgaacactcttagaaaactccttttttatctgaatgttcacaagctgctagtggtcaacgaagcttgattcgtaaccctatctcacaatagaaaacaatgctaaattcgttctatgagtttgaaaatcatgtttaacataaacaatctgagaaatcaaagggtttttttaaaaaaagcaaactacaaaagatactatgaccaagaagcttattgagccagtcatgtttaatgacagcttcagtcatcaattctcatgtctctatatttaaagaacataggctttacattcttgccaataacttttcctgtacttactttctaattaaatcaagagtaaagatgaaattcaaactgcataaaatttgtttctctaatattatagccagaagtaaaaatcattctccacacaactcattaaagaattcaaaagtaccactgattatcaacaggccagaaattataaagccaaattatatgtaccttttttaaaaagagggcgttccaggaacaatgttgtctttgttcagttctgagaggttaagtggttaataaactctggaaaataaaaaataataataatttagtagggtaggtcttttctctgaaactgaagacatactgctcaagttttggggaaacctataatttacaagtagggaagactgaaggcatgacgtcatggtttgaggcagcatgcagtagagtcttcaaaagacacaagcggccagacatggtggctcatggcctgtaatcccaacactttgggaggccgaggcgggcagaccacctgagacccggagttcaagaccagcctggccaacatgatgaaaccccatctctactaaaaatacaaaaattaggctgggcatggtggctcatgcctgtaatcccagcactttggaaggccgaggtgggaaattacgaggttaagagattgagactgccaggcatggtggcgcacgcctgtaatcccagcactttgggaggccgaggcgggtggatcacgaggtcaggagatcgagaccatcctggctaacacggtgaaactccgtctctactaaatgtacaaaaaattagccaggcgtgatggcgggggcctgtagtcccagctacttgggaggctgaggcagaatggtgtgaacccgggagacggagcttgcagtgagcagagatcgcaccactgcactccagcctgggtgacagagtgagactccgtcacaaaaaaaaaaaaaaaaagagattgagaccaccctggccaacatggggaaacccatctctactaaaaatacaaaaattagctgggcgtgatggcacacctgtagtcccagctacttggcaggctgaagcaggagaatcgcttgaacctgggaggtggaggttgcagtgactcaggatcgcgccactgcactccagcctggcaaaagagcgagactccgtctcaaagaaaataaataaataatacaaaaattagccaggcatggtggcgcaggcctgtaatcccagctacttgggaggctgtggcacaaaaatggcttgaatgcaggaggcagaggttgcagtgagccaagatcgcaccactgccctccagcctgggccacagagtgagactcctctgggaaaaaaaaaaaagacacaattgcctggaagctgggtgaagaatattttgcagagacacatttataagagacagcagaactttccttttccagtcccaattattccctgatgagagtaatatgaatatctcataatgtttaggctttgtttgttcaggtttttttttgagatggagtcttaccctgtcccccaggatggagtgcagtggcgtgatgtcggctccctgcaacctccgcctcccgggttcaagcaattctcctgcctcagactcctgagtagctggggttacaggtgcccgctaccacgcctggctaatttttttatttttatttttagtagaaatggcagggttttgccaagttgtccaggctggtctcgaacacctgacctcaggtgctccacccacctcagcctcccaaagtgctgggattacaggcatgagccaccacacccaacctcataatgccttttttttttttttttgagacggagtctcgctgtcgtccaggctggagtgcagtggcgcaatctcggctcactgcaagctccgcctccagggttcacgccattctcctgcctcagcctcccaagtagctgggactacaggcgcccgccacctcgcccggctaattttttgtatttttagtagagacggggtttcatcgtgttagccaggatggtctcgatctcctgacctcgtgatccgcccgcctcggcctcccaaagtgctgggattacaggcgtgagccaccgcgcccggcaataatgctttttaaaaggaactgtacattacatatcgtccgatcacataagactgattttcaaacctgtgttttctttccctttatacctaccactttattcgtaaatgtcgttggcatatgcttggtgacccaaatacaattttatggaaaattttaccaaaaggcattgggtacataaatagtggcatattaaattgcagaatatgaaaaaagcacattatctctaataagtccaaatcataatcatttttagaagtgaactttacattacagaatttgagtttaattctcaaattctgcggtctgatttatctagaggttcctcaacttaaatggtagttgtcagtagtaacacagaatttcttaccttgagatgcttttatacattcttacaacactaagtgtttttgcttgtttcagtttctcactgctactatggcttaacaggcaataaaaaattgctgttcattgtctgattgattccagaaataaatcatgagctctagtttattttctggtattttaacagctcaggttcttttcatagatagtatattatactaacaactttccagtctagagctcagttgttctaatatctcagctattcaaagactggcatgaatgggaactgaaaaaggcctctgagcagcccaaataccaaagaccttctaacatagcccatgccttttaccaataggggcctcacctgagccaagaagttttctatgttgaacaatttttgtaagtttgggtgtctagtttttgttttgtttccaaattccctatcccctattctgagaagcagggtgtctagtttttttttttttttttgagacagagtctcgctctgttgcccaggctggagtgcaatggcgtgatctccgctcactgcaacctccgcctcccgggttcaagcgattctcctgcctcagcctcccgagtagctgggattacaggtgcatgccaccatgcccggctaattttttgtatttttagtagagatgggtctcaccatgttagccaggctggtctcgatctcctgacctcgtgatccgcccacctcggcctcccaaagtgctgcgattacaggcgtgagccaccgcacctggcccagggtgttcagttttctagcccaaagcagaagtaaaaaataaaggccaggtgtgatggctcatgcttgtaaccccagcactttgggaggccgaggcaggtggatcgcttgagctcaggtgtttgagaccagcctgggcaacatggcaagaccctgtctctattaaaataaaatttaaaaatttaagggccgggcatgtggactcacgcctataatcccagcactttgggaggccgagggtggcagatcccgaagtcaggagatcgagaccatcctggctaacacagtgaaaccccgtctctactaaaaatacaaaataattagccaggcatggtggcgggcgcctgtagtctcagctactcgggaggctgaggcaggagactggcatgaattcaggaggcggagcttgcagtgagccgagatcacaccactgcactccagcctggatgacagagtgagactccgtctcaaaaacaaaaaaaaaattttaaaacacacataaaaaaagctaaatataagaacggaaaaaggagctgttagagtcagacataaagacaatgctaaaaaataaccatcatcaacttagcaaagaaagaagagagagagagaggggagaaatacagcagtcatttggatctcaaatacttttacacagtgatagctgagattcatacaaacattcatgttttggccaggtgtggtggctcacgcctgtaatcccaacactttgggaggccaagacagaactgcttgagcccaggagttcaaggccagcctaggaaacagaggaagaccccatctctccaaaaagtttaaaactagctaggcatgatggcatgcacctgtagtctcagctacttggaaggctgagatgggaggactgcttgagaccagaagattgaggctgcagtgagccctgagtgcaccactgcactccagcctaggcaatgaagcaagactccatctcaaaaaaccaacaaaaatgcacatttccatatgcaaatctattttttgaaatcctccaatttcaaaagataatccaaagccatcatgatcattatcaatatatctatatagtgcacacttaccactgcaattttccccagtcaagaatgcatactaaaccaggcaccgtggctcaggcctgtaatcccagcactttgggaggccaaggtgggccaatcacctgaagtcaggagtttgaggctaggctggccaacatggtgaaatcccatctctactaaaaatacaaaaattaggccggcgcagtgactcacacctgtaatcccaacactttgggaggccaaggcaggtggatcacctgagatcaggagttcaagatcagcctggctaacatggtgaaacactgtctctactaaaaataaaaaaaaattagtctggcatggtggcacatgcctgtaatcccagctacttgggaggctgaggctgaacaatcacttgaacccgggaggcagaggttgcagtgaactgagattgggtcactgcactccagcctgagtaacagagcgagactctgcttcaaaaataaaataaaataaaaatataaaaattagccaggcatggccgggcgcggtggctcacgcctgtaatcccagcactttgggaggccaaggcgagtggatcacaaggtcaggagatcaaaatcatcctggctaacacggtgaaacaccgtctccactaaaaaaaaaaaaaaaaaaacaactagctgggcatggtggcgggcacctgtagtcccagctactccagaggctgaggcaggacaatggcgtgaacccgggaggcagagcttgcagtgagtcaagatcgcgccactgcactccagcctgggcgatagagcaagactccatctaaaaaaaaaaaaaaaaaattagccaggcatggtggtacgcacctgtaatctcagcttatcgggaggctgaagtgggaaaatcgcttgaacctgggaggtggaggttgcagtgagccgagatcacgccactgcactccagcctgggcgacaagagcaaaactccacctcaaaaaaaaaaaaaagaagataaaaagtagcaaattatagaaagtcccttatgcaaaagaaagcttatttcacttttattcttttttatgtttggtgcttgaataaattctcaactaaaaggaaaattactatacagaagtagtcacttgctaaacattacaggttgcaaaggtttactcaatgacaaaccaaaaggaaacttatttgcctaactatatttgactgtcatctaggtaaagggtcatggagctttcatgagcaggttggttcaattgtgcaacaaggaaaataagcttccaagcataatgagacttattattacatataaattgttctttctgacagaggaaaggactgcctagcattctgcataaaatcacaatggcttcagcagacaatggccctatttgaatcagggtggaatctgcaagggtagaaaattcatgcctcagttaattgtaatctatagaaggcatggatttcaaaacagcaaagataggagagaatcagacaagatctagttagatcctaaagctcatctctgaagggagctaatatagtgacaatgtaagcagcattatctgctcacttcatgccaaggggtatttccaacacctattagtgattaatgagacatgctatgtcattacagactacagggtagcctcagttgaggttaaacacaaaatggaacttcagacaccatttcactaaaagctcacatccaaaggcagatttaatttcactgatccagcctttcaagactaaccataagagaagactgcccaggtggaataccaaagaagcttctgattcagatcaccgtttcaaacaaaagtaaaacaaaattgttcaggaagcagttcaattccaaacaggaagctgtactaaatactcccaacagtattagccacaagagggatgttagaaagggctaggaagcaaagaggacaaccagcacctatcctataaagttaattggaagcttagttaactcatttccactaaagcagaatgttagaattcagaagaaatgaatttttttttttagcaacaacctggactacagttctttttttttttttccccccctggatacagagtcttgctctgttgcccaggctgaagtgcagcggcacgatgtcaggtcactgcaaactccacctcccgggttcaagccattctcctgcctcagcccccggggtagctgggattacaggcacgtaccaccacacccagctaatttttgtatttttagtagagatggggtttcaccatgttggccaggctggtctcgaactcctgacctcaggtgatgcgcctgccttggcctcccaaagtgacggaattacaggcgtgggccaccatgccagcaatttttaacaaacctgatgacacacgatagcagtaatttaggagctggcctcctttaacacaaaggttaataagacagcccctccccacacacaaacctgtggatcagctttaagttttagcttaatttgacataacaaataaaagtaaactggaaagctatttcaagggtccatctaaaagactattacttaaccagactttctttcaaattgatctagggttctaatgagcaaaattcatcctagctgctgcggtggggagagtcaggggagggccaccagtgacaagcagaatcaattatcctaaacaaaaagcacctaagcataatttagagacaaagcatggttcagtggaaagaacactgactttggagccagaccagcctgtgctctagaactaatacttggtgcctcaggactctgagccagttatctggcccctcggaagcgcatcagcatcctcagcaattattatgagctttacgctgcaaagatgtttatgagtattagaaatacaacataaagggtctaagaaacccttttctttggttcaaggaaagagctaaatgaactgcaacttttatattattaggtaaattcaacctgaccttttaattccttttctgcataaaataactttcaccctgtaattctaacctggcacatggtaagagctcaatagcagtaaatattattatccagcaaattcactaaacctgtccttacacataaacatctataaaacttacagcaacactccacttgtaaaaaattttaaataggatcagagaatatgctgactaaaaccaacccactcactgagcaaccagttctgtagctacatcaagtataggggcaaggccgggaacagtggctcaagcctgtaatcctatcactttgcgaggctaaggcaggcggattgcctgagctcaggagttcgagaccagcctaggcaacatggcaaaaccccatctctgctaaaaatacaaaaaattagccgggcgtggtggtgctcaattgtagtctcagctactcgggaggctaaggcaggagaattgcttgaacccaggaggtggaggttgcagtgagccgagatgatacctctgcattccagcctgggcaacagagcaagactatctcaacaaaaaaaaaaaaaaaaaaaaaaaaaaaaaaagcagaggcaatctaatgaaggtttaaccctcagcaatcatgttcattcaggggaaaagaccccaatgtatttaaatagattttcttagcctttattgtctgggagacatgacacaaaatttctatcataataaaatggccagttttgcttccattactgttataaacccacatagtcatcacacttctttcccaaattagattccagattaaacagatgccagatgggttacagatttgatattcagaagactaatttttaatcgaaagcaaacactttctcaaatagatttttccacttttgcttccagtaaatatactttgagggagttccctgagtctacttctttaacaaataaacatatgtaatcccagaaaatatacagcaattaacagcctgcagaaatttttctctacttccatttatctggtgacataaatcactgttacatcaaccttattcaccagtatgggaatgtaaacacttaaaaaacaaattaagctatttgcagtaattcccattttaccactttaaaaatattacttttctctgcagtaaggttttctagttcagagcattaagctgtcaacaagacagatatccaagcccatccatcccgtggcatttgataagatcaacacagctatatatttataatcctattatctccttagcaggtgagaacaatggatttggccaacattattcaagcttcataatactgtatggtaaaatgttcatgacaaagagcagaaggtatgccgggcacagtggctcacgcctgtaatcccagcacttcgggaggccgaggtgggcggatcacaaggtcaggagatcgagaccattctagctaacacggtgaaaccccatctctactaaaaacacaaaaaaattagccaggcatggtggcgggcacctgtagtcccagctactcgagaggctgaggcaggagaatggcatgaacccaggaggtggagcttgcagtgagccgagatcacaccactgcactccagcctgggtaacagagccagactccgtctcaaaaaaaaaaaaaaaaatagtagacggtgttcagcaccatgaaacagggaggcaaaaatagaaagtagatggtatctaaagagatgtacaataaaacttcataaactttgttatatgtttgaaatttttcataataaaatggtgggggtaaataaccatagcaactaacatgtcctctcatagttcaactgataactggcaatttatattttttggaacagcacaaatggtatacagccttgactctggtgaagttttatttaaagaaaagctcatgtagaaaattacacgagaagcatttcaaccacaaatgtctccatcaccagaagtcaatgtaaaataacctgttataggtctagtgtgaaacaaatctgtcataaaattctctaaacatttttgaaagctctaaaatcccattctgagagaaaagcaactccaaagctcttatttgagaggggaggaatttatatttcctcaaattgaacaattctgtgtcactgggtatcacatcaaataagaagatccaatttagaggctcatgaaaacaaggcctctgcctataatcccagctactaaggaggctgaggtgggaagatgacttgagctcaggagttcaagaccagcctgggcgacaaactctgggattgacttgtggaatcccacaaaaagatacccttttcatgaaagtttcatctttatactgaattacactcttactcaatccagtaaaaaggctcaaagaaagttgccccacaaactgagactaccttgtggtattggggagagagactggatgaagcagtatccattttgataacacccagaatgatatcaatgatctggactttagaatggggatggaggagagttccatgagtcatggccatttctaaacttaaaatacagtaaatcctctcttaacataaggggtaggttcttggaaactgagacttccgactaacacacgcttattgatacaaacaagagttaggttctagggcatatttctcatcagaaaaatatcaccaaacttttaaataaagaccaaacacttcgaatattaaacactgaaataaatgtgaagtatacatgccttttttttttttttgagaagtacttttgctcttgttgccccggctggagtgcaatggcacgataaccgctcactgcaacctctgcttcccaggttcaagcaactctcctgcctcagcctcctgagtagctgggattacaggtgcccgccacccagcccggctaattttttttatttttagtagagacagggtttcgccatgctggccaggctggtctccaactcctgacctcaggtgatctgcccacctcagcctccaaaagtgctgggattacaggcatggggttgcagtaagccgagactgcaccattgcactgcagcctgggtgacaagagctaaactccatctcaaaaaaaaaaatttttttttttaccacttattccagttcagggttggggtggctggagcctatctcagcagcttagggtgcaaggccggaaccagtcctggacaggacatccactgcagaaagcactcacacttacacacacagctccacacaccagtgaacctcacgtgcacagctttgggatgtgggaggaaatcaagagtacccagagaaaacccatgcagggatagggagaacgtgtaaactccacagacagttttttttctcaacattatcttgaaacaacattattcaaggacctgctgtaatctgtatatacatggactttctggctgaaacctaaaagagagcaacttattctcaagaaactatatttatggtaacaattctcaatgcttaaaagttttacgttaagcttaatgggaagcactacacatttttaaaaatgtgttgtgtcctttcccagatactaaattggcgtttctttcctaaatcaattttaagaggtgtatctttccccatcttccaggtagtcataactaaaacataacatgtaacatttccactgtacctgatcaagctcaaagtacacctacaaaactcaaataacagacctaaaagctgaaaactattcacgaccagaaatttgaaagttatgcaacaaagacatttataatatttataatattcctgtcaacttccattgtaagagagatcctttagacacaagaaagaaaaacgtgaacacttatgctgtgatttcatactattcacaaaaattaaggtttcattcatatttgctaaatttgttatttggaaatagggcagacgggggcactttggaaaacaattctatgttagaagattatcttttgcttaattcttaacctaaggtaacagcagtatctttacacaactactgtaaagaaacattttaagttttcattatgaattattaactgtagtttaactttgacacaaagttatctctattaaagtgggttaaaaggcaggtctctgccaaaacaggactggggaaatctgtatttgttcgcttttcaattatagtcattaatagctcaagaatttttgcttttgtacacaataaagcagcaaggttgtattttgattttgaggagctgaaggcattggatcaagagttaattttcttcttcttttctgctgtacagaaatcatgtataaacagagaagggaagcccaacaaacaaaaatgagaactattattctactaaaagtaaattttgtgaccttaatctggggcaatctggtaaaagtcaaaatcgctaatgttgtgacacaatgtttaagatttgtttcaaaataatctagtttgtgtggggggatacaacatgaaacaaaaccgaccttggctatgagttaataattgtcaaagctaagtgagtgactaacacatggggttctccatactattcgagtttcgcatgttttccagaataaaaggtttttaaaaaatggtatttaaaataccatttccctattgaaatatgccattgtgatatggcagtattagacatgctttatactgcttgtatagttgtttgcttatgtgttttttttgttttgtttttttggagagagtctctctctgtcgcccaggcaacctccacctcccgggttcaagcgattctcctgtctcagcctcgggagtagctgggactgcaggcgcccgccaccacaccaggctcaagagatagtctccatctcctgacctcgtgatccacccgcctcggcctcccaaaagttctgggattacaggcgtgagccaccgcgcctaacctgcttatggaggcctaggagggtggatcacgaggttaggagttcgagaccagtctggccaacatggcaaaaccccgtctctacgaaaactacaaaaattaacacggcgcggtggcgggcgtctgtaatcccagctactcgggaggctgagacgggagaatcttttgaaccagggtggcagaggttgaaatgagccgaaatcgcgccactgcactccagcctgggcgacagcgtgagactgtctcaaaaaaaaaaaaaaattcaaacaaacattttaaattacaaacaatggtaagactgtcagaaaattctaggaaaatgtcaaaaacaaggaggccactttgccgcatgtgtgttaagagatgggtataaatcaaaatagtttcagttcactaaggaaatttaatgcctaaaacaatcctaagatacaggaggatcactcaggtaaacacacactccttactcatataaaattgaacacccataagttgcatttccttagagtacacctataaaactaagtacagaatttttaaaaacccagtatgttttagtaaagttgctgttctaaaaatcccacctgtcaccaggataaccgaaactgctccctctacactccaactgtatttttagtttttacctcaacaagtagcaatgcaatttacacttggtaagcacggattcctgaaacgccaaaatcaaccgggaacctgatttaactccaccacgctcttaacaatgaaagctacaagcagaagagaagtgtgaccttaaaaacttccacacagccgaagaacagtggcagaacagactgaagcacgtatcttcgcggaacagaagaaaacttccacacaagcaatactgcaacacggaggcggggcaagggcttaaaaggaaagtcagccaacagggaggggtgaatataagcaaagcttccgtgaaaaaaaacttatcgaggtgtagagcaagacaagacagacaaatttttccatctccgtacaccccccttcagagcccaacacacagcaagtgctctagataggtttgctcaactcaagggaagcttctgccagcaactttcccagaaatggaatgacaagaagaagctggatgatggcggggcggggagaaatggacaggttgctcatcctgcgggagatggtgaatatcctgcagttgcctaagcggagatggaaagaaacagcatccatcgtttacagactgtcaactacagtgtcccaattaagcgtacgcccctttcagatgttaacaactgaaaacaatgccctggctctggacatgggcacgcggaacactgcagcctctaagaaacccaaacggataggtaggtcaacttctatccactctgcccattaaattataccttcatatcacgctaataaattatgcagacggtttactgggacacgctgtgggtctggcactctgataagcgctttacacgccccatttcactgaaccttaagaggcagggacggtattagcagccccttttccaaccaagacacaaagactttttaagtgtcttgcctaacggggcagagccgggttcggcacccgttttggacacctgggccgtgctcttaaccactaagctacagacctgggccggcgacactgagaggctccagccctcggggacctgaagcagggacccccccccccccccgcctgcgccccagccccgggaataacttcggcatccccgcgcgcgccatgcgggacgaggaaaggcggccgcagcacctgtttgtggcaccggtgagggctggaggggatgggggcgcccggggccaggcctcagggcgccccgaggcgagggaacgcaagaggacccgcctcctccgggaaggccccgcgggctagagagaggcccgggagaaggcggaggggtgcgcgggcccgccgaggcctaggccccacccgccgcccacctccccaccgcggcggcgcccgcgagggccccaccaggcccggcccggcccggccgcctcacctggctgctgctccgagctcgtcccccggccggcggtcctgggcggtggcggcgaggaggggaaggaagaaggaaaaaagggagaggaagaagggacgaagggagggaagaggcggagtggccgtggaggaggcgggcgccgccgggccgggggggggaggcggtcaaaggaagcgggagccgagagagacgcggcagccgccggcgcaaacgctgaagagccgctcaggcgcccgcagcccggcaggaagtgacgggggaggggcaggcgcccgcccccggcccccgcccgcctccaggcccggccccggccccacccccacccacggtccgaaccacaagttccggctggcactgcggcggagcctgcgctcgcaaggcacgccgggggcccagcgggaggagcgccctgtcccgcctggaccgcagcggcccgtcctgagtcccggggcctgccgggagttgtagttctggtgggagtttcgcgctgcctgctggactcgaagcgggtctgggagaacccagcctaccttctttcctcctccacttcctttttccttccttgctgtcgcttcttcctcttgtcctgcctctggccttcctttctctccttcctgcagttgtttcttcctccatctgtaaatgttcattaaatgcttgccatatgcaaggcattgctccaagagctaagaatgtagtggtgaactgacaaaaatccctgccctcgtggagcttacattcttgtgtaagtaaaatacacaataaataaaattgaaaaatgtgtagtgagataaaagacaatggcccgggcgcgttggctcaggcctctaatcccggcactttgggaggccgaggcgggcggatcactaggtcaagagatcgagaccatcctggctaccacggtgaaacccccgtctctactgaaaatacaaaaaattagccgggcgtggtggcgggcgcctgtaggtaaacagctactcgggaggctgaggcaggagaatcgcttgaacccgggaggcggagattgcagtgagctgagatcgcgccgctgcactccagccttggcgacaaagagacactggtctcaaaaaaaaaaaaaaaaaaaaaaaaaaaaaaaaaaaaaaagacgagaagtgccagattactatttatttcacccagacctagataaactaagtggtttttagcagctgtattgtatgggaggttggagagagggtggccagtaaagaatcttggccaggcgcagtggctcacgcctgtaatcccggcactttgggaggccgaggtgggcggatcacctgaggtcaggagttcgagaccagcctgactaacatggtgaaaccccgtctctactagccggatgcagtggtgggcgcctgtaatcacagctacttgggaggctgaggcaggagaatctcttgaacccgggagacggaggttgcagtgagccgagatcacgccattgcactccaacctgggcaacagagtgagactctgtctcaaaaaaaaaaaaaaaaaaaaaaagaatcttgaacttctgcacactcagcgaaaattatgctcgcgttgtgagaggtccaagaaactgagaatgaatgaaggaactgcaggtgcacagagcttctctctcccgctcactctgggactgccgccccactatttaaaaataattctctctttcttaaatgtctctcaatctaataattgctcaatctctcttgccaacggaatataaattcaaaatacgagctgctgtgtctgaagaggcccctccaaacaaggctttggagccttagcgaagcctgggaggacacttgcctccttacattgcttcttgtgaagtgcaatgacactgaatttcagaacaccaaaaatagtcaaaggactttcaccgtccctttagtgcccatccaagacagtagtaagcaacattcagatattgtccagccctctgctaaaagtgatcttttctttctaacttccaagcagtgtggatcccatacctccttgggtaaaggagcagatgcagagaggtctccctaaacccaaagctgcgcacaatcagacaatctcgtcaaaggtgattttgctatcacccatagggacaaaagtggtgggtctatgacttccagtctcaattttcttccctctttcctccttccgcatcttttttgtttttttcttgagacagggtctcgctctgtcacctaactagagtgcagtggcatgagcacagctaactgcagcctcaacctcctgagctcaagaaatcctcctacctcagcctcctgagtagctgggaccacaggcatgtgccaccactcccagctaattttttaattttttatagagacagggttttactaagttgcccagggtcttactaagttactaagttgaccaggctggtctcaaattctaggctcaagcaatcctcttgcctcaatcttccaaagtactggggggattattccaggtgtgggccaccatacctgaccaggagtaggtcacctagatttgttttcttctgtttgtacctagaaactatcagtcaagttctcttccaaggtcctgaagacctcttgagtcttgctaagtaattaaggaatcatttttctttaccttgagaaaaagatggaagctgtgtgttcttggttcacaagaaactgtgagcattaagtatgttacgataaattatgtgtgttccttctcacaagataaattatgtgcatctgtactaaggaatgggaacatgcaaaactcataaaagccctgtgagatgctgaattttttttttttttttttgagacagaatctcactctgttgcccaagctgaagtgcaatggtgtgatctcggctctctgatgcaaagctcataaaagccctgtgagacatttatttttatttttaattattttttttttttgagacagagtctccctcagtcacccaggctaaagtgcagtggcgcgatctcggctcactgcaacctccacctcccgggctcaagcaattctcctgcctcagcctcccgagtagctgagactacaggcgcttgccaccatgccctgtaatttttgtgtttttagtacagacggggtttcgccatgttggccaggctggtctcgaactcctggcctcaggtgatccacccgcctcggcctcccaaggtgctgggattacaagtgtgaatgttaacctctgatgaattatctgttccactctcatagcctcttagtagaactttgcacccttataattttcaattatctgttgagtatatctattaggctagaactaagtgatcaacttccatgacagcagagactcagcctgtcttagtagtcatgatggtccctggcccataacacagtgccagggacacaatagtacatgataaatttccgtagactgctgaaaaattacagccttgcttatctctgcgcaagtccctaagaaacagggaacacctgtagggttgattggtgtatgtcagggtcacctgtggtatgtgtagcacaggagaacaaggttgagaactacttgctggcctaaataagtaattcccaagcttatttgaggtagcctgcactcctagggatatatcagaatctaagagcaacaattagaagacataaaaatataatggggccgggcgcagtggcttacacctgtaatcccagcactttgggaggccaaggcaggcggatctcttgaggtcaggagttcgagaccagcctggccaacatggtgaaaccccatcgctactaaacatacagaaattagccagccgtggtggtatgcaactttagtcccaggtactcgggcatgtgaggcaggagaatcacttgaacctgggaggcagaggtttcagtgagctgagatcacgccactgtattccagcctaggcaagagagcgagactccatctcaaaaaacaaaatgaggctgggcacggtggttcacgcctgtaatcccagcactttgggaggccgaggagggcagatcatgaggtcaggagatcgagaccatcctggctaacatggtgaaaccccatctctactaaaaatacaaaaaattagctgggcgtggtggcaggcacctgtagtcccagctactcgggaggctgaggcaggagaatggcgtgaacccaggaggcagagcttgcagtgagctgagatcgagtcactgcactgcagcctgggaaacagagcgagactccatctcaaaaaaaaaaaaaaaagaaaaaacaagagaaaaaagatataatggaagatcccatttacaaagcagtggaaaaataaaaatacctagaaataaactttacaagaaatatgcacaatctgtgtgaagaaaaaatgtttaattctgcaaaagaatacagaaaaagacttgaacaaagagaaatacaggttatggtattggctaggaaggttccatccagatcattaagatatcagttgatcaagacattgaaggacagcctggccaacgtggcaaaatcccaactctacaaaaaaagtacaaaaataattagccgggtgtggtggcatgtgcctgtggccccagctacttgggaggctgaagtgggagaatcgcgtgagcccaggaggttgaggctgcagtgagctgtgattgcaccactgcactccaggcttggagtgagaccctgactcaaaaaatacattaaaatttaaaaagacattgaatgagatcccaagaaaaataacaaacaggattttgttttggatctctatgagccatgtctaaagtcttatggaaaaattaataagaaaaataaccaagaactttctgaaaactcctgaccaaatagcaaacatactattggtaaagcattaccaattaaaatagttagatgctagtgcctgattagttccacaatcaatggaagagatatttccagatagacacaaacacatgtatgaatttaatactcagtaaaagtggtatttcaaggctgggtgcagtgactcacgcctgtaatcccagcactttgggaggccaaggtgggcggatcacttgaggtcaggagtttgagatcagcccggccaacatggtgagatcccatcgttactaaaaatagaaaaattagctgggcatggtggcaggcgcctgtaatcccagctactggggaggctgaggcacgagaatcgcttgaacccaggaagtggaggttgcagtgagccgagatcacaccactgcactgcagcctggccaacagagcaagactctgtctctaaagaaaaaaaaaaggccgggccggtagctcacacctgtaatccgagttctttgggaggccaatgccaggggatcacaaggtcaagagatagagaccatcctggcaaacatggtgaaaccccatctctactaaaaatacaaaaagtagctgggcgtgatggtgcccacctgtagtcccagctactcaggaggttgaggcaggataatcgcttgaacgcgggaggcggaggttgcactgagccaatatcataccactgcaactccagcctgggcctggcaacagcgcaagaatccgtctcaaaaaaacgggccgggcgcggtggctcacgccctgtaatcccagcactttgggaggccaaggcaggcggatcacgaggtcaggagatcaagaccatcctggcgaacacagtgaaacaacgtctctactaaaaaatccaaaaacttagccaggcgtggtggcgggtggctgtagtcccagctactcaggaggctgagtcaggagaatggcgtgaacccgggaggcggagcttgcagtgagcagagatcgccacaatgcactccactgtgggcaacagagactccatctcagaaaaaagaaaaaaaaaaaagtggtatttcaaattggtgaggaaaagatagatttcattttataaatactttgagacaacaaggtagcttctggggcagggggaattaaatgtgtacttcatattacataccagggaacataccaaattgatcaaatatttaaatagaagaaaggaaactgggctgggcactgtggctcccacctgtaatcccagcactttgagaggccagggcgggcagatcacctgagattgggacttgagagaccagcctgagaaacatggagaaaccccgtctctactaaaaatacaaaattagctgggcatggtggcgcacgcctgtaatcccagctactcaggaggctgaggcaggagaatcacttgaacctgggaggcagaggttgcagtgagccaaaatcgtgccattgcactctagccagggcaacaagagcgaaactccgtctcaaaaaaaaaaaaaaaaaagaaaagaaaaagaaaaaagaaaggaaactggccaggcatggtcacccatgtctataatcccagcactgtgggaggccaaggtgggaggattgcttgagcccaggagttcgaggctgcagagaactattattattactattattattttgagacagagtctcgctctgtcgcccagactgcagtgcagtggcacgatctcaactcactgcaacctccacctcctgggttcaagcaattcctcgtgcctcggcagcccaagtagctgggattacaggcgcacaccactacacctggcttatttttgcattttcagcagagatggggtttcactctgttggccaggctggtctccaactcctgacctcaagtgatccacccacctcagcctcccaaagtgttggaattacaggcatgagccaccctgtcagcttgtaatgagctatgatctcaccactgcactccagcctgggcaacagtgaaaccctgtgtcaaagtaaaaaaaaaaataataataacgggaaaccataaaagtaccagaagaattcctgcaagaatgtttgtatcactctgaagtggagaagactcttttaactataacacaaaattcggaatccttaaaggaaaagatcaattcattgactcaggaaaataaaaaatgtgataagaggaaatacaaagacaaatgataaactggaaaaaatttgcatctcagagaggatgatttcacaaatttcatgacatgtaaggaattactttgaatagcagaatgattaacaacccaatgaaaaatgattaaaagatagcaacaggctgggcgctgtggctcacgcctgtaatcccagcactttgggaggccgaggcaggcggatcacgaagtcaagacatgaagaccatcctggctaacacggtgaaaccccgtctccactaaaaatacaaaaaaattagccaggtgtggtggcaggtgcctgtagtcccagctactcgggaggctgaggcaagagaatggcgtgaacccgggaggcggagctttgtgagccgagatcgtgccactgcactccagcctgggcgacagagcaagactccgtctcaaaaaaaaaaaaaaaaaaaaaaaaaagatagcaacagacagttcatgggaaaggaaaaacaaatggttcttagaaataacaatgtaggctgggcgccgtggctcacgcctgtaatcccaacactttgggagcccaaggtgggcagatcacctgaggctgggaatttgataccagcctgaccaacatggaaaaaccccgtctctactaaaaatacaaaattagccaggcatggtggcacatgcctgtaattccagctacttgggaggctgaggcaggagaattgcttgcacccaggaggcggaggttgcagtgagatagcgccattgcactccagcctgggcaacaagagtgaaacttcctctcaaaaaaaaaaaaaaaaaaagaaaaaagaaaaaaaaaaaacaaagaaacaacaacgtaatggctgggccgctggctcatgcctgtaatcctggcactttgggaggccgaggcgggtggatcacttgaggtcaggagaatagcctgaacccaaggaggcggaggttgcagtgagccgagatcacaccactgcactccagcctgggcgacaaagcaagactccatctaaaaaaaaaaaagaaagaaagagaaaaaaagaggccgggcgcggtggctcacgcctgtaatcccagcacattgggaggccgaggcgggcggatcacgaggtcaggagatcaagaccatcctggctaacacagtgaaaccccgtctctactaaaaatacaaaaaattagccgggcaaggtggcgggcgcctgtagtcccagctactcgggaggctgaggccggagaatggcgtgaaccccggggggcggagcctgcagtgaactgagatcgcgccactgcactccagcctgggcgacagcgagactccgtctcaaaacaaaacaaaaaaaaaaaaaaaagaagaagaagaagaagaaaagaaagaaaagaaatagcaacatgaggccaggtgtggcagctcacgcctgtaatcccagcactttgggaggccgaggccggcagatctcctgagctcaggagtttgagaccagcgtggccaacatgacgaaataaaaatagcccggcgtggtggcgcatgcctgtaatcccagctcctctcgaggggagaatcatgaatcgttgaaacccaggagccggaggctgcaggctgcagtgaacagacatggcaccacagtaccccagcctgggtgacagcgagactctgtctcaaaaaggaaaaaaagaaaaaaaaaaaaaagaaacagcaacgtgaattcaaggatattaacagaagcacagtttgtaataacaaaagtttagaaataacatcaatggttcggacgtggtggctcacgcctgtaatcctagcactttgggaggccgaggcaggcggattgcctgagctcgggagttcaaaaccagcctgggcaacatggtgaaacgtctctactaaaatacaaaaaaattagccaggcgtggcggcatgcacctgtagtcccagctactcgggaggctgaggcaggagaatagcttgaacgcgggaggtggaggttgcagtgagccgagatcgcaccactgcactccagcctgggtgacagagtgagactctgtctccaaaaaataaaataaaataaaacaaaataacatcaatgtccatcaacctaagcttggctaaataagtcatgacatattcatacaatagaataatgatcagtagttaagaaaaaaaaaaaaaacgaggaaggaccccataaagagaatgaaaaagcaagtcgcagatttggagaaaacatttgtaaaataaaaagttgtatttggaatacatacatatatacatatacataattttcttttctttttcttttctttttttttttttgcgatggagtcttgctctgttgcccagactggagtgcagtggcgcgatctcagctcactccacctctgcctgccgggttccactgcttctcctgcctcagcctcccgggtagctgggattacaggcatgtgccaccaggcccagctaatttttgtatttttagtagagacgggggttttgccatgttgcccaggctggtctcgaactcccgacctcacgtgatccaacctcctcggcctcccaaagtgctagaattacagtcatgagccacggtgctgggcctacgattttcatttttatttttttcttccagtcagaatcttgttctgttgcccagtctggatagcttgatcttggatcactgcagcctcaaacacctaggttgaagcaaacttcctgcctcagcctcccaagtagctgggaatacaggtgcacaccaccaccgccaactcattttttttaattcttattagagacaaggggctcactatgttgctcaggctggtctctaactcctggcctcaagaaatcctctggcctcagcctaccaaaagtgctgggattataggcgtgagccacactgcccagccatatctggaatatattaagaactcttacagcttagcaataagaaaaacaaatgggcaaaagatctgtacagacattttgccacagaagtttataaaagtatatgagtggcaaatgagcatataaaaagatgtcattaggaaatgcaaataaaacacacatatacatacacatgggatataccattacacatttattagaatgtctaaaattaaaaataaaaataggccgggcgcggtggctcacgactgtaatgccagcactttgggaggccgaggtgggcagattatgaggtcaggagttcaaaaccagcctgatcaacctggtgaaaccctgtctctactaaaaatagaaaaattagctgggtgtgtgcctgttatcccagtttactcaggagcctgagtcaggagaatgacttgaacccagcaggtggaggttgtagtaagctgagatcatgcaactgcactccagcctgggcaacacagcaagactccatcttacaaataaaaaataaagaaataatatataaaaataagaatgggatgggcatggtggcttatgcctggaatcccagcactttggaagcccaagacagacagatcacttgaggtcactaattcaagactagcctggcccacatgataaaactccatctctactaaaaatacaaaaatggccaggcactgtggctcccgcctgtaatttcagcactttgggaggccgaggcgggcagatcacgaggtcaggagatcaagaccatcctgactaacactgtgaaaccttgtctctactagaaatacaaaaaattagctgggcatggtggcatgtgcctatagtcccagctacttttgaggctgaggcaggaaaatcgcttgaacccaggaggcagaggttgcagtgagccaagatcgtgccactacactccagcctgggtgacagaacaagatgagaccccgtccccctgcccccccgccaaaaaaatacaaaaattagctgggcgtggtggtgggcacctgtaatcccagccactcgggaggctgaggcaggagaatcacttgaacccgggaggcagaggttgcagtaagccgagatcgtgccactgcactccagcctgggcaacagagagagactccatctcgaaacaaaacaaaacggacaacaccaaataggagaatgtagagcaactggaactttttggactacaggtgcataccatcacgcctggctgattttttttattttgagatggagtctcgctctgttgccaggctggattgcagtggcgcgatctcggctcactgcaacctccacctcctgggttgaagtgcttctcctgcctcagcctcccgagtagctgggactacaggcatgcgccaccacgcccagctaagttttgtatttttagtagagatggggtttcaccatgttggccaggatggtctcaatctcttgaccttgtgatccgcccacctcggcctcccaaagtgctgggattacaggcctgagccaccgcgcccggccatgtttattttattctttatttttatttttattttatttttcttttatttacttatttttttgagacagagtcttgctctgttgcccaggctggagtgcagtggtgcgatcttggctcactgcaacctctgcctcccaggttcaagtgattctcctgcctcagcctcccgagtagctgggattacaggcgcctgccaccacgcccagctaagttttgtattttttagtagagacggggtttcaccacattggccaggctggtcttgaactccagacctcaggtgatccaactgcctcagcttcccaaagtgttgggattacagatgtcagccactgcacccggccatatttttttataatttgtagagatgggatctcactatattgcccaggctggtctgcaactcgtggcctcaagaggtcctcccaccttggcctcccaaagtgttggggttacaggtgtgaactgctgcacccagccaggaactcttattcattgctgatgggaatgcaaaatggtacagccacctggtatgacagtttggcagtttcttacaaagtttaagatatacttatcatacaacccagcagtcccagtcctaggtgtttacacaacttaattaaaaacttatattcacactaaaatcttacacccatgtttatagtagcttaattcataagagccaaaacctggagacaatcaaaatgtccttcaacaggtgactggataaacaaactggtacatttgtaaaatggaatccaactcagtaataataaagaacaggagcggccaggtgcggtggctcacgcctgtaatcccagcactttggaaggccgacgcgggcggatcacaaggtcaggaaatcgagaccatcctggctaacagggtgaaacaccgtctctactaaaaatacaaaaaaaatttagctgggcgtggtggcgggcgcctgtagtcacagctactcgggaggctgaggcaggagaatggcatgaacctgggaggcggagcttgcagtgagccgagatcgcaccactgcactccagcctgggcgacagagcaagactccgtctcaaaaaaaaaacaaacaaacaaacaggagctgtgtccatgaaacaacatggataagctttaattgcatctctctaggtggaaaaaacttagacccaaaagcccccatattgtttgcttccatttctatggcattctggaaaaggtaaaattatagggacagcaaatacatcaggcccagtgcagtggcactttgggaagcccaggagggaggatcacctgagcccaggagtttgagaccagcctgggcaatatagtgagatgccgtctctaccaaaaaaacccacaaaaagtagccaggtatggtggtgcacgcctgtagtctcagctgctcaggaggctgaggcaggaggatcacttaagcctgggggactgaagctgcagtgagccgtgatcatgccactgcactctgcacttcagcctgggcacagagtaagacccactctcaaaaaaaaaaaaaaaaaaaaaaaaaaaaagaagaagaagaagaaaagaaaagaaaagaaaacagatcagtgagatcagtggttgtcaagggctggggaagggaaaggaagttgatggaactgttctctatgctactaaaatggtagatatatgaccgaatatttcaaaacccttatgcagtaacctttattgtacacaaatatttaagaataaacaaggatgtctgaggatacgaggatggaatgaaaactgtgacaaactaatgtcattgatgaggaagggagaaaaaaaagtcactgacttaattaactttggaaaatgtgttttgactggctaaggcaaaagccaaaagaactgcacattgacactgtactccagttggtaaatttgtctctcacaaaaatggggaatattggcctgggcatggtgactaacgcttgtaatcccagcactttggggggctgaggcgggaggatcacctgagatcaggagttcaagagcaccctggccaatatggcaaaacaccatctctactaaaaatataaaaattagccgggcgttgtggcaggcacctgtaattccagctattcaggaggctgacgcagtagaatcgcttgaatccgggaggcagaggttgcagtgagtcaagatcacaccactgcactccagcctgggtgacagggcaagactctgtctcaaaaaaaaaaaaaaaaaaaatggggaggggggaatattaaaatattgtgaactgaatgaagacaaaattacatgtcagaaatttggagatgcagctaaagaaatacttagagggaaagttgtagcattaaatgtttatattagaaaataagaaatgcctcaaatcagtaacctaattttctaccttaagaaactagaggccaggcgcggtggctcacgcctgtaatcccagcactttgggaggccgaggcaggcagatcacgaggccaggagattgagaccatcctggctaacacggtgaaaccccgtctctactaaaaatacaaaaaattagctgggcatggtggtgggtgcctgtagtcccagctactcaggaggctgaggcaggagaatggcgtgaacccgggaggcggagcttgcagtgagccaacatcgtgccactgcactccagcctgggcgacagagcgagactccatctcaaaaaaaaaaaaaagaaagaaagaaagaaagaaagaaagaatcaactagaataggctgggacaccgggcgtgatggctcacattgtaatcccagcactttaggaggccgagctgggcagatctcttgaggtcgggagttcgagatcagcctggccaacatggtaaaactcgatctctacttaaaaaacataaaaattagccgggcttggtggtgcacacctgtaatcccagctactggggaggctgaggcaggagacttgcttgaacccaggaggtggaggctgcagtgagccaagatcacaccactgcactccagcctgggtgacagagcaagactccatctcaaaaaactaaaaaataaataaataaataaataaaataggctgaaagtagtggctcatacctgtatttctagcactttgggaggctgaggcaggaggatcgctttagctcagctcagtagttcaagaccagcttcaacaacgtagggaaaccatgtctctacaaaaagaaaaaaaagaagaagaaggagaaggaggccaggctccgtggctcaacgcctgtagtcccagcacttttgggaggctgaggtgggtggatcacttgaggccaggagtttgagaccagcctggccaacatggtgaaaccctgtctctactaaaaatacaaaaattagccagcaaggtggtacgcctgcctgtaaccccagctacttgggaggctgaggcatgagaatcgcttgaacccaggaggtggagattgcagtgagctgagatcacaccactgcactccagcctggatgacagagggatgctctgtctcaaaaaaagaaaaaaggaaaaagaaattagaataagatcaaattaaacccaaagtaagtgtaagaaaataaataataaaagacaagagtacatatcaatgaggggtgggcatggtggctcacacctgtaatcccaatactttaggagcccgaggcgggcagatcacctgacgtcagcagtttgagaccaacctggccaacatgatgaaaccccatctctaccaaaaatacaaaacttacccaggtgtagtggtgcatgcctttagtccgagctattagggaggctaaggcaggaagatcgcttgacccggggaggcagaggttgcagcgaaccaagaacaatagagaaaatctgtgaaaccaaaagtgatctctttgaggagggaaaatcaataaaattgataagtttctaaccaggatgatcaataaaaaaagccagaatatttgtgacaggtccagaacatacatatatgctttgtaatggacatagcttctctggattttaaggtgacgattcgagaggaaagcttggggataagagaagaaagagccctttcattgaaataccttttagtattcttttaaatatgcatatataattacatatgcaataattattcacaaataaaatgctatatatttttattttatttatttatttttttgagacggagtctcgctctgctgcccaggatggaatgcagtggcacaatctcggcttactgcaacctccacctccctggttcaagcaaatcccctgcttcagcttcctgagtagctgggattacaggcgtgcgccaccacgcctggctaatttttgcatttttagtagagacggggtttcatcatgttggccagactggtctcgaaatcctgaccttgtgatccgccgccttggcctcccaagtgctgggataacaggcaagggccacctcgcctggccagggggtagtagttttaaaagatatatttatccattcatttaataattgctgtttattatttctacaatacttacacttttttaatacttacagaatactgcaaatgaaggttttctaaaacaatattgttttgtgtatttactttttttttttttagagtctcactctgtcactctgtcacccaagctggagtgcggtggcatgatctctgctcactgaaacctcccaatcccaggcttaagcaatcctcccacctcagcctcccaagtagctggtgccacaggccctcaccaccacaccctattttttgtattttttattgtgtactttaaaattttatgtaaatggcatcatgttatctgaattcttctgtgacttgtgtttttcccttcaacattacattctgaatggttcacctatatttacatgcatagttctattttttcattttcagtgctatacagtattccaacaaatggatatgttatttttatatttacccaggctcgttctgaggatcacttaggttggtgtcctttgttgctatagtaaacaatgctgctgtcaacattcttgtatatctccttatgcaattggtggattttacattatatatatatatatatatatatatatatatgtgtatatatatatatatatatattttttttttttttttttttttttttgagatggagtctgtcacccaggctgaagtgcagtggtgcaatctcagctcactgcaacctctgcctcccaggtttaagccattctcctgcctcagcctcctgagtagctgggattacaggcacccgccaccatgcctggctaattttttgtatttttagtagagacagggttttgccattttggcccggctggtctcaaactcctgacctcaggtgatccacctgcctcagcctcccaaagtgttgggattacaggcgtgagccactgtgcctggcccactcctggtctttttctccacccactgtcataaaaaaaaattcacaagattttgtacagaaatattatgggctcaagggtaattgaggagagaagcagtgatcatgagttcattttaggtcaacaagatagcccctgttggcttagctgacctggttatttctcaaatttaataccaagtaacccaatgggaaaagcaaatcccgtgctatataaatttaaaacgtattttcgtattatactggaggcagaaggctaaagggagtcattctcctcataatgatggagagcgttttggtcatgcaaaatagcttttggtggccttgtgcaagttacttctcattacgcacacaagtgctcttattatatccacatattgcctggtctctagataatttctatgctttatgacagttttttttttttttttttttgagatggagtcttgccctgtggcccaggctggagtgcagcggcacgatctcggctcactgcaacctccgcctcccgggttcaagagattctcctgccccgtcctcctgagtagctgggattacaggcacgcacctccatgcccagctaatttttgcatttttagtagagacggggtttcaccatgttggtcaggctggtctcgaacttctgacctcgtgatccacccacctcggcctcccaaagtgctgggattacagacatgagccactgtgcctggccaaagttagctttctttttttttttttgagacagagttttgctcttgttgcccaggctggagtgcaatggcacacaatcttggctcatcacaagctccgcctcctgggttcaagcgattctcctgcctcagcctcccgagtagctgggaatacaggcatataccaccacacccagctaattttgtatttttagtagagacggggtttctccatgttggtcaggctggtctcaaactcctgacctcaggtgatctgcccaactcggcctcccaaagtgctgggattacaggtgtgagctaccgtgtccggctaattttcttttcttttttttttttttttgagacagagtctagctctgtcacccaggctggggtgcagtggcacgatctcggctcactgtaatctccgcctcctgggttcaagcgattctctgcctcagtctcccaagtagctgggactacaggcgctcgccaccacgcccagctgattttttttttttttttgtattttttgtaagtacggggttttaccatattggctaggctggtctggaactcctgacctcaagtgatccacccgccttggcctcccaaagtgctgggattacaggcgtgagccaccgcacccggccaaaattaattttcttaatcaaagtaatgtgtgtccatagtttagagagtcaaataattttaagaagcttatcatgaaaaacaatgtccactcaactcttcctcttggcatcttccttctggtttttttttttttttttttttttttgaggcggagtcttgctctgtcgcccaggctggagtgcagtggtgtgatcctgggccaccgtgcccggccatcttccgtttttttttttgagacagggtcttgctctgtcacccaggctggagtgcagtggcatggtcatggtttactgtagcctcgacctcctgggctcgagtgaaccgcccaaagtactgagattataggcatgagccaccatgcctggccaacatagcaagaccctccctctattttttaaaaaataataaatttttaaatgaaattttatatatatatatatatatatatatatatatattttattttatttttttttttttgagacagagtctggctctgtcaccaggctggagtgcagtggcatgatctcagctcactgaaatattcacctcccgggttcaagcaattctcctgcctcagcctcccgagtagctgggattacaggcgtgcgccaccacacccagctaatttttgtatttttagtagagacggggtttcaccatgttggccaggatagtcttgattttctgaccttgtgatccacccgccttggcctccccaagtgctgggattacaggcgtcagccacctcgcctggccaaaaaaataatttttaaaaaattagctaggcacggtggtgcatgtacctgtagtcccagctacttaggaggctgaggtgggaggaccacttgagcccaagaatttgaggctgcagcgagctatgattatgcccctgccttccagcctaggcgaccgagtgagaccctgcaaaaaaaaaaaagaagccaaaagttccctgggataggaatagccccttatgagcacctgccaagtcagagtgtccaccatgccacttttctctcgcctccactgcccccttctgtcctggaggagccaggggctgacttgtgagtggagcagggttagtggaaggcttgggtggaagaaatagagaagtcctccgggcaggcctctttttctgtcttcatgtggccagtccaagcaggctgaagtggaagaagggaatttaattaactttaaatgaattttaaattttttttgtttggttggtttgtttttgagacagagtctcgcactgttgcctgggttggagagcagtggtgtgatctcggctcactgcaacctccgcctcccaggttcaagcaattctcctgcctcaccctcccgagtagctggcattacaggcacccaccaccacacctgcgtaattttttgtattttttttttagtagagacaggctttcactgtgttggccaagctggtctcaaacggctgacctcgtgatccacccatctcggcctcccaaagtgctgggattataggcgtgagccaccacgcccggctccaaatgggcttttaaattactgaaccgagactgtttgggggttgtaagtgaccaagataattttattttatttattttgagatggagtctcgctctgtcacccaggctggagtgcggtggcatgatctcggctcactgtaaccgctgcctcccgggttcaagtgattctcccacctcagcctcccgagtagctgcgattacaggtgcacaccaccacacccagctaattttttgtttgtttgtttgtttgtttgttttgagacggagtctcactctgtctccaggctggagtgcagtggcgccatctcagctcactgcaacctcagcttcctgggttcaagcgattctcctgcctgagccttccaagtagctgggactacaggcatataccaccaagcccagctaatttttgtatttttagtagagacggggtttcaccatgttctccaggatggtctcgatctcttgacctcgtgatctgcccacctcagtgacccaaagtgctaggattacaggtgtgagccaccgcacgtggcctatatatatatttttttgtatttttagtagagatggggtttcaccatgttggccaggctggtcttgaattcctgacctcaagtgatctgcctgccttggcctctcaaagtgctgggattacaggcgtgagccaccatgcctggcacaagaaaattgtattgcctgagagtcactaagaaagcaatggctttgggagaccaaggcaggaggattgcttgaggctaggagttcaaaaccaacctgagcaacatagtgagatcctgtctttttttttttttttgagacagagtctcgctctgtcgcccagattggagtacagtggcgtgatctcggctcactgcaagctctgcctcctgggttcacgccattctcctgtctcagcctcccgagtaggtgggactacaggtgcctgtcaccatgctcggctaatttttttgtatttttttaatggagacggggtttcaacatgttagccaggatggtctcgatctcctgacctcctgatccgcctgcctcggcctcccaaagtgctgggattacaggcgtgagccactgcgcccggccgatcctgtcttttttttttattcatttatttagagaaagtgtcttactctgtcacccatgctggagtgcagtggcacaatctcagctcactgcaacctctgcctcccaggctcaagtgattctcctacctcagcctcccgagaagctgggattacaggcacataccgccacgcccagctaatttttgtatttttagaagagacgggtttcatcatgttggccagagtggtgtcgaactccttggctcaggtgatttgcctgcctcggccttccaaagcgctgggattatgggtgtaagccaccgcgccaggcccctgtctctatctaaaaagaaaaaaaaaaaaaagccatgggacttaccctagatttcattcaaggtatggggaagaactggcttcccagagacaaactgaacatgcaaagaataaagttgttttctgtctataccctatgcatgagtcccaccacctgatcaataaattggcttacaacatagtgaaaccacatctgtacagttaaaaaaaaaaaaaaaaaaaaggaaggccagacatggtgcctcccacctgtaatctcacagtttgcgaggccaagttgggtggatcacatgaggtcaggagttcaagaccagcctgaccaacacggtgaaaccctgtcactactaaaagcacaaaatttagccgggcagggtgtcggatgcctgtaatcctagctacttgaaggctgaggcaggagaatcacttgaacccaagaggtggaggttgcagtgagctgagatcataccattgcactgcagcctgggcaacaagagcaaaactctgtcccaaaaaatatacataatgataattggccaggtgtggtggctcatgcctgtaatcccagcactttgtgaggccgaggcaggcggatcacgaggtcaggagatcgagactatcctagccaacatggtgaaaccccgtctctactaaaaatacaaaaaaattagccaggcatggtggcaggcacctgtagccctagctactcaggaagctgaggcaggagaatcccttgaacctgggaggcagaggttgcagtgagccgagatagtgccattgcactccagcctgggtgacagggcaacactctgtctcaaaaaaaaataataataataatcaaaaaaataaataaattcgctacgcttagttttctgtatacttatctctgattggtgtgggttcctctcctgaccagttgggcagctgtggcactgtgtcttgctttaacctttttcctgggctggatctcctgtttcctgaattccatgagttccttttgcatagttttctgcctcatgctccactcacttcctgtcaaaggggtggacactacatatctggaaatgtcttttcgttctcacacttcatggataatttagctgggtatacaatgctaggttagaaatcattgtccttcaggaatggagttctttctcattccagggggcaaatgtgtttcttagctactttacacatgtatgagaaaccaacttttttcttcctcctcttctctctctcctttttttcctccttctcctccttgtttctggtagtggtgggggaaaattctacatcactaggttttcaaactctagagctgtcaaaaagcacacagctgttttcctaacacagactttatttacatagcagaaaaaggacttggcacttacactttgcatattgtttgaattactgttaacagggagagcaggcttatgtaatcaagtctggcttttcttggttgaaaaacttgttcttgtatcttcataaatggtaaaaatgacttttctatcatcccccatactgcaactcttccttttaattttttctttttagaaattatatattgaagtgaattcacataatataaaattagccatttcacagtgaacaattcagtgacatttagtacattcacaatgttatgcaaccgtaatctctatgtagttccaaaacattttaatcactccaaaaggaaacctggcattcattaagcagttagtccccatcccccaattccctaatcccccacatttctggcaactaccaatctgcttcctgtttacctaaataggatttacctattctagataatcagtataaatggaataaaataatatgtaacctttggtgtctggcttcttctacttagtataatgtttttgaggttcatccacaatgtagcatgtatctcacttcattcatttttataactgaataatatgccattatatggatataccacaaattgtttatccattcatgtattaatggacatttgagttgtttctgccttttgtctactgtgaatagtgctgctgtgaacactcgtgtacaaggatttgtttgagtccttgctttcacttcttttgggtgtatacttaggagttgaattgctggttcatatagtaattctttttttttttcttttaatagaggcagggtctctgtatgttacccaggctggagtgtagtggctattcataggcacaatcatagcacaatgcagtcttgagctcctctcctcaagtgatcctcctgcctcagcctcctttttttcttttcttttttggaaatgtagtctagttctgttgcccaggctggagtgcaatggtgcgatctaggctcactgcaccctccacctcttgggttcaagtgattctcctgtctcggcctcctgagtagctgggattagaggcacatgacaccacacctcattaatttttgtatttttagtagagacggggttttaccatgttggccaggctgatcttgaactcctggcctcaagtgatcagcccacctcagcctcccaaagtgctgagattataggtgtgtgccactgctcccactctgcctcagcctcctgagtagctgggactatggcatgtgccagagtacctggctgtcatatgctaattctatgttaacttttttgaagaactaccaaactgttttccacaccagctaaccattttacatccccactggcaaggtacaggggttcaaaatgttcatatcttcatgaacagttggtttttttgttttgttttgagacagggtcttactctgtcatccaggctggagtgcagtggcacggtcatggctcagtgcagcttcaacctccccagactcaagtgatgctctcatctcagcctcctgagtagctgggactacaggtacataccaccatgcctggctaattttgtattttttgtagagacagggttttgccatgttgcccaggctggtctccaactcctgagctcaagtgatgccccttccttggcctcccaaagttatgggattacaggcatgagccaccatgcccaggtgagcaccttttcatgtgctttttggccacttgtatatcttctttggagaaattttgtttatttttctagctttattgaggtataattaacaaattttgcataattcaaggtatacaatgtcatgattgaatatatgtattcattgggaaatggttgccacaatcaaattaacatactcatcaccacacatggttaccatcttttagataaaggcttattcatgtcctttctctgttttttcattgagttgtttggtttgtagttgttgagttgttaaagttgtttatattttctggatattccccttaaaaacggaagctattggaattttttttttttaggcagagttttgctcttgttgcccaggctggagtgcaatggcgtcatctcagctcaccacaacctccacctcccaagttcaagcaattctcctgagtagctgggattacaggcatgtgccaccatgtctggctaattttttgtatttttagtagagatggggtttctccatgttggtcaggctggtctcgaactcctgacctcaggtggtccacccaccttggcctcccaaagtgctgggattaaaggcttgagccatcgtgcccggcctactggaatttttactgttgtaatatcgggtaatatgtgttacccaatgtgggagcaaccatttgttgcttaacaatagccatttctcaaacttttttattttattttatttatttatttatttttgagacagggtctcgctctgtcatccaggctagagtgcagtggcatgatcctggttcactgcagccttcacctcctgggctcaggcaatcctcctgcctcagactcctgagtagctgggattataggcgcacactaccatgtttggctactttttgtaattttgtattttttgcagcaatgggggtctcactatgttgcccaggctcatttctcaatttttttttttagacagagtttctctctgtcacccaggctggagtgccgtggcgcaatcttggctcactgcaacctccgcctcctggattcaaacaattctcctgtctcagcctcctgagcagctgggattacaggtgtgggccaccaacccggctaatttttgtatttttattagagatggggtttcaccatgttggtcaggctagtctcaaactcctgacctcgtgatccacctgcctcgggctcccaaagtgctgagattacaggcgtgagccaccgcgcctggcctatttgcttttaatgtggggcgattataatcaatgctgaaaagaacactcttgcattttaaaacatgcttacttacccaattaattaattcccattggaaaatcttaaagatggttaagatgagtcacaattcagtttcaggaagcaggtaaatgggctggagaaaataaatccagcctcaccaatgccaccctatttagtcctcccaacagccatataaagtagataaaaaatatcactactgtctctttcaaactctgttttcaaaaggtgaggtataagcaatcaagtaaaatggagatggaaaactgaaaaccacgaaaagatcaaggcttgcccatggaacacagataatgtccaagtgataatcattctatgcttgaatcagaagatttggggccatggccaggtgggtggctcatgcctgtaatcccagcactttgggaggccgaggcgggtgggtcacctgggtcaggagttcaagaccagcctcgccaacatggtgaaatactgtttctaataaaagtacaaaaaattagctaggcatggtgatgcacccctgtaatcccagtttcttgggaagctgaggcagggaaattgcttgaacccaggaggcagaggttgcaatgagctgagatcatgccactgcattccagcctgggcgacagagctagactctatcacaaaacaaaacaaaacaaaaagaaagactgggtgtggtggctcacgcctgtaatcccagcactttgggaggccaaggcaggtggatcacctgaggtcaggagttcaagaccagcctagccaacaaggtgaaaacccgtcactactaaacatacaaaaattagccaggcatggtggcatgtgcctgtagtcccaactacttgggaggctgaggcaggagaaccgcttgaacccgggaggcagaagttgtagtgagctgagattgtgccattgcattacagcctgggtgacagagtgagattccgtctcaaaaaaaaaaaaaaaacaataacaagaagaagatttgggtccatgtctaggagataatgtctagatctcaaacagacctagagtcaaatgcctgccacccctcttactgtatagaaggtaagctactcactttctgggcttgggttcctcatctgtccaatgggaatagctcatagagtcatgaggattaaattagatcatgcttgtgaagcatcaggcatgaatttagctctcttgctttttctctgactccacattgctaatcaagttcagcctcatgacctaattacttcccaaagctcccacctcctaatgcatcagttggggttagaatttcaacacatgaatttgtgggggacacaaacatttagtccataacagaaggaacatgggatcagttaggattagattcagttgcatgtgacaacaaaacaaaacaacagtggtttcaacaacatagcagacaatttgacctcacataaatgaaggctgaggaagtctgaggttgctagtccaaggcttacatggctgtgctccctaaagaccttagaagcgcaggctccttccagctctctgatccaccatcctcatcctcctggcccaagatgggaatgagagtgacagccactccatccaagtctgttcccactttggggcttttgcacttgctgggtttttttcttagaaatcttcatctgagcctctttctctgcctttgagtctcagctttggaatgtggtcaccgtctcagagagggctcccctaaccacatgcctcaggcccctcttgttgacccgccttttattcttcatctcacttatatcacctgtatgtatcacctggttctgatacctaccaaccttctgaccttgggcaatttccttaatttcctcaagagcctcaatttcttcacctgtaaaatggggatataacagcacccataggaaacttacactttagattcatgagagtggttggctcttgagtgttggggagaaaagaaacggtgatatctacagtgtccacagcagagcttagaacaaagtagaatctcaataatatttgtgggattaaggaaaatattatgttaataaactcatcttcagttggtgccactactcaatagtagaatattgctcaacattgattactgagtaacattcaccttgagtctccgagaataaaatcagtagaaaactccctgctttgccaggcgcagtggctgacgcctgtaattccagcactttaggaggctgaggtgggtggattgattgaggccaggagtttgagaccagactggccaacatggtgagaccccagtttcttctaaaaatacaaaaattagctgggtgtggtggcacatgcctataatcccaggtacttgggaggctgaggcaggagaatcatttgaacccaggaggcagaggttgcagtgagccaaggttgcaccactgtactccagcctgggtgatatagcaagactatgtctcaaaaaaaaaaaaaaaaaaaaaaaaaaaagaagaagaagaagaaaaaaaaagaagaagagaaaaagaagaagaaaactctttgctttgaattggggggcatagctgggtgcagtggcccacacctatagttccagctatgcaagaggctgaggctggaggatcacttgagcccaggagttccagtccagtgtgggcaacatggcaagacccttatatcttaaaaaaaaatccctcaaggctgggtgcggtggctcacacctgtaatcctagcattttgggaggccaaggcaggcagatcccttgaggtcaggagctcgagaccaacctggctaacatggtgtaaccctatctctactaaaaatacaaaaaaattggccaggcatggtggcgggtgcctgtaatcccagctactcaggaggctgaggcacaagagtcgcttggacccaggaggcagaggttgcagtgagccgagatcatgccactgcactccagcctgggcgacaaagtgagactcatctcaaaaaataagtaattaattaaaaaaaattaaaaactctcaaaataaaaaaaatgaattgaggggagaaaacttcattctcctgagcatagctaatgatctgggactgatgtgaaacccccaaagagaaaaataagaaatttttttttcctttttcccagtctattccttttagacttgggtttgggagggagataaaaagaatgacatgggacgtggcagggaagtaggctgggggtgaaagttgagatcgatttcataggaaggtgaagcagatctctgaagctcccaacatctttgacctccaaggatctcagaagacttgctcattcttgggcaaggctttcaagatcttcatatctgcctacatcttatccattgcaaatcattctggggaattaggatgtgaaggcagccaggatttggccccatcaaataaagaggtaataagattgcaacccacggggcacagatctccaaagagatggtgctgatgtctctgagcccagaggctcccatggggctgggacccaaaccttggagaatgaggcgctgctcagcgttgctggtgctctggctgggtacagaaaagctggttctgtgagtattaaaaagaaaaacaagcaaccccccactccccggcgctgccaaatggaatgaattgctgcttctagggagaagtgctgctggagtgacacaggaatgcgaaatagaacaagacccaagttcccgcttcctcctccagtgctccgttctctctcacatgcgccccctgctggcagatcctaacaaggaacttgatggcaaagtacaaacatggttcctggagtcccaccccaggtacatgagtcaggtatagaagggttagtttgaagctgacagtaccgtaataacgggcacagcttattaatttgaaaactattagatgaaactacacaaagaaccaagaacaaaaacttgtgttccccagtaccattttgcatcctttgtatccggagtttttctttagctgttgtatatccttcctaacagtgtctttattttataaataactaggaagttacccaagaccacacagtaaggagcagaagcaggatttgaatcaaggctgtgtggctccaaagcccatcctgttttttttttccttttaaaatatatatatatatatatttttaggccaggcgcagtggctcatgcctgtaatcccagctactcgggaggctgaggcaggagagtcgcttgaacccaggaggtggaggctgcagtaagccgagatcgcgccactacactctcacctgggcgacagagtgagaccctgtctcaaaaataaaaataaaaataaaataaaataaaataatttttttttgagacggagtttccctcttgttgcccaggctggagtgcaatggtgtgatctcagctcaccgcaacttccgcctcctgggttcaagcgattctcctgcttcagcctcccgagtagctgggattacaggcacacaccaccatgcccggctaattttttgtatttttagtgcagacggagtttcaccatgttggtcaggctggttttaaactcctgacctcaggtgatccacctgcctcggcctcccaaagtgctgggattacaggcgcgagtcaccgcgcccagctagcaatatatatttttttaattcacattttccatcactccctacaaagcccaatctttttttttttttgagatggagtcttgctctgtcgcccaggctggagtgcagtggcacgatctcggctcactgcaagctctgcctcctgggttcacaccattctcctgcctcagcctcccgagtagctgggactacaggcgcccgccaccacgcccggctaatttttttgtatttttagtagagacggggtttcaccgtgttagccaggatggtctcgatctcctgacctcgtgatccgcccgcctcggcctcccgaagtgttgggattacaggcgtgagccaccacgcccagccaacacgtttttaattaaaaacaaacaaacaaacaaacaaacaaaaaaaacatgatggggtcttgtcatgttgcccagggttgtctggaactcctgagcacaagcgatgcacccacctggcttcccaaagtgccgtgactaaaggtgtgaaccaccttgcctggtcttgatttttattttcttctgagattttttttcccctacaataaacattaattttaattaaaaagtttcggggctgtgcgcagtggctcacacctgtaatcccagcagtttgggaggccgaggcaggaggattgcttgagcccaggagttcgacaccagcctgggcaacatggtgaaactccgccgggcgtggtggtggcgcctgtacctccagttactcagaaggctgaggcgggaggatcgcttgagcccgggaagtcggggttgcagtgatccatgatctccactgcaccccagcctgggcgacagagccaaaccctgcctcaaaaaaaaaaaaaaaaaaaaaaaagacaaaaaattacttagaattttaccacccagaagcaatcacagctaactgcttattgtattttcttccacagcttttttttgtatctaaatatacacatctagagtttataaatgcaactctttagactctctcacccttccaccctcctcaaatactgccaccgttttgaggccggagacaatggaatttgcttacctaaaaagctccgccccttgatggcgtcacacgaaaccaaccacgccccatattgccgcatgcgcactcttaagaggtcgaacggggagggcggcaggggctctggaacggaagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggtatgagcacggttctggtctttgggtttccttgactgcttcccttcctcgcgattcctcaggtccctgtccccgaatcctcatcatcccctgccagccccggaagtttcccgaaaaggatctcaccgggaccccaagatcttcctcagtttccccgccactaggttatctctacgtccgcctgcttctttggccatgtcgttccctgtctccttgctgaactcagtatctattcactgaactgatatttaaccacgccctgtgtaagagacggcaggtttcttacaccttgtaagaggtgaagtcagccatggttcctgctcaaggagccatggttagctgtcctttcgtatgttcatcgagccagtgtttattgaatacttaacgcctgctagacttagtgttaagcgttgggggcgtagcaatgaacaaggtgagtgccactctcctgaagcgtatggtggtgtgggggcttgcagacattaagcagtatggcaattaaagaggtattggtgttctgaaaaggatgcttgcccttcaaacattcagcccagatgttgtcccctctgcactctcatctgtccgcctgataggtttatccagatgtcccatggcctctacaaattcaactcctccaaagatgaacttgtgttcactctcatcctgttcccttctcaagccagaaaccttagagttattcttgacagttttttcttcctcaccgccgccagtgctctgcaagctagctcatgaatctctcttaagcttctcccgcctctctccattcacactgtacccaccctagctccggctactgctgtctcatgcttgcacaccagcacacctgcagtccaaacatacttcatcttcatctctttatcttgagcacttccagtgtattcttcgcttagcagcagagggatctctgcgatacagtcacgttagagacctcccttgcttaaaactctccagcctgctggtagagacccccgggcctgtccaccttgcaaagactcctcaggcagcgtctgggtcccgtacactgtcgccatttccccgatgtcccctgtgggcgcgggcggccacccaggcctgctggctgcggccccctctcggacaggccttggctcagcccgctgcgtgggaggtcatgggccagtccccgaggagccaggcccctgtacagtgcccggtcacacccatgatgcggggtgtgtttgtcacacccatgatgcggggggaattgtttgtgtttgtttttcaagaaatgattcaaattgctaaaaacaaaacaaaacaaaacaaaaaaaactctccagcctgctttcacgtggctttcaaggtcctcacgatcttgtcctttccaccttgactttcatctctcacagctctcctcttcatgaccaacactccagtctcattcacttcatttttttttaagacagagtcttgctcggtcgcccagggtggagtgcagtggcgcgatctcggctcaccgcagcctccccctcccgggttcaggcaatcctcctgcctcagcctccctagtagctgggactacaggcatgcgccaccacgcccggctaatttttgtatttttagtagagacagggtttcaccatattggccaggctggtcttgaactcctgaccttgtgatccacccacctcggcctcccaaagtgctgggattacaggcgtgagccaccacacccgtcttttttgtatttttagtagagactgcgtttcatcatgttggtcaggctggtcttgaactcctgaccttgtctgcgtgccttcgcctcctaaagtgctgggattacaggtgtgagccactgtgcctggccccttcttgctttctatcattctttatctcagccccaaagtcactctgtctcttactcttcccaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaaggtgagactgacagtgatggacagctccagactttgggctattaagattggactgtgagtttcagggcctagccctgacctgactgaccatctgtttacattcagcagatactacaactcctttgaaaataactggttaaaaaaaaacaaaagaaaatatctggtatacttttgatgagatgggcacagggatcacaaatgactcactgtcttttttttttttttttttctgagtctgcttgctggggagactcctctttaataccaaacaaagtatgagcacttgccaggtggtctccggtggtgtcactgtgcagtgtccctggttcccacacagcacagccaaagctaccacagatgtcattgtcatctgtttgtttgccaagatcccatgcctttctgtgaatctggttaaactagaagatgcatctaagttattttccatttcatgtcttcaaagagaaatattgcctgtccagaacagtttaatccaggctttgctggtccttactctgattgaagtaaaccagcattgccttttctttttttttttgagacagagtctctctccattgcttaggctggagtgtaatggcgccatctcagctcactgcaacctctgcctcctgggtttaagcgattcttgtgctttagcctcccgagttgctgggattacaggtgcccaccaccacgcccagctaattttttgtagtttttttttgttgtttttgagatggagtctcactctatcacccaggccggagtgcaatggtaccatcttgactcactgcaacctctgcctcctgggttcaagcgattctcctgcctcagcctcttgagtagctgggattacaggcatgagccactgtgctcagccttaccagcactgcattttcaagatcgtctggagaggattaaaaaaatttttttttttgagacggagttttgctcttgttgcccaggctggagtgcaatggcgtgatctcggctcactgccacctccgcctcccaggttcaagcaattctcttgcctcagcctcccgagtagctgggattacaggcatgcaccaccacacccggctaattttgtatttttttagtagagacagggtttctccatgttgaggctggtctcgaactcctgacctcaggtgatctacccacctcggcctcccaaagtgctgggattacaggcgtgagccaccgcgcccggcctaaaatttttatatatataatatgtatatgtattttcagagaaggccaaaattttttctttttcaagttaattatgaagagtttgttctcttattcgatgtttcaatgaaaatttctttttcacctctttatttttatctgcagagggcagccactacattagatgagaagattgagaaagttcgaaagaaaaggaaaacagaggtgagaagaaaagtggctatttttcgttgttagggcccactctttactctcaccacgaccccagcatctctctggaagcccttatagagcggggcatggctggggcaggcgcactcttctgtgtgtttgctgtgaatctgtactgagaatccccacagccgttcattcaggccggagagcttcctatcgctctacttaggttctggatttctagaagtttctcatcaccctcactttaatttttttcccaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcaggtagacgttacggcggaggtgtcagtaatggggacaggagatcagaaggcatcctcctttactttgtagggtttcctccactcttctgcacagtttatctttaagctgttctgcctactacattgaactcctttctttcttttttttttttttttaagagatgttggctgggtgcagtggctcatgcctgtaatcccagtactttgggaggctgaggtgggtgtatcgcttgaagccaggagtttgagaccagcctgggcaacatggtaaaaccccatctctactgaaaatacaaaaataagcttggtgtagtggcatgcacctgtaatcccagccactcaggtggctgaggtacgagaatcacttgaaactgggaggcagaggttgcagtgagctgagattgtcccactgaacttaaccctgggccacagaatgagaccctgtctcaaaaaacaaaacaaaagagatgtggtctcactccatccacaggctggagtgcagtagtgcaatcatacctcactggaaggcttgaactcactggcttaagtgatcctcctgctttagcttcctaagtagctgggcctacaggtgcatgcccctgcgcctggctaattttttttttttgtagggacggggtcttgctttgttgctcaggctagtctcaaatttctaggctcgagcagtcctcccgccttgacctctaaaagtgctggcattacaggcgtgagccactgtgcccgctgaatcctttcttttaggttttcttttctcttgggattttgtttgggttgttgtacttcataggtagtttactcttttcccatctagccccatgcggctgccagatgccactgtgatacaaactcatttggggtgacatactcagatgggtccagccacatagtgggtgctcaataagtatttctttctttctttttttttttttgagatggagtcttactctgtcactcaggctggagtgcaagtggtacaatttcagctcactgcaacctctgcctcccgggtgcaagcaactctcctgtctcagcctcccaagtagctgggactacaggcacacgccaacacacctggctaatttttgtatttttagtagagatggggtttcaccatgttggacaggctggtcccgaactcctgacctcaggtgatccacctgcctcggcctcctaaagtgctgggattttaggcgggagccactgcttccgccctcaataagtatttcttgcagaaatgtgtgctaaagcatcataatacagtgtagtggtcgagagcctggtctctggaccagagtcactgggttagctttctctctgaccttaggcaagttacttcaccatgctgccacaaagtgtcctcatctgtgaaacaaggttgacgatggtcacccctcagaggctgaagtgtggcattggcacttaggacagtgtccagcaggatgcaagtgctttgtaagtctgagccgtggtcatcagctaagtttttctccatagatacactcaaagtaaaggatcggaagaagaagaagaagaaaggacaggtgagcttggggctgcaagacagtatgcagcttgttggcaaaccgaaaggagtttaaggtcgtttgggtttcttggctctttttgttgaattctcttctctcttttggttttctggtgtaggaagcaggaggattttttgaagatgcatctcagtacgatgaaaacctctcgttccaggacatgaacctttcccgccctcttctgaaggtagcagcttcttgtcaaaaattttctttgtagaagcatggtcttgctatgttgtccaagatggtctcaaattcctggcatcaagcaatcctcttgcctcaacctcccagagtgctgggatttgagccactgtgcctggccagtagtggcttattttggcaaccatgggattattgcagccacccctaactggactttctgcttctctctttgcctccctcaactcttgtccatacagttgccagagaactcccttttttttttttttttttttgagacggagtctcactctgtcgcccaggctggagtgcagtggcacaatctcggctcactgcaacctccacctcccgggttcacgccattctcctgcctcagcctccccagcagctgggactacaggcacacgctgccacgccctgctaattttttgtatttttagtagagatggggtttcaccgtgttagccaggatggtctcgatctcctgacctcgtgatccgcccgcctcagcctcccaaagtgctgggactacaggcgtgagccaccgcgcccggccgagaactctcttaagcaatgagttccatcgtgtccctcctcttcttctctgagtccttcagtacttcccagtctcactcttcttagaagcctgagtccttatattgacctacaaggctctgccccttctggccctctctgacgacacctcctggcactcgttctgctctggccacactggcctccttgctggccctcaaataggttaggcctcctcttcctcagggcccttgcactttctgttccctctgcctggaaaactcttccagaaatcttttggggtgctctctagcttccttcagggttcaactcagtatcccttgctcagtgagaccttccctggcagccctaccgtgaatagcactccccctgctgcccgtctggccgctgcattgttttccgcagcatctctccatatgacatgtgtttgttttttggtctgtttctaccagactgtaagattcctgagggcagggtttttatttcttttatttactgctgtgtcctcagtgtctagagcaccacctcacacatagtaggcgttcagtgaatgtttgtggaacgaatgattggtggggattggtgtggtccccacttgtctggaaacctgccctgtttgtgttgtgctgagacttcccccgctcaaccctgtctgacccagttcttttttcctcaggccattacagccatgggcttcaagcagcccaccccgatccagaaggcgtgcatacctgtgggtctattggggaaggacatctgtgcctgtgcagccactgggacaggtgaaaaggatagggacccagggtgggcagaagggtgttacggccagggctgggctctaggttgacttaccaaaggctggtttgctaaataaatattcttggttttttgaactatttcatttttattttttattttgtagagataggggtctcactttgttgtccaggctggtcttgaattcctaggttcaggttcaagcgatcgattttcccatcttggcctcccaaagttctgggattacaggcatgagccactgtgcctggccataaaatttttgtaacacaaaaaagatatactggtgcaattgagagagtaaaggactttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtcttgatctcctgacctcgtgatccgcccgccttggcctcccaaagtgctgggattacaggcgtgagccaccgcgcccggccgagagtaaaggacttttaaatttttaaccactttattttgaagtatttgtagatcagtggcaagttgcaaaaatagtgcatagggtctctcgaatccttcatcaatggtgacatcccacataactgtaggacaaaatcaaaaccaggaaattggcactgatacaacagtgtttcctagactgcagagcttactcagtttactgaaggattaattttttgttttgagatggagtctcactctgtcacccaggctggagtgcggtggcgcaatctcggctcactgcaacctctgcctcctgtgttcaggtgattctcctgcctcagcctccccagtagctgggtttacaggtgcccgccaccacacccggctgatttttgtatttttagtagagagagggtttcaccatgttggccaggctggtctcgaattcctgacctcaagtgatacacctgcctcagcctctcaagagtgctgggatttacaggtgtgagccaccgtgcctggcatactgaaggattaattttgtaagataaacagtgcatgagaggatgtccggtctagtagtgggccacaagtttcaaagggtctgatgaaggtcattttcatttaatcctcttggggtatccctgatctctgtgaccatggcctcctggccctgccatatcagaggaggaaattttttttttttttttttttgagacagagtctcgctctgttgcccaggctggagtgcagtggcgcaatcttggctcactgcaacctccgcctcccgggttcaagcgattctcctgcctcagcctcctgagtagctgggattacagatacacgccaccatgcccggctaatttttgtatttttagtagagacagggttttactatcttggccaggctggtcttgaacccctgacctcatgatccacctgcctcagcctcccaaagtgctgggattacaggcatgagccactgtgcctggctgtattttttctttttttttttgagacagagttttgctgttgtcacccaggctagagtgcagtggtgcgttctcagctcactgcaacctctgccttcaagtgaatctccttcctcagcctcctgagtagctgggattacaggtgcccaccaccaagcctggctaatttttatatatttagtagagacaggatttcaccatattggccaggctggtctcgaactcctgacctcaggtgattcgcctgccttggcctcacaaagtgctgggattacaggctcccgccaccatgcccagctaagttttttgtatttttagtagaattggggcttcactatgttggccaggctggtcttgaactcctgacctcaggtgatccgcctgcctcggcgtcccaaagtgctgggattacatatgtgagcctgaccatgtgatttgaaagcagaaaaaatattctatgaaaaataagttcctttattttccccaaccagacgtagtttttctgtgctctggtgaaaacctaaccctggagggagctaaacttcttctcattgcttccttgctgtccctccctccaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggtgagtttctggccaagggctgccagcccctgagagactgtggtggggtggaggatggatgtgccccgccatctgttggtgttggtgacaggtgccaggagaggcctttgtgttgattgaatccacttaaaaactggaagacttttttttttttttttttttttgagacggaggagtctcgctctgtcgcccaggctggagtgcagtggcgcaatcttggctcactgcaagctccgcctcccgggttcacgccattctcctgcctcagcctccccagtagctgggactaccgccaccacgcctggctaattttttgtatttttagtagagacaggttttcaccgtgttagccaggatagtctcgatctcctgacctcgtgatccgcctgccttggcctcccaaagtgctggaattacaggcatgagccaccgcacccagccgacatgttttcatagtgctttaggtgggtgggatttgattgagacttaaccaaccttcacaaatgaaacctgaaaactatgaacatttttttcgtggtactgaacaaatttggggtataatttctgctctgtgagaataatgaatcaaatattactttgggcagcgtttttccaatgaagttatatgatagtgttatctagcctgcattttgccctccttgtgctattggaagtcagaagtgatctttgtctccctgtaacagacacctcatcactttcctcagctgcttctcttagtccttgaatgtttcaggcattctcttttttttttttttttgagaggaagtctcactctgttgcccaggtgggaatgcaatggcatgatcttggctcactgcaacctccacctcctgggttcaagtgattctcccactgctttccaagtagctggaattataggtgtgcaccaccatgcacagctaatttatgtatttttaatagagatggggtttcgccatgttgggtaggctggtctcgaattcctgacctgaggtgatccacctgccttggcctcccaaagtgctgggattgattacaggcatgagccacctcgcccagcccatgcattctcttctgaagtgcttttgtgtcatcatcattgttgatttttgcacttagcacaattttaatgacatgatctgtctttcccagtgcgtttctgggaaacccatgtgcttgggcctttgtcagtcttactctctcagtggttttctctgcatctggcctgaggcctggtgagtggctggtgctcagtcaacacccatgagcagctgacctggccgcctggtggggctctcttctctttgcaggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggtgctcctcacagcctggggcccagggcactgtggggttccaaggcccagaacctggatgtggacctgccacactgcgttattctttgtggctctgggccatggctgttggtgtgcgataccagatcagccacttgtgctggggcctctgcccagccttagcccatgttttcctcttttttctctttctctattatggtggttaagtgataaggctggtcaaatgttggtcctgccacttcctaagggagatttggaaatatttagattctcaaaacaaatcttttctcatttgtaaatgggagataaggacatacgcacaccatagtgttgaggagctgaggagggaggaagaggaagtgccagcgtggctcccacagggcctctgtgactgcagtggggactccctctccccccaccccgccccccagctctctgttcctctctgtgccatctgctcacctctttgctctgggactgaacagaaggaactcttcctgaactctggactgaggctggaggtggggcaggggaaggagctcgcagacagccccagggcatgctaaggttgcaggcccttaatccctgactcttcaccagcttggggaatggcagctccatccttccagctgttctgaattcttagcgtgtcctcctgttttcacattccacagcccgcctgtcgacacagcctggccacacgcccccactttgtggcttctgcatttgccatttcctcagcctggagccatctcctgccccttcaggtttctgttccagttgttatcttgttagtggggcctttgctggctgccctgtgacggtcctgccctgacttgctcctcccgtcctgcctgcattgtcactgagggttcatggagtgccaagtccccctctctccctaggatacagtattcatgaaggggctactgctatactcccatgaacaagggcatgtctagtatatagcaggcgctcagtaaatacttgttgaataaccaattggctgactcccccagaacagaagacccattcctgaggcctaaaggatgaaaaagagatcattttaagccaaggggatgtgatctggtttaggttttaaagggggagggaaactattcaagtatgtacctcaaaagaccaaaaaaggcggaggaagtatttgagatttagatcaggagacagctctgtgtgatacctggacctagactgtagcctgcactggggagagaaatgctgtaaggggttgggcttgctgaaaacatggaatccaaggaatctcacagattactattatgtataaagagaaagaggatcctttacagtggcgtgatctggcagacactatagccaagtgaccaacctcacatccacagttctggaacaaaccggccgtcagtatctcatgatggagcgtgaatgcagggcacagctgtgcccagcagcgctgtccccatgaggatttctctgaatccagttactgagaaataattatacgaatccagactgtgagaaggatgaggggccttttcgttccttttttttttttttttgagtcagggtcttgctttgtcacccaggctggagtgccatggtgtgaacaccagctcattgcagcctctacttcctagactcaggtgatcctcccatctcagtcccccgacgtagctactactacaggcacatgctaccatgcctggcttattttatattaaataaatagagacggggtctcgctatgttgtcaaggctggtcttgaactcctgggcttaagacacccttctgcctcggcttcccaaagttttgggattataggcatgagccaccttgcccggccccagctcatttttgtattttttgtggagatgaggttttgctatgctgcccaggctgagggggcttttctagatgcaggaagactagagacgtggcagccagttgcaaggcaggaactttggttcttgcactaaaacaaaaggtaactataaaataaaacttggcctggcgtagtggctcatgcctataaccccagcactttgggaggccgaggcaggcggatcacctgaggtagggagttcaagaccagcctgaccaacatggagaaaccccatctctactaaaaatacaaaattagccgggtgcggtggctcacgcctgtaatcccagcactttgggaggccaaggcaggcggatcatgaggtcaggagattgagaccatcctggctaacacagtgaaaccctgtctctactaaaaatacaaaaatattagccgggtgtggtggcgggcgcctgtggtcccagctactccggaggctgaggcaggagaatggcgtgaacctgggaggcggagcttgcagtgagcggagatcgcgccactgcactccatcctgggcgacagagcgagactccgtctcaaaaaaaaaaaaaaaaaaaaaaaaaaattaagtgggtgtggtggtgcatgcctgtaatcccagctattcaggaggctgaggcgggagaatcgcttgaacccgggaggccgagattgtgccattgcactccagcctgggcaacaagagtgaaactccatctcaaaaaaaaaaaaaaaaagacacttggaacctggaggcagctgaaggaatttgaacgtggcctgtgctttagatattcacgcacttgaaagtcttgggtgtgttgatgaagttgtgtttctgtaagagaaggtcctagtgcttaggagttgtgtgctgaaatatttggggtaaggtgttataacatctgtgactgacttgccacaaaaagacaaagcaaatgtggcaaaatgataattcttggtgaaaagataaaataataaaatagatgagtcctaaatgtaaccaatgacaacaaacagcagccggtatgcaatcccgtgtccctcactgtgaccgaagagcactctctccatttctgccatgtctttctctgctcccaggatgctggatgagtactttgaggagcagatgaaggagatcatccgaatgtgttcccaccaccgccagaccatgctcttctcggccaccatgacagacgaggtgggccgagggacttctctgtggcgggtggcaggtgtgcccagagggggccatgcagaggaccctggctgggcttgagggggtttgcctggggtgagcactgcttcctccttccctaccaccttgcagagagctgaggaaacctggctttgtgcttggcaggtgaaagatctggcttctgtctccttgaagaatcctgtccggatatttgtgaacagcaacacagatgtggctcccttcctgcggcaggagttcatccggatccggcctaatcgtgaaggagaccgggaagccatcgtggcaggtggcagcacagggcaagcctgggcagggtgggctggtcagcttccttgagctcgtagtatccatgctgaagtgcttggtttcccctgcgcctctgccgtccagtcttccccagcgcagaggctgcactgcactaatgatgatccgctgcctctcttctccacgggtccttcctccctttgctttatcgcctcaccaatcctctttgtgtcctgttcaactcccaaccacttggcatcagctgctgttgtacccgtcagtccagaccactgttctctgtcgcctggatcgttgcgcagcctcttgctcgagctccctgcttccactcggccttttgtgactctctgcattgcagagcatttacaatgattgcttgcagaagacattcgtacttattatgtccttatttgaacaccctgcggtggcttccattggtcttagactaaaatccaaacatcttagttttttaggactcttcgggcctggcccttgcctgcccgggatcccagccttggaggcttgctcatggctccagccacattcgcctgcttgcacttttttttttttttctttgaggcagagtcttgctctgtcgcccaggctggagtacactggcacgatcttggctcaatgcagcctttgcctcctgggttcaaacgattctcctgcctcagcctcccgagtagctgggattacaggcacttgccaccacttctggctaatttttgtatttttagtagagatggggtttcaccgtgtttgccaggctggtcttgaactcctggcttcaagtgatctgtcctccttggtctcccaaagtgctgggattacgggcatgagccactacatccagccgcctgcttgcacttctcactataagctggttcctgcctccgggccttcatgtttgccatttcctctgtctagaatcttcccctggatcttcccatggatcatctgccttgtcattcaacctaatgtcacctcttcagagaggccagcccttagctgcttccccctcgtccctgcactctctctcacagcatttttcaccccccaggaattggcttctctgtatccaccctggaatttgagttccacaggacagggacagtgcctgtctatccagtgccaggcacagtgaccatactttgtggatgaggagggggtacatgttgaataagagcctagaaacagctgccagctcagtcctctcttcctgccagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggtaacatttggggtggggactgaggctcccaccatccttctggggcagagaggatagaaggaagaagaggaccctgagcattctattagaacattagcaggggacacatagcatgatcttggccttgaacattttaacctaaccactgtgaggtcatgtcttagatgtgtttagaactctaacttcatagtcagagatgaccctcatgtccttggatgcttgtccctagcatgggagctgttgtgtggcgtgacagaggaagctggcttggaaaggcaacacatggtctcttcttggaagctttctgagagtggtgaacattcctgggtctgattgaacaagatttagagtcaaagttagcagccattacttgagcatctactttgccaggcactgtgctgcgtgctttccatgtgatttcttgtttagtcctcagagaatggcatcaaggtggttggcaaggaggaaccctttagaactctccacctaaccctgttcatcagtgggtgctgaaaggtgtttgttaaagataggctgatttaaactgagacaattgcctatgctgttagcagatacagaactacgtttgctctgtatgatgggttgttgaagggtgggtgtaaatatcccatgtgctcacatttagaatctatccctatttttttttttttttgagacggagtctcgctctgtcgcccaggctggagtgcagtggcgcaatcttggcttactgcaagctccgcctcccaggttcacgccattctcctgcctcagcctcccaagtagctgggactacaggcgcccgccaccatgcctggctaattttttgtatttttagtagagacggggtttcaccgtgttagcgaggatggtctcgatctcctgacctcgtgatctgcccacctcggcctcccaaagtgctgggattacaggcgtgagccaccgtgcccagcctctatccccattttaatgccctgttctgtcctctgctggctcaggctcttgtggagcattattaggggagggtgtctggatgaacagctgtttgtgactgtttctaggcgttttaaggatgaacagattgacatcctcgtggccactgatgtggcagcccgtggacttgacattgagggggtcaaaacggtgagcagacactatcttccttggacttttggtggaagtctttttgcctcttcgcaccccccttcccttgccaggcctgacgttcatttttgaccttctaggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaaggtgagcaggcacccctgtggcagtgcagaatggctcggtgggcggggcaaggacagagtgtaatggctgagagcaggtactttgcagttcagagccagatttgaattccagccctgctgcttccttgccgagtgaccatgtgcaggtttcacctcacctctctgagcttgcctcctgtgtgtagaagggaattatgacagaattgtaaacacagtgccccatttaggtggaaattgagaagagaaggttgcttggggcaaaattctcactaaactcctctttcccttactgttggtggtggggaagagagagatcagtactcattctttttgggtcctttcattgattttgttcctctgatctgtgggggtcttataaagcacatcctctttaaagtctttttttgttttgttttgttcttgaattcctaggctcaagcaatccacccaccttctgcctcccaaagtgccgggattaacagtaatgagccaccatgcccagccttaaaaatttttaaagttataaaaataatacatatttagcctgagcatggtagctcttgcctataacccagcactttgggaggccaaggcaggaggattgctagaggccaggagttcaagaccaacctgagcaatatagtgagctgcctgtctctaaaaaaaaaaaattagctgggcatggtggtgtgtgcctgtagtcccagctattcagaaggctgaggcaggagatctcttaaatccaggaggttgaggctgcagtgagctatgattgtgccactgcactgcagcctgggcaaaagtgcaagaccctgtctctaaaaaatgaaatgaaaagtacgtatttattgttggaaattagtaaataaaaaaaaatgtaattctgtgtcaaagagctcaccactggtagcatttaggtgtatgtcttttcaaaccatttttcctttcttaaatgtcccttttatttttttcattttcattgtcttcatttaatcagcgactagttattgagtcctgctgtgggcctagtgctattgattctgttctaggtgctggggatacagcagggaacaaagcagagctgtggttctgggagaaagagacaataaataagctaacagtagatgtgattgagaacagcaggaggagactgcctcattaagctgttaaggaaaggcctctgcacagctggcattggagctgagtcctgggtgatcggaatgaggcagccatgagaggtctgagggcaaagtgctgagctgagagaacaagggtggaggctgtgaggtaggaacgagcttagtgtgtgagaacaagagaaaggtcaggaggctcaggcgtggtgagcagggacacacagaagatcagagcggtaggcaggggccactctgagtctgggggatatgaagcagagaaggcacacattacagacaccatttcctatgtcagtaaatgcacagctaaattattttcatcagttacacagtattagtagtcacccttattttattttatttaatttatttttgagatggagtcttgctctgttgccaggctggagtgcagtggtgcgatctcggcccattgcaacctctgcgtcccgggttcaagtgatcctcctgcctcagcctcccaagtagctgggactacaggtgcatgccaccacgcccagctaatttttatatttttagtacaggtggggtttcaccatgttgtccaggatggtctcgatctcttgacctcgtgatccacccgccttggcctcccaaagtgctgggattacaggcttgagccactgccttattttgtttaagataaggtcttgctttgttgcccaggctggggtacaggggtgcgatcatagcttactgttgcctcgaactcctgggttcaagcagttcttctcctcagcctcctgagtaggtgggactacaggtgtgtgccaccatgatggctaattttttttttttttttagatggagtctcgctcttttgcccaggctggagtgtagtggtgtcatcttggcttactgcagcctccgcctcgtgggttcaagcagttctcctgcctcagccttctgagtagtagctgggattacaggcgtgtgcccccacacccagctgatttttgtatttttaatagagacggggtttcacagcattggccaagctggtctcaaactcctgacctcaggtgatccacctgccttggcctcccaaagcgtgggattacaggcatgagccactgtgcctggctttttttttttttttttttttttttgtagagacagagtctggccacgttgcccaggctggcctcaaattcctgggctcaagcaatcctcccacctcaatctcccagagtgccgggttacaggtgtgagccaccatgcctggcctacccttatttgtaaatcctttttattttctcccattgagatgtcatcctcaaattccgggacaagattgagaaaatggagaaagatgtgtatgcagttctgcagctagaggcggaggaaaaagagatgcagcagtcagaagcccaggtgaggctgcgaggcgggatcttgttcacaaggctgctcagtaagcaagctgctgcatccctgctggtgctgcccttctgaaatgtttctcccatcagagccccaggcatttgcagcccgtggcttcctgtgttagtagatacgggtttcacggcaggcatccttttgttatctctacagatcaatacagcaaagcggctcctggagaaggggaaggaggcagtggtccaagagcccgagaggagctggttccagaccaaagaagagaggaagaaggagaaaagtaagtcagggaggttccgcagaaatctaaatacagaattaccccacaggactcagcagttccatttcctagttctatactgtaaagcagcggtccccaacctttcggcaccaaggaccagtatcgtggaagacaatgtttccacatttggggtgtgggggttgcattagattctcataaggagtgcacaccctagatccctcgcatgcgcacttcacaatagggttagtgctcttatgagaatctaatgctgctgctgatctgacaggaggccaagcacaggtggcaatgcttggttgcccaatgctcacgtcctgctgtgcagcctggttcctaatacgccatggactggaaccggtatgcagcctggggttggggaccactgttgtaaaggatgtaaacagggactcaaacagatacttagatgccagtgctctttgaattactgttcataatagcaaaaaggtggaaacaaactatgttcatcaacaagtgaatggataaacaaaatttggggtgtgtgtttatatacacacaatggaatattattcagccatgaagttctgatacatgccataaggatgaaccttgaaaatcttaagctgaatgaaataatccagacacaaagggacaaatactgtctgatttcacttacctgagatatctagctaggcaaattcacagagacagaaatagattatagattacttagggctaggggaaggggggttataggaaattattagtggttgcagagcttctgttttcaatgatgtcagtgagtagcctcctgataggagttttggaaacagatagtggtgatggttgtacaatgttgtgaatgtaagtaatgccactgaattgtatacttaagattgggtaaaatggcagcctttgttttatatgtgtatatataaccacaataaaaataattttaaaaaagttaggagatatttaatacagatttcctctccatctccctttaaaaaagacccaaaacacttataagttcacattgttctatgcctcgccttttcacttaattttgaagcttagagatatgttttatataggcccacatatgctgccctttttgttttttgttttcagacggagtcttgctctgtcactgaggctggagtgcagtggcgcaatctcggctcactgcaagctctgcctcctgggttcaccccattctcctgcctcagcctcctgagtagctgggactacaggtgcctgccaccgcacctgggtaattttttgtatttttagtagagatgggatttcaccgtgttagccaggatggtctcgatctcctgacctcgtgatccgcctgccttggcctcccaaagtgctgggattacaggtgtgagccactgcactcggccccctttttgttttttttaatggcttcatgttcttccatcatatgagtagattgttgagggacattgaggttgtttacaatcatttgtcatccagcctgggcagcatggcaaaaccccatctctactaaaaatcaaaaaattagccagacatggtggtgcatgcctatagtccaactacttgagaggctgaggtaggaggatcacctgagcctggggaggtcaaggttgcagtgagctaagattctgccactgaactgcagcctgggcggcagaatgagaccccgactcaaaccaccaccaccaacaacaaaaaacccaaaaaataatcatttgtcattacaaacaagtgatgtagggaataaccttgcacatatgcccttttacaattaagcaagtgtatatttggcttgcaggattaattcctaaaagtggaatagtgggtcagaggatatttgtatttctagttttgttagaggttgcaaaatttccctcctagagggtataccagcagttttagaaatgctgtctatatttgatgggacaaaataagggtgtatataacttaaatttctgataaaaatagagttataactgtattggtgggtaaagtagtaaagtgacctaaatcttcatccttcatagcaggaggtttgtaatgagtatcttaagtggattgagaaatagtcaaaaaagcatgttatttagtgagatggaggtaatcagtggaagaagtgcttgcggcttttcttttcttttttttttttgaggcagggtctcgctctgtcgcccaggctggagtgcagtggcgcgatctcagctcactgcagcctccccttcctaagttcaagcaattctctcacctcagcctcccaagtagctgggattacaggtgcaccaccatgcccagctaatttttgtatttttagtagtcggggtttcaccatgttggccatgctgatcccaaactcctgacctcaggtgatccacccacctcagcctcccaaagtgctgagactacaggcacgagctactgcactcggccaagaagtgcttgccgcttttcattttaatctgctaacttaccaattgaaaacgtgcacttcttatcgtaagcttaaaaaaagataaaatcatccctgaaatcttatgctttcttctcatcccagttgccaaagctctgcaggaatttgacttggccttaagaggaaagaagaaaaggaagaagtttatgaaggatgccaaaaaaaagggggagatgacagtgagtggcctcccttttggagtttgggcccactcggtggggtgggtcagagtggcctggtgtgttccacactcacacctccccactccccctaggcagaggaaaggtctcagtttgaaatcctcaaggcgcagatgtttgctgaacggctagcgaagaggaatcgcagagccaagcgggcccgagcaatgcccgaggaggagccagtgagaggtcctggtaggtgaatggggagcccaaaggagcttgtacaaggttttccctgaaacctgtgctttgggtcagggagaaaatctgagggatgatgacagtagcccacattatttgagtaattagtatgtaccaatgtgtacagctatccctccacggtctaaggggcgcagtgaccttgtggttgttgagaactaggatttgaacgccagcttttctgactccggagcctaaggcctcaccagctgctacttggaggagctggtgaggacagaatgaaaatagtctttggatgccagagtatccactgaacttggaatcattaccttgaacttaaggggatttaggagcttgggccaaagacaaccatatgtaacccattctctctgtgcacagccaagaagcaaaagcaggggaagaaatctgtatttgatgaagaactcaccaacacaagcaagaaggccctgaaacagtatcgagctgggtaggattttaagtcatcatggagcccttggtattctttttttttttttttttttttttgagacggagtctcgctctgtcgcccagggtggagtgcagtggtgcatcttagctcactgcaagctccacctcctgggttcaagcaattctcctgcctcagtctcccaagaagctgggactataggcgcacgccaccatgcccaactaatttttgtatttttagtagagatggggtttcaccatgtttgccaggatggtctcgatctcttgacctcctgatccacccgcctcagcctcccaaagtgctgggattacaggcttgagccaccgtgcccggcgagcccttggtattctaatggaagctatgagtcttctgcctccttccccatttccagtttttgcacacctatagctttatactatgtaaattcaagggtacctgtctgttctccaccccccacccctctcagagccacctgaggatcccaaggtgagaacaggagaggggtgttcagttagcactgttcctgccttggaggtgaaatagtacattgttgggttcagaaatggagctttccttcaggggagtgataactctttcatctcaagttccatcctgcagaaccccagagaatcctggcttgctcttaggaatatgttgtcccacaccattttccccagcccaaggttggggcaggggcagactaagcttcccaagtagtggtatatacctaagaagggcctcttccaaccttgttttaaaattgggccctgacttccagaaacacgttatcaggtggaaacacataaaggcttagaacttagggcctgaaaatgatgcatcccagagatgctactgcttcatgtaggagctggggagggtgggggtgagacaacacccatttgttcaacagtttgctcatttcagcatgtcatcttctctcacagcccttcctttgaagaaaggaaacagttgggcttgccccaccagagacgaggaggaaactttaaatctaaatccaggtgatactggctgttttggaggggcataggttttgggattagagataaaaacctttcatggaaaagaagcttctccatcctcattctggtcttaactctgattttcttacagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaccaatccaagtgtatatcttattactatctcttcctcaatggcaaatgtgcccacagtctactagcttggtatcaccacatacagttggtatgcataatctttatgcttgtagaggaacagggtatggagtgaggaaattcttggtagaagttctcttctagcctggggaacataacaagaccctgtctcttaaaaaaaaacaacaacaacagaaaagttctcttctgttgatactctagaactaagagctaaatgatagctgaagaagatagctaaatgataactcttagttctaaaacatcaacaggggagaactttagcatgaatgccaaccatgcaccagatattctgtgtgctgaatagaatccagtcaactcactgcactcctgtgaggcaggcagtgatatcctcattttccaataaacagaggcttggaaagactaactttccagagttgcacagctgggaattcaggttttcaaccaacatctacttgaaccctcaccttacctcttgctgctgtgctgtggaaatgctgctggagaaatggaagcccgaaaaggacagaaggagccttgacaccataaattagttacttgctgcaaaaaccagagtctcttgtcctccaggctggagtgcaatgacacgatcttggctcattgcaacctccacctcccgggttcaagcgaatctcctgcctcagcctcccaaataccggtgattacaggtgcccgctaccatgcctggctaatttttgtatttttaggagagacagggtttcaccatgttggccaggctggtcttgaactcctgacctcaggtgatccaccacctcagcctcccaaagtgctgggattacaggcttgaaccactgtacctggccaaaaaccagttttgatcctgtaagaacgtcggttctcatccttttctgactcagaatgagatgaaagctgtggggccccacctggaaaactgtatagtttgttataatttcagggagtacttaccaccctacccccagcttaaaaattataagttatccagtagcacataccctagatactaaagagtgtgttcaaagctattcattcaggctgcacctaagtcaccaacagagggtccaattcagaaaatgatggcacaactgtgtgatggagtacagttcagactactgtcttactggattttacagaaagtaggttattaggctaaaaaagccaagtgcagaactgtgtactttttcttttccttttcctttttttgaagcagggtctcactcttgcccaggctggagtgcagtggcttcactgctcactgcaacctcgacctccccaggctcaggtgatcctcctacctcagcctttggagtagctaggactacaagtgcaagcaacaacacctggcttatttttgtatttttttttttgtggagatggtttcgccctgttgcccaggctggtcttgaactcctgggctcaggccatctgcccaatgtggcctcccaaagtgctgggattacagatgtgagccaccatgcctggcctaagggatgtgtattgcatgtgcataagttctctctgggaggactcaggaagttaacagggtttgcctctggagaaagaaacttcaggtatacccttttgtacaggctgaaaaaatgttctttttaccgtgggtaaaaatgattcattcaccagctaaataaaaatcctgtatcacaaaaacaaaatcacagcctcactgtagacagtgccttccctgtgcccgtcttcactgtctttggctgagttgcttctgaaaattgaggatacacgtggaccactgattttctcaatcattgtttttaattggctttataagctaaagtgcatagtaaagacaaaaaaaggaaatgcatacataggaaagggacacttagaaaggacctgagatacctaaatgtctgttctaaggaacactggaaggagggaatgcagatgcaggcagcaggcctgggtctggcttctggcctgggtttggagcctgcagaagctgctggcatgctagctctacccagggaacagctccaagagggagtgttgggatgaaggatcacacttgggataggtgctgctggtaccaaatgtgattttagctccattcagggcccaggggtaaccagcagtgccaccaaacctgtcagcaggtaaagaaacttctaccatcccaaagtgcaggttacaggaaaggggtcactccttaatgacgacctgggcctgctgcataaggcccatcttatgcagcatgtgggctgtcccatcttccccactctcagtgactatgtaactgtgtcagggtgagttggtgcagtcttttgtcttatcacgtgcctccatctcctggaggcagggtgcccaaggagggcagggaggggttcttgtgctcctttaagggataagcagttcataaacaactatgggcctctgtttattatgagagttagtctgcaaattagggcctggcaattagaatcggtctgcatcaatgagctcatactctgttcctggggaacaatgtagaataaacatctgaccaagtaaagacccagagataccactaggtggccctaggtggaagccccaaacatgttccagggagtctgtccactaatttgcaggagagaaggggtgagatttgttaactttgctctcagttctggagataaagtgcttactctagcgcaggggtaaatctagaaacaaatgtgggtgagccctaaaagtggatccttaagtaggtgctaagactaaaaagaatgatttttttttttttgagacagagtcttgctcctgtcgcccagactggagtgcaatggcatgatctcagctcactgcaacctccgcctcctgggtttaagcgattcttctgcctcagcctcccaagtagctgggattacaggcgcccgccataacgcccagctaatttttgtatttttagtagagacggggtttcgccatgttggtcaggctggtctcgaactcctgacctcgtgatccgcctgcctcggcctcccaaagtgctgggattacaggcgtaagccactgcgcccagcctaaaaaggatgataataaaaaacaaacttcagttccttcattagggagctggccccagtcattcagtggcgagggcaaaaggcagtggtgtaccatcttcctacatcatcccctggatctcctcaaagttcatcaggttgttggccgtgtcagaccaggcagcatgctgggctccatccatttcagaagcaagctggttgcttctttccagagtatgatttgtgccaccaatcacttccttacagtcaggacacgtgcccctctccatggctcccccacaatcgccaatcacatagatatggccattgcggcacttgaaccagtgaccacgaggataacctatggcactgacaatctgcactcgctcttcctctgagatgcccaggccagagcagggaagggtggctttcagagcttccatcttttcctgcacaagttgttcatcctcttgggtgaacttacatgttttctcaaggatattctggacactatagacctctactgctatgctatctttcaccttcttctctgctatcttgtagcgggtcagaaggttcaccaggtatgtgagcctctggatttcacttcggaggtcacttagttcctggctagtgaagctcaagcgcttcttggccagccactcatggacctgttctagtcgagtcctcactcttttctcttctaagacatgcatctttttcagggaatcccacaggctggccaggtggtcatagaagctgatgtaattctcaaccagacccaggtccttcactgacagatttttctgggccagcttctcctttaacatcaggaagtcttcaggaagcagctggtggaggaggctcttcctctccagcagggccttaagccgttcctggctggttgctatttcccctgctgagccctggatcttttccttgatgatttcaatctcttctagccgctgttttatgctagttccatacctcaggtttttgcggatgggcacctggcagatagggcagactttcaatctgatggcgacttcatcatccttctgttcattcatgtagcggtctagggcttgcacctcaaagatgtggctgcagtcttccagctgcacaaagcgggcatcaggctcatcctcaaagccaaagaatatttgggtgacctcatccatgtggcagatccggcatttcttggggcatggctccccacagagaccaatgcaggggtggccacaaactagcagcttagtacaaggcacatagcatgggggtcggttgcagggctcagagcagagtttggtgcactggtagtgctggcagcgccagacacagggttccacgcagggactacacagctccccacatttcttcttgcactggctgtggacacagcggttctgacaggtccgctggcagggtgggcactcaccaatgcatggttcctggcacttgtgtgagcagataagcaggcgcttgcagggctgctgacagcgttcatggaaacgcccttcgaagcagctgtggcaggagcctgggcaaggatgcccgcagtccaagatagtgccacactttgtggtacacttgactagcagaccaccatacaggaggccttccacatgaccacattttaccggttgactgtgcccacacttgagttttatggtgaccatttctgaacacagctgcacacagtcctcaccacatgggtggctgcatctgtgcccacatctcagagacttggagcaaggctcctggcagcagaaatctgactcaggcacggaacaagggaccatttgttcatggccgcaccgaggaatggttttgggcaccttcacctgacaaggctgacactcctggaagcaaacaaggggacaccggtgcccttcctgacagatgaccttctggcatggcttcatgcattggaactccttgtgtgaagagtcataagggtggcaggcacgggtgcagacatgcccacagcccaggcggaactcgcagggcaggctgcagcctccttcgggtactttttggaagtcagaagctttggatactaaggtgtgggtttcagggtggttctggcagcagagccggagcatggggcctatttgattgttctctcgaagtgtatgaatgatcttgctccacaggggcaccttggccagcatctgcatgtttccgatgcagtacattcccttcttggctcgggacaaggccacacagatgcggttggatatctgcagaaaacccaccttgccttcttggttgctccgcactagcgagaggaggatgatgtcattctcttccccttggtatttgtccacaacatggaccctgacgccagcaaatgtcttggcaggcatcagtttgcgcaggcagaagagctgcccggtataggtagtgaggatggtgatctgggaaggcaggtattcctggcacaggaagtacttgcacagctctaccacaaagtgagcctcatgctggttctgatggcttttgccctcttggatttcctgttcaggaaagttgtgttctacaaagaaaaggttggaagacaccccctgacagggaaaagaagtgacatgttaaaaggttcactcatggcacttgtttttttcttcctctcttgacatgcactggccacttactctgctccagagagagaccttggaaagctttttgtccactcaacatcactatctttagttctttagttagtcattgtgtgcttcattttggggccacagcaagttatgaaaataaaagattatgtctctttcagttttcaagatacttgtttgatgttaatatttaaaaaagctggctgggtacagtggctcacgtctgtaatcccagcactttgagaggccgaggtgggtggatcacctgaggtcaggagtttgagaccagcctggcccacatggtgaaaccccgtctctactaaaaatacaaaaattagctgggcgtggtagtgggcgcctataatcccagctattcaggaggctgagatgggagaatagtttgaacccaggatgcagagattgcagtgagccgagatcatgccactgcactccagcctgggtgacagacagagtgagactccatctcaaaaaaaatagaaaataaaacagccatccacaatccaaccattatagctgaaagaacaagcagtgctgtgaggaggatgatgataatgacagagcagctaacttactgagcactccactgtgctgactgctttatatacattacctccttccatacagtaatgggatatggcaggagccattattcttattgtccagaagaacctgatactcagaatttatttatttattttaaaaaaagagacagtcttgctatgtgccccagcctggttttgaactcttggcctcagctgacaattttttttttttgagacagagttcactcttgttgcgtaggctgaagtacagtggcacggtcttgttggctcaccacaacctccacttcccaggttcaagcgatcctctcgcctcagcctcccaagtagctgggattacaggcgcccaccaccatgcccagttaatttttgtatttttagtagagacggggtttcaccatgttggccaggctagtctccaactcctgacctcaggtgatccacccatcttggcctccgaaagtgctgagattataggcatgagccaccacacccagccaggcacatgccaccgcacccagctaatttttgtatttttagtagagatgggatttcaccatgttggccaggatggtcttgatcccttgaccttgtgattcgcccgcctcggcctcacaaagctctgggattacaggcgtaagccaccgcgcctggccagaattcttatataacttgcttaaggttacatggctaacaggcagaattgggattaaaaaaccctggtctgtatttcaattttctcccagtaaccagcttttaaaaagctggctctactcccttctgaaggctttctttttttttttgacagggagtctctctccgctgcccagcctggagtgcagtagcatggcacgatctcagctcactgcaacctccacctcctgggttcaagcaattctcccacctcagccttctgagtagctgggattacaggtgcttgccaccatgctcagctagtttttgtattttagtagagacagggtttcaccatgttagttaggctggtctcgaactctgacctcaagtgatctgcccacctcagcttcccaaagtgctgggattacaggtgtgagccaccgcgcctggccgctgaaaagcttttttatcttgaggaaattatagcctttttaggttgctgacaccatccaagaaagatcgggtaagacagactcaccttaatcttctcatacttaagaacagatggatgattctccagatcctggtaaatgtggggggtcaaaaggcgggcaatttcagggcacatacggtgctgaaaaaacacatgcatgtcattagaaacatgggcagagcacacacggacaatttctttaaagataaggttgctgttagaaaatttagggagggccagttgtgatggcttgtatctgtaatcccatcactttgggaagccaaggcaggaggatcacttcaggtcaggatttcaagaccagcctggcaacatagtgagccctcatctctatttttctttcttttttttttttttttgagacgtgtcaccaaggctggggtgcagtggcgcaatctcagctcattgcaacctctgcctcccaggttctagtgattctcctgcctcagccttccaaaagtagctgggactacaggcatgaggcaccacgcctggctaattttttgtatttttagcagagacagtgtttcgccatgttggcgaggctggtcacgagctcctgaactcaagggatccgcccgccttggcctcccaaagtgctaggattaaggtgtgagccaccacacctggcctctatttttcttttcttttttttttttctgagacagaatctagctctattgccaggctggagtacagtggcatgatctcggctcactgcaaccaccgcctcccaggttcaagcaattctcctgcctcagcctcctgagtagctgggattacaggtgcccaccaccatgcccggctaatttttgcatttttagtagagacaggctttcaccatgttggccaggctggtctcgaactcctgacctcaggtgatctgcccaccttggcctcccaaagtgctgggattgcaggtgtgagccaccgcacctggcctctatttttcttaaaaaaaaaaaggaaagaaaatctagagagatagagattatcatttgaaaaaaataaggagaaagcataacataaacagctcctttgtccaacaaaaactcaacacggtgatcttgtggtgttttaaaacagaaaatgtaaggttgacagagtcatttcagtattaaattatttttatttatatgagacctcttttgctggcaactggcagcttcccaggagctttctcctgggcatttggtaacaacagaggcccagcttctcacctggtaattcagacggacaaagggaatgtttactttcactagccgttcaaaaagggacacctcaaggttgaagttcttggccagatcatacacgttggcactggggcgcagctgagaagagaaacatggctgaggattctctactgataaagtcatttaaccatccatacttccatccatccaaccaaccatcaaatgtttttcaagtgttgactatgtgccaggcactattctacatactcacagtttaaggattaataatgacaagggttaaggattagtagaactaaaggtgatatgacagagtgccccatggtgggttttttctagctaggcctctgaacagtgacatctgagtagacactagcatggcagaagttgccagttcttcagtcatttgaaaagcaagatccataatggggagcggaaaggacacagtgggacaccaagagcaaatgggatgaagtcagagaaataagctgaaacctgatcacataagcctttgtgggccactttaagaagcttgatttttatgcaagtgcaatgggacaccactggagggttttcagctggaaagtgatattatctatctaccttttttttaaaaaaattcactttggctcctttatgtagagtgcattaaaaggtagcaaaaatggaagcagagagactgaggagcatgctattacaatacagtccactcaagaggccatggtggactaggtaaatagcagagggaatggatgaaataaatgacgttgccactaaaatataccccaaatctaatagcatctgctcttagactgaacgtgggaggtgaagacaagaggaatcacaagaagctactaataagcttgaggactgttgaagcagaggccagggtcttcctttatgatctcacccccacggagagccagcccatcttctagggggactctcgttttacctgctggtggtccccaatcaaaatgaggtgctggcaagctttgctcaatgtggcaatggtatgggcctcaaggacttccgcagcttcttccactatgacaatcctcggctccaccttctgtaggatctggcggtatttggcagcacctcaagtgaggaaagaagagaaaggctcctctgagctgaggcacaggacccacagggccactgggcctctgggaatccacttctgtatcttccctgaacctgcatcagcgacagctggtccttatagtgttctgggtggtctccagaacattaaaactgtgttggtcactgttggagtttcaaacccagcaggagaaagtgagtgaatttcttttttctttttttttttttctttgagacagtctcactctgtcacccaggctggagtgcagtggtgcgatctcagctgactgcaacctccacctcccaggttcaagtgattcttgtgccccagcctcccgagtagccaggattacaggcacccaccactacacccagctaatttttgtatttttagtagagatgagatttcaccatgttggccaggctgattgcaaacttatgacctcaggtgatccacctgccttggcctcccaaagtgttgggattataggcgtgagccactgcgcctggcgaaagtgagtgaatttcaccaagagttctcaaaatatgggtgctttcagtagcttttcatggtattttcctctaacctaccaaagaagctcctctttacctgtccttagataatctggcaccagaagtgaacttagatgcaacaggcaaatttctccacagtttcttacctgtggttgtcattcctacaacctgggcatctttaagaatgtgcaggtcttcctggagtctcagctcggccattctttctgctgatgtgcggtactggcgttcatagctgaggatcttccggcgggtgtcagcctggtacaactgtagccagagcctggagaatgggaagaaccaaggaaagaaagccacatgctctttgagaaggtggaagaacgcccttcagtgtgcccagtgtatgaagtgaaccttggacccttggagcatagtgacaaacagagagatacattcagggacctaagaatccaaaatgcccaacaaaaagatgtgcagagtagtcaggagctaaggaaaggggtgagataaagaacaaaggttaactatgggaagaaaataagagactttaaaaactttgggaagaattctcccagctgcagcatccctgcctaatttccctcccctcctctaattctccatagagtatttattttattagtaaaactgatgatgtcactaatcgctgtaaaactttccaacggctttctactacttttttttttttttttttaaaagacggagtcttgctctgtcacccaggctggagtgcaatggcgtgatcttggctcactacaacctccacctccgggttcaagcgattctcctgcctcagcctcccgagtagctgggattataggcaccggccaccacgcccagctaattttttgtgtttttagtagagacggggtttcactgtgttagccaggatggtctcaatctcctgaccttgtgatccgcctgtctcggcctcccgaagtgctagcattaaaggcgtgagctactgcgcccggcctctcctactcttttttttttttcctgtagagatgaggtctcactatgttgcccaggctggtcttgaaccctgggcctcaagagatcctctagcctcagcctcccaaagtggtgagattacaggtgtgagtcattgtgcctgttacctctctgttcttttctgagtttttatacccatttgtaactttttatttgtggaattacgtgattaatttgttaccctggatagactccataggctccacgaaggtaataattaatttgttaccctggatagactctataagctccatgaaagtagagcaaagtgtctattctatcccatggctgtatccctatcactcagctcagtggtggtgctcaatcaataattagttaacatcgttgaaggtcttggaggtggagaatgttctaggaacagaagaggaactccctacatgggttggctagatgtggaacacagtacctataaagctgccagcgagaactgaggtccagctgccaaacatcctcgatctcgttggcctcggctgcagtcatggtgttcagtttgcgaagctcatccttcactctttttttcattttctttttctggttgcgctgggtctgcagacatcaataccaggcagggtactgtctgagcagaggcaggcttggttttaagcccaaggcaggggtcacagcacgtaagaaaaagggctggcatcactgattaatgtcaagtgtcttacattctcccaacagctcttccactgtagagtggctaaacaaggactctggagccagtttgcctggcttcaaagccctactctacctcttactaggttgtgggacctagtaaggtaaatgacctaacctctgtgtccctcagtatcaccttctataaaatgggaataataatggtatctctttataggattgttggcttgtcaggagtaaatacgtggaaagcatttatactagtactagcactagttatcattaaacatctttgaccatagcctgtttcttgttcctaaaatgcatgccatgaaagtcatgggggtggtactttcttgttgaatgctgtacaaccagtgcctagcaactggtgcttcacacaggacttggcacagtgcctgctaaaacggtcctactgccatcgtatcaacacagtacctttaacaagtggtggaaagcactgtttatgagaaagtgctctcttctggccgtcactgagtctgaggctatgagcctttagaaggctcgcaagtcagacagatgtcactaaataaagatcttcccgctgcttcaaaatgaaacaaatcaacctttcctgatgcctcctgggagagatgctgaatctgtgcttctaagaattgagatcatgactccgctcaccacatatagtgatactgaactgaactagatcaggtgcaaagccagcactcagatgaaaactgcatccaaagttgcccttgaaagttctcaaatcattggtaaggtttacaaattcttattttgaatatctaatcctcgatcatcatagttatgcatggtaaacagtgaggactactaggctccaccaaaaggagcagagggaaggctacatgaagacacctgggcattcatacaattctggctttaagagaagtgtcaaattccaggctgaatgaaggaggaatattccatccagcctggaggtctcgcttcattgcttactttaatcctctaaaatcttagtacatgttcacaaactcatttgaaatagagaaaacaacactcctgaaggcattaagtactgagaccgtgtttgacctgactcatatgtgctacattcttccacaagttctacagaagcacttggctacctgcttcctgtctttctaagttggcatttcttgccagaggccctctgaagaaccatcgtatttatatccttgggaatcactaaagccatctcataccaggggtaggctgtaatacaggtacttagctaattgtaatggtgaagtgaatatactgtatcagaagtgggggaaaacaagcggtcagaacactctcaggcctgtttcaacccaaggaagtgagtttacctgccactctcctgtggcttgctcctgtccagctgctgtcccagtgccacaatggtctagcctcatggccagaagcattttagccaactcctggtctgctccactctcttccttcttccgccgctggggcctcaccacctcttcctcctcaatcacccggtctgcttgaatcaggtcagcttcctctgcgatctctatcagcgaactctcctcctccccttcttcctcctcatccccttctgcctgggctaagagagagaaacaggcaggagagagatgaaaactctttttttttttttttttgatatggaatctcgctcttttgcccagggtggagtgcggtggtgcgatcttggctcattgcaacctctgcctcctgggttcaagtgattctccggcctcagcctcctgagtagctgggattacatgcacccaccaccacgcctggctaattttgtaggctaattttgtatttttagtagagatggggtttcaccatgttggtcaggctggtctcgaactcctgacctcgtgatctgcccgccttggcttcccaaagtgctgggattacaggcgtgagccaccgtgcctggccagagatggaaactcttgaagctaagggacagaagacggcacctgcaagagctcagatgcatgaagacattatcaagggtttatgtgattttttttttttttttgagacggagtttcactcgttgcccaggctggagtgcaatggcacaatcttggctcaccacaacctccacctcccgggttcaagcgattctcctgcctcagcctcccgagtagttggcattacaggcatgcaccaccacgcccagctaattttgtatttttagtagagacagggtttctccatgttggtcaggctggtctcgaactcccgacctcaggcctgcctcggcctcccaaagtgctgggattacaggtgtgagccactgcacccagccctatgtgattatttttgagaagagaaactaaaaggaatgagaggagagttaggaaaggcttaaggtctccttatatactttttgttacgttttacgttaaaaaatcatacgaatatatgccttttaaagaaaggttttggctgtgcgtggggcttatgcctgtatcccagcactctgggaggctgaggtgggtggatcacctgacgtcaggagttcgagaccagcctggccaacacggtgaaactctgtctttactaaaaatacaaaaattagccaagtgtggtggcgcatgcctgtatttctagctacctgggaggctgaggcaggagaatcacttgaacccaggaggtggaagttgcagtgagccgagatcgtgccattgcactccagcctgggcaacagagtgagactccatctcaaaaataaataaataaggctgggcgtggtggctcatgcctgtaatcccagcactctgggaggccgaggtgggcagatcacctgaggtcaggagctcaagaccagcctggccaacatggggaaaccccatctttactaaaaatacaaaataagctgggtgtggtgagtgtgcctgtaatcccagctacttgggaagctgaggcaggagaattgctcgaacctaggaggcagaggttgcagtgagccgagatcacaccattgcactgcagcctggtggacagagtgagactgtgagactcagtctcaaaaaaaaataaataaataaataaataaataaaataaatacacaataaataaataaaggttttacttataccaaatacatatacaatggagggcatacaatgtaaatatgtaatataaaggataataaaaatatataaaatgaatacccaagtaccttccacccaatttaagtagaaaactgacaaattttttgaagacctttgttagccttcctaacccgaattttatattactcatttcctttttaaaagataataatgttaccacatttatactgtatctaagtaacacattgtctagtatatatgtttccataacttgccttttttttttttgagactatgtctgtcactcaggctgtagtgcagcattgcagtcatggctcactgcagcctcaacctcctgagctcaagccatcctctcgcctcagccacctaagtagctgggactacaggcacgcaccaccacacccagctaaactttttcctttttttttttagtaaagacagggtctcattatgttgcccaggctggtctccaacttctgggctgaaacgatcctcctgccttgcacttgcaaagtgctgggattacatgcatgggccactatgcccggctaacttgcctttttcattcagcatgtttttgagattcatatgtgttactgtatatgctgtgtttcattccttttcactgttgtacagtatttcattatctgagttgacttaattgatccatccattgaagaaatgttgatgaacatttgagttctttctgattttctgctatgataaagtggttatgtaaatttaaatatccccagcagcagtgcatcagagtttccattgcttcaaattctcatcaacatggggttatatcaaactttaattgttgccaaactggtgtgtaagtaatagttatctcattgtggttttaattcctctagtttttaatgagcacttttcatatatctattgaacaatttcctattttgtgatgtgcctgttaaaagtcttttatctcattagctgcgcgtggtggcacttgcctgtaatgccagctacttgggaggctaaggcaggagaggagaatcgcttgaacctggaaggtggaggttgcagtgagccgagatcacaccactgcactccagcctgggcaacaagagtgaaactccatctcaaaaaaaaaaaaaaaaagtattttatctcttttccttatattaagctatttgtctttctctgattgactcatagctctttatttattctgggaattatttttaagtctcactgttctggtatttactatattctacgttaagatttgattctaggaagacatgcacttcttacctgtattctcaggtcctgctggagaaacactttgcgtgaaagaaccgacaccaagacctagccactccagcatcatggaatgcttccagtgctggaagcaaatccattcactatcctaaggaaagaagaatgatcatttgtgaggattctatgacaaccaatgtgaaggctgggtctcctcaaagaatcaaaagcagattggggcatggtagctcatgcctgtaatcccagcaatttggaaggccaaggcaggaagactgcctgagcccagaaattcaagaccagcctgggcaatacggtgagaccctatgtctttaaaaagagagaaaaaaaaaagactgggcgtggtggcttgcgcctgtaatcccaacactttgggaggctgaggcaggcggatcacctgaggtcacgagtttgagaccagcctggccaacatggtgaaaccctgtctttattaaaactacaaaaattagccaggcatagtggtgcatgcctgtagtcccagctactcaggaggttgaggcagaagaactgcttgaacccgggaggcagaggttgcagtgagtggagattgtgccactacactccggcctgggtgacaaaagcaagattctgtctcaaaaaagctgggtgtgatggcatgcacatataatcccagttacccaggaggctgaggtgggaggactgcttgagcccaggaggccgaggctgcagtgagctatgattatgccactgccctccagcctgggctcaagaccctatctcaaaagaaaaaagaatcaaaagtaattcccttaaagtttataggctgtactattcacaacagcaaagacatctaatcaacctaaatgcgcatcaatgaaggactggataaagaaaacgtggtacatatataccatggaatactatgcagccataaaaaagaatgagatcatgtcctttgcgaggacctgaatggagtttgagggcattatctttagcaaactaacacaagaacagaaaaccaaatactgcatgttctcacttataagttaaatgatgagaacacatggtcacatagaggggatcaacacactggggcctattgaagggtggaggatgggaggagggagaggagcaggaaaaataactgatgagtactaggcttaatatctaggtgatgtacaacaaaccgccatgacacaagtttttttttttttttttgagacagtcttgctctgtcgcccaggctggagtgcagtggcacgatctcggctcactgcaagctctgcctcccaggttcacaccattctcctgcctcagcctcctgagtagctgggactacaggcgcccgccaccatgcccggctaatttttttatttttttagtagagacggggtttcagcgtgttagccaggatggtctcaatctcctgacctcgtgatccgcctgcctcggcctcccaaagtgctgggattacaggcgtgagccactgcgcgcttggcctcatgacacaagtttacctacgtaacaaacctgcacacgtacccctgaacttaaaagttaaaaaaaaaattaaaaaagaaacatcatattgttaaaaaaaaaaaaagttcagaggctgtgaactggcatctccttgggcaactggaacatttaacatgacttgtatagaattttaaaaatcaaagggctgggcacggtggctcatgcctataatcccagcactttggagagccgaggtgggcgggtcacctgaggtcaggagttcaagaccagcctggcgaatgtggtgaaaccctgtctctacaaaaattagccaggcatgatggcaggtgcctgtaatcctagctactcaagaggccaaggtaagagaatcgcttgaacccgggaggcggaggttgtagtaagccaagatcgcgccattgcactgcagcctggggtgagagagtgagaactctgtctcaaaaaaaaaaaaaagaagaaaaaaaaaaaagaattaaaaaaattttccagcctattttgacaaaatcaggagctatggcagcaatgactgtttattactgaatggcaacaaatggctggagctgggttgctaccacatctgttctagtttgccacagtcctctccgcttcttaatatttcaaatctagattgcttcacttatttgtaagacctgaatgacctctgtaagcttttggtttgtaatcctgtaaatcagcaacctaatggtaacaaagctaccatttcactgggttcctagcctgccactttacagagactgtctcagttatttcttaccatatcttttgaaggtaggcattattattatccatgtttgattgctgaggatcacatgaacccaagtcacacagtcagtctgcatgactatatctatcaactcccaagttctctatctgtgctagtttgcctctggttatgattttcttcatttcatttaacaaacacttatagtacagttactaaattaataagtttacaaatatcaccttgctcatctaaataacaatcctgtaagaacaaagatctgtaagaaattgccttttttgcaaatcaatattacagatgttggcaatttcatatggttcaacttaatgcttattattatccccattttataaaaggggaaacagccacagaaaattaagtaacttgtccagagccaagctcagactaaaacccaacaggctggttcgagttttgttcctgaccagcatattcagctgcctctcatcacaaaagggaactttacacattgtggcagcatcagattatcaaacaggtaaagttttggactgatgcttctcctggaggctacctcaaagtactgaggccagagacatatttgtgtcccccaggatgacccctacctgcactggtccattcatgagactttcccagtgctggggtgagatgtacttctgcaggtactgttcccgtaggacaccacgcatggtgcactccagggtcttggctccttcatgaagctcttgctctgactccttcatctgtgtcatgatcttccaagaacagagggaaagaaatgatgaggaaatatcatcatcccccaaactcagtcctcaccttgagggaaagcaaagctaagacaggaacagtaaggagggagaataaataaatagactggtcaacaaaccaatttcccaaggcacattattgtggtcttgaaaccaaagaactagtatcggttgagtgtggtggctcatgcctgtaataccagcattttaggaggccaaggcaggtggatcacttgaggtctgtagttcaagaccagcctggccaacatggcaaaacactgtctctactaaaaatgcaaaaattagccaggcgtggtggcaggttgaatatcccttatccaaaatgcttgggactagaagtgtttcagattttggaatatttgcgtttatacttactggttgagcattgcaaatctggaaatccaaaatgtgaaataatgttgggccgggcgcggtggctcacgcctgtaatcccagcactttgggaggccgaggcgggtggaccatgaggtcaagagatcgagaccagcctggccaacatggtgaaatcttgtctctactaaaaatacaaaaattagccaggtgtgatggcgggcgcctgtaatcccagctactcaggaggctgaggcaagagaatcgcttgaacctaggaggtggaggttgcagtgagccgagattgtgccactgcactccagcctgggtgactgagcaagaccctgtctcaaaaaaagaaataatgttggcactcagaaagttttggatttggattttccaatttgagatgctcaacctacacaacagaaaaacaaacaggccaagaatactgtgggagagacttcaaggctcacaatatctgttctctctcttttccttagtaataagaactcagatttttgactgggcacattgctgcccagctaaaagatgacatttccctggtcagttggctgtacacagaggtgctgtgggtggtatgggggaaggagcgttaaggtagggtggggatgggcagtgtttccttgtcttttctccatcttggattgtgaaggcaaaggtcataccaagggattggcagaatagaatgctgaaaggaacctgggtcctccagagctttgaggagcctccaaatctaccctgggctgcctacccagaaagccactgctatcttgtttaggtccctcttgaactaccccagatatttcagagctgggacttacactcatgtaggcccttcggaggtgcatggggaggttgcggcggaattcccgcttgttcctcagctcccttagggtgaactgcttcaggatttcactgttgctccttccacccacccgcacaatgctggtcttctgacaattgtagatgcctgtggaacaaagtggagcatggcagggttgagaggagcttatgctaggttctctcaggtgagagctgtgtgtatttgggatctagtctggtcccttagagaataaacttgtgcttaaaggaaatttaccccattaatgagtgagaaggtccccgagaagatgtgacctgcagagcagtaaagtgtagcacttaaagagtacaggttctggaatcagacaactagggatccaactcttagctctaccacttattgctgtgtaacctggggcaagtgacttgagtctcagtttctctgtctgtgatttagagatggcaatatctcccatatagggctacagtctggataaatgaaagaaaatctttaaagctcctagctagggcccagcacaaagcaagcacccaggatatgttacatatttttcactctgcagatttactgattgctcatatgttttaggcatgtgccaagttctgaagatatagcagtagaaacataggcccagtttctgatttgttatcatttctttgtctctggcaggaagttactcattaaataattaatacggcagcaataaatgtagtgagtactggtagcaggggacattacctagtctgggtggggtagggatctatttttaagaatctaatatttaaactcagactctaagaataaagatttatctaggtgaaagggaggtatagaagaataaaaataaaggaaaagcatatatttattcatccattaatgttatttagtattttttgagtgcctaatatgtgccaggatatgtgaatacagcaagaaaaggaccaatcctcatctagggtagcgatacataaaatagattataaaaaaataaaaaatgcaaaagagacttcactttggggctatagaaaaagtccacctgagaagagagatttaaagtgggaccagaagaatgagtagggccaggttgagtagggccaggttgaataagctcaagatggagagggaaaaaactattccaggccagaggatggcatgggccaatggaggacgtagaggctttcaaggaactgaagataaccagtgttgctggagttagggagaacaaggttaagaagtaggagctgtggttcacagtccagctgggacagatcacaaacggccatgtaagtaatgataaggactgttgactttgtttgaagagcaatagaaagctactgaagttgctgatggttcaatcatcaacatcttgatagagaacaaatttgcctataagtattaccttccagaaactggtccaaagcatgattagtataacacacaaccaagatggggaacttctggaggctaatttgccaaacagactcgttggttaggagggcctgaacaatttttagacccacataggttttgcctagaaaataaggaaaaaggaatttaacaatttagacattttctaaataaagtaattactcagagcaaaatctttttttaaatttaatataatacattaagatagtttaaaatctaagaagcgtacattgtatattgtgaaaagtccctcttgcactctgtcacccagttctctgggtggaagcaaccaatgttaccagtttcttttgtaactttacagagacagtatatccacgcatatacaaacaatacaaatgtgtattctttttctagacttccccttttctccttaaaatatgaatagtaacagacaatttttaccattctacatcttgatttttttcacttaatgtatcttgaaggtcattctctatcaatacataggagaatcccatcccccccacccccccctttcctttttacagctgttaaggtattttttagccagttttctattgatgctgtatatattgtttccaatcttgtggcaaattagaaatactttttatatacatggtagatttgcttttgtgatgggaggggaaaacttgtagaaatcaacattggaataagagttataggctcattagtaaatggccattaattaattaattaggctaaaaactgctaaattctctctttttgtttgagatggagtttcgctcttgttgcccaggctggaatgcaatggtgtgatcttggctcaccgcaacctctgcctcccgggttcaagtgattctcctgcctcagcctcccaagtagctgggaccacaggcgcatgccaccatgcccagctaatttttgtatttttagtatagatggggtttcaccatgttgggcaggatggtcttgatctcttgacccttgtgatctgtccgccttggcctcccaaagtgctgggattacaggcgtgagccaccatgcctggcctgctaaattcttacattgtgtcaggctggtaaggtagacactgtcctcaaaaatctcaaagttgagggagggagtgatataagataatcaaagatttcactacagcaggataagtaacaatttcttccttcttttttaaggccctatgttgtccagactggagtgcaggggctatgtgtactgcagcctgaacacctgttttcaagggatcctcccatctcagcctcccaagtacttggtactacaggtactcgtcaagacgtccagctttgttacataaagttttttttttttttttttaaatcatgagttgccattacttcattggtgttttttaaagacttcttcctgtttggggttttgttttcttttggtacttcctttcggagagtaatttagcagtagctattttaactgttaatgtaaattcccacttctaataatagttatgaccccagagtagaattagagagtggcacctggggagaaaggtatgggaaggtatagttccacgacaagtacaatgtggcagataggagccaggattctacagctagactgcctgaattcaattcctaaacttgtcacttaacatttgtgtgagcttcagtacatacttcccacctcttaagaggttatttaacccttctttgccttagctttcttcatccgtataacagttttgtttttttttttgaggtggagtcttgctctgttgcccaggctagagtgcagtggagcgatctcagctcactgcaagctccgcctcctgggttcacgccattctcctgcctcagcctcccgagtagctgggactacaggcgcctgccaccatgcccggctaatttttttatattttttagtagagacagggtttcgtcgtgttagccaggatggtcttgatctcctgaccttgtgatccacccgcctcagcctcccaaagtgctgggattacaggtgtgagccaccgtgcctgaccaactgtataatggttttagtaatggcttctatttcacaaggttgtgaggatgcaattagttaaggtatgtaaagtaagtaaaatgttgcttcacacatagtgctattatatatttgatactatttaatttaaaataatataaaattgaaccaattatataaagcagaaatcacacatctcactacatttgacctctagcaatcttgtatctattactatgcatgacaatgggttcctattggaaaatccctatgagcagctactttataaacaaattttatgcccatttcgggaggaatgttattaactaaacattctattgcaacaaaaccaaaaattgacaagtggtacctaattaaactaaagagcttctgtacagcaaaagaaactatcaacagaataaacagacaacctacaaaatgagacaaaatatttgcaaactctggatccatctaaggtctaatatctgcaattaaacaaccccattaaaaaatgagcaaaggacatgaacagacacttctcaaaagaagacatacacatggccaacaagcagaggaaaaaaatgctcaacatcaacatcactaatcattagagaaatgcaaatcaaaaccacaatgagattccatctcacactagtcagaatggctattaataaacagtcaaaaaaaagtcaaaaaataacagatgctagtgaggttgcagagcaaagggaaagtttatacactgctggtgggaatgtacattagttcagccactgtggaaagtagtttggagatttctcaaacagcttaaaacagaaatgccatttgacctagcagtcccattattgggtatataatgggaaggaatataaatcattctcccataaagacacatgcatatgcatgttcattgtagcactattcacaatagcaaagatatggactcaacctagatgcccaacaatggtggactgaataaagaaaatgtggcatatatacaccacggaatactatgcagctatgaaaaagaagaaaatcatgtcctttgcagcaaagtggatggagttggaggccattctccaaagcaaattaatgcaggaacagaaaattaaataccacatgttctcactcataagtgggagctaaacattgaatacacatggacacaaagaagggaacagacaccagggcctacttcaggatagagtgggaggagggtgaggatctaaaaactacctatcaagggctgagtgcagcggctcacacctgtaatcccagcactttgggaggccaaggcaggtggatcacctgaggtcgggagttcgagatcagcctgtctaacatggtgaaaccctgtctctactaaaaatacaaaattagctgggcgtggtggtgcatgcctataatcccagctacttgggaggctgaggcaggagaattgcttgaacccaggaggcagaggtcgcagtgagccggaatcgtgccactgcactccagcctgggtgacagagtaagactctgtctccaaaaacaatgacgacaacaaaaaactacctatcaggtactatgctcattacctggatgacaaaataatctgtacaccaaacctctgcaacatggcaatttacacatgtaacaaacctgcacatgtacccctaaacctaaaataaaagttggaaaataaaataagtaaataagaagacattctagaaacctagagtgaaggctccgtcccttgcttatcttacaaagcagatcttatgtactctaaaaaattttgtcttacctgttccaggaggtccttgaataatagccagttcccttgtgagagcaaactgcaaggcttccatctgggagtcatccagcttcagggcttcttttgagggccactggccaggatctaagacattaattctgggatgtctcaaaccctcgacatttcttagaaattccccagtggctgaaggattctctattaagggggtaaagtcgtatctgccccccattagcaagtaccttggctccttcacatgagagttacactccacgatattcctctggaagggaacatcttcctcctggacctcctggagtccttccaggacgtgcctgtaggcctcaaagtatgcagttgtctctaccatgaggaaagagtcagagggctggacctctgctagcagctgttggctttgctcattgaagcagagctggacaattcctcggcagagatcttcctgctccctgttagatacggtggcaaaaagaaatgtctcgaagttgtccttggacatgcataccaaagacccatagagcaatcgtttggaattctgccagcgaacaaacttcagtggttttgtgtcaaactgcaccttgtagactatgcctgatgatgaacacatgggggtgataatcctggtgtcaaagtagattcggatgtcatcaaactttctcttcctcaggccctggtcttcaaagctttggagaagttccaaaataccttcccgtaaaggtctgacgaaatcttctcgcaggagccggaagtgggtatccagatagatagcagtgctgtcgtattttccagaaatgatattggggcgaaggaagggcctctcatccaagtgcacttcattgtaggtagggtaaatgggcatggttcggtagctctcaacatggtcttctgcctcaggctgcactagagtgtaggtatccactctcaaagtgccctctcgcctcttttcctgcagatgttcaatgatagtctgtaccttttccaggttcttctccgtttcctcttctatgtcaacaccagaggctctcagagcattaagagaggttggcaggagggaaaccagcatggaagtttcctgcacagagctggcagggaagacacttacaaggtcctggaggagggagatgatgttgcttatgtgctctggatactggtttcggatgtcagggatgggttcagtgatcatccctaccacataagcaggcaggcagactttgagaaatttggagtttttcaatatgcccagtacatggagaacactctggcgatccattttggagctacaagccttccgaagaacctgacagatgagctcaaggaagttagatttcatggaagaatgagaaaggagctctttcagccctaaacttgtggcaagtgtgatgaccacctcagaagggtctttctgcagaagactttctaagaacttgtagcccagtttcttcgcctgctgtggctgttctgtaggcttctggtggggagtccgccactgctggaagttgtcattggaccatggtggtctgcggttcctacagtcctggttgccatttctccacctggtgtcattctcctggtcatgtctttggtctctagcttcgtcgctggcatgcccctcctggttcctccttccttgatgtgggttcctgcccatggccctaaatctctcttccctctgccagtaagcagcaggatggttgttggccctaggatgccttccagggtggctggctcctcctcggagagcattggctggtgggttattggcctgatttctagctcttggtggtaactctccatccacagggcctaaacacaatgaaatattgagtaaccacaagaaccaagttctgttggaaacccaacagaacgacaatgaacgtgctttcattttccaaaataactaaagagctcaggttttatacggtaagaaaaacggtttctaccaagtcatatgataaatgaaagataattactgttgctgtagaggttaggaaaatattatttttacaaaggacgcaaaagggaaaaggaataaacagttattgagtacctgatgtgtgttagagaataaatacatacagtatgtctcattgcttctaatctcatgccagtaccaaataacagtcagaacatgagtttaaaggccaaactgacttggttcaaacattggcctggccactgccttactatataaccttggccaagttgtataatttctctaagtctcagtttctgctttttttttttttttgagatggaatcttgctctgtctcccaggctggagtgcagtggtgcgatctcagctcactgcaacctctgcctcctaggttcaagtgattctcctgcctcggctcccgagcagctgggattacacacacctgccaccgcgcctggctaatttttatatttttagtagagatggggtttcaccatcttggccaggctggtcttgaactcctgacattgtgatccacccgcctcagcctcccaaagtgctggaagtgctgggattacaggcgtaagccaccgtgcctggtggggattttataaagattaaatgtttataaagtgcttagtatagtactggacacattaaaaactctcaataaatgttagttattactagtagcaataattgggaatatcctattgattctaagggggccactggttctaccactaaacaattatcacagccaacagagacatcaagtgaaataatattacaaagggaagtactacctgaatgctgtccagcatcagcaaatgcagtttgaatgggaaagagaaaggtggggtttccttaccaagatgtttttgagctaacagactatgaaagaaactgaaaaatgaaactcaagttttcctcctttctgtagcatgaacttcaccctcatagtacttaccaattaccaacccttatacaggaagcctaacatacccaaagtccagtttttttcactttcctttttgctaaaactgattctggggctgacctaacttagcagaatgacatgaagattttaaaaacaaataaaatacgactgtatacaatgatttgataaaaaagttgtaaaagcttcaaatgcatgttatatttgagatgattataccatttcctgacatcagatactaaattgatttatgcacactcttccttgttttgcattttgtagagaattttattttttattttttattttttgagagggagtctggctctgtcgcccaggctggagtccagtggcatgatcttggctcactgcaacctccgcctcccgggttcaagcaattctcctgactcagcctcctgagtagctgggactacaggtacctgctgacacacctggctacttttttgtgtttttagtagagatggggtttcaccatgttagcctcgatggtctcaatctcctgacctcgtgatccgcctgcctcggcctcccaaagtgctgggattacaggtgtcagccaccgtgcccagccgagactttaatgtgacaacataaaggaatatttggtaaaatataaatgatctacaactgaactctaaatttttataattgttacttacatatttacttttcaaactacctccaaaatcagaagaaagtactacttttaatatttttatctgattagaagactctatgtcttggaagaatggaaaatcgtatcatttcttattctttcaacattcatggccaggtgtggtggctcatgcctgtaatcccagcactttgggaggctaaggcaggcagatcgcttgagctcaggagtttcagaccagcctgggcaacatggagaaaccctgtctctactaaaaatacaaaaatgagccacacgtgatggtgcacgcttgtggtcccagctacttgggaggctgaggtgggatgattgcttgagcccgggaggtcggggctgcagtaagccaagatcatgccatggcactccagcctgggcaacagagcaagaccctgtctcaaaacaaaaaacaaaccattcacatagctcacaagagcccatagttcttcctcatttgttccacagctaaaactctttggaagacacatttcaaacttatggaaaagcaggaatccatttggttgtttagttttagaaagtgctgagcaagcagaataattcctttagtagagtgatggtcttggaactaatttagctttggtgactaggattcacgatctgcactatccaatacaaagccattagccacatgtggctgctatgtttgtgaaatgtaactactttgaattaagacgtgtaaaacacacgagattttgaaagctagtaccaaagactgttaagcattacattaaaaatttttatgttgataatatcttaaaatgagtatttgagggaaataaatatatgtgaattattaaagtatgataataaactatagtcaattattataatcaaataacattttggttatactgggttaaataagacattattaaattcctaaattttattaaattgtcatcaaattgaaaaaataaatttcaaggccaggcacagtggctcacgcctgtaatgctagcactttgggaggccaaggtgggtggatcacctgaggttaggagtttgagaccattctggtccaacatagtgaaaccctgtctctactaaaaacacgaaaattagctgggcatggtggcaggcacctgtaatcccagctacttgggaggctgaggcaggagaatcgcttgaacctgggaggtggaggttgcagtgaaccgagatcgcaccactgcactccagcctgggcaacagagcgagactccgtctcaaaataaataaataaatacataaataaatttcatctgtttcttcttacgttttaaaatgatgtttctagaaaataaaaactaggccgggcgtggtggctcacgcctgtaatcccagcactttgggaggccgaggcaggcggatcacgaggtcaggagatcaagaccatcctggctaacacggtgaaaccccgtctctactgaaaatacaaaaaaattagccgggcgtggtggtgggcacctgtaatcccagctacttgggaggctgaggcaggagaatggcgtgaacccgggaggcggagcttgcagtgagcagagatcgcgccactgcactccagcctgggcgaaagagcgagactctgtctcaaaaaaaaaaaataaaataaaaaataaaaacttatgctcttggcttacattgtttctattggatgctgctctacaccaaacgtcatttccctttctgaaactctatcactgtttttgttaaagtgaactgcacccattcatcagctctcttaggaaaagtggagggttggctgtttttcagagtaattcatgaagtaattaagaaataactcattctttttttttttgagacaaggtctttctgtcacccaggctggagtgcagaggccagatcacagtccagagcaacctctgccttctacacccaccccttcctgaggttcaagggatcctcccacttcagcctcccaagtagcctaagtagctgggactacaggcacgcagcaccaagcccggctaatttatatatttttttgtagagaaagcctattgccatgttgcccaggctggtctcaatcccctgggcgtaaacaatcctcccgcctcaggctcccaaaatgctaggattataggcttgagccactgcatccagccatagtcattctttacttgagagatgcagacaatcttaggtaggcctgctcatttatagagagccctatttccttcttttattactagaatttccttctcattaggtaggaaaccttgcttacctctgtggttggtatgggaattcctgggcctggcatccagatgaggtcttctctcctccatgtctgagtcacctgaattccttcacgttactttctgttatctggaaaactgcacatgttgagttatcagtgtcctcgaaacatagcatctagcagcaaaaacccaaacaccatcaagccagtccttctgcctttgttaacattttaatgatttgttaactaagggttaaatacagattttaatctagagcacaagtgctcgactctgcaaatgcccaattatgatataaaatattaaattcacaatttagctgatttcaagagatagaattcccctttcttttaccctggcactttcttggggtagagggaatgtcatcaattcccattcaaaactgctgtttggtttatgcctttagccaagttacttaatcagttgctaggtttcattttcctttcctaagaagcagacaatattgttgccaggacaaaaaggagtacatttttgttaatccaaaaccatgtgctcaccaccttatctggcatttacatatctgccacttatatagtacccaatagcttgcagtaccctacagtttataaataattagtgagcagttatccccttagcctactctttggaatggagccaaatgattaagctctctgctctactgaatcaagagaaagaaattacatgtttcaataaccaggaggtttggcaactacgaggtgctgtttcctcaggaccagctagaaatctgatattctttcttcctcctcattcttctaccttggtgatttttgacactggtcctgtaagaggaagaggaagcccctttaagggagcttctcaacccaactcatacacatggtgtgggctggggctaaggaaagagtgggtgactcagagtcctcagcaaagggatttttgagactgtcttcactgagttctaaaatattcataattggaaactgtgactacatttggcattatatgaggggcagcttttttcctcatctgaaaaaggagtctcttttcttccccctgggaatatctctggtgagtcccctccctcatcttatcaaacccagccctcctggcgcaggctcagtatttagagtttgtttgtttattttcaattctccgaggggaaaattccttcttccccttgttgaaaaatgctaaaatagaaactccagaaaatttaaaagaaacggaagaaaagaaaaaaagatgttaaaaaaaaggcaagggaaggaagggaggagtagacatgaacaggaaatgctgggatcgaaaacagactgaagtgtttttttttggtggggggaatcaaggcctaaagggcacgaagaagaaaatcagtgatgatcaagctggcctggagtcagaatgagaggggctagtcatcaccagagtgggacgcaggaggctgaggtcggaggcagagctgggtttgggggaagtctccagggtcctggggaatccctgacccagggagcccacggtccctaatggaaatgttatggggtcagggagcgccaaggctgtgaggtggcggggttatgggggccttggggagagggtggtagcgagcaccagggggtgcttgctgaggacggaggcggcggggtgggggcagggagcaggctgaagggggtgccgaggtgctctgtagaagagggggattgataaggtgacaggaggtgaggccggaggaatgaggggggtgcgagtggcagaagggagggcacagacaggggtaggggcagaggagatcgaagtgctgagggcagaagcggtgacggtgtcgggggtgctggggagagcgacgggccagctgaggggatggggacactaaagagagtacaggggagccgaaggggcgacggggcgctgagatgggccaggggctgagtgggtgacggggcgctgagtaggcgatggaggtctggggtctgagggggagacggggcgctgagaggcgctctgagtgggtgctgatgccgctgggggccaaagaggtgacaaggctctgagtgggtgatgggggtctggggattgagggggcgacggggcgctgaggggccaggggctctgagcgggtgacgggtgcgttgggggcttgagagggtgacaggtcttacgggcagaggcagtggcgggtcggcgcgggcgccggggttcgcggcgaggcaaggaagaatcaggggcaggggcagttgcggggccactcacccggctccggcgcgtcctttcactgccgccggcgagtgctggggcttcggcccaggcaggtcggtggccccgcccggcgccgcgcactttcggtttccgttccccgcagaccctgggcggagccgggcgggcggcccagaggaggagaaggaggaggcgggggcccagggtggagagcacgagggcctggcccaggcacggccggcgcctccgccctcgaggagggcgtcacctcagctccccccggcggcggagccggcgggctcaggcgggcgcggctgaggggagcggaccgcggggggcgggagatgactgcgcccaaggcctttgcgggcctcagccggccccagaggaaggggaacccgtcgagcggtttggtgcgtgtgaagcgcgacatggcgaggaagcggacaagcccgggtggcccggcgtgtagagggaagggggcggggctagacgcggcctggacaactactagagcgcctcgggctgtgctgctcgagactacatttcccagagcgacgcgcgcggagcgggcgggaaagagagcgtttcgggtccagtgcgcaggtgcgaaagccatctttggttatataagggaggttcaggaagccattcgttctttcgcgtctgcggtgcccggagtgtggtacttctcctagttgcagtcaggcttcatacgctattgtcctgcccgtaagttcccgttttgtgtgtggtgagtggaaactccatgttcttcgttggagacctctggtcctcccttcccttctttgtgccgtcgtctctgcggccagccctaatctccttctcgtggcttctccgtctctgaccccaaataggccttaagggcgtgggagaaatgagtttctggagctggaaaagccactgccttctgcacgggcctgagaagcccttggctggtgtaaatgatgacttcacttttttccccatcagatcgacaatgctgacgtcttatattttgccagttagttctgatacatcggcctcaaaaggcccggccttgttcgtttctgaccgtgggaagatggcggttaacgccctttatttgttggttcacaggttagagcagccagcgggtacagaatggattttggaagagggagtcaccactggacctccaaggaagccacgtgcagacatctacaaccttcgatctcctgacgagtaagtctttgtctcctatgggtctactgtagaaaacacgtgctttgagaagctttagttttctaggaaaacgtgggatttaacaaagcactttctatcgagcatttattaggtatttaaaaaagtgttctgacggccgggcgctgtggctgacgcctgtaaccccagcacttggggaggccaaggcagatgggtcacctgaggtcaagatttggagaccagcctggccaacatggtgaaaccctgactctattaaaaatacagaaattagctgggcgtggtggtacgcgcctgtaatcccagcaactcacaaggctgaggcaggagaattgcccgaacccgggcggcggaggttgtagtgagttgagattgcgccactgccctacagtcggggcaacagagccagactccgtctcaaaaaaaaaaaaaaaagaaaaacatgttctgaatgttttattctcacagttcaaatattggaactaggtttctggtgaagaaacaggtttaagagaaatgcctgaagtgaaagaaccttgttagtgaagaggcgtttaacattttaatgccacttaaacatatttttggattccattcttcctgtgtgttggggcgcttaaatttccaagtggagggatgatttattgacatattttggaaagccaaatgtgtttttctgttgaactagccactcaaaccagtgcccgactacataactaatatttttgctagagtccaggagtgaggcgtttacaaagtctgggcttcatgggaacacatgtgaagcttattgttccagattgttcttttgtcaggtaacttgtggtaacttgtgttaaaatgcaatctcttggtacttgttcacttcccaactcagtaaatgccaactacttcctcaactcttccagccacactggcttctatcatgggcctgtactcagagtgtaagcactgaagacaggggtgtttggtttggctaccaagttattgccagctacaggatacaacacagaagtgctcaaacaccgaatgcaaatttgcaaatatgaagcataccaaccaaatcttactcctcatggctttcaaatcttactcctcactcaagaacttcctgctggcatatatgatgacttagcttttttccccgacagatcgactatgttgatctaacttttctaagccagtttctgtctgatatgccagcttgagcagctcctttgtcccagctcccctgggcatctagctgatgggagctcatttttctgttttttcatttcaggtttattgttggccaaaaccaggctttgattgaaccaggatgaatgcgggtgttggaagtagaatatatatatacatataaaattggtaagtggtgccaacacgtcttccctggctgagtagacacaggctctggagggggtagtagctgcttttcagtgtgggtttgtcaccctacttcttgtacgactcaaatgtggcctttgcagctgatgatacagcttctttccccatcagatcgaccctgttgatctctacactattggccagttttgtctgatgcattggccccagtaataactcctatctttgttttctgcttatctttatcagagactattgcttgttcatgggaactgggctttctctattttttccagcattcagatggcttcttttgacctgttaactttctataggttgggagccacgtgtaccagtgtgtgttgatcttggcttgattcagtctgccttgtaacaggtgaggtttctgctttctatctgccaaaccccaccgcaaaatttgtccaactgggcctaacctcaggacccatttccaagttgggtataaaactgggagaataagtcattaggactgacattggcctgttggtattactaggtctttgttggaaataagagcttggagttccaaagaaaacgagcacttgaacaaaagatttctcagcaaggcaaatttacttctgccgtagggtgctgctgctggcattcctggcaagagcacacctaacaaaagagagaaagggtttttattcctaacaagtagtccctgcttctgtgtcctatccccattggctggagtcgacagcgcaatctaaactagtcctgattggctattttaaacaggaggcatgtgggttacagctgtgggaagggcaggaaacttgtttacagagctggttgctaggagtgagggggacttttccaaatagggaacaggttacaggttgagattggccggagaagttgtttatagaacgggtaactcggagcaggaaggtatgaggaagttgaccttaagaacaaagaacaaggaagttaaaactttgaagagaaatccattgtatctaacgatttcccccttttgatttttataattatttctcttcagacttgttttagcgtgtcttgattttgttcctcttggtcctctgaaattagaagcttaactgaatgatgcgagggaggattgaggaagattttggtgggtgagagctgttaaaataagcttttgtattaatcctcagatacagggtatgatacagcatcctacaagaatgagcaaacctattctgatggcaggagattgaggacgtaagtcctttccatttgcggaactatttttccattaaaatcgtgaaggggtcatttattccagaatttctagctagctcattggataaagcagtaagtccttgggcctttgttatggttccatcgggagcagtattattagggatgaaagtacaacactgggttccaatcatgacacaaactacacctttctccgctagtatcatgtctaatgctattgtattttctcaggccgtttgactggtgggccctaattgttaaactgttcccttaatagcatccctagtataattaatgaatcgttgctgggttacattttttgtgttttttttgagatggagtctcactctgtcgcccaggctggagtgcaatggtgcaatggttcactgcaacttccacctcctgggttcaacctactctccttcagcctcctgagtagctgggggctgtcaccatgttggtcaggctggtctcaaactcctgatcttgtgatccacccgcctcagcctcctaacatgctgggattacaggcgtgtgccaccactcccggcccaatctacatttttatttagagttgaccaccagaacaacatggattcaaacttgcagctatttgattttgggccttaaatctatctggcactcctcgtgggattccaatggcatctatataaacatgagagtcacgagggacatccattgttttatgatgttctgtttttatgtatgttttctggatgaaataccagggtgaaagggagatagccaattggattagagctcaagtgccacgccaagtaacttggcagagtattcagtaatggtccaccacaacaccaccatacgtttgcttggggatgaataagggacgactgattggtaagctcctggaagggcttaagctcactgcatctcgttaggtctccaagcaaattcaagttctccccctgtgagagacacgaggtaaaattggcattggaagacggatgcttgatggccctcgggggctgacccgcagggtgtcggacttcaggggacttcaggaaacagcagcgagagagtttggcatagcttattgccccaggttgtggggtcttggaagagagctgccatacaacttaatgcctgatcggctggaggacgatccgagtggaaagggaacaatctggggctctggcttaccacgtgcgtaagcataacaatcgctttgtttagcgagcggacagaatgtttaatccattccagccatgcatttgcatctcggtaccgtttcaattggtagagtttgctttagatctttaacctctacaatggtcactttggttttgtcattgggtgtttgtttagaaggggatgaagggggtgggggaacaatgaagcgcatttcgaaagatcctgtagggtctatccctaatgttgcggctcccatgctgtagaagctacttaaagtgggattaggattggtggaggtagaggtaagaatagaaatttgcactgggttacattggtgatattggcaattagagggggccttccctttgaaacgaaggtagggttgtagagagatgcagctttttggggaagtctacccttgaggatcggtattccataggacgtcattccgggatgggcagaacctctcctcaaacccttcccattcccaaactgcaaagaatgtaatggatttagtttcgattaggcaagcattgtgtgaggatttagaatttatcttggaagggcagagatatttttctgagaaggccagttgcctctggttttggagatccccacaggatatgacaagacaggcatcaaatgtgattgaggtgagcttgatctagttacattaatgataaaatagctgacggtagagagaggaaagaagacaaggcagtataagagggttaaagttttcgtagctttaggttggtagaaattggccctggaacaatagcccatgactctgaagatggtgatgctgttttgactggggtatgatgggtccaccccttttcggctgttcgggctgctgtttcagttaggagtgctaggtatggtccttcccaagctggctccttccagcttttgataaggatgtgatctccaggctggtattgatgtaccaggaactgtaagggtggcatctgtgctaaaatacctttagttctgaggtaagagaaagtggaaagccaagtatataatttgatcctttgtttcaaaggtaggaatgtcagtagtaagagtgtaaataaggcagtccacataacagagagataggccagtatctttctgagaggcagtcctgactgaattaggtgaatctgtaaacccttggggtaggactctccattggtactgctgcttccatccagaatgagggttttcccactcaaaagcaaatacttctcttgtcttcagccaagggacatgcccagaaggcatcttttaaatctgttactctgaaccattgattgtcatggaattctgctgaggatggtaaaaggattggggacaacagggtgggtagtctggactatttggttgatagcctggagatcttgtactagttgatgagacctgtctgatttctttacaggtaatactggggtgttaatagggggacatacagggttcagggaatcagtcctgaatgagaacttcaactacaggctttaattctattctgccctctaggggaatgggatattacctttttcttactatttcccctggggtctttaactttgtatggattggagtgacttgaagtttctttttttctttcttttttttttttgagttggagtctctgtcacccaagctggagtgcaatggtgtgatcttaagccactgcaacctttgcctcctgggttcaaacaattctcctgcctcggcctcctgagtagctgggattacaggcgcctgccactgcacccagctaatttttgtatttttagtagagatggggtttcaccatgttggccaggctggtctcaaactcctgacctcgtgatccacccaccttggcctcccaaagtgctggtatttcaagtgtgagccagcaagcccagcctccctgatttctttttcctgcccatacatgaggatgaatgtatttttcttctgcggtggtaagtctcttcctaataagttcgttcctgcctcagggattaacaggaatttaacatgggctgatcaatttttgtatagacctctgtcttttaagatttttgctttaaatcttttatccctgagatagaaagttcttctgaagaacaggtgatagataccagatgggagggaacgggagcgagctgctgctgaatctgtaagaaggttttaagttcacatttgggtcccacctctaaatttatcaggggctcttggtgggactcaaggtaaaagagacagcccctgacctccctattttcctggaaggccataagtggaatattttttctttttcccatttggggcattctcttttgaagtgacctactcttccacatttgaaacatttgttttcccctcttccctgtcctgcactgtgacttccaggttttattcccttactccttgtatacagtttggtcgctggtggcctagagggtttgtaagttttacttccttgtgtctcctactgcagagttctctgttgtaaggtagacagcatgatttttgccttttgtttctgctgctctttgtccctacttatatgcttctctaagaagttagtctctgggacaatctttccaattctctatcttttgtagttgtttttagaggtgtttggccaagtcttagtaacaaaatgaagctttagcatcccttgccccagtgggtcttccatttctaaacctgcatattttctcatctgttctttaagcctatttaggaattcatgggtccttcatccatcccttgtatgttgaatgcttgggaaatactctcagttcgggatactgatggaacattttgaccggtagggtgttaatgttcccagactaccaaagcagccctatggatcatggttcttctcccaagaagggaatgcctaaaatggacataagctcggcccatacaactggggtcctaaaaaatgatttgatctgctaccccataagggtcatctaacaagggcttgagtttttctttttttttagattttgtacttctgagctggttaagggggcatttacgaagctgatgcctcctctcccaaggggcacttcttcaaggggaagagagttgggggcaattctttggaggtggaaaggggaaagggaagttctgagtatcctttttacattgttctatttcatgctgtagggcttaagtgtgtggctagggggaacatggggtattgattcaggattatatgggggagggactgatgagtggggggatcctgtgtaccggcttgatgcatggggtttggcagaggcaagtggtctggtgggtcccatatgttagcaggctgttcgggggtagagaccttactcctttcagaggagttggcttctggcttgcttcctgtagttatgtttagtcctttcactatccttttagcatgagaacctaggggactgtcagaggggatgttactgtcattaatttgatcctttctatttactgtctttcttgaggtattttgcataatgaaggtttggtgtgaggcccaaaattagatttattgcctttcctcataggctcaacctcccttactggagatttcttgccattcctttctctagagggtcagcccctggctactggagatttcttgcactcttctccttttgcttcatccttctctggctgcttcccaggagggaatatttcaggtcctccttagcattggtgtgtcagtataagccccatgacaggaatccaccataagctatacgaggtgaccatggaatcacagatccggaatcatcgctcgcttcgcactcagttgtgcgtctcattgacacactttcaacctctaaaatgccctgaccaccaaggaaatactttgtcgcccctgtgacttttcttaacttggtctgtgcagttacctggtcaccgcagtatgtgaggatcctttccgcctgtgttgctgagagtctgggtttatgtgtcaccttgggtgggacccaatctcctgtttgtgaggccaccgcaaagaggtggtgggatgcctctcctcaagagaggtgatcgtgggcttctcctgaaggagaacggtaatcccagatgagctcccaaattgttggcaataagagctcagagttgcaaagaaaatgatctccaaaagatttctcagcaaggcagatttacttctgcagaatggtgctgcttgcactcctggtcacagtgagagcaccccgaacaaaggaggtgaagtggtttttatccctaacacagctagttcctgcttctgtgttctatccccattggctagagtccaatctaaactagtcctgattggctattttaaacaggaggggtgtgggttacagcagtgggaagagcagttgccacgagcgagggagacttttccagataaggaacaaatgcgggttacaggttgggattggtgggagaaatgtttacagaatgggtaattaggagtgggaaggtatgaggaagttgaccttaagaacaaagaacaaggaagttaaactttgaagagaaacccatcatacctaacagtcttgtaagaaaggatgacaaagtgattgaacattgggtggagctaattttccttggccaattcacttagtaagataaggagctccaaatcatatttaagttgggagtcaattgattttacttaattcttgtgaggttcagttataagattcatcatactactaccatgagccatcctcagctccttgttacatgggcctgttaacatggcagctttgtctataagcaaacccaggagagaaagacatagcagagatggatgtttgaagtctataccttccaccccctttaaagagaaagtaacaccactccttttctgtgtcccttggggacactacctccatgtctggtcacatggctggactttacagcagataagcatactgtggcctgagaccatgattgtatgctttccttctgctgacctttacaatccctcaataaattgagctaacacagggaagcttttttaccaaataactgtgttgcatcatcctccagtttgcctggtgtccttaatcaatggaaggggaataagcaaactgagttttcttacaccttttgagtatagtgtttttgccatcatagatgtggctcctcataattctccaacttttatattaaaaaaccaaaacctcaaaaattgtagttcatgtcagtcagtgatgactcatcttagaagtattttgtttttggatgtgtgaatgtgcatagttcttaaagtccaacattcatgtaataagacatcttgcatataacaatgacccttacgtctaagatgttaaatagatcctaagcctggtataactttattcaagtatccttatttgcccctaaaatgtctttaatacacattacttgggttatttcttgaatgaacatacaggtatcccaatttctgtttttaagagaatggggtcttgctctgtcacccaggctggagtgcagtggtgcagtcatggcttactgcatccatgatcctcctgcctcagcctcccaagtagatgggactgaaagcacacactgccatccctggctaatgttttcatattttgtagagttgcagccttgctacgtgacccaggctggagtgtagtagctattcacaggcatgattgcttgaaactcatggcttcaagggaaactcccaccctcaatatcctcagtagctgcaactacagccataccccccactgctcagcttctcatcctttaaaagatttttactggtagtgtcctcattctgggtttttgtcttctgtgtttactgtgacatgaagtcatttttagatgaaggttaaacattttgccaacgcaggtacaatatgggattcaataaaagtacagaattaaagttgtcttattagagattgggaagtttcccagctccgtttatcggtacttggccgtaccgataaaggggatggacttggagtgaccaggtcttagtcacatgtattttcataccctaaacaagaagcggtatagaccagaatggagcactgattgtaatccaccttctttcttagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaatgctgttttgtttggccattggagataaccattgaacagggataacaagtagtagttaggtatttgcagtttcatttggttttagttttttgaggggagaatcaccctagtgggcagttggtttctgtgggcaaagcctgctttccacaggtattgtgcctcgtgattggcttctgcattggaaacctaagaataagcaagcacacttgggccagaattcaaagcagagggtcaatacagaggtatctcacttgtatgcttacacctgcacaagatcgtgtatgttaaatcgtgggtattaggccttaatggttgcatgagatgagtaaggatgatgtgggctatggtatttgtttataaacttcataggaaattgcaaaaataggctgcatcatttatcaatatgtgatgattttttatttaaaatacacagtgaataattttttaagtatcttaaaatctcacctcaaagatgggacctctagatttcttttttttttctgaggcagagtctcgctgtgtcacccaggctggagtgcagtggcatgatctcagctcactgcgagctctgcttcctgggttcacattctcctgcctcagcctcccaagtagctgggactacaggtgcccgtcaccacgcccggctaattttttgtatttttagtagagacgggttttcgctgttttagccaggatggtcttgatctcctgaccttgtgatctgcccacttcggcctcccaaagtgctgggataacaggcatgagccactgcgcccagcctgggacctctagatttctaaaatgactcctggtattgactcagaatcccctccccttgactaggctggacctagtgtaacttctgagacttgctagctctttttctcattctccttggcttgctcactttttttttttttttttgagatctcagctcactgcaacctccgtcccctgggtttaagcaaattctcctgcctcaccctcccgagtagcttggattaccacgcctggctaatttttgtatatttagtagagggggttcaccatgttggccaggctggtcttgaactcctgacctcaagtgatctgcctgcgtcaagcctcccaaagtgttggaattacaggcgtgagccaccacgcctggcctagcttgctcacttttaattaagctgccatgttgggagaggccagcgtagcaatcaactgaggttgaaccattagtgtgggaggagttacccaacaaccatgtgagtttgtaagcacgtctttctgtagcggaggcttgtgagaaaccctgagagcggacccacccagattgtgcttggatttctgacctatgggaaatgtatttcaagccactaggttttgagataacttgctacaaagcagtaaattcacaactctataatgcccactctaaaggtcctgacatgggcatctccattacctaagtcaactgatgctacttcaatttctccacgtagcatttgaagcgtttatgtctggccccagcctacattttcagacttatttgtgcatttgacttaacatgtccaaaactaaatgcctgatgcttcactcacctaaccccattccctgcaagtctgtgcttcctgcgatcttcccttcccaggtattggcaacaccagaagtccagttggtcaggagctgtggaatcaacctcatgtaccatgtgaatcccttggcaaatgctattggttctaccttcaaaatacatctgaaacccaccccctcttagcgtcttcattgctaccaccttggtacaaaccatcaaacaagcttggaatactggtctctacttcagcctttgctccctacgatcaattgagatgcaaccagagcgatctgtgaaaacctgaattaggtatggagctctctgctcagaagcctccagtgtcttccccacctcacacagtaaaagccaaagtccatcagggcctacatgatcttccccttcccttaacctctaacttcatctcttccctttcaatcttagccacatgggccccctgacttctccattcctttaggattactccaacctcagtatcttagcacttgattttcccactgcctggaatgatcagccctagacccccagagctttgcacagccctctgccttgtgtcattcaggtatttgctctcactccctctggggaactgtctaatcatctctatcactttctattcccttatcttgttttttatttttttaaatagaaactgttgctcaggcgggtctcaaactcctgggcttaagggatcctccctatttggcctcccaaagtgctagaattacaggcatgagccaccatgcctggccatgtttttacttagtgcctaacaggtactgcctatgtgtatagtatatacatgcatgtacatatacatctatgtatatgtgtatatatagtttgtcatacagctgttaagtggcagagcatgcatttgattctgtcagtctgctcttgtatttgtggggtgtttgttttgttttttgagacggagtcttgctgtgtcccccaggctggagtgcaatctcagctccctataaccttcgcctcttgggttcaagggattctcctgtttcagcctcctgagtagctgggattacagaagcctgcacggtgccccttaatttttgtatttttagtagaggtggggtttcaccatgttggccagactggtctcgaactcctgacctcaagtgatccacctgcctaggcctcccaaagtgctgggattacaggcatgacccacgtgcctggcctggcacttgtatttgtaacccttggcttaattgcaacatgttacttcaatgcagtctaatggatacaggaaggagataatttctggctcttaaaagctcaaatgcttttgctggacttctgtgttgatgagataccactgaggtcagaaatggccccaaatacctgccagccaggggccagagaagcttcctggagaactcccagccacacccatagtctcagctttgctgttgcttctctgagctccaaggcagttgtaggcctctaatgatcaaactattggcaacccgtctctagctttagctcctaccagtcccaccaaacatttgatgcttcagtctcgttttacctctttgtcttattgactgaggagtcctttccttctataagcttcagtttcctcatctgtgaaatgaggtttattgggtgcttgccacgtgccaatattgtgctattatctcatttaatctataccccaactctgttattaccctattttatagatagcaaaacaggctcagggaggtttggtgagttcatgtaccttgaaggtggttcttgaaagctgggatgtgaaccagtactatcctaggcccctaatttccaagggcctttgcttaagaccctcaccaactgcatgggtaaaagcacaagcatggccaggcgcggtggctcacgcctgtaatcccagcactttgggaggccgagccgggcagatcacaaggtcaagagattgagaccatcctggccaacatggtgaaaacccgtctctactaaaaatacaaaaattggctgggcgtggtggcccgtgcctgtagtcccagctacttggcaggctgaggcaggagaatcacttgaaccctggaggtggaggttacagtgagccgagattgcaccactgcactacaccttgacaatggagtgagactccatctcaaaataaaaacaaaacaaaaacaaagaaaaacccacacaagcatttctggaaagctgtgggaaaaaataagagattcacaatgtcttccagaattttagctgagaggtggtggtattatctcccccataccccactactcattttctgggaacagagcagttttacaaatggtttggagcttgggcttattcccagctcctggcagacagcagtaacttccccagatctcctatctgtaaagtgggcataacatgtctttcctcctggagttactgtgaggatcaagtgagacaatgtgtcctctaaatgcttgaccacagggttaggtcagtaattgttgcgggaagtcagggaccccaaacggagggaccgcctgaagccatgacagaagaacgtggattgtgaagattttatggacatttattagttctccaagttaatacttttgtaatttcttacgcctgtctttactgcaatctctaaacgtaaattgtaaagatttcatggacttccccaatcaatacccttgtgatttcctatgcctgtctttactttaatctcttaatcctgtcagttgaggaggatgtatatcgttccaggaccctgtaataattgcgttaactacaaaaattgtacagcatgtgtgtttgagcaatatgaaatgtgggcatcctgaaaaaagaacaggataacagcaattgttcagggaataagagagataaccttaaactctgactgctggtgagccgcgcagaacagtcatatttctcttctttcaaaagcaaatgggagaaatatcgctgaattctttttctcagcatggaacatccctgagaaagagaatgtgcacctagggataggtatctgaactggccccaccggggcgtacctgtctcttatggtcgagattgcagaggtgaaataaactccggtctcccatagcgctcccaggcttattaggaagaggaaattcctgcctaataaattttggttgatctcaaaaccctgtctcctgataagatgttatcaatgacaatggtgcccgaaacttcattagcaattttaatttcgcctcggtcctgtggtcctgtgatctcgccctgcctccacttgccttgtgatattctattaccctgttaagtacttgatgtctgtcacccacgcctattcacacactccctccccttttgaaaatccctaacaaaaacttggctggtttttgtggcttgtggggcatcacggatcctaccaacgtgtgatatcacccccggacgcccagctttaaaatttctctcttttgtactctgtccctttatttctcaagccagctgatgcttaggaaaatagaaaagaacctacgtgattatcagggcaggtcccccgataagtaatagtcatcttcatccgagtgaaaaggaataaactagtgattgtgcaacaacttggatgaaccccagagatgcgatgctgactgagggaagccagcctcaaatggttacatgctgtgtgattccatttatttgacattctggaaaagacaaaggtatgatgaagggaagagatgatggtgttgccagaagttaggatgggtggcggatgtggatgtaaagggatcgcacaaggaagtgtttggggtgtcatgattgccgtagtggttatatgaatgtactgggccaggcatggtggctcacgcctgtaatcccagcactttgggaggcccaggtgggtggatcacctgaggttaggaatttgagaccaccccggccaacatcgtgaaaccccatctctccatctctactaaaaatacaaaaattagctaggcgtggtggcgcgtgcctgtaatcccagctacttgggaggctgaggcaggagaatcacttgaacctggaaggtggaggctgcagtgagctgagatcgcaccattgcactccagcctgggcaatagagtgagactccgtctcgaaacaaaacaaaaacccagatttatagaactgtacagcaaaataaaaaaatagttttattgtatgacaatttttttattatttatttttgagacagggtcttgctctgtcacccaggctggagtgcaatggtgcgatcttagctcactgcagcctccaccttccgggttcaagcaatcctcccacctcagcctcctgagtagctgtgactacaggtgcgtgctaccacactcagctaatttttaaatttttttagagataggggtctcactatgttgctggagttgatctcaaactcctggtctcaagtgatcctcctgcctcaccctccgaaagtgctttttaaaaatgttaaaaacaaacataggctctggagctagacttgggtttaaatcccggctctgttatgtattagccattggctcaatcttctttttcttttcctagattttgcctgcctgagctcctctagtagtggccacaattgccagagaagatagagcaggtctctcccaggacttgcagctccagcctgtgtctgcaaggggtgttgtagcgactgatttctccagcccatggcaagaggccttcatcttgtgcctggaaagagggaagtacaagtccgtctggcagagatggtgcagatgggcaagtttttcagacactgcagccagcacttctgggaccgcagcagtggagcctgcagagggccggttctccaggcatgggctactgacattgtcacttccagactccttatgcaataaacaacccctaaacagatttattcacaatttctccatcctaacaagtcagtgatcagttttcacttttccacattcccttctgtccccattatgttcccatagtggggcagcttctacctgcatggttggagcttcccatttttaaagaggcaagaaatcctttaaagttctttgaaatgtttgtagcctgttccaattttataaactgtgaagactgagcaacacacaatgcatgggcctcatatggcctggaggccaccagttggagacctctgtagcttgagctgtgtccctttcagcactgttcttgtcattcctgagctgggatgccccctgaaacataggatgctcagttaaatttgaatttctttttttttttccttgaaatggagtgtcgctctgtcgccaggctggagtgctgtggcgtgatctcagctcactgcaacctccacctccctagttcaagtgattctcctgcctcagcctcccgagtagctgggattacaggcatgcaccaccacacccagctaatttttgtatttttagtagagacagagtttcaccatgttggccaggatggtcttgatctcctaacctcatgatctgcccgcctcggcctcccaaagtgctgtgattacaggtgtgaaccactgcgcccggccgatggcaatcattctttaagatgcagcctccgtggacctcgtaccttctcagtaatttccatattctttgctgacttgggtttttcctccaaaattgtctgggataaattgaggtttgtggagtttcctgatggctagtttccaaactggcttcaaagcctgggcttgtggaattggctgggtctgcggccagcctaacccatccttcggtcacagtctcccatggtcctgatattaattcatcacaggtctgtttagaaggtggcagaaacagacggtcttgggcttatttatatctgtggctttttttaaaagacagaaaaggagaaatctggatcctttccttgtcagcctcctttaactaaatggtcttttgctaaaatagactggccccactgtgtgggtaggaagggttgagatgggagtgggccaagtgagtgagaactttttttttttgccttgatgttaaaatggcagcatgtgcagtcttctgcctctgcccaggttgacctgatgtttttacagggagagaggctgcttgttgagtgtggtggtatttatcatagtgtatgttaggctgcctcaaacatccctcgctgtcgtacctttcagccaactctaatgtacctctctcagcctgatttctccccacttgagttataataacaacaactgccttttaaaaaatttcctactgggcttcatgctaggtactttccacgttttatttttatttatttattttttgagacagagtctcactctgtcacccacgctggagtgcagtggtgtgatcgcagctcactgcagcctcaaactcctgggctcaagcgagcctcctgcctcagcctcccgaatagctgggactacaggtttgtgctactgtgcccggctaatttttctatttttttgtagagacagtgtctccctttgtttcccaggctgatctctcctgggctcaagcgatcctcctgcctcaacctcccaaagtattgggattactggtgtgagccaccattatatgttttaaataatttattcctcacctcaagtgagtgaggtaacatcccagttttacagacaaggaaacagattgggcaggggaagtgacttgcctcagatgcacaataaatggctctgccagtgtcttccttagcgcctccgatccccttctcacccttgtcctctctgctcctctctgctcaatgctcctgggagcgtgaactgcattaatggctccttgtctggtggcctcaaggttccccaggaggcagggagggtgaggctgagatgtgtgctcccctaaggcacatgcctcagcctggctgcctctgtctaaggccacagcccctcaagtgcttccccacctgactttctgggctctggtaaccgcttcctgcctgccccatcaggtgtagggggtgcttcatgggtcaacattagcttatgtggtttccttatatcctgggcgcacctttgttagtctcaaattacattctgcttgaactattctctatccagtgggttgtgactatctagaggcagagttgggatttgaaccccaagacttcaaaataagctctgtgcaaatggcctcccagagctgcctgctggtttcttctgcgaggcctggcttctccattttggcttggaccatggcctgctgtcatttccacaacagttgcaggaagttgccaaatgcgttttctgtgactgccaggctggtgaccctgttaaaaacaaagcaacaacaaaaaaagcaatttcttcaattaaaattacaaaacagaaaaaaaaaaagatgtcacacttgggggaagctggttgaagtgtacttgatattctacatactattttcgcagttctctgtgaatcaatagttatttccaaataaaatgttaaaaaaaactttattactaaatcagaaaaaaacaacaacaaacaacaacaaaaaccaaagcagaatatgtggtgcactgttgagggaagtacagaaggataaaaacaagaaaatactgacacaactcagactccactgttgaaccttattttattttatatacttctaggtcttttttttttttttttttgagaagagtctcagctcactgcaacctctgcctcccaggttcaagcgattctcctgcctcagcctcccgagtagctgggattacaggtgcctgccaccatgcctggctaatttttgtatttttagtagagacggggtttcaccatgttgtgcaggctggtctcgaactcctgattcaggtgattcgcccgcctcggcctcccaaagtgctgggattacaggtgtgagccactgcgtcaggccacttctaggtctttttctacatgtttatatatacactgtatgtattctttaccaaagtgggatcataccataatgctgttttttttttgttttgttttgttttttgtttttgtttttaagacagtcttactctgtttcccaggctggaatgcagtggtgtgatctcggctcactgcaatctctgcctcccaggttcaagtgattctcctgcctcagcctcccgagtagttgggactacaggtgcccaccaccacgcccagctaatttttgtatttttggtagggacggggttttgctgtgttggccacactggtctcgaattcccaacctcatgtgatccacctgccttggcctcccaaagtgctgggattctaggtgtaagccaccacgcccggcctatagtgctgttttgtaacctctgtcagttaaccatctccattttttcacatcaataaatttcccatttgtccacaaaagtcctgtacagctggcagaggatatgtgtgactggaggccattaggtccttcaggttcttccagcctagcaccaccctttcttcccctttaccataggggcttgtcctagagaacgtctcaccttctggattcatctgagtgttgccttctgggggtgtcacttcatttgttcctctgtatcctgcatcccctgtaaattggagagtcaatctaaagttttgataagatcaagttaaatattttggcaagaaagcgtcatacatgatgatgctgggcacatcaggtgacatcacattttatatttaatggacaaataaaagttgtatatatttactgtgtacaacacgatgttttggaatatgtatatgttgtggaatggctaaatcaagctaattaaaatatgcattacttcactttttttttttttaagagacagagttttgctctcgttacccaggctggagtacagtggcatgatctcggctcactgcatcctctgcctccagggttcaagcgattcttctgcttcagcctcccaagtaggtgggattacatctgccaccatgcccggttaattttttgtatttagtagagacgggtttcaccattttgctcaggctggtctcaaactcctgacttcaggtgatctgcccccctcggcctcccaaagtgctgtgattgcaggcatgatacttcacttattttttgtgataagaacacaaaatctcttgagcaatttttaagtacacagtatattcttattgactatagtcaccatgatgtacaatagagctcttgaagttattcctcttgtttaactggaaatttgtaccctttgatcaatatctcctgaaaacaattttctctgcttctctcttatgactttgacttatatgtgtagatgccacatagaagtgatatcttccagcctgggcaacagagtgagattctggttttgtttgtttgtttcttttttttttttggagacagtctcactctgtggcccaggatgatctcggctcactgcaattctgcctcctgggctcaggtggtcctcccacttcagcctcccgagtagctgggactacaggcatgcaccactacgcctggctaatttttgtatttttttgtagagatgggttttgccaggttgcccaggctgatcttgaactcctgggctcaagcgatctctgcctgcctaggcctcccaaagtgctgggatttcaggcgtgagccaccatgctcagctgagactgtttctaagacagtctcactctgttgcccaggctggagtgcagtggcgggatcttggctcactgcaacctctgcctcctgggttcaagtgattttcctgcctcagcctcctgagtagctgggactacacgtgcccaccaccacgcccagcgaatttttgtatttttagtagagacggggtttcgccatgttagccaggctggtcttcaactctcgacctcaagtgatccacctgcctcggcctcccaaagtgttaggattacaggtgtgagccaccatgtctggcctcacacagaattttaaaaacacattttaaaagtgtattcaagggttgacatgcaatagaattagcaatttttactgctttatcaaggacattcctaagtgaaactggctctcttcttgttactgtgggcttgtaggggtgaagaatacagtgattactaatagaattaggtgccaccactttgattcatgctaaggagccagcagctttgtcctctgttgtttttgtaccatttaacgcaaatgtcacaggggaatgttaaaagataaagtcttactatcattatgaaaattcttggccgggcgcggtagctcacgcgtaatcctagcactctgggaggccgaggcgggtggatcatgaggtcaggagattgagacgatcctggccaacacggtgaaaacccatctctactaaaaatacagaaaattaggcgagcatggtggcaggcgcctgtagtcccagctactcaggaggctgaggcaggagaatggcgtgaacctgggatgcggagcttgcagtgagccgagatggcgccactgcactccagcctgtgtgacagagcgagactccacctcaaaaaaaaaaaaaagaaaattcttttgaccttgcagccccctgaaagtgtcttaaacaccatactttaagaatcaccaatctgttctatagacttcattcaaatgttgccaattttcctactaatatccttgttatggtctaagatctaacccaagagcacatttaaaaaaaatatcaacttttactttagattcaggcggtacacatgtaggattgttacaaggatatatttcgtggtgctgaggtttggggtatgattgagcctgtcatccaggtagcgagcaaggtacccagtaaggggtttttcaccccctgccccgtccctctcttccccctcaagcctgtcatccaggtagtgagcaaggtacccagtagggggtttttcaccccctgccccatccctctcttccccttcttgtagtctctggtgtctaatgtttcatctgtatgtgtccacgtgtacccaatgtatagctcccatgtgtatgtgagaacatatggtatttgtttttctgtttctgtggtaatttgcttatgatagtggcctccagctgcatccatgttgctgcaaagggcatgatttccttcttttttttttttttttttgagacacagtctcgctctgtcgccaggctggagtgcagtggggtgatctcggcttactgcaacctccgcttcctgggctcaagcgattctcctgcctcagcctcccgagtagctgggattataggcatgcgccaccacacctgactaatttttgtatttttagtagaaacggggtttcttcatgttggtcaggctggtctcgaactcccaacctcaggtgatccaccaacctcagcctcccaaagtgctggggttacaggtgtgagccactgtgcctggggatttcattttctttcagggctgtgtagtattctgttgtgtatatgtaccacattttctttattccactgctgatgggcacctaggttgatgccatgtctttgctattgtgaacagtgctgtgatgaaaatacatgtgcatgaagagctaacgtcgaaacatgttctatttagatgtcctctctccttaggctctctctctctctttttgaggcagagtctcactctgttgcccaggctgtagtgtggtggtgtgatttcagctcactgcaacttctgcctcccaggttcaagcaattcttgtgtttcagcctcccagacattaaagagatttacaggccaggcacagtggctcacacctgtaatcccagcactttgggaggccaaggcgggtggattgcttgaggccagaagttcgagaccagcctggccaacttggtgaaagctcttctctacgaaaaacacagaaattagccaggtgtggtgacacacacctgtaatcccagctactcaggaggctgaggaatgagaatcacttgaacctgggaggcagaggttgcagtgagctgagatcgcaccattgcactccagcctggggcaacaaagcaagaccgtgtctcaaaaaaaagggatgggaaagaaaattgaaaattactagagggttactttgattacagtattcagggaaggcctctctgaggatgtgacatgtgagccaagatctgaaggatgaataggagctgggcacaagaaaatctgaaagggaagagcattctgggagcggagacagaaagtgcaaaggctcagagatgagaatgaactcggcaacactacacagaattctgtccaacattcttcagctgctgaaaaacttgttcatgataaacttgggactcagacacatataacagacatcagttaaacacttatcagagctggagtcatgttaaagtagaataaaaatgtcaaactccagacatttccataaacactcaacatgcttcatttgcttaggaggaattttcctcatctctaaatcatggggttccagtttcccaaactctctgccaggaagggaaattgagctggaaagtgaaccatcagagaaaattaagcacccggctccaccctgagctttatcatttatcagtggagtcagctagacatttggcagaaaacggtgaaaataacatttgcctgtgtgtctaatggttccatatgcgttttgggttgggtggcatccagaagcagctgggaaaattccagttgtatcaggcattcatctcttctctctgtggctagccactcaggaagtcacatgggtaccttactgctccctaatttagctctgtctttaaaaaatatataaaaatgtttcttttttttttgagatggagtcttgctcttgttgcccaggctagagtgcaatggcgccatcttggctcactgcaacctctgcctcttgggttcaagcgattctcctgcctcagcttcccaagtagctgggattacaggtgcccaccaccatgctcagctaattttttgtatttttttagtaaaggtggggtttcaccatgttggccaggctggtcttgaactcctgacctcaggtgatccacccgcctcggcctcccaaagtgctgggattacaggcatgagccaccatgcccagccaaaaaaatcttccttaagatataaacacacacaaaaggcaaaaggaaggcaacttgaggaagtggctagatcaccatattgaacttcacagaatctgggttcaaggcccatttcatgcactaactgactcagccctctcatttgtaaaaatttacaccagtttcttacaaagtggcaggtactttttagctgtgtgaccttaggcaagtgagttcacacctctgagccttgacttactctgaaaataggcattaataatacttatttgtggtagacactgatggtttctacccaacagttgttttcccctcctgggtctttgcttccttctcccatgacagaagcagatgtggccagaccttcaccttcccaacctcctctgcagctaatgaatgcagcctagttctggccaatgagatgcatggaaaaattggctagggagcttctgtatgtagtgcctgtgattttttgttttcacatgattaataatatgatttcatgcagctattactagatggggccaggcgtggtggctcatgcctgtaaccctagcactttgagaggctgaggcggcgaatcacctgaggtcaggagttcaagaccaccctgggcaacatggtaaaaccccatttctactaaaaatacaaaaattagctgggcatggtggcacatgcttgtaatctcagctgctcaggaggctgaggcagaattgcttgtgcctgggaggtggaggttgcagtgacccgagatcacgccactgcactccagcctggatgacagagtgagactctgtctcaaaaaaaaaaaaaaaaaaaaaaaaagtacctggggctaaatagaaaggcccagaaaatccaaagcatgtgttctgctgtgtaagttggagcagtgcttttggatgcttctcagctaaaaatgcagattctggttcagtaggtctgtggtggagcttgagagatgttcctaaggaggaccatttagggttggctgatccaccatttcaacaagttcttcaagggctcaagatctctcccacttttctccctgccatcctggatggttggtgtgctgtccccaggcttgttgtgtgaaggtcacaaggtcaaggacacaatgccagcgaccacacccagacataactgaactttcaaaggaagaggagcatgtacccttccaggcatctctctatcagtggagaaatctttccccaggagcccattcttctgacccccacccctcaccccagccaatggctgccgtgtggcacaagccaggagtaccattttaatagactctctgggaatgttgtcccagaagttctagcagccttctcctcacatcttattagccagatgtgtgtcgtgtgcttcaagcttaagccagtcattggcaaggagagtagaatgactgtgactggctcaggccagaagtctcaaagtgaggtgctgggaccagctgtacctgcatcacatcgcctgggaagcttgttagaaatacatattttaggctgggcacggtggctcacgcctgtaatcccagcacttcgggaggccgaggcgggtggatcacaaggtctggagttcaagaccagcctggccaacatagtgaaaccctgtctctactaaaaatacaaaagttagccgggcatggtgatgcatgcctgtagtctcagctacttgggaggctgaggcagaagaatcgcttgaacctgggaggcagaggttgtggtgagccaagatcatgccactgcactccagcctgggcaatagagcgagactctgtctcaaaaaaaacaaaaacaaaaacatattttgggcctgcaccccagacctactgaattagaaagtctaggggtgaggcccagcaatggattctaacaagggctccagataattgtgatacacactagaattggccctggctgcgcattggaattatccaaggaactcttaaagctaccgctagatagacgtcagaatggtggttacccctgcaggctgcactggagtatagaccctgaagtagtgtgaccaacttgtggtttgcttgggagtttcttggttttagtactgaaagtcctctgtcctggaaaatcccctcaatcctgggcaaattaggatggtttgtcaccttaccttgatggagcaagagggaattttctggggtgttgaaaatgttctatcccatcatctgggtggtggttgcatgtgtgtacgcatgtgtaaaaaatatcaagctgagctgggcactgtggctcgagcctgtaatcccagcactttgggaggacaaggcaggaggattgtttgagcacaggagtttgagatcagcctgcctgggcaatatggcaagaccccacctgtactaaaaataaatttaaaaaaaactttagcattagccaggcatggtgatgtatgcctgtaggcccagctactaggcaggctgaggcaggaggatcgtttgagcccaggaggtagaggctgcagtgagccatgatcgcgccactgtgcttcagcctggacaacagagtgagactgtcttaaaaaaaaaaatcaagctatccgtttaaagtttgtgcaccttacacatgctactaagtgtacatcacaacttaaaaaaatactgatgtccaggttgtattccagattgattaagtcaaaatctctaggagaagatcccaggcattggtatcatggaatactctccagacgtttctcacgttcagccagatttgtgaatgaacacgatcaaatctccagggagttaaagtgaaggttctgattcagcgggtctgggtgggcctgaaattgtgcatttccaccacactcccaggggatgctgatgctggaccatgctctagggagcgagggccaggcctggttaacgtttaccttctggggcaggcagagggctgctcccctgaaacatcttggtggtcttagtgaggaaggaagaaagtggggctcattggagactagctgtggggtaggcaactcccgtggcattcaaagaattaaaggttagggtgaggttagaagcttacacctgggcaaccatacaaatgcaaaagctcagacatctgttcccaactccctgatgtgccaggagggccatgtttgcctaggttttggctctacttcctagccagagtcaggcctgaatacccagcgtgggcttagtttgcttctcctgaggttactcaggaacctgtctttctggagaagccagtgccatgtccagaggtgccctcctctgcgctgcagacaccacggagactgataacagggctgccagctggtttaattacccagatgggaagctggcaggtggagtctaaccttgacagagattaatgactccattatcttcctaggctatcatcccgtgcgggccccagtccggaatgtagacataaggtgtaaataaagtccttgttctgagggaggacatttttcattgtcttcagatgggaatttgcccccagaaacccttgactcaaattcgggaagtatctttttttggcagaataacctggtcgtttgtgggcatgtgacaggtctcctaaaggctgggccaaggcttgctggcaaaaccaatgttacttgtttccttaaactcattaagaaatacgtgcctgttgtaaacaacttaaagtgacagctcttgtctcctttcccactctttgaaggtaactattatacttaactctttggcgtatagtcttccaaatatatttctttttctgtttgttttcttctccagataaagtttccccccaaattttattggggcataattatagtacatttatttatttatttatttgagatggagtcactctgtcgctcaggctggagcgcagtggcacaatcttggctcactgcaaccttcacctcctgggttcaagtgattctcctgactcagcctcccgagtagctgggattacaggcacctgccaccatgcccggctaatttttgtatttttagtaaagatgaggtttcaccatgttggccaggctggtcttgaactcctgacctcaagtgatcagccctcctcggcctcccaaagtgttgggattacaggacttgagacactgtgcctggatggtggcacatatttaaagtatataacttgattggtctttaaaattattttattatttgcagagataataaatcttccttaataaataaaacaatcttccttcctcactttgttgcctagggctggtctggaactcctgggctcaagtagtcctcctgccttggcctcccaaggtgttgggattacagacatgaacctccaagcccagccccaatttgattactctttttttttttttttgagatggagtcccactctgtcgcccaggctggagtgtggtggcatgatcttggctcactgcaagctctgccttcccggttcacgccattctcctgcctcagcctcctgagtagctgggactacaggtgcccaccacgcccggctacattttttttttttttaatatttttagtagagacggggtttcaccgtgttagccaagagggtttcgatctcctgacctcgtgatccgcctgccttggcctctcaaagtgctggggttgagccactgcgcccggcctattattattattttttgagatggagtcttgctctgtcgcccaggctggagtgcagtggcgcgatgttggctcactgcaaactccacctccctggttcacgccactctcctgattactcttgacatagacccattaaaccatctctccaactaggatagagcacatgtccctcacccccaaaagtttccatgtgtccctttgtgattccttcctacctgcatcccctccactactgaacaacaactgtcactataaattagtttgcattttctaggttttatggaaatggaattatgcagcatatgtatatgcttttgcctggcttctttcactcaacataatgattttgagattcatctatgttgtagaaatcaacaatatgttgcttttaattgctgagtatatcccatggtatggatatatcacaatttgtctatccattcatctgtggatggactttttaagttgcttctaatttatggtgattacaaataaagctgctctgaacatttgtgtacaaatctttgtgtgaacagatattttagcttctcttaggcagatacctaggagtggaaagactgagtcatgtcacatggtaggtacatttaacttttcaagaaactaccgaactgttttccaaagtggtttatctcattttgtgttctcaccagccctgggtgagagttttatgcgctccacatcctcaccaaccctgtgatgatcagtctttctaatatttgccattctaatgagtgtgaagcggtatctcattatgattttaacatgcatttccctaatgtctaacgctattgagtatctttttatgtgcttattggccatttgcatgtattattttgtgaagtgtctgttgaaaattttgttgctctttcttttattgggctgttttcttattgttgagtaataagggttctttatatatgttaaatgtctaaaatgctacattttaatatagtggtgtcctcaaagtgggagtgatgaattttatctaattttgtcatggtcaggggaggagttgtgctctggaagcccatccatggggaaggtgaggttcaaactctaagataaaaactctagataaaattttaagtcctgctgtggatggctgttgtttctttctgcccagcatttacaccttttctgataacaactcaccccaatgttttcaagggagaattattcttccaccatttttagtacctgcggtttgggtgaagctgaccctaaaccctggctcctggggaggggtatgaccttggcctggccaatcagcattttcatcttcctggctctgtaatgtgcatgtaactcagatggatccaatgggattcaactttaggacttttgctggagtgactctttgtattggtctcagcttcctcctcagccacctccttcctcagccacctcctcagagaagccctccctgacttgcagaagagatgaggcatctctgatgtgctcagttagctcgctgatctttcatgcacagcacttatcacagctattaactaaatatttgtatgattatctgtgtaataaatttctgccctccagactgcaagctccatgaaactggggctgcatctcttttgttcactcttgagtccccagcattggtatagcctatccgtatattttgaacgtgaagatgacaggatttgctgaggaattggatgcatgctggatgtgggagaaatagaaacttgagacttaataaatacttgttgagtgaatgtaggaagctacatttgtgcatgagaaaactgaggtccagagaggtgaaatgactctccccaaatcgcacagcaagtcaggagcagagctggaatgtgaattcggggctgtccaacttcagagcttgtgctcttcctcagcaccctaaatgactccttgcaaactgaacataattttccacaacaaacactgcttaggcatggcagatacctctgaaataaactgtgttatttatctattgcttcataacaaattacttcccaaccttggtggcttgaaacaacatttattaactcatgatttctgtaggttgggatccaggtgtggcttagttaggtcctctgctttggggcctctcataggccacagtccaggtgttggctggggctgcattctcatcttaaggcttgactggggaaggatctgcttagggaaggatttgcttccaagctctctctcttttttgttggagggattcagttctgagggttcttggttgaggtccattccttgccacatgggcctgtcccttgggcagctcacagcatggcacctggttttatcaaaggagtgagtgagtgggaaaaagtgagcagaaaggaagtcatggtatcttgtagcctcatcatggaagtgacatcccatcatgtttgccttgttctattcattggaagtgagtcactaagtccagcccacacttcagggaaggaaattacataagtgaaaacaagtttgtgaatgcccaggtcagtgggagtcatctgagaagcctgcctaccacttaaactaagtctctttctcatgtagcttaacttctggtcaggggaagtgcacaaaaagcaaacaaataaataaaaatataacacatcagatgatgctaaaatgcttgcagaaaatcatgtggaggaggttatggagggctgggtgcaggaggagactaagcattcttactttatatcaggtggtccgcagagacctgggtgagagggagacatctgaatagagagctgaaggaaatgaaacaacaagccaaaaggatacgggaaagagcattccagcagcaagaacagcaggagcaaaggccccgcatcacaaacctgcctgaagtgttctaagaacagcgaaggtcagtgtgactccagtgatgatggcaagagagagagtaccaagtcatggggttagagagataacagggcggccgggcatggtggctcacacctgtaatcccaccactttgggaggctgaggtcaggagtttgagaccagcctggccaacatggtgaaacctggtctctactaaaaatacaaaaattagccgggtgtggtggcgggtgcctgtagtcccagctactcgggaggctgaggcacgagaattgcttgaacccaaaaggcggagattacattgggttgagatctcgccactacactccagcctgggtgacacagagagactctgtctcaaaaaaaaaaaaaaaaaaaaagcgataacagggcgtcgggtcatgtaggcccttgtagggccactgagtgagatgatgagaaaacattagaagtttctgagcagagaagggatgtgatctgacttaaatttaatagagtccctggctgctggttggaggacagaccttgggagacaaaggtggaagaaaacaaattatgaggtttttttttacctggttcaagtgagccatgatggatatttgaagaatttgctaagggtgacaacacagaggaatccaggccaactacaagatattcggcctgagcaactggaaagatagagctgctagtaactgatttggggaaactttgtaaggtgaacattgactgggagcaaaggatgaaaggcccctttattttattttattttattttatttgtatgtgtgtgtgtatgtgtgttatttgttttgttttgttttgtttttttgagacagggtctttctctgtcactcaggctggagtgtggtggcgcaatcatggttcactgcagccttgacctcccaggctcaagagatccacctaccttagcctcctgagtagttgggactatagatgcatgccaccacacctggttaattttttaatttttttgtagaggcaggatctccctatgttgctcaggcaggtcccaaactcttggcttgaagtgatcctcccattttggcctcccaaagtgctggaatcccaggcgtgaaccaccacacccggctgaaaggtggctttggcgctgctaacatcaaggtccctgtgagacatccgagcagagatgccaagttggcagttggagactagagtctagacttcacgggagaggtccaggctggggatgtaaactcagaagttgtcagtttattagtgtttagagccatgagtctggatgagatgggagagagagaagaggcccaagcctgagctttgggcacttgattaattcaaagccacaagatgaggaagaaccacctgaaaagactaagaagttgtggacagtgaggtaggaagagaactaagagaagaaagtgctgaatgacaagcagcatcatggtagctggccatgggaaatggcccgccaaaaactgcacactgcggttcacactcttgctcggccccagccactttcctctgggctgtcaccatagaactaacaaaaagcagcagaagtggcagcctgccttctgaggccaggtcacaggaaatcttgcagcttctaccttagtgtttttgaatgctgctctgggataagccagttgccatcaaagaagtttgactactctgagccaccacgatgtgaggaagcccaagctaagcatgtgggaagcccaggatggagggaaaagatggccaaccagggccatggttgttccagccatctcagctgaggcaccagccacaggagtgaagaatttgttttagacatccagtccaatcaaaccttgccatgactttggctacagctgcaccagcatgagaaaccctgagggagaaacccacaggactaggagagacagtgacacactgtcattttaaggctctatattctgggatggctcattctacagtggataatggagacaggagttcattgcaaagggagactgaccagtcccctgcccgcaacagagcacagccctcttcacccagacccatggagaggtggctgagcagacctcagctgggcagccctccacactctgaaggctccccctttcctgccttagtggcaagaataataattttctctttgtgcccagagagctggcaactgccaagtgccctgctgtccccagggcccttacaaaaagactgcaggggaggtttttctgagaactgggtcaccggttacttagatgcttcaaacctggcagaacagagaaacatcagataaaggagactgggaacttcataggaagctgctggtccttgtcatggggacacaccatgacaagccaccagagagtggctgcctgccctctctggacccttatgtcatagggacctcctctcttctagagagctctctctttctttgtaaatgtttgtaaatctttctttgtaaacattttggaaagtatgcattaatcaggccagacacgatggctcacgcatttaatcccagcactttgggaggccgaggcgggcagatcactcgaggtcaggagttcaagaccagcttggccaacatggtgaaaccctatctctactaaaaatagaaaaattagctgggcatggtggtgggcatctgtaatcccagctactcgggagggtgaggcaggagaatcacttgaacccaggagaaagaggttgcagtgagctgagatcacatctgtaatcccagcactttgggagtctgaggtgggcagatcacttgaggccaggagttcgagaccagcctggcaaacatggtgaaaccctatctctacaaaaaatacaaaaattagctggatgtggtggcacatggctgtagtcccagctactggagaagctgaagtgggaggatcacctgagcctgggaggtccaggctgcagtgagccgtgattgtgccactacactccagcctgagtgacagagtgagaccttgtcttgaacaaaacaaaacaaaacaaaacaaaacagaaaaaaacctgtccttttctcccactgcctgttcagttccccagaggcaattgcttaacatttctttcacatttattggaataggtaacacaaggcgtgtgctaaaaatttcaaaaggtacaaaaaaggtaaagagattaagtctccctccttccttctccccacccagctcctctccctaaagacaaccacttctaccagtgtattacatctccttccagagatatgctatgcatatgtcagcatataatataaacagccttaaaaaataaaacagggctgggaatggtggttcatgcctgtaatcccagcactttgggaggccacggtgggtgcatcacctgaggtcaggagttcaagaccagcctgaccaacatggtgaaacgcttgtctctactaaaaatacaaaattagctgggcgtggtggctcatgcctgtaatcccacctacttgggaggctgaggcaggagaattgcttgaacttgggaggcggaggttgcagtgagctgaggttgtgccattgcactctagcctgggcaacaagaggaaaacaccgtctcaaaaacaaccaccaccaccaacccagaaagggtaacttgctacaaatgctgttctgcaccttgcttttccacttaaccatatattttgaaggtcttccatatcagtaggtaaataactgctttattattttaggggactgcacaatattccactgtagggatggaccgtaattcatgtaaccagcccctactgagggacactgaggttgatgccaaccttttgatattacagtgaaacagcaaataatcttgtactcatgttttcttgcacatgtatgcctctctcagtaaagattcctgaatcaaaagacgtgtgcttttgtcattttttaaaatttttatttattcatttatttttgagacagggtctcgctctgtcacccaggctggattgcagtggcacgatcatggctcactgtagcttgacttcccgggctgaagtgatcctcctgtctcagcctcctgagtagctgggaccacaggtgtgtgcccccatgcctggctaatatttaaattttatttttagtagagacagggtcttcctatgttgcccaggctggtctcaaacgtctgggctcaagcaatcctcccgcctcagcctcccaaaatactggaatcccagtattataggctgtgcttttgtacttttaataggtattgacaaaatgagactgtattgatgttcttgtttgcagacttcatacttaagtgcccctttccctacaccttccccaattctattcaaataaaaatcaacatctttaatctgtgctgtagaattggtaagaaatgtatctctgcacttttacatttgaaatatattgttagaaggttgagcatcttcatatgcttaattgtcatggcaaccacttctagcctgtgtagcgatttcttctagttgtttatttccatagagctaaataatgtttgaatgtagccattcattgatttatcagctttaggtgttatctattgatttttgctccaatacatgaggatttagctcacttacagtgtcatccttgcacctcctctatctttctacccttccttccttctctcttttttatttttattttttttttgagacggagtcttgcttgttgcccagggtagagtgcagtggcacaatcttggttcactgcaacctctgcctcccaggttcaagtgattctcctaccacagcctcccaagtagttgggattacaggcgcccactgccaagcccagctaatttttgtatttttagtaaagatggggtttcaccacattggtcaggctggtcttgaactcctgacctcaggtgatgcacccacctcgtcctcccaaagtgctgggattacaggcgtgagccaccgtgcctggtctcttctctttatgaaaaatattgctggttttccatttatagtagtgatatatttttttcctttccttttcttattaaaatagactattttttagagaagtttttggttcacggcaaaattgaacagaaagtacagagttctcatatattccctgctcctcccacccctcagtttttcccactaccaaggtcctacaccagtggtacatttgttacaatcgatgaacctgcactgatacatccttatcatccaaagcccatagtttgccttagggttcactcttggtgctgcacattctatgggtttggacaaatgtacaatgacatgtatccaccattatagtatcatgcagaatagtttaactgccctaaaaatcctctgtgctccacctattcatccctccctccagcctaaccccaggaaaccactgataattttactgtcttcatggttttgctttttccacaatgtcatgtagttggaatcatacagtatgtagtctttttcagattgtcttctttcagttaataaaatgcacttaagtttcttccacgtctttttgtggcttgatagcttatttctttttagtgctgaataatattccattgcctggatttaccacagtatatttatccattcacctcctgaaggaaatcgtggttgctcccaagtttggggaatcattaataaaacttctaggaacatctgtgtgcaggtctttgtgtggacataaattttcagctcatttgggtaaataccaaggagcatgaatattggatcatatggtaagtgtacatttcattttgtaagaaactgccaaactgtctcccacaatggctataccattttgttttcctaccagaaatgaaaaagagttcccgttgctccacgtcctcaccagcgtttaggattttaatcctttgaataggcatgtagtgttatctcattagtattttcatttgcaatctcctaacgacaggtgatgttgagcatcatttcatatgtttatttgccatctgtatatcttctttggttgaggtatctgcttagttcttttgcctattttttttttttttttttttgagacggcgttttgctcttgttgcccaggctggagcgcaatggtgcaatcttggctcactgctacctccccctcctgggttcaagggattctcctgcctcagcctcctgagtagctgggattacaggtacccgccaccacacttggctaattttttgtatttttagtagagatggggtttcaccatgttggtcaggctggtctcgaactcctgacctcaggtgatccacccgcctcggcctcccaaagtgctgggattttacagacctgagccatggtgcctggcctcttttgccaattttttaatgaggtcttttgtcttcttgttattgagttctaaaagttctttatatattttggacagcagttctttatcaggtgtgtcttttgcaaataatttttcccattctgtgggtttggtgggtttgtcttctcattctcttgagtgatgtggcatttaaaaaaataaaattactttaagtttaaaaagcaagtccatttaaagagaaacacccaggaaataatagccaaggtggtagaatatggtgaaaaaatgaaagggcacccaagagcctcaggtttgggcaatactgatgacacatagagcctggttccctggcaattattatggcggttactactattttaataatattagcagttacggttggtatttttgctattacaattaatggcataggggctgtatcgcccctgtcttcctggaacctggaggcaatgaggagctctgcaaagttgttgagattattatgaccatatctgggtatttcaccactacaaagagctgcgcaaagtttggacggtaggaatcggggtggacatcagctcggtgacaggtaggaggtgggtccgaggaggggtcgggtctgggagcctccgcccccaactcaaggcaggctacacaagatctgtctccgttggcgtcccggtacctagcttgagcccgaccatgggcatgcgtggcgtggcgcgaatcctgtccctgtcgctcgtcctggccgcggtggccacgggggcctgggagcgggggccgctgggcgtgctcttgccctggcagggctccgccgcgctgggccgctgctgtcctggccgtgacccgatgtttgtcgcccgcgggcccccgcgctgcttctgcgaccaagcgtgcggcgcggcgcggcgcgggactgctgcgcagactatacgcgggtctgcccaggtgcacccggggaaaggcaaggcactagcggaacgctcggagcggaggggagctggggcgggggatgagcggaggaagggagcccagcacctagggggctctgggcttggaggggtcacacgagccgagggcggggcgcggcgcttggggactggaagggtgcgccgcggggcagacgggacgtgcagggggtcgcgcgggcaaggagggacgcagacactcaggacctaaaggggaagcactggctgtggagctgcgagccgagaaagacgcgcaggttatgaacctgggtgcgttcatctcgggggacctgaaggagagggactcgtggagagttgaggggtgtttcggaggaggggcgcaaggactgctcacaggacttgaagggcggcaggaaggtggaggattcggcccaggtgcgggacgcaggcggtggaagggaaatgagcacaagaggcgcaggcaggaaggagagcgcctggtgcgagagaggaaggagcgcacccagtaagcggtgtcgggggggtcgtgaagcttggagggcctcgaggggagggaggcgcttgggttgaggtagggcgccagatttcgcaaatcaaaatacagcacacccagttaaactcgaatttcagataaacaaatctttctagagaaaaatatgtcctaaatatcgcatgggatatacttatactaaaaaattatttgttgtttttctgaaattgaaatctaactcggagtcctgtattttatctgagagccccagctggggacgggcgcggggccaagagagctgcgagggaggaggggttgcaagcttctttcgggcggaggggtcacaaggcgaatggagaaggtgacaaggagcatggagaaaccaagaaaagggctaacgcttggagagcaaggatggaaagacgctcaaagcggaggcggaacggtctgagtgattccaaaactagtgtgtccaagctggttagaactcaggcaggcgggtccagaagccgaggggcctgacagatacgcaggtgaagtccatctgtggtccgcgtgctgggcgtggccaccgggctagtccaagcattcctggtaaaggctcctccagagtggtacccacagcgctctattaagggctattttagttgagtcattagtgggaaggacgctgcctatcccctccccccccgccaccccactcccttcttctagagatggagccttgctctgtcgcccaggctggagtgccgtggtgcgatcatcattcactgcagcctcgaactcctgggctcaagcgattcttctgcctcagcctcccaagtagctggatgacaggcacgcaccaccatgtctggctctctatcctttttaaatcccagaagtaaagttttcacacccactggagacaaaaaaaaaatctaaattctgtcaccctgtaaaacggttatgacccaactttcctatgtcagggaggaaagtgattgattgggcccctctaccgtgtgatatcactagagcttccttcagaaatttgttttaaaagacagagagggcgcttttaaaaaaatgcataatgggtcgggcacagtggctcatgcttgtaatcccaacacttggggaggctgtgggaggatcatttgaggccaggagttcgagaccagcctgggcaatattggaagacccagtctctacaaaaaattaaaaaaaaattagcctcaaatggtgatgactgcctgtagcaccagctactcaggagactgaggtgggagaatcacttgagcccaggaggttgagcctgcagtgagctatgattatgccactgcactccagcctgggtgacagagcgagatcatgtctcaaaaataaataaataaataaataaataaataaaaatgtaagggacctaacatccattaatcacctatccctctgtgcccagaagctgggctggatgtcccctggaacctgaatacattctccctgccctctggggttcaggtatggaataacatccctgtttagcagtcaagaaaagcaaggctcagagaggagagggctttgggcagtcaagaattcccagccagtggaggagctgggtctgattctgagtcttctagctccttgctgccaggagtggccaacgttggaaattcaggcagcagtgagatgagaaagtaattttggatgtggtgtcttctcaagccataggcaaaagagaactccttccagattaaatttggggaaggactgcctgggggtgcttttgtactggttggttttctgtgtagagagttcatgcagccgcgggtctgtactgattggagctgaagtcccaggttagcaccaccaacaggggctcccctgccacagcgcaggagtgggggcccaggatgggtccaggcaaaggcatcagtgatactttctcatggtctgaccgacacccacagaatcacacaatgttagcccctcccaagagatgtcctttctatacggagtgggggctggaggaaccaggagcctcaaagctttgctttcacctttgttttgctcttttgggatctgcctccttatctggagcagggtcttgtgaagagacgcagggaaaagttcactttccacctcccaggggagcaggcaggaggggactagttaggaggcaaaagatgtagagaagtatttgcttttttcatgggctatttttaggagataaagtcaactgccttaagtgatcaattgtaatagagggagatgttgaagatgacttaaaaaacaaacaaaatccgcaaacaacaaatctaatatttatgaaataccaaatgtcaggaaggtactattttaagtgcttgaagtaaattgtctcatttaagcctcataataacgctatggaacagtgttatcatgtctgttttacagatgaggaactaaggcacagagaggttaagtgacgtgttctgggttgcacagctcttaaacagcagatctgggatttgcactccagcagtctgactccagatctcaatattgtatagcagctcaagggtggcagagactcaagaatgttaggagagggaagcttgagtctacaggtgtaaggagaccccttgacatcttccccatttagttcaattaaaattttctttttttttctttttctttctttccttccttctctcttttcttttctttttctctctctctttcttccttcctttctttttatttttcagggtttcactgtgtcacccaggctggagtgcagtggtgcaatcatggctcactgcaacctctgcctcccaggctcaagtgatcctcctacctcagtctcctgagtagctgggactacaggtgtgggccaccacacccagctttttttttttttttttttttttttttttgtattttttgtagagatggagttttaccatcttttccaggctggtctcaaactcctgggctcaagctatcctccagccttggcctcccaaagtgctggaattaccagtgtgagcctccacacccagcctcaattacaattggtggccaccttctgtgtgcccaattcagctagaagcactgggggatggaagcaaggctggagttctggtacccctcaagcttattgtctatttttgggagacaaggtagttgggaaaggaataaataatttcagtctgagcaaggtgaagcttggaaatgattggtgaggatggtgtggaggcagggagagagtggggctggagtgattagtaaggccttgaaagatagacaccactgtattttccaagttatttacagaatgtttccatgtattctatacttcttaaatatcatctcaaccctgtatggttgatgtccctacatatacacttatgtgtttcctgtagacttagtactcttagggttgtgacacaatttaacttaagttaacaaggatatttattggcttaggtaactaaagaacaacccagggattccagagcttcaggcatgactggatccaggggctccaaggatgtcatcaggactctatctctttccattcttcggcttttcttgtgttaacttcatttacaggcatgctgtcaccaagtggtagcaaagctagtggtcaaagacagtagctgtaaactgccatccttaatggattgagagcatttttccccagttccagccaaaatcccagggctggttctcatgggctcagtttggattaaatggtcattgctgacccaatcaatcactgaacccagggagaaggaatatatcaactggccatgtgggggtcacctgcctcataccaggaacgagagggtgcgatcagccctgtccaaaccatgtggattgagagtggggagttttggtttctcagaagaaaactgaggtggtattcccagaagatgggggaaaggaggctgggagggtactactcagctgtgggagaccacgtgctttgggaaactttgggtaaagtgtgctgagatgttgaataggaggagggcacggtaaatgactgtggatgagttgcaggaaaatgtagatttttagccactgagcttgggggtctccatctatgatccactgtcaaaaaagatccttcgtgaaccccctcaataggagatgggaaccactgagggatttcagggaacaggccagaactgtattctagaaaatccttttggtagacaataaggagggcagatggtaaggaggctgggcagtgtggttcagaggagaaagcggggtttggataatgcagaaagacattccttggctgggccccgtggctcatgccagcattttgagaggctgaggtgggtggatcacaaggtcaggagtttgagaccagcctggccaacatagtgaaaccctgtctctactaaaaatacaaaaattagctgggtgtggtggcacgtgcctatagtcccagctactccggaggctgaggcaggaggatcgtttgaacctgggaggcggaggttgcagggagccgagatggtgccactgcactccagcctgggcgacagagagagactccatcttaaaaaaaaaaaaaaaaaaaaaaaaaggtgttccttcatgagcctgggcctgtaagggtggggtgaagcgattctaaggggtctgtgggaaatgtggtctggccatggcaggctcagctggcacgatgtcatctgggtatccaggactcagtgagcagccttaccaccgccctacccctttctgtaaggctgggaagctagaatttcttctttggtcaggaaaagtgggctgggctttgctttgagaaacactgctatctggtgttgcctttttgcaatgtcagcctgtggttatatttcctttgttgttgctaaggcaagatttgctcactcattgttcagtggcacatcacttcctgagttgctgtgtgccaggccctgtgcttggtgatgggatacagcagggaacatgacaaatgaggaccctattgttgtggagctgacactctaatggaggaggcagacactacgagaataaccacagatgtactgagtttgtgatcctgggcctatgcgaggggtgatgatggttccctcttgtgtgcgtgctgccagtgagacgggtagaacacgtgcagggtggtgcctgcctaattttccgcaaaatctctcacctgcctggcaggcagggcaggagatcgtggtggactttggggataccccttggtccagctgtccagccagtgcctgaatctggtctgcagtcttcctgccaggttttttagccacattgtgaacactttcagtgacacaaaactcattcttctagcagcttcttctactgtagataatcctttctctcctgggaaaccgcaggagccatcatgcttctgccctcacccccacccagagagatgggcagtcatccttttgaaacctttggtatcaccacgtcacatctctgctcagaactcggcaatggcttttcgtcatgcctagaataaaatctgaactccttacaacagtcctcaaggccctatatgctatctttgtcccctccctctctgatgtcacctcctaccacttttcctctggcttattttcctgcagcgacactggcctcctcactgtccctctgatatcctacctttaccctgcctcagcgactttgcactgcctgttttgtgcctggaatacagttcccttcctacacagttcccttcatcactttcttgggggctctgttcagatgtccttgtcttggaggacttccttgactcctgcctaaaatagtttcttgttacaccacccttggcactctttctttttttccctgcctctctctcaaccctggccactcttgacctgctgttttttctcaaagcacagatcactagttgaaattacatggttgcatgttattgtttattgtctgtttcccccactgaatgtcagctccttgagggcagggctgtacctgttttggtcatctgtgttcccagcacccagcccagtgctctgcacacagtaggtcctaaattgttgttgaacgaatgcataaagaccattgaactgggcatttacagtatggccagtgctttgcattcgccattgcaacaaacccgagactgtggttcaaatccaggtttgtctgactctacatccttggctcaacttagggattctgcctcttaagccccagtggcctcatctctgagctgggtttgacaatagtgcaaacacattaggagttggggacctggcaagtgacagatggtacccccagaagggtataatagaaaacaagggctctattcacagaggtgggggcagcagtacaggacaggaggaaatggtgttattggagcctgtgagagtaggatctgcagccaagggcccccttccccaaaatgggggacaataaacaccttgggtgcactctcctcctgccctctgctcctctcatccccgctggtgttccccactggttcaactctactggcagccagggagaggctgggagatgcacaggcttgctgggggttgagtatggagagggagtacagagtttcaggagactgttgtgaggattaaatgaagtcatgtatgggacttgcttggtttagcatccaaagcacaatgaacggggttattagatggatgatgaaagcacttgatcagtcttaggttgccacactgggtgtctcccctccctcctccttcttgccctccctctttctgtttcctttcttctcttgtttaccttcctttctttctttttccttccttccctctgagcttttcaactctgctaagatgggcagattgaaggattgtttgctccaagaaaaaaattttaaacctctgagatttatgcaaagaatatgtgacttcctgaccttccagaggcactgctgcttgtctttggcacaataacgccattccttcatcaaggatgcacatgattttttccctcttcacattttcacgttgctgaattaggacatgtctcatagctgggagggcttttcctgaagacagacctcatctttcttgttaaacgctgtgtctccagcacccaagacagttctgggctcgctgcagatgcttggtaaatatttggggtatgagtgaattaattctgacagtggtggccgccttgcatgtgcagcaaatgtgtgtgtgtgccgctgacaaaacttgctggcacatccgtagaaagtctctcgctggggaagtgcccagattccgtttctgctagactgcctttccctgtctgatttgctctggtcctgatctgggagtgtggacttggaatgaagaagtgtcggtcccagcggggacatcattagaaataccacctgtggtagacatgtgaagcacctcaaggatgggggaacccagcacgttccttttgtgatgatgaaatatttccgacatacaccaccaatgtagagagataatacaacaaaccctcgggaaaagctaagaaacaaaccttgacaattgccactgcagtgtctgtttccctcctgtagtcacctgctgtcccactctccccagagattgtcacaatgctgaatttgacatttaaaattcccatgcatatatgggggtatgtgtgtgtttatgtacataaacatacactgtacattcttttttttttttttgaaacagaatctcgatccgtcgcccaggctggaatgcagtggcacagtcttggctcactgcaacctctacctcccaggctcaagtgatccttctgcctcactttccctagtagctgggactacaggcgtgcaccaccatacctggctagtctttgtatttttcttttttggtagagatgggatttcaccatgttgcccaggctggtctgaaactcctgggctcaagcgatcctcctgccttggcctcccaaagtgctgggattacaggtgtgagtaatagcgcctggctacaggactttcttgtgattcacagtagttatgttctgtaaagttgccacaaagactgaattaaccaatactgaattaaccaatggcccctaggggaaatatgtacacacatatctcacttagtttatactttagatcctaaaaacaactcatcctggtcaattccattttcttcattttaccaaagagtgttaggaagtgttaagagactcgcccgaggctgcctccctaacagttgctggagttgggattcaaaccccatccaactggcccagggctggagcttcttgcactacatagacctgtccctactgtctctgtcctctggtaacatctgtatgaagctggaacaagaagacagagtggggccctgtttaacttcagcttggaacctgcacattgagttactcaaatttttcactaatcttcgcttgtctgtgagtaactataaatgtgctgcaagtattgattttagggttaaaaataatttcagcaaataagcaaagtagcaaatacagaatctgtaaatcatgaggactggctgcatatatatgtatttactatgcctgtatgaatgcctaaatactttatagtaccgttttgcagttttaaaaaactatataggccaggcgcagtggctcacgcctgtaatcccagcactttgggaggccgaggtgggcagatcacttgaggtgaggagtttgagatcagtctggctagcatggagaaacgctttctctgctaaaaatacaaaaaattagccaggcatggtggtgggtgcctgtaatcccagcttctcaggaggctgaggcaggagaatcgcttgaacctgggaggcagaggtagcagtgagccgagatcacaccactgcacttcagcctgggcaacagagctagacaccgtctcaaacaaacaaacaaacaaacaaacaagactgtatataaaaagcatcacattagacatgtgaatccttttgcaagtaatttatttccccttcaggttactgacagtgtagctgtggctcattttcactgatgtagaggaatagttagtgcttattaaacacctgctatgtgctgggagcaaatgctttatatttcatatttggttgaacccttaaggccaccctatcagttagatactattcttattcccatttgacaaaagaagaaattgaagcatcagttgccctaagtgcttaggaaatgtttattgaaggaatgagtgatggagacgacctaagtgatcatcaataagatgattggataaaggtggaattctaagtttaggtgaacatatgaagagttgtcatagggaaactttcaaggaaggcatagactgaggtttgcaagagttctagcacttggtgtggtgttttgggggttcagattgtggggaaggtggagaagacctggatgctggctagctaaaccccacagaggtctcccttgcagacaccaccttctcttccagcagtctcctgcactgtggcacagtggagtggctgcagtcgctgtgtgaaacctgccaggtctcctaccatgtacaccggaggcgtgtcctgcaggagccgaggaatgggggtgtccccttcccgctgctggaagagcgggctggctgtgtggagtactggagccaccagggagtggagtgccagcagtcattgcatgagtggggatgggccccaggggtggctctcagtgggaacagtcaggctggactgcagggccctccatgagttcttgggtagggtctgagtttggaatggggctttgccttcctttgccctgatcccccttctcatcttgtgaatgagttcagaagctctgaactccactgggcttctcagtcttctttctgctcctctccctgtgtgaatcagtcaggactttgtatgcaggtgataggagacccaacttaacctgaactgagcaaaactgtgtggctcctgtaactaaaattccaggggctgcattcaggcatggctggatccaggagctcaagcaatgttgccaggaatctctctccatgtctcagctctgttttcctctcagttggcctcattctcaggcaggcttttccctgtaatggtctttgacagcttcaggcttccctctaaccagcctaacagctgaagagaaggcctctttccccatagttccagcaaatatcctaggatatttgtggtggtgcgcacacccgaagtcccagctgctcgggaagctgacgcaggaggatcacttgagcccagaagtttgaggttgtagtgaactgattgcactacaagaccctgtctctagagatcaatcaatcagtcaatcaatcaaaaggtcgttctgactgttatgtggacagcagactgagaggggtcagagggaatcagggagcctagggaagaggtggctgcaatggttcaggcaagagactatggtggttgaaccagggaggtggcagtggggtgatgaaaagtgggagtgttgcttcctctgcttgaaatccttctccctacccccagccactcccatccagccattcctgggtcatcacttcctgtaaagatgtcagtttccctgaggaagatcgggaagatcatcctgacttgctaatatgtgccaagtgcctcaccacatgacctgactctgtgaggtcagtgttactattctcttcttacagacagggaaaccgaggctcaaggaggtgacaaagcttgtccaagtcacatggctattgactagaggaccaggaccctcccattctgacctttgatatcacccacctacaatcttttcgttgtactgttttttgttgttgttgttgttgtttgttttttgttttttttttttaagacaaggttttgctcttgttgcccaggctggagtgcaatggtgcaatctcagctcactgcagcctcctcctcccgggtccaagccattctcctgcctcagcctcccgagtagctgggattacaggcacccgccaccatgcctggctaattttttgtattttttgttgagacgaggtttcaccatgttggccaggctgatcccgagctcctgacctcaggtggtccacctgcctcggcctccccaagtgctgtcagaatgtagtaaggtgatatatgatgagcacctactacataagtgctcaataaacagcagctgaattattttctttgctcaccgttacagccatgaggctctgatctttatgactgatcccttgaatcttctttcaaaacatctcacctctgtatttgagggcttgtcccttcaccatagcatgagagcaacagctgcatcacagtagctaacaatgtcaagcaaattacaaagggaagaaacactcactgagtacctgccttgtgccagaccctcgaccaatgttacattacattctgacaataacaccaggatgtagatactgatattatccccattttgcagttaagaagaatgaggctcagacaggtgcagtaacttgatcaaggtcactcagctataacaaggggagttgggactaacctgggcttagctggggctctccttactgctctaggtgacaccaaaagtacaactacagctgttggaagagggaagggaggctgtgtgttagggattcctaaggaatcacgaacctcttgtgaaatgattatcaattctcttctatgttctcctctgtttgatctagaaaggaagaaacttggaagctggccaagtaaaataattttattcattcatttgtctttctatcaatccatccccctatacctcctttcttccatccttccattgttacattcactcattcatctattctcccatccatccatccatccatccatccatccatctactcgttcatctagccatttccactcatctctctgcattcttctatcttcttccattctaccttcttccattcttctatcttcccatccatccatccatccatccatccatccatccatccagctatccatccatctatctacccatccattttttattcattcacctatccatccacttgtcaactctccatccatcctttccattcatcctctcttccacccatccatctttctactcatctctctgtctctccttttcttccagcctctcatcttcccatttatctacctattatacatccattcttcctttcttccatcatttcagctatctatccatttattcatttagtcattgactttaaacattttattttcttcttttaaaattatttaattaattttttgcctttcctatggtgctgatagttattgactcttttttctttgttttttttttttgtttgtttgtttttctgttttttttttgttttgtttttttgagtctaggtcttgctgtattgcccaaggctggaggacagtgatgcaatcatggctccctgcagccttgatcttctgagctcaggtgatcctccccttttagcttcccaggtagctgagactacaggtgcacgccatcacatctggctaatttttgcaggatgaggtttcaccatgttgcctaggctggtctcaaatttttgggctctagcaatcctcctccctcggcctcccaaaatggtgggattacaggcatgagacattgctcctggctgactaactcttttatctactctattaaaaaaatcattcacttattcattcagcaaatcattcattcaaaaagaatttttgagaccacaccaggccctgaagtctcagagataactatgatcctgcttccagcactataaagggcactggtagggattatctacccagttcaaagatcctacagtctctttagggctgtcttgtaagtgacttggataccagaggtaccaagctcggtgtccctatggtgccatagcctgggatgtggtccgccctaactctgttttctccttgacccacagtccctgctttgataaccacaggcagctacgggaaagagtgggaaaagtgagatagtcccaagaaacaggcaacagcagggtaagtgaaaatcaatcaacctaaagtcaaactaaaatttgtgaacatgtttccttgaactaagtttcttttttttctttttctttttttttttctggagatggagtcttgctctgttgcccaggctggagctcagtggtgtgatctcagctcactgcaacatccgccacccgggttcaagccattcttgtgcctcagcctcctgagtagctgggattacaggcacacaccaccacgccaggctaatttttgtatttttagtagagacggggtttcatcatgttggccagactgatctcgaactcctgacctcaggtgatctgcctgcctcagcctcccaaattgctgggattacaggcgtgagccaccgtgcccggcccaaaatttcatttatcacgtctttctcttactttggcaacatccatatctccccgtttgtcaccttgttacacctgcaagctcattaacatggattttaaagtccccaatgattggtctccattcaacttcattcattcacccattcattcaactttgattgagtgcctactatgtgacaggtactgtgctagtccttgggttatggcaaggaacaaaaaagacagaaatacttggtcctcattgagtggacagtctagtgggaggagagagacaaaaaacaaataacatgttggagcctaagtgccatggagaagataaagcagggaagggggtaggggtgccctgagaaggtgacatttgaactaagatctggaggaggagatctgggggaagagtgtgcctggaagagggaaacagcaagtgcaaaagttctggggcagggcatgcctagtgtgttcaaggatcagcaagaaggcgggtatagtttgagtgcagggagagagtaggaaatgaggttgaaaagataacaaggtaggaggtagatcctgtggggcctgtaggctgtgttgaggagttgcgcactttctctcatgaggtgggagtcatggtagggtttttagcagaggagtgacatgatctgacttaagtcttcacaggattccttgggatcctacttggacaatggatagaggagaagcaagggggtaactcgggagaccaatgaggaggcaattgcagtggtccaggcgagggaagaaggtggtttggaccagggtggtttcgtcgtaccttgtgaaggatggattgtggggactggcgacagatcagcgtgttgtgggatcgcggagctgaggtcaaatttccaggacagtgcctggctcatgataggtactcagtaaatatcagttgaaagaataaggtctgaactaagtcagtggcaatggagatggacaggagaactaaaagggttaggattcttttgattgcaagtgacagaaacttagctcagactgcgtcaagtgaaaaggtgaagtattggtttagataaccgggagggaagttctgaaataacattacttcaagcagggctggcgccaacggtgtgtgtaaggccgtcagggctggctctcgtcccctctctttctgtcactcgctccatgggttgactttattctcaagcaggctctttccctgtggtggtcaagatgggcatcttgcagagattgtggggataagcagccccacatcctcccagatcagtaaccccaaaagtgtcctcttggaagtctcagcggatcatatctggaggagaccccgattgggtctgcttggatcctgggcccatccctgaaccagtcgtcgtggccaggaagatggggaactctggtcggtcaactccaatcacatacccgccttagtggcagctgtgggagccacggccaggccggctgagtgatggcccctccaagaccatagggcgagggcaagaagtttccaaacaaactgccaaaaggggaagagaaattgtatggggaagacgcaatttctagttatcacagacttctggtaggggacagattcccgaggggatatgggggcagatcagagagggaaggactggggatgggctttcggctgcacctggaagaaaaccgtgggctcctctggccaccagggggcagcagattcacacagagtcattcacgagtccttgacacgccgcgtctcctccagcagggggtgctatttactgctccttgtagaaaaagttgggtggaagtaaaatttggcaaattctgggtcttatttcagatacccttgaatgggggggctttccttttaaagaattctcattgcaaatctttttttcttctgttttttgagaccgagtctcactctgttgaccaggctggagtgcagtggcgccatctcagctcactgcaacctctgcctccggggttcaagccgttctcctgtctcagcctaccaagtagctgggactacaggcgcgagccaccacgcctggctaatttttgtatttttagtagagacagggtttcatcaagttggccactgcagtgagccaccgcgcctggccttttttttttttttttccctctttttttttgaggcaaatctttttcttttctcttctttttctttctttctttttttttttttttgtggcaaatctttttaataaaataggatcttttgaaagaacgtgccgggcgcggtggctcacgcctgtaattccagcactttgggaggctgaggtgggtggatcacctgaggtcaggagttcaagaccagcctgactaacatggagaaaccccgtctctactaaaaatacaaaattagccaggcgtggtggcacatgcctgtaaatccagctactcgggaagctgaggcaggagaatcacttgagtcagggaggtggagtttgttgcggtgaaccgagattgtgccattgcactccagcccgggcaacaccagcaaaactccgtctcaaacaaacaaacaaacaaacaaagaaaagaaaaaacacagtggagagcttaagagtatctatttaggcttattttcagcagagatggttccattttacatcccactgcttattaggtatgtggccttgggcgagttttctctctgatcctccgtttcctaatctgtaaactaggggaaacacctaccttgcaggggttccatattccatcggccccaatgacttatttaacattttaaaaactgagctggatataattctaggagttggacccaacagtaaacaaaacaaatgaacattcctggcattatggagccagccttctaatggggaaaacagatgagaaataaaacactcagtcttttggataaagtgcttagaatagggtctgcctggtacatggtaaaccctgaataatgttaacttgaaaagcagaagttgaatcttgttgtatgcaacctgttgaggccaattgggttgcacaaaagattcctgtatcagggagaaattgtaccaacctgggcctaagatagggctggatgtacagtaggtgcttcataaatgctcatgggtacttgaggtggtatctccctgtgtggctgcaggtactgtgtccagttccagttggggtccattccagggagctgcgggcaggcgagggcaccccatgcccagtggacaaggtatctgagtcagggccacacggtctgtgtgaggagtgaatggcctgcccaggacaccaggagccggcgctgctacggggacggtggtggggccaaagggtgagcgacaggactcgggcatgggcaggtgtggctgtagagcccagggcatctctgctgcctgagatagcaccctgggagagagatgctgctccctggccagggcgggggccagcagggtcccaatcccagggtccaaagagaccagccagttaggagccggactcctgccacttccggtggtgtaaacttgggcaaatctcatcacctctcggatcactaagtgcctcatctgaagatacagataatgagaggacttccccatcggtcaggggtgagggctaagtgagattgtgcaaggtgaggacctaggacagtttctgacatccagaaagtatccaagaaaagggagcttgcatggtcattgaaccctcacgagtcccttaaaggccagatttggttactctcattttatagatgggcaaaccaactcagagaggcagtgtgacttagtcaaggtcacacagcagggtttgacccagatttggcttacattatccctctagactgcctcccgtggggtgagggtatcttggaaagcacttcacacatactaattataatactggcttacatcgattgagcgcttcctatgagttgaggattattccaagctctttatattccttcattcattcagtgttgagcatgtgctaggtactgttctgggcactagggattctgcagtgaagaaaacagctgaggtcccttcccttatgcagacagtaaggtcccttcccttatgctgggaggaggcagacatcgggcaaataaatctataatttgtcagatgggagatgaatgttaggagagaaagcagagtaaggatgatgtcctgggggttgttaattttttttttcttttctgggtcttgccctgttgcccaggctgaagtgcagtggtgtaatcccagctcactgcagcctcaacctcctgggctcaggtgatcctctcacctcagcctcccgagtagctgggactacaggatgcaccaccatgcttggctaacttttgtattttttgtagagacggggtttcaccatgttacctaggctggtcttgaacaccttggctcaagcgatctgcccgcctcagcctcccaaagtgctgggattatgggtgtgagccaccgtgcccagccattatttttaaaagcctgatcaaggagggtaacagaaaggaggtgatatttggacggacacccaaaggaaatgagggaggagccatgtggatctctggaggaatagctttccaggcagagggacggcgagtgcaaaggccctgaggtagagcgtgcctgctgcactgaggagcaagagaggccattgggcaggagcagagtgagtgagggagagcgtagaaggaggtgaagtcacactaacacaccgtatgccaatgaaacattgcaagaatctaacatggatacttttaggatctctgctttccagatgagttgactgagatacaaagaggtgcccaaggtcacatacctagcaaatggcagaaatgagatttgaccctgaactgctcagacccccaagccaagctctaaactctagtctagactgtttcttactgaacatgcttttccggtgcagggattatcacactgttggaatatgagctctctctggggtctgtacagggagttctaccatttccaagggtgttaatttccttcttttaaaaattaagcagccctgatcactgtaaacttagaacagggaatgccaaggccagttagggtgttagggagaaacgcatttaggcaggaggcattggattacacagatctgggttcagattccacctctggccctgattggctatgtgactctgggcaaggcctgcacgtgacccggacagtcaccaccacgtacgattgtggggagcacccacaattttgcacagcacctgaccccttgtagatacccactagtgggggctgctgtcattatctctaatctgcagaatagatataataagacgtagtttgtgaaaatgagatgtaatggatgtgatgaacctggcacatagtaggttcccagtaaatacacgtccaacaatattatcacactatagggtggcccttcctgccagcctcccttccaacctccctcccgcttacttgtcctagacctgagattccactgttagagtttcattctttgggataggcgctcactttttagagcttcagtttattcatcaatttttggaaacactttctagtcttaagactctgattaatcccaaatttctctttttggacacaaatactctgggatgtgaaacatggcactttggcaaggctgagatgtgggtcccaggggccacagtacccaccaggaatgggaagggacagaaaggagagccagggctgtgtccgagacaggcatctctccacactccccacctggggccaggctggcagagcaggtgacggaaggtctcatgggggcatgagctcaccaggaaggactggcggagcagggggatccaagagaggagaggcatgagccgtcagccgaattctttccacgggcagctgtgagagcgggcgtgccaagggcatgggcctggagagggattagcctatcagttgggaatttttggagggtttatttagcttaagaagtatccctgagtttgggtcaagcataaggaacatctgccatgagccactcacctactgcgtgctgggcacgcaccaagcaggtgcttcacacgtgtgttcacagttaggccttaggggcacttttagacaagggacatgaactccattttatataatgatgatggcaataataatagtaactttaaaatgttatcatttgtaaaacacttattatctgccacgtactgggcttacaggcttacaacggtgcctggtaccacgtgggaggcgcttaatcagtgtttttttttttttttttctatttttttgatgggggtcttgctctgtcgcccaggctggagtgcagtggcacgatctcgactcactgcaacctccacctcctgggttcaagccatcctcctgcctcagcctcccaagtagctgggactacagtgcatgccaccatgccgggctaatttttgtatttttgtagcaacatggttctgccatgttgcccaggctggtctggaattcctgggctcaagcgatctgcctgccttggcttaaagtgtggggattacaggtgtgagccactgcaccaggcccagtgtttgtcattattgatattattttgcatttttacaaaagatttggattacacctacagaaaattggctttaaaatatatgaacaggttcacaaacatttgggaaggtcacacacctaggtagacactgcccaggcaaggaacagagcctggccagcccccgagacctgcacacgccccctccctcagtccctccctccccataaaggaggcctctgccctgacttctctggtgatccattgtgcgacatccttgccagctttaggaactcgatgtggagccctcaacactatagttccatttcatttcgttttgttttgtttctttccaactttgcatcagtgaaaccacgcaggatgtgctctttggaattcgactgcctttgttccacatgaggtttccaacgttcatccacgtggttgcacttgcagcattagctggttcattcttgttgctgaaatagttagctattactattattattttgagacagagtctggctctgtcgcccaggttggagtgcagtggcacggattcagttcactgcaacctccacctcccagattcaagagattcttatgcctcagcctcctgagtaactgggattacaggcaagtgccactatgcccagctaatttttgtatttttagtagaggtgaggtttcactatgttggccaggatggtcttgaactcctgacctcaagcaatctatctgcctcagcctcccaaagtgctgggattacaggcatgagccaccacgcccagtcagttagctattattatgatcatttttattttctttgcacacagcatctcagatgacctccccaccaacacctcagaggggcaaagattattgatatctccatcttccactgaggagagagaggctcctaggagccaggtcccaaacgccacctgattccagagcctgtgctcttagccactccgtggtgtggcccctcaacagaggaggaaaagggggcacagagcagttaagcaacttgcccagccttgcccagcagggacgtgatcgagccacctccccagaccctcagaactgactctggaatgcccttgtggcctctgagggtcgctggctctgtggccatccccagggtgacttacaagggcccagtgcccatacacttttagggcccacaaagacattttaattttaatttcttttaaaaccagaagaaaaaaactgatgctataataataataataataataataataataataataataatattagtggatcacaaatccagcctggattttacttgtctttatacagtgcagtcacaagctagagggagggtccctgaaagcaaacatccctggagcccaggaaagccatcattcgactgagccagccccatctcttgcaggaacaagatgtggctgtggcaagcggccagccatccccggtgccgagggacctgggagaagctagggcagctccggcattgttcctgccctgtggtccacagcctcgtcttcatctagcgtctgcaccccctaaccgtctttccaaagcctcggggatggcagggaaactgcagggcttgggatcccgcagaaccaaagagttgggagaaatctgcaattttgagactgaaggaacaagccttgtcgttatgttgacactgaaaatagctttatgcttccactcagtgccagctgagtcacggtcctactgacatctcctgcccattcagggcttcccacatttcatctcccagacacactctcctggcccttgccctattctccttattgtatacttaattttttaatgaactctctcccttcccttccctttccttccctctctctctctctttctttcttttctcttttttggatggagtttcactcttgtcacccaggttggagtacagtggggtgatcttagctcactgcaacttccacctcccagggttcaagcgattctcctgcctcagcctcctgagtagctgggattacaggcgtgcaccaccatgcctggctaatttttgtatttttagtagagatggggtttcaccatttgaccaggctggtcttgaactcctgacctcaggtgatgtgcctaactcgacctcccaaagtgctgggattaccggcatgagccaccgtgcgcagcccctccttccctcccttgtctccctcccccacttccctctcccccccttctctctcccccttcccccccttccctctccccctcccccctccctccctccctccctcccttcctcccttccttccttccttccttccttccttccttccttccttccttccctctttcttgacagaatctccctctgtcacccaggctggagtgcagtggcacaatctctgcttgctacaacctcggcctcccaggttcaagcgattctgtcacttcagcctccctagtagctgggactacaggtgcacaccaccatgcccagctaatttttgtatttttagtagaaatggagtttcaccatgttggctaggctggtctcgaactcctgacctcaagtgatccacccatctcggcctcccaaagtactgggatgacaggtgtgagtcaccatgcccagccttcttttctttactcaaataaatttatttgaaaagaaaactacttaaatatatgtttaaagaggaaacattttatcacaattataaaataaaataaacaataatagcaaacatttattaagcacccgtaagagtgccaagcactgtctcagccttttatacatactcactcattggattctgagttagatgcaatgattatccccattttacatgtgagaaaactgaggttcagagaggtttggccactttgctggaagttgcagttagtgagtggcagagtggggattcgaactcaggagctgcacctactgcttaggttccctgcacagtatatcagcctcatgagggcaggggttttggtttctgtgtccctgggcctaaaatagtgcctgacacacaataatgctcaataaatacttgttgataaaaacaaatgaataaatgaatgatcagttgctatactaagaagacaatcaggctgggcatggtggctcacgcctatgatcccagcactttgggaggccgaggcgggtggatcacctgaggtcaggagtttgagaccagcctggctaacatggtgaaactccatctctactaaaaatacaaaaatgagccaggcatggtcgtgggcacctgtaatctcagctacttgggaggctgaggcagagaattgcttgaaacccgggagatggagttgcagtgagccgagatggcaccaccactgcgctccagcctgggtgacagcatgagactctgtctcaaaaaaaaaaaaaaaaaaaaaaaagacaatcagaaaaataaatacaatggaaaccagagaagtccactgttgcctgctcaagatgctgagcatgaagcctgttctcctgattcagacaagaaaccagccagtgtggagtgataggaagaacacactcatagccaatggagacttgctccttgacaaattagaaaaattatactggaatcttggcactttgggaggcctaggtgggaggattgcttaagcccaggagtttgagaccagcctgggcaaaatggcaaaaccccatctctaaaaaaaaaaaaaaagatacaaaaattagctgggtgtggtagtgggtgcctgtagtctcagctactcagggggttgaggtgggaggatcacctgagcctgcgaggcagaggttgcagtgagccgagatcgggccactgcactccagcctgagcaacagagggaaaccctgtctcaaaataaattaaaaaaaaaaaaaaggcttaaaaggaggctaatttttttcctttaggagtcagttgttataaacatttttaacagtgaattcacataccatgccattcacccatttaaagtgtacagttcaattcttttcagtatatagaaaaaattgtacaaccatcaccacagtccaatttagagcatttttatcctcctctgaaagaaaccctgtactcgttagcagcctctccttcctccgacccctctagccctcagcaatcactaatctttttctgtctttatggatttgcctattccggacatttcatataaatggaatcacacaatatgtggtctttcgtgactagctgctttcacttggcagaatgttttcaaggttctcccatcttgtagcctggatcagtactggagtcagttatttaatgctacatcctgggttcgggtaaaacgacctaaaatgtgagtcccccgcttcaggaagcgccgctgtaatgaataaagaaccttttgggggaatcatagctcaatctcttcctggttctaagcgggcaggttcaggcttccctgcggtggggttggagcaggaggtttatctttcagctgtccttgggactgggcaggaacttgttcaaatgttactgctactctatcctccttcctaaatcaggactctggacgctcctgggaatcactgtctgttgctgctctctgggagtgtgaatgaatcactgggtgagaatgtcagtagcacctgtgtgtgctggtctggggcgagaatcctgggccaaggggcagcggaggggagaaagaagcagatggccacgaggccagcaaggggctgtccgactcgtaccccacagccagcattccctgcctctacccgtacacttgttttggctgcaggaagctgttttaggtggaaatcatttgatgtgtgtaggtgctgtcttcccaaacacaccgtgctcgacaattgccccagctctgcaggatagactttttgtagctcttggtagctacccattttttcagcctctaaatagtggtggtgcctgttttaatcctctcatggatcgtgtaaagtaggtgatcttttccccattcacagatgggaaactgagcttcaggatagtcacatgacttgtccaagttctcatgattaggaaacgttggagctgggctttgaactggactgcaaagcttgtgctcttgacgaaataggaaggcagaggctgtggtggggagcagcttggttatgggtacccagaaggcagagccgtttcttgcgtaccataaaatgggacatttaccttgggtactccctttggagtgtgttgctggaacttgtgcagggacttagggaatcttctggggaagaggccagcaatgtgttggggatggagacgaggagcactcagtgttatgttttggagccttgtcctacacctgaggacctccaagtctatcagtcaaggccctttgggaaatgagtgaaagaactcaaccagctcgagcaaggataatttattgactcatgtaaagaaaatatccaggataagactgccttcaggtatggctggatccaggggtttaaaggttgaagccactgcctcactttcttttggccttgctctcctctctgttgactttgtgcttaggtaggcatcctgtggtggcactaatggctgccagcagctctaggctttcttcctccccattctgcatcacaaagctgaagacagcatctcacttccaatggtctcagtctcagctacaggtctggggttgctgcttattgaccaggctcatctcacacccctggttcatattcctgaatcaatgggtggggggagggtgggggaatgcactgttttgattggccggtgctgggtcaggtgcatatccttggaagtggaggcatggtcagtcctacttgaaccacgtgaaccaagaaggaaaactcgggacccttgtatcagaagcaatgggaatggatgctgggaatgtttcaggccacagacatcctcctcgtgggtggcagagaagccaccattcatctctgtggctttgctgccaacttgccatgggaccttgagcaagccacttcccttctctgagcctcagtttcctcatctgaacagcgatgatctttaagggcccatacagccctgaacttttgaggccaacagggtttgtctagccaacagcctggcatcctagcttgacaggtccaagctaaggcttaggaatgcatggccttcagaaaccctggggtcgaacctggggctgggcgcctggcctcttgttcttgcccatcctggcagggtacagcctgtgatgtgggagggaagggttctgaggaggtttctttgcacatccccagcattctccgtctataattggctccaaatgaaatgatctcatccctgaacactgaggaagaaagggtgggggtgaagctgctcgctggcagcatctgacatagtttatgactaacccgcttccctcccgaggcagggagagacggtccgctctctcgaagacaatgtacaattttgaaaaaaaaaataaaaaagtcttggtaaatagattgaggaggctccagcctcctgggcttttgggaggcccaaggcatttttcccctctgcccaaaccaggtatcttttgcccattgctcacaagtcaacgtgacccgtgctattaccattccccaaacttttcacgtcaaaccctggccgggaaggtggtcaatgtagccagtccatcaagcgatttgtcccatatggattctcaattgagttttgtggccggctggagcttgtttaaatgcccatacattaattttgaaagatgagctcctaatcaacttttaaaaagcttgtcacagcaccatctgtttggcgtttgtcactattgcattacataagaggaaagacatttttaaagaatgcggctacatttagtaattggatcgccggagagaagccaaaccggggcggatggcaccgtgattcagaaatgccacgggcccttctccggggtgtggcggcctccccaaattccacgcggtcttggcagagacctgagtgcagcccagcttgggagacaggcttggggtggcttcttttcctcttgccttggtcttcctcttattttttccatttgttctccctcaccccttgctaccccagtattagcagtgaccaagtggctttacttccctgagtcccaatttcctcatctggaaaatgggattcacaagagcaccatcttgtgaggtttaaatgcattaatgcctacggtgcctggcacgtggtgagtgctttataaagtgttgctattttataaagctatgtctgatgcatagtaggtgccaacacatgttcattttccttcctttttcccttccctttatttatttatttatttagagacagggtcttgctctgttgcctaggctggagcacagtggtgcaatctcagctcactgcggccttcacctcccaggttcaagcaattctcccacttcagctccctgagtagctggaactacaggcatgcaccaccacacctgactaattttttgtattttttttggtagagacggggtttcaccatgttggccaggctggtctggaactcctgacctcaagtgatccatcagccttggcttcccaaagtgctgggattacaggcgtgggccaccgtgcccggccccttccttccatttaattcaacaagttcttaggaagtgcccacgtttgaggcagagctggcatcatgcacatgcacagccatttgcacagggccccacactcacaagaatgctgagcttggtttagcgttctgctgtcgctggcttgacattcttaatttttgaacaaggggccctgcattttcattttgtactggaccccacaaattatgcagctggtctcatctggaggtctagaatgatgctatgtcttatttgaccgtctgatatttaaaataacaatagagtcaacgttttaaaatcaggagagttcacacaacagtctggcttattttagaaaattagaacatcttgccactgtgagtctgcattcccacacactgccacatgggctggagctggagtcctctatacaggccacatccgccactgtccccaccactcctggaggctttggactgagtctctttgctcatttatagagcttccagcatggtagctgggatcatgggctttgcagccaggtatgtgttcagcttttctgttaatcatcacagtaacctctctcttagggtagtaaggattaaactagttaatataggcaaagcatctggaatatgttgcactgttattgctactgttctgctttatcctggtgcagaagctcagacccccagtctgagggctgcccctccgggagctggaagctgcgcctgtggcagctggctatgaaagcgtctctttctgctgtcccacacagcagccgttgtcaatgtccactttctctccctccacctgcagcaccagagttcacaccttgggcccgccctcctagcattattttgagaaaagggccttctgtcctgtaaataggctgagtcatccctgcctcagggcctttgcacacgctgcacttgcttcctagaatacttcttttcccatcgctttgcttggccatcttctccttttggtctagctcaaatggtacttcctcagggaggcttttcctgatcgcctaagaaaagtagccctgttttctttcccctgtcatacacattcgcctatattattttcttcccagaactggtttgttgtgtatctcccagaggaccaggtctgccttggtcactgtgatatccctagcacttaggccattgcctggcacatggtagatgtttgataattatttattgaatgaatgaaggaaggaagaaaagaattcatcaactcctcatgaccaccctgtaaagcagggacaagagacctgagtcatggagaagagaagggactcctcaaggtcgcacagcccagaaggggcagaaagggtgatgaggacctaggttttctgcttctacaccccctgtcccctcaaccccccaggtgggaagcagcagagacatttggatctttggctcgaccagccaccaagaacgggtcaagtgtgcagcaaggcccagagcacagcgtctgagggtggtgagagcgattcacccaggcagccaggaggcgagactgtttacaggggctagcggctgtcgccatgacaaccggacagcctacagcttcctgcgtcaccagggacgcaggtttgctcttggctgggaagcagtggggacaatggagtgggggctgggaaatggggggaccctaaacactcagtcttggggggaggcagttctcatttctggttttttttttttttttgagatggagtctcgctctgtcgcccaagctggagtgcagtggtgcgatctcgactcactgcaacctctgcctcccgggttcaagtgattctcctgcctcagcctcctgagtagctgggattacaggcgtgtgctaccatgcccggctaatttttgtagttgtagtagagatggggtttcaccatgttgcccaggctggtctggaactcttgacctcaagtgatctgactaactcagcctcccaaagtgctgggattacaggtattagccaccatgcccggctgggagttctcatttctgagagttgcttgaaggctgggagggcctggtgatgctacctaagtgtgtgtgtgtgtgtgtgtgtgtgtgtgtgtgtgtgtgtgtgtgtagtgtctgggctgtgtggagccaagctgcctgggtctgaatctcagctttgcctcttctgtgccgtggcattttgggcaagtgagttaatctctcggtgccttagttccctctaatgtaaaataaggtggacagtagtacctcataggactgttatgaggattaaatgagataatagtctcacggcacttacaatgcaccttgcattgtgccttaattcttgacatcaatctacatctgactctaggttgtcttcttgctggggtagtgggaaatttggtctcaatcatcctcagggatccctacttccctggcttttgtcattcattcaacaaatacttattgagcacctactgcatgccacgtattgttctagaggctgagaccacagcagtgaacaaagcaaacaaaaatccctggcagagtagagctaacattctagtagggatagatagacattaaatatgacaaaaaggaaaatagatattatatcagatgacaataagaagaaaaagaaagcagggctggaggattccaactgcaggggagctgttgcaattttagaaaaattgatgcatggggatgtgagtgtgtcagggaaggcctcactgagagagtaacctttgagtacaacttgaagaaggtaaaagagggagtcacaggttatttgcaagagcattccaggcagagggaacagtaagcgcaaaggccctgaggcaggagcatgagcatgtatgtgactgtatcatgtagtcatatctcttggcaagtctgtgtgtgtgatgttatgtggcacacattggtggcatataggtggttatgcctgtccacatgggtggcaatgcacatacatgtttgttcatgtacagagctgctgtgttcagtcacagaggctgtgcctgaacaattcagggagtgacattcacactgattgccatgaaatgggaccccctggtgtagtgcagcgcagtggccccgagcatatatataaggaaatcaatgtaaaatgtctgtgaaaatgttcacacgtgtatgtgtccggatatttaaatataacgatatgcaaatatgtatatatgaatgtctttaagatgttgatatttcattcctcatggacttttgcttcagtattgatttttaaaaaatattgcattaagatattatttctcttgattactcagtttttgggtgcatcttacatttgcatcagaggcaagtgcctcactctcttaatgctggtcctcgccctgccttggagttgggcaatgaatgtgcgggaggcagggatgaggcaagggaagcctctccttctggctccttccagcatctgggctcatcagcacatgactagaatccaaacctaatctgaacacattttgttcctttaaaacaagatttattgagtgctgactgtgcgccagggactctgcatacattattttattttatccttaccaccatctctgggggtagatatttgctcattccattgaacagacatttgcttagggcctactatgtgccaagagtataagctggcatttgtgctggtctggcagccactcctgatttttctggtaaaagcaccccagttttcctttagggaacctagcctcttccctttactgtccaagtggtttcacctgggctttctgtacccctccctcagactccaggggtgggggtgtgatccaggcgacccaatcagcatactccatcccttttgctccagagattagttataggacgagtatctaacccaagttggttcaatcagagtgaatcctgggatttttgctgccctgttgggaaaaagagctctcttttcatcaggatttctagctgtgagaattctgtaaccctggaattcccagtgagagtctactacatggagagagagagagagaggaaaaactcatcccttatgacatctttaaagcccctggatccagccacacctgaagtcagttaccctaagatttttcaattctgtgagtttatacttgtttttctttttaaaagccagtttgagagggaagctgaaatcctgtgcttggcatctttgtacattatctcctttaattcagagatgaatcccatggggaaggggctctgattgtacaagaactgatcctcagggagggaggtgacttatccaaggtcacagcaggttggtagttggagcttgaattcaagcccaggtctctactcctgagccgttctgccattccacatggtctgacctctggacaagagggtttgtgtgagtattagtgacatagacccgagtcctgttatggccactgttttgctctgtgaccttgatcaagtcatttctctaatatgagcctcagtttcccatctggaaaaatggtagtgcttaccccatcatgctgtcgtgagatgatccatgaaagtaaagtactcagaacagggctagacatgcagcaatgaacataaactattattaccatggctctctttttttttttttagaaaatttttttttaaatttcataggtttttggggagtaggtggtatttggttacatctttagtggtgatttgtgaaatgttggtgcacccatcacccgagtggtatacacttcaccagagcagtatacactgaacccaatttatagctttccatccctcacccacttcccaccttgccccgcaagttcccaaagttcattgtatcattcttatgcctttgcatcctcatagcttagctcccacttatgagtgagaacataatgttggttttccattcctaccatggctccctctttgagggaagaaaggggacccagggggctccccggccaccctgctcccatcctccctgatggccacaggctcccagcagcccttgatggcaccttcatccatcttctgccagacacacagaactggctcgcttacccgggaagcaggcacttaaggaggcgcttccccgctttctcttttaattttcgttacataaatttcacatttcctggaatagagagcttgaatgtctggactcatttggaaatcgagtcagcaaagggcctcatttatattaatggggactcgagcctgacttgagacgtggcagagacaaggatggatggcagcagctcctaggcccagccatccaggctgagctcagacactgccttgagaagcagatgcctccagatttaggctgggactgttctcgttgtgtggggagctcctggatgcaagggcggtgttgtcacccctcccccactgaaacttcccaatggctgctcactctctcagagggaactccagtctgcttatcctgcttgacaaggggctgcgtgatggacccctgctaacctccctgctcctgcccaccactctcctccctcatccttcttcagtctggctggcctcctgagagcattcctgcctcagggcctttgcacttgccgtgctctctgcctgaaaggttgttctcctagctcatcccgtggctagctccttccatggcttgtctcacagacagcacctcagggaggccttccttgattgcccatctggagaaacactctccagttactctgtatcacacccatttcattttctccatcacactgagcaatagtttgtattttcttgtttacttatttgcctatttatttattggctgtctttcccatgagagtataaaccccattagagcacagactacgtgtctccttcagctttgtccccctaggatctggctcagagagacagatttcttaagcaccttaataaatatttgtggaatgaatgcctgcactcattcagcaaaccctttctgagtgccttcctggtgccaggctctattctgggtgctgggaacacagctaagaaaaagacaagaggcagggcacggtggctcacgcctgtaatcgcagcaatttgggaggccaaggcgggtggatcacttgaggtcaggagtttgagaccagcctggccaacatggtgaaaccctgtctctactaaggatggaaaaattagccaggtgtggtggcatgtgcctgtaatcccagctactgaggaggctgaggcacaagaattgcttgaacctgggaggtgaaggttacagtgagccgagatcgtgccactgcactccagcctaggcaacacagtgagactctgtctcaattaaaaaaaaaacaaaaacaagacaagattgttggctgcatggaactcgtggtctggcgcagagaggaaaacaccatagtaacgaacatttattgagtgtgacaaggattttacaaagagacatcacatttaatcctaactacagcccttggaactattatttgtaccagttcatgaggcacagagaggtgaaatagcttgctcaaggccatacagttagaaaacagaggagccaagattgtggccaggccatccggctccccactctgctggtttaacaagctcactgaagccactgggagttaaagccttgtgctgtgaaacctgtgatgggggaggctctgaaggctgtgggagcccagaaaaagcacctgacctattaggctggtgcaaaagtaattgtggttcttgccattgaaagtgatggcaagaactgcaattgcttttcacaacctaatagcttttgataggagaaaagatgagcaaagcctcctgaaagatgcagtaccttagttgtgtctagaatgtatttatttttaactttacattatagcttaagaacttttaatatctccatgctgtccacagttaaaattttaagtaatgcatattattccagtgagaggcagcaccatccatcactgttggggagtttcatgcttgcaattttgaggttctctttaatgctttgaggaccaacaccctggacttactggagtaatgtagcgctcaggtttcggctcctccctttacttggctctgaggattctacatgcctggaacaaggcacatctccaaagtcactaacgtggctagataatggataactagaagtgcctgccccctccaccatccttgtcttgatgccaggtgagatccaggctcctctgccccaagaagggctgagcttacattatctccagctcagcaggtccttggaaattaggttgttttaaggaaataaagaaatgtgatatttcaacaagacactaggaacagcggttgcctctgcagagggaaactgggtggccaaaggatggggtaagagggaaattttcgggccaggcgctgtggctcacacctgtaatcccagcactttgggaggctgaggcgagtggatcccttgaactgagtccaggaattcgagaccagcctggacaacatggccaaaccctgtctctacaaaaaagcccttcaaaattagctgggtctggtggtgcatgcctgtagtcccagctacctaggaggctgagcttggaggatcacctaagcctgagaatttgaggctccaatgagctgtagttgcaccactgcactccagcctgggtgacagagaccctgtctcaaagaaaaaaaaaaaaaggagattttctttgcagatccttttatatctttcccattgggcaccacgtgaaattattaccgagtttaaaaaaaacttttttttaaaaaatgtagaagttaatgtattatttctgcatatcggtctgtggactaagctttatacgatgcattcattctctttatttacctcaaatgtgggaagtagctattattgcctcttcctgacaacaacaaaaaaagcctgaggactggagatgggctgtgccttgcccaaggtcacatggtgaattagtgccagaactgagactccactgggtgcagtggcccacgcctataatctcagtactttgagaggctgaggcaggtagatcgcttgagcccaggagtttgagaccagcctgggcaacatggtgagaccctgtttctactaaaataaaaaatacaacagttagctaggcatggtggtgtgcaatgtagtcccagctacttgggaagctgaggcaggagaatcacatgaacctgggtgatggaggttgcagtgagccgagatcgagccactgcactccagcctgggtgacacagcgagactctatcacaaacaaacaaacaaacaaacaaagaattgagactctactccaggccttctaacctgtccagggggtctccacttctccaggtacctcttcctttactggcggaagccatgccgaggtgtggacagaggggtggtgatacctctgtagttatcacctacagtagggtggtcacacgtcacactggtgttacacaatctgggctcaaatcctggggctgtccctggcctgctgcatgaccttaggtaaatcacaaaacctcttgggccttggctctgtgatagctgggctccaagatggctccaatgactctcaccttccagcgctcactcttttgtgtggccctctttggcagtgaatagggctgacctgtgggaccaacagggtattttggaagtgacagtgtgtgtgacttccacagctagataataaaggatattctaacaatggaatattattcagctcctgggctcaagctatcctcccacctcagccttccaagtagctgggactccgggcgtgtaccaccatgcctgtctagttttatttttatttttgtagagacagggtctcactatgttgcccaggttggtctcaaactcctggcctcaagtgatcctcctgcctcagcctcccaaagtgctgggattacaggcatgagccactgtgcctggcgccggctgatgtctgtcttgactgcaacttcacaagagagtctgtacaggaaccgtccagctaagccactctcaaatacctgagccacagaaactgtgtgaaatgtaagtgacgattgttgttttaagctgctaagtgttgggataatttgttacacagcaataggtaatgaatacagtttttcatctgtaaactaaatattgtggtaatttcacagtgtcattgatgataataatttcatgatgactcctttgatgatgacttcataggttgtatttcatacggttgttgctaagaaattagcaaatgctaattagtgcttggagcagtgtctggcacccagtagattctgagtaaatgttaactggtttgattatatgttctttgttatttctggcactgtgagatgctgagcctgaacaatagattccccgccccccttttttttctgagacagagtcttgctcttgtcacccaggctggagtgcaatggcacaaactcggctcactgcaacctccgcctcccgggttcaagtgattctcctgcctcagcctcccaagtagctgggattacatgcatgtgccaccatgcctggctaatttttgtattattagtagagacgggtttcaccatgttggccagtctggtctcgaactcctgacctcaggtgatccacccacctcggcctcccaaagtgctgggattacaggtgtgagccacagcacctggcatagatacccattaaggaacatagctaggccccaggctgcagtgggataatagagatggttaggatgagagctaccgctattgaacactcactcaatgcctgttcataagcacttcatatccttccatcgaagcctcagcagcagccctttgaggtagatgctattatttccccatttgacagactagaaaatcaaggtgcagagagagacaatgactggccctaaatcacacaccgaagaagtggggtagccaggatctgaactcagatgtttcagaccccaaagtttctattctgaaccactaggctgagctgcagcttggctccccatcccccacgcccacccctgacacaaagcttatcttttccctttaccaatttcctgcttattagtacagagttaattgcccacacatctgagtgcaatcattagttcattcacctcctatctgcagaatgtcaaactcctttgcactcgggagactggagagtagattcctttagaagtttgttcttgtgattcacgttccctctcccaggctatccccttcaatagctaggattgggaataagaatgcacacatgtacagaaaagcacagaaacatctgccctgccttagttccctacagggtctcatcagaggtggtttcattagccccaaccctttgcagcctggcaccttcagacatgccaccagctggctctcctaatatttgctgtggggccatgtgatcatcaggagggataggtcctcaaacaggcgatgagctcaggacatgggcattgccacacctgttcctctccccaaggaggggggaaagctgtgcagtcacagacaacgtggccttttataagcttgaatgtgatgtgcatacttgtgcatgggcaggagagcagacagggaccaagccaaggctgacagggatcagagggaaggacaggggtgtttgcgggtgcctgcaatgtggcagtggctgagctgggcctgtgtgcctgtacaccattgtgtttcagatatttttgactgtcaagttgcaggaagaagtatattttgcagcatgacctgtaacacacacacatgcacacacaattgacatgaaagtttcatgaatctgtacttaccttttatgagcaatgcatgctgactttgattcgattctagtttattctactccagtctattttattctttcattacaaaattgctagtcatgacccatgaaatatgtcaaaacccccaaatgcaggagttcataatctgggtctacaaacttgtatagaacaaaacgatataattttattttcactgacctctagttgaaatacagcacttcctttaggtatgaatataggcaacaaatcatagtaatatgtttcatagtaattatgtttcacacacacaaaaatcacaggctgggagtggtggcatgcacctgcagtcccagctactcaggaggctgaggtgggaggatcgtttgagcccaggagttcaaggctgcagtgaactatgatcacgccattgcacttcagctggagcgacagagtaagatcttgtctctagaagaaaaatcacagattgttttgtatctcgttatgtttgttgcagatgtctcaaaataacatttatgatcttcactacctcaaaattgtggtcgttactaattgctggaactttttatttatttgagacagggtctcgctgtgtcatccaggctggagttcagtggctcagtcatagctcattggagccttgaattcctggcctcaagtgatcctcctgcctcagcctcccaaagtgctaggattacaggtgtgagcaccaggcctggcccgatcttgttatttaatttgttaataaagaagcacttgtattactacatcacacatctaaaatattttgaaaattgcatttcagtaggtttcctttgtaaacctatgtatttggctaagtgcagtggctcacacccataatcccagcacttgggaggccgaggcaggaaaattgcttgaggccaggagttcggagagcagcttgggcaacatagtgagaccctgtttctacaaaattgataagagaccccgtcttttaaaaaataactgggtgtggtggcaagcccctgtagtccctgctacctgggaggctgaggtgggaggatcacttgaccagaaagactgagactgcagtgagccgtgatcatgccactgcattcctgcctaggtgacagagtgagaccctgtctctttaaaaaaaaaaaaagaaaaaaaaaggagcgtgaggaaaaaaaacccttatgtattggcatttaaatattattctgagtctgagaagggggtctgtgggtttcactggatttgtgagagggtccatggcacacagagtttgagagctgctgccccagtgagtcctgatacacagttcatgaaacgctaccccatgctgaaagctcttggggggcagagctccggagtcttgaacctcgagcccagcatggaaatcacatcggtggccaatgtttccatagcacatatggtgccagcctctgtacgaggcccttcacatggattatttcttttaatctttacaccaactcttgtgtgaggggtactattcttagccccatgtctctgtctctttaccctacttcatttttcttcttagcaccagaagtgtcatatatttttatctgtttattggcagcctcccccactgggatgtgtgtctcttgaaggcaggaatttgctttgctgagtgcttcatctccaaaatatcaaaatatgcaagacttaagggggtaccaaaaactcaggaatcatgccatgtcacatatcatgttcacacacacacccacaacctcagaaatcgaaataaggaacattttactgcctttttttttctgggacagggtctcgatctgtcacccatgctgaagtgcagtggtgtgatcatggctcactgcagccttgaactcctaggctcaaaagatcctcttgcctcagcctcccaagtagctgagactacaggcacacgccaccacacctggctaatttttttttttgagacaacagtctcactctttcaccaggctggagtacagtggcgcgatctcagctcactgcaacctctgcctcctgggttcaagcgattctcctgcctcagcctcccgagtagctgggactacaggcgtgcaccactacgtccagctaatttttgtgtttttagtagagatggggtttcaccatgttggtcaggatggccgcaatctcttgacctcgtgatctgcccacctcggcctcccaaagtgctggaattacaggcgtgagacactgcgcccagcctaatttttgtatttcttatagagatgggatttcaccacgttgcccaggctggtcttggcaactcctgggctcaagtgatccccttgctttggcctccaaagtgttgggattataggcatgagccactgtaccctgtctgtaatatttaaaaaaataaaaaataatgccccaaacccataaacaaaatatcaacatttcaagtaaagataggatccaacctcctgcatgtgtacattactgcctggatctccttatcctgttactggtcctgaggggcttaaaacctaacggttgctaaagtgaattagtctcattttgcagatggggacattgaagcaaggatgctaaagaccccctcggtgccaatagccagtaagtggagcagttaggattttgaactcaggcaattgagttccagccccatctttcttaaaccctgcacagccagcctcatgaattatcatgcttgatctttttggtagaggcagtaaactggtaaaatcagataggtttgagttaaaaccccagttttggctgggtgcagtggctcacgcctgtaatcccagcactttgggaggccaaggtgggcagatcacttgaggtcaggagtttgagattagcctggccaacatggcgaaatcccatctctactaaaagtacaaaaattagctgggcatgatggcgcatgcctgtaatcccagctactgaggcaggagaattgcttgaatccgggaggcggagattgcagtgagccgagatcacaccactgcactccagcttgggcaacagagcgggactctgtctcaaaaaaaaaaaaaaaaaaaaattcaattttgccccttcctagctgggtgatcttgggccagtcatctcaatgctctgtacacagattaaagagggcagaggggactggaaggggatcagaatgtggctacttcattaggtgggtccactgtgggtgtgtctgagaaagagtggggagaccgggatgttagagcaggcacccttgggtgagagctgtgggagatgaaatagagaagcatgcaggagccagtggatgtaagtatttgcagaccaagccagggactttggactttatttaacacgtaacagaaagcctttggaaggttttgatggcaaagtgacatgatcagactgacagcttgacaggacccctctggccattatgttgagaagaacctgaaagatcaagggcagaaatagggaagctggtctggacgtggtacaatatgaaggcaataaacaatggtggcctggccccaagctgcagcagtggaggagcaagaaatgcagatcccagatctattttgaaggcagagcccagaggaacggctgacaagccattcatttcagcactgtttgttatagcaaaagttgaaagcaacttgaacgttcaggagtaggagactggcaattaccatgtataatagaacacaacataggcttatgaaagaatgaggaggctcttcgtgtattaatacagaatgatttccaagatacattaaatgaaaaaagcaagatgcagagcagtgtatatggcactcttactatttgtatggggtaaaatcaaagcaaaacaaaacaacacacgcacgctacacatcggttatatgtatgtgtgtgtgtgtgtgtgtgtgtgtgtgtgtgtgtgtgtgtttgcaaaaatgatctctggaaggatacgtgagaaactggcggcctctagggacagggggacaggggtccaggggtataagggaaatttcacttttcattgcatcttttggatttgagattttgtgcctcttctcaactggaggtgatgtcccccaggggacatctagcaatttctggagacatttttggttgttgcaactggggggaggtattactggcatctggtgagtagaggtcagagatgttgctaaacaccctgcagtgcccagggcagaccccacaacagagcaagagctggccctaaatgtcagtagtgctgaatttgagaaggtttgatctattaaaaaacataataaggctgggtgtgttggctcatgcctgtaatcccagcactttgggagagcaaggcgggtggatcacctgaggccgggagtttgagaccagcctggccaacatggtgaaaccccctctctaccaaaaatacaaaaattagccaggtgtggtggcgggtgcttgtaatcccagctacaggaggcaggagaattgcttgaacctgggagacagagattgcagtgagccgagaccgtgccactgcactccagcctgggcgacagagcaaaactcagtctcaagaaagaaagaagaaagaaagaaagagagagagagagcaagagagagagagagagaaagagagagagagagaaagagagaaagaaagaaagaatagaagttttttttttttcaggatggtctttattctgaggttgtatattttatgggtttgatatatcctttgttttactaagataatatatagtacatgatagtcattttttccacatctttacttggcaaaataaaatgtcagcaagccttatacacttctctaagctgaataaaaaattatccgggcatggtggtaggtacttgtagtcccagctacttggaaggctgaggcaaaagggtggcttgtgtccaggatttcgaggctgcagtgagctaagactgcaccactgttccccagcctgggtgtcagagtgagaccacatctctagacaaataagaataaattttttttttttactgggctatgaaatcctaaagtctggaaactacccttttcactcaatgggcttttgaaaggtaatgattttaaaatatgtccacaaaatatttgatcctttttccccaagaggtagaattacctctctctaagtgtgaaccagatttggtgactcactgctaacaaatagaatttggtgcgagtgatggtttctgatttctgagactaggccacaagacgcattgtgcctttctccttacccctctctcttggaccactgcccctgggggatgccagcttccatgctgtgaggatattcaagagccctatggagaagtccacatggtgagcaactgaggcctcctgccaacagccagtaaggaactgaggcctcctcagccaacttagaggcaggtcttccatcccagtcaagcagaggactgcagctggtgtcttgattgcaaccttgtgagagacccctagccagaaccactcagctaaagatgctcctgaattcctgacccacaaaaaccatgagataataaatggttcaacttgctagagtttggggggtaatttgttacacagcagtagataaatacagaaggctgggcacagtggctcatgcctgtaatctctgtactttgagaggctgaggtgggtgtatcacttgaggccaggagttcaagaccagcctggccaacatggcaaaaccctgtctctattaaaaaatacaaaaaattagccaggtgtggtggcacatgcctgtaatcctagctactctggaggctgagtcacgagaattgcttgaactcggcaggtggaggctgcagcgagcagagattgtgccactgcactccatcctgggcaacagagtgagactatgtttcaaaaacaacaacaaaaaacctcccaaaaacaaatatagaaatctttgagccctatcagtaaggcagagatcacagaaaggtagcctatgggctctggtctgcctacagatatatttcctttggccagtacaggactacaaaaaatggaattaatcactaatgtttatttatttttattttttatttattttatcttttagcagagacaggatttcatcatgctggccaggttggtctcgaactccgccttggcctcccaaagtcctgggatttcagttgtgagccacatgcccagccatagttgctaacatttaaaagttgggtatttcctttaaaaatccagatttctgacttctcttagaaagatctaatattgctgggcccacatccctatggggtaacaaccagctggagatgaatggtgttcacccctttagacagggtgtgtgttctgttttttatcacactcaccaccacccccttaagtctcttagttaagttgctttactcatttatgttacctgctctgccccagtagtcatttgagcttatgccttctattgtgagacagtttttaatgagatgcccaggcatagttgacatgagaactaaatgaccagagttggaactttgattcatgaatatcatgtaggatgggttaccactgggttgcatagtgggggtgaaaagccagttatattttcatgtcctccctcttctggggggaagagagaaagctgatgccgcctggagacaggattcctgattcaagtccccttacagcgcttcccatctcgcctccctgtgccctccaaaaaataaactcctccaggcttgttttttccataccttttattgaactctgcagacttcattaagggaccatttgcttagaaattcttaaacatttggacatattttacaagacaagacagcagctggaggtcacacaaagatcacaatttcatctcaccacatgcataaaaagacactgggatttgtgtgtgtgtgtgtgtgtgtgtgtgtgcgtgtgtgttgcgcacatgcgcaatgcttattttcacctttacaggaaggactagagacattaactgacgagagatgaataggacccacgaatgcacccccgagaaaagagtggctgaggacattggtcatttatggctaatgtgattggcttggcccctgtcaagggtgaggtgatcagaatggctttactggcagaaaagccccaacctcacacgacgggttcctgggagagacagggtcttagctgatgggatctgggggcatactatcatgacggctttggggctcagaaaaaaagatcttcggctctaaaagctggagggcaggctggccttaatatccagctggactcccatggctcagggaatgcaatccagtttccagatgttggctcctatgtttctgccccaggaagtcccagaccaaaggaagtcccaacttcgaacccttggcttagtccattggaaaaccacttggtggtcccccccatgggtcgtgtgtgagctaaaatagaacatgaggctgagaaatgcagggtaggggaagaggaaggagggcagagctgctctgtgggcccccaggaagtgtggctctgagagggctgtggcccttatcagcttggggcctacaagcatcaaattgagatgtcatcttgagtcaaagaaagatgaccttgatggggcagttatgggtttcagtgggagaggggctcctcatttttcttctcttcacagttaggtagggattcattaactcccccattcactcacacattcacgcatccagtcatccactcagaggccaaccagtcacacattcactcactcacaaaaacacaggttggatgaccatcatgtgccagcggcataggttggggataaccctgagttcctggtgcagaaaataagattctcagtttttgaccttggattgagaaggacctatgaaatcaagatagacctggagaatcctccctgtccccacccactcaggcacactcagctcaaccaagagggaggcccaaaccccagtgaagcccaaggggcagagccaagctgtggatatgtcagagtttcttgggcatcttctctgctgcctgcctctttccaatcttggttcagatcagggaagcaggaagtatgggaagatccctgcatggccccttgagggcatcctaatgggacggaattgggagtttcttatattttcatgaaatatcctatttttgtctccttgtgttgttgcaacttgagtgattctgcagggcagagcctccagtgaggagttgggaggaatcttgaaaactggtttttattttattttggtttcagaggaaggcggctgctcattctacccatccaaacatatcatcctgcccaacctcatactaaaacaaccaaagacaaaccagtcttcggttcaccctgaggttgaagtctcactttctcccaatccaccatacataaaccctctcttgtcaaatgctttccttagagaatgcagtatgcaggatgatttgggatggaggccacagctgcaggagagtggcattctgcttggaggcagccaagagcctggttttgctgtgaaactggattaaaagctgcctttctcttttgacccttctggatttttttcattgacggggactttcaaaggtcttgagtggggtctcttatttgatttaccaaaaaaacaagcccttttggaatggagccatttgctattgcctgggaagttgttcattgtggggatggctagtggggaacagatatcattgcatcttttatacagaaagccccaggctcatgagggcacaggagctgggcggaggggctgaagcaccataagacagccagccagggatgggggacagcgtggattgctccttggctggcctggggaagggtagcatgagtctcatcccaatgtggtgcctggtaggccactggggatgggttggattggtgactgacagtcattaaaatgttccaagacggagccggaaggaagcagacttgtctcttggacaccccctctgagagctccaaagcccagaagttgcattcctgctaattgtgctgcatgcctttgcctcagtggcttgagcttatatccagagtgttgaaaccacctacacacacacacacacacacacacacacacacacacacacacactccaagaaacaaagaggaatttctgtggttgttcagcccagtttccatgcaatgctagggcccctctgcaatgcccattttttacaccatctagccagcctctctttaaacacctgtgatataagggagctcactgtccaccatggcattgagctccatggtcagacaacccagcctgttaggagggcttccttaatttgagctgcaattgaccccatccctttcatacaatagaaattttcggagaacttgcatacagccagctggcagctaagtttttttcttcaggtgcactgccccactccaccccatcctggccagcctttaggagatcttttcaggatctttggagggaggaacagagaattaggtttataagtgaagatgagggttccctcgattaacagagccctacccaaattcaagttggcatttggggtagttcaggagaaattctaggttaagataaaatcagggagagtggatggaaatgcaaactatataacctctttcttgatgaaaacagcaacagccataggcaacagtgtttgcttatctgggcatcaaacccaggaaactactggcagacttttttttgttttgtttttttgcttttgtgcagaggaaaaaaaaatcttgtctgttttatttgactctggttcaaaccagactatcagaggttttcggggtgggagaactctgatcagggtcatagtccagaataataaaattcatatttgagttggcttcctcttgggagttatctgatgggatggctcactgccatctgagggtcccagtttggctcaaatttctgattctaggcagagccccaagccctgcagctgacagtgaggtgggtggtataccaaaacctaaacgaatgcaagttggagattatctgggctttcttcatcttcctgcatgagttgacggatggagaatcactttctgctgaagatcctgcctagtgagatgtcctccgcccacccaggactgaaaactgcctctggaattaattatcaggacagtccaaaaactcccccaggcgtggataggtggaagctggaaaactgcccctgtccttgccacacacctcctgctctatggagccaggcagctggcaagggaaggggagatgagctagcagattcggggacatctcttctcagggtttggctgcaagggtgtctggccactgttttttggtgaagctgttagaaatggattgaaatggactgggtgcagtggtggctcacacctgtaatcctagcactgggaggccgaggcaggcagatcacctgaggtcaggagttcaagaccagcctggccaacatggagaaactctgcctctactaaaaatacaaaaattagctgggcgtgatggtgcgctcttgtaatcccagttactcaggaggctgagacatgagaatcacttgaacctgggtggaggaggttgcagtgagccgagattgcgccattgcactgcagcctgggcaacagagcaagactttgtctcaaaataataataacaaaaaaataaataaataaacagatcgaaacaaggaactgataaacaagttggtgagatcggaggcccagcatgttcttgtgaggttcacgagaacctgaaaaacctctgaccttcagctctgattgatgttacaggccgacagggtgctggacatgtgggagcagcccagccaggagggactcacatgtgttctggatctcagaaatgccagtgatgagtttgcttgcatgagatttttggttccaagatctctggggatgagaaaactcagtcccttcagatccctaaaggggtgtgggatataagtgaaaccagcccacatcccatcctgattttgagggccatctgtagctctgcttccctgggtctcattcctgcattcatgccctggattcttaagaacaacgaatgggagaaacacacagaaatgaatgaggaaagtcacagcattgacagagtccaggcctagtgtcaagaaatgcctacacaaggaagtcaaaccccaaagtctttccccaccctcaagaaatcagaatcaaaaggaagaaaacccaaacagcccaagggacaatggtaggaactgcaaaagaccagaaaacatcagctacgataatgaccaacaatgaaactcctaagatattgttctgtattacaaaagaagaaattagactcaattgccctattataaatttgctaaaaatacatatatatatatattttatctgaacagaaaaatagactactctgagatgcgtggacattctatgacatagtcgcgcatcagatacttctagagccagaaaaatggcaacagaaaatgcagaggtaactcttatttctgggtgtagccaggactggtttgggttgcctgggctgagtgacatgaaagcatttggatgctgtcctataagcagtgataggtgaggaaacatcagctcggggctggaagctttccattgtcctgccggggtctcaggggagccccttctccctcctgcccactctgcagctacagaaaaagtcctttcccaaagaagcatgtccggaggctttttgccttgctctcttttgattcaaagttacttgaattgaggctgaaaaaaagcctggggtattgttacttgagattagttggtagagaaataagaataggagagagattagcgatagagacctggctttagtggctcttgtccgtggtgaattttaaatatccccttgtccatggaactagacactccagctgggactggagcaagacagaaatatacaatagttacaaatatcaacaatacattacagttttacagaagagaatactgttttgtttttctccttagaaacatggatcttattaggagaaagggcagagacgaggctacagttaccaagacacatggagaagctggaagtcagtttgaaaaagtttgtatcaccagcagttttcaggggcaagctgggtgggttaaaagaaatggcctcctcaggattttgttgtttttccttcttactcttcttccttcttgatccccagtcctttggagaaagggacttcacgggaacaaatgttctctcctccttttttctttccccttgaagtgtgcttaagatagaattcctaaagaaggcactgagaaatctactgcaccaaagtcctgttggtttcttttacccaaagataaaaaggtgaatatactgtctcctccaaagcttccccacctctctcaccgccggtggcagactctcccccgtgtgattgggacacatggctacctggtccctagccctttcagataattgtggaagttggaatgcaagttcagctgggttcttgatgagtttcagtgaatttgccaaactgaccagcatccattcgccgcgtccagcccctagtttgcttgtttgggttgacttgtttctttctgctctcattggttcaggaatgaatgggaaatggaccaccaagttaaagcaggatttgccttcagaccattgctttcctcttctcttctctatcaagacctttctatcgagtgaacttctcagtgaagactcttaagtagatttcccagtgcatgtatattcacgtacataggtacaggttgggtgtatacatattaaaatttggatatgttcttttttagcgggtggatgggctgggaaaacttataatactctctttcgaattgagcacagaataaaagctatactcccccagtacatacacacacaagtaaaagaaaaaaaaacccaatcaaacccaaacaaaatactttctaagcatagtatatgctgaatttcaattattctgtttctataagaactctataggactctggctatgaagcctgaaaaggtaggttcttaatgatacttctgaattcgtccttcaaaagtgactcaataaaatgctactttacggttggacaaaatacacaaggaaggaagggccaggtcctacatgaccacagaaggcagaaagggcctttggttacaaggagagttgcaccaattggttttcgttttttttaaaaaaaaaaaaaaacaaatcattttcaatctgtacagttctcatctgcttcaaccaacaaatgaaatgcctcgattggaagaaggggtggtaagttccttctcaatatatatggctatattgaaacatgttcactttcctgatatgtaaaatagactatattattattattattattttttacagatagcatcagctctaaaaatatctgaattggaaatcacaactatttacttttatcaaaaagcatttgtttttttccctgaattttcacatttgtgctgatggtggacattaatggtgatgaaaacaaagaagagacatgtgagatggtcggcggagaactgtcccacagtcattcctcaagaggcccccagctcagactgcgtgttcagcaaagtgttttgggagtgctgcttcctctgcctggcacgggatgacctcacactctccctgcccctaagtccctttgcagttgctgcgcgaatactctgaagatacctaggaagagtgacgttctcgttttctctgttaatgcggcaaagaacaggactgcaccctcttggggggatctacagtctctggagatgctgagaagtgttatgaattgggtttgtatacagcagagaagacatatttttaagggtggtggaatgatcccatctcatcatatgtgtggcaggtggctcaaccttatgccttatgtatgaagagcaggcagaacagctccatgatatttgtgtactgagaggtggatcatgccattgtactaacaggcagaccagcaacagatgatattgagacttaagactaggtgaaccaataccatatctttcttccactgggaagacatatgcctgttactgtattgaggatagacagaactacactattgtacttgggacatcatccatcaacattacattaagagaacaacattgttccattgtactacagacaggcagaccaataacatgtcatctttactgacaggtgagccaacactatagcattgtattcatcagtggttcaacctaatgccactgtactgaggaatggccaacaacaccatgctgttggactaaaagcaggcaggacaatgccaggtcatcaaacgaggacaggaaaaccaacaccaagaaatacaccagaaccactcaggatgcacacaaatacttattgcttttgtctgtactggctgcatcgatggctgcaggaaggagagttgagcttttagtacagacagtgacactgaaaaaccaatagctggttgacaagaaagagaacagagtaaaacacccaatgtccaactgtcactgtgtccttttgagatgtgcatgtctcctgtatacttgacttcatgagaggccccacccaaggggcaagaacccctcctgacccatgagggttaagggaaggtttcagaggggcagggaaggagcccacagactttgatatggcagacagtaataccagcacaatattacccatgctggccagaaatgggcaggtagcaacaatccaactacagtcccaacaattgggctatgggaaatagtgcttattttaaagtgcaagatgttgacactgtccctggcagaacctatttttgaaaaacataaagtgctttttattttaacttttttttttttaacttgaaaaccacagaaaacaaaacagaatttctattatagtaggtactttccttgctgcagcaggaattattcagtctgaactgggcatttcaatgcgtggtatttttttcctttcatttttgcaagtaaaaaaatcatatttttatgctgttcttcagtaacacacagtctctttgaataaactatttcttttgcatatttgacacttgcatatcttttgagtctacactagtgatgtaaagaaagcgtgttcctcctccaaccctaaaacaatgctctgagttcatgctgttggctgggtgcccaccttctgaacccttcccagattgccagggggcaattagaattgagtacaagtggtgcaactcaccctgatggtatctcaaaataaaatctcaggtactatgaaataccgaagtcaatgaagacatttgagtaagggttttgcgctgggatcgtggcttatggcgcagagacttccccatgaccaatcattccctgtagctgtctaacagtggaatccatccaggaggtgatggacaggtgttcctaggggtggctgggcaacattcaataccaaattggtcaacccactctttcaacaccagccgcttgttccagcatccttctctagctgaagccaggaggactgtcaatgttgccctccgaggctgagatggaaagccacgagagaatggggagtatgtggcctcggtcctgtctaaagtggtggtagtggtggctgtgagttccactcatgtcatctcccaaagagggctatagagttgttacaaggaggtgctgtgccctatggcttggccaacttcatgctgatggacctgtcatggctctcaaggtcttagggagccttctctggagtctctcttctctctgagggctttacagggcctttctgttccagagttcatgcagaaaagctctgtggcaggtaagctgaacagctctcctctttggacctcacccaaaagtctctcctccaaggcagggcagttcagatgctctgatctcgtgtgcttccatgggctcctccccctggcaacacacggacgtcaggggagatgtggttctcaagtttgcacttttcctgaccactggggccttttccagtcaatgcttctgtggagtaaatacagttctgccttaagaacttaggggaggtgggtaaaggggagctttcaaagtggtttttctccgatcttgtccccgtgctgaacttcggactggtgctcccagggaggcttttgggggggctggagtccacactgtagagcagctgtccctcatcatctgtgtctgcgtcaatgtactggtggacacccgcctcaaagttgaacgctattgctgtgtgtttctcaggagaccgggggggtgtcttagcacttgctgtggtgtagatggaggactctgggctcagcacagccttgtccaaaagcgtggcacactccagtccagcgacagcagccgcagcactcccccggttcctgagagggtcatggtacatccctagaacggggaggagtggactggggtcaccctccatgaagttgactttaagtgctcggagcttcaaagggttgttagttttcatggaactcttggggctctcgatgaagaaactagagtgctggctggcatcagggctggggttggcctccacaaacctaccaccactggcacccagagctccccgccagcccacttctggggctgtgctgcccccagtcttgctggggagtgatgtcaaagggctgtgggagaatctggtggcctcagggaagtctgtggcacagctaatgaaactatcaatgcttgacatacttcgcatgtcaatgaccccttctgtgcgagtgggcagaggggctacggggctggggatactctccatttcaagttcttcctttggtttgctctgtgctgctgactccttggtattgaggatgggttgggattgggtcttggccatcttattgtacatgtcttccaactgctgaacgttcaggtgctgaggactagaagacgatctggctttttcaggggatccctgttccttggtttcaaaggacttacttgagctggtttcagacagtgtcctctttgtccatttccatttgttaggagacaagtggttatcttgtactttgtctttcttacccatattctccccatttttctcaaccacaatgtccatcatctcaatgctccgggcaaaagcatccttcatgttcatggatacgatgctgccattcctcttggctctctccagagcctctcgccgtttgattgctttctcctgtctcttctgctccttatagaactcagagaagttattgacgatgatggggatgggaagagcaatcaccaggactcctgcaatgcagcagagtcccccaacaattttccccaggagagtcttggggtagatgtctccatacccaacagtagtcatggtgatggtggcccaccagaaagaggctgggatgcttttgaacttggtgtcgtcctcatccttctcagcaaagaagacaaggctggagaagatcataatgcccatggcaaggaagaggatgagcaagcccaactcattgtagctcctccgcaaagtgaagcccagagactggaggccagtggagtggcgtgcaagcttaaggatgcggagaattcgcatgatgcggaagatctggaccacgcggcggacattctggaattgcagcacgctcttgttggattcggtgaggaaaatggtgacatagtatggcagaatggccaacaagtcaatggcattgagtgggcccttgaagaacttccacttcttgggcgaggagaggaacctcagcaggtactccatggtgaaccatgcgatgcacacggcctccacgtgggccagctgggggttgtctgtggactggccgaactcatcgaggctctgtagctcaggcagcgtgttgagggacagggcaatggtggagaggacgatgaacatgatggaaattatggcaaggatctgtgaggagaagagagtgggatttagttatcaaccaccccacaggatgatcatcataatatcctggatctacagggcactcctcaatgttcaagagcattttcacatttcactagtcatttaatgagccaaaaagagaatttgttgtaatccatttattgtctagatgtggaaaccaaggcccagagaaatgaaatgttttaaagctatcagcaagcccagggttcaagcatactttttcagatagtaaccattttataggccctgaaaccctgcattgtctgtcacaacgactcgactctgcagctgtagcataaaaccaaccttggataatacatacatgaatgggcatagctgtgtttcaataaaactttatttacaaaaataggcagtggactgaatttggcctgtgaaccatgatttgctgacttctgatctagaccagtggctcacactggatggggaactaccttcacagagatgatactaatgataataactatccttgattgagtgttcattgtgtgctaggcactttccatgaaatagctcatttcattcttataataaccccgttcagtgctattagctccattgaacagatgcggacacttgggtttccacagctagtaagtggaagagccagcattttaacccaggtctgtgtgacccaagaacatgagctcttaaggctgtgttaaaaatcagatttggctgggtatggtgcctcatgtctgtaatcccagcactttgggagacctaggcaggaggatcgtttgaggccaggagttcgagtctagcctgggcaacatagtgagactctgtctctatagaagaacaaaggggaaaaaaatcagatgaaagctaaccttttgctagaaaaatgcctagacactcaagattttgcaggtaattcctagggaggcacagacattctgggcccatgttaactcctgattggaactatgtgcttttgggggctaaagaccttggcttaactacctttgagtcccctggatcaagaagagagcttggcccagagaaagggctcaatggatatatgttgaaattaatggaatctaggccagtaggccagtctacagactatgcagaaaagcaaacagatgtaatcaattgctctgagggtcttttttttttttttcaaaaatacaaatccaatcacattactcctttgtttaataaatctccagggctcctcatgaaaaaatccaaacccctaaacctgtctattgggtcccctatacctgtcttgcttttgtagattttccctttctcttcctctgcccctgctaagtgggaaggggggggcctggtcaccatggttgtatcatttgatcctgcctgccaatgatcagagcatgaagtttggataaaaaaatccaagttaagccaatccgtacactggggcttagccagcctacctttgagaaatttgagttcaggaacccaggcggtgagtgggttacgggagggtaagtccctgaattaaatgttaagtagaatctaggcttgaatcagcttcatgataagcccaaccctcaagcaactgtctcccaaatgtaggggacagagatgccataaaaacatcagagaaagctgagccttagcctagacatggtggcttacatttgtaatcccaacactttgggaggctaaggtggggggattgcttgagcccaggagttcgagaccagcctgggcaacacagtgagaccccgtctctacaaaaaataaaaaaatctgctgggtgtattggcacatgtctatagtcccagctacttggaaggctgaggcgggagaatctcttgagcccaaggaggttgaggctgtggtgagccatgaccacaccactgcactccagcctgggtgacagagagagaaaccctgtcttgaaagaaaacaaaagaaaagaaaaaggaaaaaaaaaaaagaaacgaaattagccgggcatagtggcggcacctgtattcccagctacttggcaggtgaggcaggagaatggcttgaacccggcaggcagaggttgcagtgagccgagattgcacgactgcgctccagcctgggcgacagagtgagattccatctcaaaaaacaaacaaacaaacaaacaaacaaacgaaagaaaaagacaaagaaagctgaaccttcaagagaagccagagaatgaagggaaggtgcagatgaaggaggagtggggaccgcaggagggtcatagcagggtgccgagggcagcagttaagagctgaggctctggtgtcagcctgtttgaggttcaagcctcagctctgccatttccttacattgagcatgttatttaacctctctaagccccagtttcctcatctagcaaatgggctgataataacagtatctacctcagagaactgctgtgaagatgaaatgtgttagcacaggcaaagtgctaggacagcttccagcagcacacggtgagtgtctaatagatgccagctgtcatcacaggggaaatctcagcccacatcaccccacccactcagatcaccagcctcggggtggcccggtctcggtctttgcctcctgtccttgttctgagactgtctgctgtatcctgtaagtcaacccaattgctacatgggtgagtgtgggaggtttctggccctgcaatgaatccccagtaaggacacttggttgtcaagtccttctcattttgactctgacctctctctctggccactcctgccatcggttctcaaaattcacactcctctagccgcacactatcattggtcaattctgcatgtccgagcttcttgcttgctgtctggtgaactccaatccatcttttcaaatccagcccatgtgaccccttccctttggagttctccctgctttccccaggcagggttgactgctccatccttgggtttcctcaccattttaccataccttggggatacttaccactcatatcccatcacaggtgcgtgcgtgtgtgtgtgtgcatgcgtgtgtgtgtgtgcacgtgagtgagtgtgcttattgctgcccagaattggtgagtactgggaggatggggatgggttctgaggtttatctatgtgcccccagcacctaacccagggtgggacacctgacaggtgctcaccaagtatttgttggccgttgctcaagttcatggagttagaagtagaagggtcagtaccagaattcaggtttttttttttttttttttagagacagtatctttctctgttgcccaagctagagtgcaagggtgtgatcatagcttactgcagcctcaaactcccatgctcaagcaattctcccacctcagcctcccaagtagctaggaatacaggagagcacaaccaagcccaactaatttttaaccttttttgtaacgatgggatctcactttgttgcccaggctggtctcgaactcctgggctcaagctgtcctcctgccttggcctcccaaagcactgggattacaggtgtgagccactgcactggcctgggaaatatttcttggtcatctactctgcgtgaggcactaggccagacattggggatgccacagggggcaagagagtgccagtgccctgatgggccagctctgaagatgaaagggaatgttccaaggtgtggtgcctccccagcctcaggggttccataacttctgatttttttgctatagttaagtctgacacatcctatgtttaaaaaaaaataggtttgagtttcttgatttgcacccattgaaaaaggaagattctgtaatactttataaatgaaatgtttgaggcagggtgcagtagctcaaacctgtaatcccagcactttgggaggctgagacaggtggatcacctgaggtcaggagtgcaagaccagcctggccaatgtggtgaaaccccgtctctactaaaaatacaaaaaaattagccaggtgtggtggcaggcgcctgtaatcccaactactcgggaggctgaggctggaaaattgcttgaacccgggaggtgggggtggcagtgagctgagatcatgccattgcactccagcctgggcaacaagagtgaaactctgtctgaaaaataaaataaagaaaataaaatgtttgatatatacaaaaatagacctaatttatatataatttatgaaccataatcaaatgaacacctagaacccgccacccaaatggagagacagagcaggcagcagtaacactgacacttcctttgtgtctttcccactccagagataacctctgtgtgcagtttttcgtccctttgtttctctgtatgattttcaataagaatatatgggtccctaaattgtcattttgttgcgtttttttttttttttttttttttttttttaagaggtagagtctcactctgtggcccaggctggagtgcagtggtgcaatcacagctcgaatacctaggttcaaacgatcctcctgctttagcctccgaggtaacttggactacaggtgcatgctaccatgcctggctatattttgtagagatggggtctcactatgttgcccaggctggtcttgaactcctggcctcaagcaatcctcccaccagggcccccaaagtgctaggattacaagcgtgagccaccgcacctggactttgctcagttttgacgttatactgtatgtattttgctacttgtatcactctttccttaatggtaaaaacaaaaaatcaaaaaagcccactcaccttctttattttattttagctttattctaagaaatcatatgcaaaattgctgatttttcatgccagggctatatgtattaaatattcaccaaaataaatatgtaattgttggaataacatcttggcagcacactttttggtgctcctgtgttgagctgaggagtgtgggtcctggagttgaaattctagctcttgccattcattggtggaatggccttgggcatccaaatgttcactgcctcagtttccttatttgtaaaatgaggacatactagtggtttttaaggggatgatttttactcctgggggacacttggcaattttggcagaaatttttggtcgttacaactggtgggaggggtgctcctgacatcttgggggtggaggtctgggatgtcactaaatgccctacaatgcacaggacagctcccacggcaaagaatgatctagcctgaaatgccatcagtactgagattgagaaactctgggacatgccaatagtcagcccctcacaattgtggagttggggacacagagtgggtcagagtgggcagccagtgggctttgggctgagccctacaggaagctgctctcgtctggtgacttctggcaggagggcgcctgcacagggaggaatgggttccctgggagtctgttcctttaagagctgggcagtcttattttcccccaaaggctagcaggggaagcctgctttggtttctaacccccagacaactccagggaaggcccacataattgatgttctggcgacagatgcatgaattatgcacccagctattgtacagacctaaagcaggcaccccttttgtacttgagactgtgccctccctctccccttccctcagcccaaggaagcctaggaaacgagcaaagcagggggaggggctccactggactccaaggtggagggtgtgggggagtgcctgctgctcagggttgggttgggagggtcagagcacacctgccatcggtctgtgtgaatgtgcatcacacagcgtatgcggtaatgcagtgtggggggtctcccctgccccacccctcctgaccccacctgcaagaactttttctttcccagactcagtgaggcccttagaatcagggccacacttcctgcctggggaacttcccaacgtgatttaagccctctgtgcctcagtttccctatatgtaagacagggatcattgcaagactgcaatgaaaattcattgaactcaaaatgcccttagctagtggcacaatcactttaaactttaattgtatttatttctccacatttctttacatttatttatagctggttttggacttgagtttgagtcccaaggctattattccccagctgtgtggctttggacaagccactccccctctctgagcctctatttccttttctctgaaatgaagatgaaggtaactgagtactcacctaaaagccacttaatatataatgttattaaattattattcagggccgggtgtggtggctcacgcctgtaatcccagcactttgggaggccgaggtgggcagatcacctgaggagttcgaaaccagcctggccaacatggtgaaacccatctctactaaatatacacaaattagccgggtgtggtggtgggtgcctttaatcccagctacttgggaggctgaggcaggagaatcgcttgaacccgggaggcggaggttgcagtgagccaagattgagccactgcactccagcctgggcgacaagagggaaactctgtctcaaataaataaattattattcaggtaatttatggtcaaccccatccctaacctctgtactggttgcttttggaagccaggagtagctgtgtagaccccagtgactgcctaaggcagcgtgcgtcctctaaacagctcgtggacccagatggactgtgttgatttggtttctgggataagccccaggaatggggaactgactaccacctgggagtcctcccagccccagctcaggcctggacaggcctctgcttttctgggatctgagcccagttgggcttggcagaactccaggaacccggggagcagaggcaggagccagctccagagactgggaggctgtccccaaattccctgtgaagaggttctggatcctggagcctacctgtctgcaccaaatgggagagggggctttggtcctctgggggaagagattggcaggtggggatccccagggtggaattcaggagtgctggagccaggccctcctcatcctaatcgtcggctctggtggttaatcacagagaggcctacggactgtttatcgtggcctctgcacacttccctgctgttccaggaatgtggatgaggcacagactgtccatgcagaaaagggctcaagcttcctgctgggaagatggggaaactcaagcagagaacggaagtgacttgcccacggtcacacagcccattgctgtcaacactgttcagtaacactagaagctttggcaagctggaagctgcacctagtgtttagggcttgcaaattgctcttcgtaaacatgcaggtttatagctgcagtattcataatagccccacagtggaaacaaccccaatgtccgtcaactgatgaatggataaacgaaatgcagctatccatacaatggaatattcttcatccataaaaaggaatgaagtgctgatatatgctacaacacagacgaaccatgaaaacattatgataagtgagagaagtcagacacaaaaagccacttattatatgattccatttatatgaaatgttcagataaagcaaatctatagagacagaaagtaggttagtggttgccagggtgggggatagggattaacagttaatgatcataaaggacgtcgtgttctaaaaactgacttagggcaaagcctgcacgatttggtaaaatttaataaaaattatcaaattgtatgctggaaatgggtgtgcattatatgatacataaagtaagcctcgataaagttatataaaaagttgctttccataaagggcagcccattgctattgcttttcttttcttttttctttctttctttttttttttttttttttttgagacggagtcttgctctgtagccgaggctggagtgcagtatcgcgatcacgactcactgcaacctccgcctcccgggttcaagcgattcttgtgcctcagcctcctgagtagctgggattacaggccaccacgtccagctaatttttatatttttagtagagacagagtttcaccatgttagccagactggtcttgaacccctgacctcatgtcatccacccgccttggcctctcaaagtgttgggattacaggtgtgaaccaccgcaccgggcctttttttttcttttgagacaggatctcactctgttgcccaggctggggtgcagggatgtgatcttggctcaccgcagcctcaacctccctttttgtattttttgtagagatggggttttgccacattgcccatgtcagcccattgctttccatccccacaacatatggatagttcataggagagaagaagctgagcaagccacagagctgctgtaagccctgcagcgactccccattctcccagttaagttccagttcctgtgcctttagttggcatgtgcttattgagcacttcctaagtgctatgctagttgctgagggtgctgcatgaataaggaagaaaatttcctagcctcatggagctagcagggagaggcagaccaaaaaaacccaaaaacgtaaaccaggaaagaggcaaggtgatgtcagatagtgttagatgctgtgagttattgagaaaagcaaaccagggggatcgatgcagaagcactaggggtgtccacgggaggcagagtggtcagggcaggcctctcttaggaggtgtctcgttgctgagacttaaaaataagaagtgtgtgtcattcaaagatgcgaacattctaggcagaaggcacggcacgtatgaaagccttgggtgggaataagcctggtatatcaagcaacccaaagaagctcagcatggctggggctgcatgagcgagagcgggagagcggggtgggcctgatgagacctgatgaagagatctgggttttatattaagatcccttttcttctctctcctgaccatttcccctatttcccattgtaacccacactgaatcctgcagaaaccacttaaagttcccaaactcaccaccatgggtgcttccacctctagatctttgctgttccctctgcctggagtacccttcctcctactccaaacccacttctcctggctggttcctactgcctattcaggcctcagctttggggccacttgccccagcgagccctctctgggcccccggtctgcattaggtacatcagttctctgagctcacacagcccctgcgcatctctgatcacagccctggtgctgctgagctgaaactgttttctcctttctgtcccacactaaagtgtcacctccatgagggcccgaactgggtcggtcttgtccagtgctgtgtcctcagctcctgaaacagtgcttggtacagatgggagctttctatatagctgacaaatgaatgaacaagtgaataaagaaaatggaggctgagagaatgaagtgacttttccagagtctcgcaacttgtaagcggtggttccagacccatggacttgatctcaggtctgtgggtctcccaagacgttttcaaggacgtaggaggaggcggctgctggcccatcaaaccttcggtccttttatggtgcttccgcttcccccagctttaaggggggattacagctggggagttttaattagaagggtcactggtgcagatccgattaaggggattgggagcaggctgatggggttgcccgcatcccctacaggcagggaggggtccctggcagaggattggtaagacattggagtcagaagcctgcagggggcgctcgtgggcacaaagggacaggaatcctgtgcgtgtacaacaaaggatgaaagcagagggctttgccatgagaagaaaacagtcacaaagatggaaagaggatggagggccactgtggagggcgccctagcccttataacccagaggctttgctgctgggaagtttatttttacttggttgaccgagtttcaaaattgggagattttacataaaaatccagattttcacattcttttggaaaattagatgctcgtcttcactcaacctgcattcccagtggcaaccactggctagagctaaggaacagcaaccccttgggagagtgaaccagctccctagtgtgccacaggcccttcacctgttttgtgatctgtctctgcaggcagctgggtttgcagtcactgacccacctgaggcgataatgaagacaacacctgccatagggtatgaagaactttccagacaagatctgcatcagactccacaagccaggaacatgggggtcacacttgctataccctgccctatccccatacccagggatcaggagacaggagcctgcagggggcaggctaagagctaagaaggataagtaggaagtaaccatgcagagtgaagggaaaagcattccaggcgaaaggaacagtgtgggaaaggccccatggcaagaagatagtggttgctaagtctgatcaattcaagttcaccaacatctgcgcatctgttccattctctccacctgcacagtccccaccctcccgcatcaggacttctttctggcctccccaaaaccactctctggcccactattgcaaagaccactagctgtcaccaacatctattcttcccctcttccattgtcacagagttttagctggacccagggctgcccagaataaagactacatttcccagcttcccttgcagttagatgtggccatgtgattaacattggccaatggaaggtgagcagaaataatagaagccctgtctccttttcctccttgctggctggcaggcagatgtgctgggcagagctggagcaactgtcttggatctgagatggaagcgaatctcagtgctagactggccctttatggaaaaagtttgccagctcctggtctatctcatgacatccatcttgttgaagccactcactgtattttggggtctcattgttacagccgcttagtctctccctgcctgactaactctccagccttctcttgttccatgctcttctctgccccctcatctcaggtacattaaccagtaaccttcctttggtcgttcatagtcttcactatcttcttgccacgggacctttcccacactgttccctccacccggagtgcttttcccttcactctgcctggttacttcctactcatccttcttagctcaagatcacctgttcaaggaagccatccttgactttcctgaccaagtcaaatcccaatcacagactctcatagtactattatccttctcctcataacactgttcaagttgcaattttgcagtaatgtccacctctgcagactgtaagcagtgtgagggcaggggttatatctgatttttctcaatcttgaatccttagagcacatagttggtgctcaatacatatctatggaacaaaggatctcatttcatcctgataacaatcctacaggctgtgctgtgcctccacctgttttataattggggaaactgaggcttaagaacaaatgtccagaggaacaattaagaaaatagtagatggccaggcatggtggtgcaggcctgtaatcccagcactttgggaggccgagttgggcagatcacttgaggtcaggagtttgagaccagcctggccaacaaggtgaaaccttgtctttactaaaaatacaaaaattagtcaggtgtgttggcacatgcctgtaatcccagctactcaggaggctgaggcaggagaatcgcttgaacccgggaggcagagtagtgagccgagatcatgccactgtactctagcctgggcaacagagcaaaactctgtcaaaaaaaaaaaaaaaaaaaaaaaaaaagaagaagaagaagaagaagaaagtagtagagagagagtttaaactgatgtatactagactttgatgcccttctttattttaaaaaatatacatacctgggacctttcttatcctagtatcctggggtctggtttttaacttatgccttcacttgaaccgtctctctgaggtaactgcactcttcttaacaagctctgggttgggcaacctcttcctaacaggccagccaggttcccacaagcctctccaaaggcaggaattctgggagatggtgatgtcaccatctcctgccaacctgaggacaatggtctctggtggaggaggaagagggactcaaaactgatccctgcagagggaagaggggatgaagaggcttgtttctgaaggggagaaatgcgagacagtgtgctccctgcctgggtggttgccaattccctatatttgctgaggacatgagcaggtgggggaggaactgtcagtgttaaccgtgatgaatggcacgggtccattcctgttgtagagagcaatgtattgaatgaaaaatgaggagcacaggaagtgttaggcaaggacagtgtccccaggttctgccggccacaaaccggtttccttgtcctctgagtctggctggaggggactggggagggtagtctctgagagcttgaccaaggtggctggggttgctaatggaagctaattatatgagtctggagagatgctggggttaggtagtactctggctaatgtcagaataatggctctgtgagtggtctttttttgacaatagccagatttactggttaatgtccaatctactttttgaaagagacattttggtggcttaacaatagatctttctcatctattatgaaattatagcagtttagtctcaccagagattcatattgaggtgaaatggacacgtgggtagtcaggagacctacttttaattctggctgggcatgcttcggcaagtgtcgtcacatctctgatctttctcatgcaggatccactgagagtctaatgggtctccagtacagttcctttctaggtggtgactcaagaacctagtggctctaccatctcaattggtagcctccagtcttgccaaggcagaggaagggacagtgtgggcaagtcacacttgctcttaaatgcccgcacccaaaagtgatacacatcattccctccctcaacagtgaggcctctggtctcttactgtgtcctccagggggacacagtaagtgctttgaaacttacaaaatgctttataacaggctaaggagatggtccccaatatgggtgtgtgcacaatatgacacactgcagtgcagaaacaaatgactggcatttctaccctttactgttaaaaacaaacaaacaaacaaaccaagaaatcaagttttcctgatgttaagtccatgaattaacatcgggatccttgttcactcagtatgtcaggcagccatggagaaaggagaagacccctggcgggagagtaggggtgcttcagcttagcggggttggcaaggaagccctcacatctttgtttgatggccgcagtgccatgtatgtgtgtctggggtgaagagacttctagcactcatgggtgtctggttccagtcttcttcctgggcaaaatgtctatttcctcgaggcagtggggcggggatatctggttctgtatgggctctgtgtgggtactggcagaggcatttaagagtgggtgtgagttcttcacacaaaactttgatgggtaaagtcaagagattgtggatttcttcattactgtagcacaatctagcatcttctcactaattcatctggtcgagtcaggttacagattctattttctgattttaagctaactagtcctctcagacaaagatgaatggcttacaaagatcctggaaaacgggcatggtggctcacacctatgatcctggcactttgggaagctgaggcgggaggatcacttaaggccaggagtttgagaccagcctggggaacatagtgagaccctccctcccccctgtctctaaagaaataaaaataaaacataaagatcttggtaaagccacaagggtttgggggtagtattagcaatggaaacacaggagaacatcaagacagtggctgaactgatgcttcccccaccccagtggtctgagccctttggcagtgaaaacacaaagttaaaaataatgatgatctcatcagatctgacaagaggttggccagaaaagggttgaaatgatcaggaagactctttgtatgtgaattttcatctactctcttttacagtgagccctattctcattcattcatcaaagaaagaaagaaggcaggataaatgaaatttgataaggaatgaatgagctagatccagggggagggaggcactagaatgtgttggttaagaaccaggacttgcattttaatctgttttcaattttccagctgtgaggcctcggacaagtttcttaacctccctgagcctcaatttcttcatctgtgcaatggggatcaccagagttcctccctcactgggttgtcatgtgggaattcaatgagataatgcgcgggggtgcctggcacgcagtaaggcctcgatgaatgttagatgttcgtttgttttaaagctgcgaggagtacttcgcctcgatataaggacgaccgttctaatggtgggagctgttacaatgagctattgttattatgcaatggagggaggccaaagagaaggatggaatcagcaagatctgggttcaaatcttgcccctgacatttactggctgtttgaatttacacaaggaacttcatctccatgagcttcactttcctcatctataaaaagggactattaataccaacatggtcagattcttataaggatttacctcattcattcattcattcattcatgtggggatgtgccaggtaatcttttaggccctggtaatactgcagtaaacaattcaggcaaaaatcccagtttgcacggagctgatggttttgtagagggaaggggcacacagtgaacaataataagtcaacaggatcatttcaggctatgataatggctatgaaaaaatgaagctggtcaggggaaagagaatgactatgagatggtttactttagctggggtgatcaaggagggcctccttgtggatgtgacatttgagctgagacctgaatgataaagaggagctggccacatgaccatcagtgggaaaagcattccaggcagagggaacagcaagtgcaaaggtcctgaggtaagaacgtgtttggcaagcgtggctgaagtaggttaagtggaggggacagtaaggaatgtggtaaggggggcagatcttagagtgcctccaggccacacacaatgagtgcagaacatgctattattattagtatcattagcagcagtcttcctctgactcccttgtttgtcccccactaaggacctgctttggaaaacaaggacatccattcttgtggttctcctggaagatcccttcagttattcaactgtcccacatgaaaacattcagggcagcaacactccaagtccttggtctggttgttgaaggggaggttgactcactagagtgtaaggaatgattgcattaattgtccaggaaagtgacaaggaggtgactctggtcatgcaattttgagctttggcttcaacctttgggggcctcgccctgccacctcccattctctcaattcttaatgctcaggggtgagatttctatgggcctcgggccactttgaggaaagccatgcgtgcacgagacaagtatccattttctactctttcacagaatcctgattttgtgcttacgtgactactttgcttgaagataacaccgcccagcctcccctgcagctggatggaggtcacatgcttggatctggtcaataagatgggagtcggagtgttgtgtgggacttctagaatctcttttttcttttttgtttttcgtattttttttcttttttttttttttgagaaggagtctcactctatcgcccaagctggagtgtagtggcacgatcttggctcactacaacctctgcctcccaggcttaagcgattctctgcctcagcctccggagtagctgggattacaggtgcgcgccaccatgcctggctaatttttttgtattttagtagagatggggtttcaccatgttgcccagggtggtttctaactcctgagctcaggcgatctgcccgctttggccccccaaagtgttgggattacaggcatgagccactgcacccagccccagaatctctttaaagcagggaaggctgcctcctctttttagatcttcctccatcctgctgccagggatgattacatgattgctggaactctagcagccactgagagtcgtgagactgaaaaccccactctgggaaaagcagagcagaaaggtggaatgaggctggggccatgatgactttatagagccatggtactagtcgtggactattttcatctggactgatgagagaaatatacttctctccctgggtctcactttgttatagagccaggcctagattctaatcagcactgcagtggttagcccagtaattctccagtatatggagaatatggagtacaacttacacatggactgccaacccatctgatagtaacacaggcaaaaagacaccggttgcccagaataacgtagcaatggactgggaacaagttgctcagaaaacaactccattccatggaacttgagtagttccctgtgtccttaactggctccactccacacccttccttccttccctttctggactctcagtagcctctcattttcctgttctaagagggaggtcaacagagacctcggcaccttttcatttgctgttccctgggcctggcctggagagaccttttcctgccacctcccctgccccttcaccagtttgctttcttccttctttcgggactcagtagcaatgtcaccagcttttcctagactgaattaagttgagtcagccctttcattgccctgtcacagcagtctttgtgaagtttcatcactcgccttcttaaagtcctccagtggtgtcctgctgcacttgaaacaaggtccaaactcttatggaggctgcacggccctgcctgacttggcccctgttgacctctctgatctctttttctctgtgctcttgcacatagtcactcccttccagccacactggccacctgtctgctcttccacatgccaagcccactcctgcctcaggacgtttgcacttgctgtttctctgtctagaacatcctcatcccagattgtctgtgactggctccttcttatccctcacagtctctccttagagagactgtccctcactgcctgattaaaaatacctcttcctcagtcactcactcttgctgcactgttttacctccttggtgatttgtcacaatctgcagtcatttttttttttttttgacagggtctcaaaagggtgcagtgatgttatcatggttcactgcatccttgacctcccaggctccagcaatcctcccacctcagcctcctgagtagctgggaccacagatgtgcgccacaatgcccagctatttttttttctttttgtagagataagatctcactatgttacccaggctggtctcaaactcttgggctcaaggaatccttccgcctcagcctcccaaagggacgggattatagatgtgagccaccatgcctggccaaatcattttgtttatttgtttgtttactcatttattttccgcttctccaccaacctaggttagcacatcaagggcagggactgtgtctatttcacaaggctgggtccccactgcccagcacagagccagatgtggcattggcactcaacaaatactggtgcactaaatgactgcctgaatgaatgaacaggtgaatggtttgtgagttggtcagttggatggagggatggatggatggatggaagtttggatggatgggtttagaagccatgaccccaatcggaccacccaaatgcaatatgtttactgagcacccctcctatgcaaggcactattggaaaatgcaagcttgaattagcagctggatgcctgatactaatgatataataacagctgagatttattgatttctcaccaaagcaggcactgcgccaactgcattgcatgaccgatctcatttactccttatatcaaccccaggaggtagatactctcgtaattcctgctttgcaattgtgaaaaccaagcctcaaaaaggtgaggttccattggaggaggaaacatttgggctggggcttgagggctagagatggattccagcaggcagagatgggagtaggggtgttctaggcagaggcagctgcatattcaaagggttggaggtggggaataacagtcaagccagtttggctagggcaggtgtgcacacagagagaaaactggcaagaggggagaccaccatttactgcacacccgcgacatgtgaggtaccaaagcatttattcaccatcaccccaggaagtagctcctcttttcaccttcatttttcagaggatggatctgaggcttggagcccctaaataacatgcccagagccacacagcaggattaggacttgaattcatgcctgtctcactctgaggctgggtcagagatggatagtcagaggttcaggaaggagttgacaaggctggctatggagtaactgagcatgtactgggagccaggcacagcatactatctcaattaatcctcacaagtacccaggaggtaggtattagtgtggtggatatgtttttggatagtttagcatcattttttgggaattgttcctcctccacaatcacgcattaagtgaagttgaccctgtttctccgtttcagggggtaagagtgagatccaagcttaccagttaggataattcatctccctggccacagggattactttagtagtgtgggcatgactaaaattggtcaatcagggttcatcctggaactttttctcaaattattgggaaagaggtggtctctttcatcaggggctgttgggttaacaggatatcaaccagaagtggctggagggtcaactctggctctctggggaaaaaaaatctgcccaagagtgtagccaaagcagagggactctgtgccaagacacaaagacaggtttctaatgacattatttgagcacctggatccagccatccctgaagccatccctttggattttccaacaatatgaactgatgaatgctctttttggattaggccagttgggctggatttctgacccttgcaaataaaaagtgatctgactgaacaaaattgttatcttaattttacaggtgagagagctaagattcatagaggtaaaatgacttgcgtttaggatccacaggaaggaaggggctgaatcacactgagatatcacaaagaaagtgcatggcatctaccaggtcctcaagaaatgcctgttcccttcttccatagatcaaggagtggtggagagaaggacgggaggaggtatacccactggtggaagctcccccatgagccgcaagcttctgggcagattctagattgcatctggaatcctccaaactctcccagcctgcactggggtctggcaggagcaaccaaagcccaggagttgacacataaagtgaacaagcggtcagatgtcagcatttgaacaaaattcctgaggatcccactctctccaaaaaagtgtcatctaagagccctggctgcaacacagggtttccatagaagggccagaagtcttagcacttctcagggcttacgcttagtaggatcttgtacagataattgtttcagtaccaccaaggattctgtggtcacttgaacttctcaaagctccttcatattgaaactggatagagagtaaggggttagcctacaaactttgactttggacaaagttgggttccaatcctggcccttggcagctgggtgactttcggtacattacttaacctctctgagtctcccgtgtgaaacaggcagaatcggaagatgaagtcagacaaaacaggtagacactcttagtacagagtttggaaccacttcagcttttgggcaagcagattagttctagatataggttgaactctggcatgtatgatcacattaactctctgagcctcagcttcctcatctgtaaaatggggctcagaataataccccctgcacaggtggttgtcaggcagcaatgaaatcatgcatggaaaatgcgtaccccagggtacgcatgtgaaccgaggacaccctgccagcaggacggccccccactcatccaccggcagggagttttggcccacacagtgaattcgttgccaatatttattttccctatgaattcacatttgagcttctcaagaaaaatctgaagctctgggtactcttggtccacgctgctccgtggcaagcccaggctgccgctgcgcggtgttaagtccagtcctgtactctaaaatctcacgtgcaccctgtgcgtgttgtttatgaggctcgcttggcttctgcaggaatctggtttgggagcccaggaataaatcattagacgtgtagccagcgatgagggaaaagattaaacagtgccagagaagcagtcatgggttccttagggaatgctgggccaagagctgggtccgcgagatgccctggatcaggaatatgcggatggaatccctgcctgggccagcccctcatccatccgtatatggctgcagagaagccatgttgctgcttccttagagcccctggctgcattttcccctcgtctctcctgcttctagactgctctgaagctcctcctagtccccaccgctcatcctaccacacctcagtaaagcagaattagaggattaaaaaagacgggcaggagataggggactactttagcccaacggctttggagggcctcactgaggaggtgatgcgtgagtgcggatctgaggaatgcaaaggagccagctcgcaaagatctggggaaaggccggtccgggcagcagtcacggcaagtgcaagggtcctggggcagggaagagattggcaagaagaggaggagaaaggcgaccagtgtccctggtgctagggaggaagacaaagggcgtgagagttgaggtcaaagagagaagagaggcaggcctttaagacctgataggatgttttgaacctgagaatcctgggagccacacggccatggcctaatgtaggtttaaagatcccctagctctagccaggcgcagtggctcatgcctgtaatcccagcactttgggaggcggaggtgggcagattacctgaggtcaggaattcgagaccagcctggccaacatggtgaaaccctgtctctactaaaaatacaaaaattagccgggcacgggggtgggcgcctgtaatcccagctactcgggaggctgagacatgaggatcgcttgaacctgggaggcagaggttaaagtgagccgagattgtgccattgcactccaacctgggcaacgtgaaactttgtttcaaaaaatagtaaaataaaataaaataaaataaaataaaataaataaaataaaataaaataatccccgagctgcacctaggaacagcctgtagggggactggaatagaaacaggaatcaaagtgaggaggctgtggtaggtgtccaggcaagagactgtgtctgttcacagtacggaagacaaattcaagttatattttggaggtgaaatcaaccaattgctgatggctcagatgtgtggggcgagggaaagaagagtcaagatggaatcccaggttttcatcctgagcaactgggaggatagtggtggtgtttcctgagatggagaggaatcggaggagcacctggggccagatcatgggggtgctgtgaacatcagctgaggggtctggaccagaccccgcagacaatggggagcttgggaaggcttctgagcaacagcagaatattcattcagtcattcaacaaacatttgtggtaaaagcttgtccatattctattctctcacagacggcaaagctccccacaagcagccgtgggttatgggccacaaacatccttcctgggcctatagagtgcacgagaaagctctacctgcccatccacattttcccttcccgacttcttcacctctggcttgaggagctgaagagcatttaaaaaatattcatggctgggcgcagtggctcatgcctgtaatcccagcactttgggaggccgagataggcagatcgcctgagctcaggagtttgagaccagcctgggcaacatggtaaaaccccgtctctacaaaaaatacaaaaattagccgggtgagttggcgtgcacctgtagtcccagctacttggggggctgaggtgggaggatcgcttgagcctaggaggtcgaggctgcagtgaaccatgtcaccgccacagcactccagtttgagtgacagagcgagaccctatctctaaaaaaaaaaaaattaaaaaaattaaaaaatgaaaatatttatttactccctgcctgtcttttcctctaaaagctccatgaaagcagggaccatctttgtaacttcagcatctctcatgcctagacctgtgtctggtacatagtaggtgcttaataactattgaggaactgaattttaaaaataaataaatgagccctagtctctcagactgaaggactgactgagagcctgtaaagtgccccgttcagggcctggtatacagtagacattcaataaacagtaatgaaaatatacacagaaaatacagccactctgtcaggtccctggtaggtcttgaggcttctccagtgtaggaaaggccagaggagtaggagggtgaggtggcctgtgactcaccctcccggggcccctgtcttgggcctaggcctgtgggcatggcgtctgcactaatccggctaagcagctggatgtgcaagggtgtgtaatcccaggcctgctggctttagcctgaccttggctaggatgacccaagtcaagaagaacgctcctgtcctcttaggccacccagagctgagaccctctacacaaccggggacagggatctaaaagacccttcttgggggacagaggggtggcaggctcacctaggtctccccccgaagctccaacccagctatttggggtatgcatctctgcacccctccccccttgctacatctttgccccagtgtcctccctgatggatgatgcggcacagaaatactatcggggaagaaaaggggcattcattcatcaaacatttatggagccaagctatgtgccaaacacttttccagatcctgaggacacagcagtgatcaagacagactctgtcttcagggaactgatatttgggtgggggaagcagacatgaaatgaggaaataggtaaattaaaaaggatctcttcaaggtgcaagaaaatgggctaatgggatagagactggctgtagggacatcatcaactatggtagtcagggagggcttctctgaggaggtgacatctgagctgagacccaaagatggagtatcgagttgtatgaagatctgggaaaggagcatccaggtggagggaagagattttaatcctagtgagtcatataagttggcaccattgagtacactgaatagataatgaacataataactaacatttactgagtaccgacaatgtgtcaggcccttttctaagtgctttgaatgcaataactcatttaatactcaaaacaatcgatcattttcatccaattttacagatgaagaaaccaagccacagagaggtcaagtgctttgcccaaggccacacagctaacaagtagcagagctgggatttgaacccagggctgctctacctcacaacctatgggttgttccctatctttacagcacattaatgttttacaattaaaaacattaattgttgagcattaccaagcaccaggtcctgggacccatggcgtctttatctggtcctacctctgaaggccacccactgatcctctgccctgcacctctctctcaccctcttctgatgtctctactctgaggccacctccagctccaggagtggccatgtggctctgcctggtccaatcagcatagaccaaccctcccagcctttgtgattgactgagggatgggcatgtgacacaagatggcttcatgagagtggatcttggaactttgcaaccatgggggaggaggagttctctttgtttttttgttttttgtttgtttgtttttttgagacggggtctcactctgtgtgcaggctggagtgcagtggcacaatctcagctcactgcaacctccgcctcctgggttcgagcaattctcctgactcagcctcctgagtagctgggactacaggcatatgccaccacgcccagctaattttttgtatttttagtagagacggggtttcaccatgttagccaggatggtctcgatctcctgaccttgtgatctgcctgccttggcctcccaaagtgctgggattacaggtatgagccatcgtgcccggccaggagttctcttttgagggaaaatgtctagctgggagataggaagcctggagcccaaagagcttgcttgagagtgaagccctcgtagaggagggcagagacaaaagatggagagagactgagttgcaatgacaagcactgatggtattgttcgaggcctgtgtatctgggccagagccagaaccacttctgaacttcgcagttgcatcacccctcccattttttttcaagcttaagccaatttgaattggatttctgtctcttataactgcaatcagaaccttgttttcctcctggaatgttcttccttcttttctctcttgctaccaattaatgttactcttatttattttttatttttagatgcagtcttgttctattgcccaagctagagtgcagtggtacaatcttggttcattgcaacctctgcctcccaggttcaagcaattctcctgcctcagcctcccaagtagctgggattacaggagtgtaccaccatgccaggctaatttttgtatttttagtaaaaggcaaaagatttatacgatctgaagagaaaccagagaataatttttgtatttttagtagagacagggtttcaccatgttggccaggctggtctcgaactcctgacctcaggtgatctgcccgcctcagcctcccaaagtgttaggattacaggaatgagtcaccgcgcctggccccagtaatgttattcttatgaccaccattaatatgaccatcactgccatcgccagtacagcgactattctcatgaatacttctattgccactgccaggaatgacagcatcatcctacttttaacacagtgaacacaggggccattattgctacactgatgctgtttctactactctttctgctattagcatcgcacttcccatttgtaaacctctcctgagtttacaaagcactttcaaaatcctctcattctcttctaaacctcaccacactcccccatgagtggggcacagtcactactgttagttccatcgtaggggcaggggaatcgaggttgcagaagtgagaggaactgcttgcagccatagccaatgggactcagacccacctactcattcatttattgacgaggtggcactgaacgccttcggtatgaggatggactctgctagatgctgggacgcagcagtgaacaacaccgacatcgttcctgccttcgctgagctgccctttgggtgggctccagaacattccaagagcctccctcacaggccccacaggaagccaggccaggatcattctgttctcctcagaattctgagaccagagtggaggagcccagtttgtgagcagaattgaagcactgctgtggattttacttcttacctgagctgccttgggcaacagacccagcctttgagccttccaacaagacagtgaattccttggcaaggagagtcctgacttaatttttctgtctctgctacagtgcctagcacagggtcgggcacagagtaggcactctgtaagtgcttattaatggattgctgctcagaggcagaactaggcctccttccatctacccaactttctattcttctatttgtctaatatctatcaatttccttccttcttctattcatccatccatccacctacccacctatccacctgtccatctgtccatccgtgcattttcctaccttgcttcctccctccttccttctctccccgtccctcccctgttctccttgggcaatgaagaattagtccagcctccaggtttttgctcctgctgtggctactccgaaggctccttccccaggatgttaacattttcctggctcttagcaatttgcaaagagcttgggagactgaacaaacaaacaaaaatccagattctctcaaccacttattttctttttttttttcttttctttttcttttcttttttttttttttttttttttgagacagagtcttgctctgtcatccaggttggagtgcagtagcgtgatcttggcttactgcaacctccacctcctgggctcaagcaattctcctgtctcagccccccatgtagctgggactacaggcatgagccaccatgtccagttactttttgtattttttgtagagatggggtttcgaggctggtctcaaactcctgatctcaagtgatcctcctacctcggcctccctgactgctgagattacaggcatgagccaccgcacccagccttcatccactttttgaggcactccgaattcctactagatttcttatctttcctgacaacccagtagcaatcctatgcttacttttaaaactcttttttctggtttcctgcatagtgtgctctctctcctcccctctactgccagtttgggattgaaaactcaaccaggccagagcagtgactcacccctgtaatcccagcactttgggaggccaaggcaggaggattgcttgagcccaggagtttgagaccagtctggggaacatagtgagatcctgtcactactaaaaattaaaaacgtagccggatgtggtggcacacacctgtggtcccagctactgtagaatataataaattcgtcttcaaaggttttagcctgtaaattgttaagtacaatgagttctgagatcctcttcaaagaaccaatgtatcagtatgttcagctcccctgttctttgttcttcattttaaagtttaactttctcgttctttacgtctccttgcccctagtttcagcaaccaatcttctcctagcctctatcacctgctctgaccttagtcatctttggccacctggtctgttcttagtcatcctgggtcacctgctctgttcttaatcatcccgagtcacctgttctgtaaccatccttcccgccaaactactcaccctgccactccagcttgtacctctgcctctttaaaatagccaatcggaattaccttagactgtgcagtccaaccctagccaataggggaaagacacagcagcaggaactagctgcgttgggatgagaatcccttcccctcccttgtctggtgtgctctccccattgctccatctgcgagatgcacccttctatagaagtacaattgccttgctgagaaaattaaatttatgtttgagtgctgtttcttttgcggcactgaaaacttatttctaatattactcaggaggctgaggtgggaggattgcttgaacccaggagattgaggctgcagtgagctatgattgcatcactgcattccagccttggtgacagaacaagggcctgtctcaaacaaaaagaaaagaaaacctaaccagctactgcagctaggcaggaagtgcaaatgaccaaagcaggctggatatcgaactccaggaaggagtgcatgggccacctctcaagtgggcggccactaccagctccaagagggaatagatgtggcccagagtggtctaattttccagtttctcagtagaaacaaacaagtgaaagtctaggggttcttttggtgaactcttcccaatttgttaatgtgggtaactaattaaaatatgtaaatgcagttcagttcaaacaatacatgcttacaggatagagctgcctctcttctctttacaacccctctggtcactggccccctctttccctccctaccctgcaaattgccacaagagagctcaactccaagaagagcttattgctttgaatacaaacaaaatactgctcataatagctgctacccaaaactgaacatccaagtactcaagtcacctctattgttatcattgttttacaaatgaagaaagcaaaaggctcagagaagttaaggaacttgcctaaggtcacacagctaagtgacaaactgaatttgagcccagggctgtgtgactccaaagacagtgatctagcccagtggtggtggcattttgccacaggaggcattttggaaatgttagggaggacaggtgtttctggttatcatggtgatactggcattcagtgagtgggacccagggataagagacgtcttgcaatgcacagtcctgtgtcgtgaagtcttgtcttgttcccaatgctaatagtaccacggttttccctcttcccccacaatggcagccattattgagtgcctagtgtatgccagggactttagatccagcagtccaataaggtaggtacttttagtatctccattttacagatgggaaaactgcagttcaaagaggggaggtgacttaacaaaggtcacatgaactgggaaatggcagcagggctgagtccagggtgaaaaaaattaagggtgtgaaatttaaggcattgccaaataactcagtaagcaagataaatactactttaatgtaacatttaaaaaatcaaacttaatgtaaaaccccccatgatgaacaaaatatctatattttcaataaagacaggatcagcaacactggtgtgctaagccatatgggagtgaaagggaaaaggaaaaaattaatactgatcttgttttgtttcgtttttttgagacagagtcttgctttgtcgcccaggctggagtgcagtggcactagctcggctcatggcaggcaacctctgcctcccgggttgaagtgattctcctgcctcagcctcccgaatagctgggatcacaggcatgggccactatgcccagctaatttttttttgttttgtctttttagtacagacagggtttcaccgtgttggccaggctgatctctaactcctgacttcaggtgatccgcccgcctcggcctcccagagtgctgggattacaggattacaggcgtgagccactgtgcctggcctgatcttggatttttgtgcccaaggtgagtgcttcgcttaactcactttagtcttgtccctgagtggcaggccatgctaattgtatctgtctctgtctcaccagcctcaataagatgtggggagtccattcttccactcccagtgctccaggacttcagcacgaatggtgaaattacaggctccagaaagccatgatttctaaagcagaagacggacaggcctttaattagagccaggcgggtgggtggccagctaatactaagttccataatactaagttccgtaataagcactgtatttttgaattcactggcttgatcacacacatcccggaggcatctttggaaatttgttcatagaaaatagggtaaacagctatttgtaccctaagagagggaaaatggctttacagtggggtggctatgacaagggtgtgctctggtggcagcagatctgggacaaaccccaccccaccactcactggcagtgtggggctgagcaagtcacggccctctctgagcctctgctttctcatgtgtaatgggaatgagaacacctaccttgctggtgatggggaagattaggattaatggacagtagagtcatatcctcatgggtttggttccaacgataaccagtaagatgaatatctatcacctacttttgaaaatccctacctttatattgtgaggacctgaaaactggaagctcagaagccaggaaatgatgcattttatcccagatgtggcctctctgtttgaggcaggaaggtaaccagctaatgcagagggtagggtgggggtggttagggaaaggccaacaggtgaaggagaaaaataaaagaatttttctttgtctctcttccttctcaagtctcatacattagatgcccaggtgtgaaactctgttctagctaaaattctctggcatatagaagagctcattctggttcaggttttccaaggaacaatcagcaggggttccagaccacacaaatggcctgtttctggctgtaatcacacgtgggagctggctaatgtccccggagtcaggctggagtggccaagacaatcaccgtggatttagccaggggctgctgccttgggaatctttatttgtgcttgtgttgcctcctctgcttccaaggataattaccagggaggtgcacaaattggaggcaaagacaagccactcgtagtgtgcaaaggaccctgatcgtgacagtgcaagtaaacaaaccattaggaatgcaaagattgacagataacaaacaagatccgtgggcaggtgtggtggctcacagctggtaatcccagcactttgggaggccgaggtgggcggattgcctgaggtcaggagttcaagacctgtgtggccaacatggtgaaaccctgtctctactgaaaatacagaaattagctgggtgtggtggtgggtgcctgtaatctcagctacttgggaggctgaggcaggggaattgcttgaaccagggaggtggaggttgcagtgagccgagatcgcaccactgcactccagcctgagtgacagagcgagactctgtctcaaacaaacaaacaaacaaacaaaaaacaagatcttctgagcaggagccactgttagctggaggttggatccagtgattctcagcagggtggcactacccataaggacatgccctgaaaatgtgcgagggtgtcacaaggatgggagaggatgccacaggcatgaagtgagcagaggctgaggacaccaggcgacctgtaatgcacgagacagccctgctcatggataaccttctcttgtcctgctcaatgttggagtgtcccagtggatactcaggtaggtgaacaacaacttgtttaaattaattttagactgtaacttcattttatatataaacccgccaaatatgttttgccaatgttttaatctaccctgaattttccagaaatggcaacgcctggtgaagcaagggaagaactggactttcttctgttcagaactttaccaggagttattcatcgtattggaaaagtcatgcagctgatgtcagtgctgcttgggatatcagagctgccagcacacctgtacctctgtttttgtcacggtcacactcatggtgcttctatgtatagtggaagcatctgacaacctcatggtgttttctggtgttgttgtcctgaccaggcatttgcatactgaaacacacacaagtttaatacaaacgtccttgtaattattcgttctaaagttagggaatgatattgatttttttgaagttacatatatagtatattatctgtgaatttcattttagaatacgaagtggtgggagaagttaacaaaatatttgttatttataaaggggacttgggctctgggagtggaaaactgtgaccctggaaggtgcacgtgtttatacgtctcacccatgcaaggtggccttccttggctgtcttctacctccctgattaggctccaactctctgctcatattttcagagcgtctgcactttttttctttgcggcacttatcagaaccaaagtgcacatgcaccaccctgagagcgagctcctccttcaattttgcatcctgggcacctcactcttccaccctcttctgggtcctgcgaactagcttcagctatttgtagaattagctgtaatgcccatctccccaaccaagctgggcgctccagtgcggggatcgtgcttgctgcatttattgctatatctgccgtgcttagcgcagtgcctggtgtgttttagtcactgattgaatgagtgaagggctgtatatttcatatacatcataggcaaataaaaatgaataaattttaaatttatggcaaggctaaaagatgatcagccctgggtcagcacagagagggtctgcgaaagcaagtaagacctagtcttcctccgtctggcagcggggagagacagatgcaaagctgaggcaagggagacagggaccctcccactgcttgggagaaacacgtctacgttagctgggggcaggtgagggaagacttcctgcaggaaacaccacttgagtcttgtggggagaagagtttgccaagcagccaccgaccacatggtccagctcattattttacagatggggaaactgagactggtggggaaactgagaatggttctaggcccggctctgccaccgtcccgctgtacgaccttggccaagtctttcttcttcagtcttcccatctgtacaatgagatgacctctagggtcagcctcaccttctgggacagaagtctcaaactggcagctcctgggctgaattctcctgctcctggctgttacctgccagagaccaggaggtgtttgagctgagacctgtgtgaaggttaccaactttgtaaattagatgccacctaaaagcggtgattcttgatcaggggcggttttaccccccaggggacatttggcaatgtctggagacatttttgattgtcacactgggtgggggttgtgtgtggggtcgctactggcctctaatgagtatacgccagggatgctgctgaacaatcacaggacggccccacagcagagaactctccagccccaaatgtcaccagtgcggaggctgagaagccccgcctaaaagtccagtccttctgggccactctggctcctgggaaggccccaggaccccgtggtctttgtacttggtgactgatctccagccttcctgccgctgtctggagctgtcctctgactgcaccgtcaccatgctttctccccactaggccctggctccctctagcctccgctttccagggcagggcctgcctctccagctcacattttgactatactgggtcaaacctgatagcaccctggacataggcgcctgtctgttaagactcctgttttccacaattgcagacagatgcacagagagtgtcactagcttgatcaaagtcgcacagcaaagggagtgttggggctgggatttgagcccagataccttgaccccccccgcccccagcccatttactgcaattttttaaatttttttttttatttttttttgagacggagtctcgctctgtcgcccaggctggagggcagtggcgcgatctcggctcactgcaagctccgcctcctgggttcacgccattctcctgcctcagcctctggagtagctgggactacaggcgcccgccaccacgcctggctaattttttgtattttttagtagagacggggtttcaccatgttagccagatggtctcgatctgctgacctcatgatccgcccgccttggcctcccaaagtgctgggattacaggcgtgagccaccacgcccggcctccctgcagttttgtttctgaaaattgacttcctttgggtctgggttttctatgcctcctctcctcaacattcattgccttcctggtttgaactgagccacaaagttacattggaaatggaaacagaaggtgtctttgagaccgtctcccagggtgatgtgctgcggtctcagaaggactctctgacaatgtcacacgagggaggatgggagaatggtatgaatggtgggaactgaggtggcagccacaacacaatggtgggaaaaacaggctccgcactgggttccagcattggagcttcatgctagacccaggacaaattccttcaccgctccaagccttgctttccccatctgcagtgggagacagtgagacttccttaatcgtggaactgtgaatatttaatgggaacgcggatgtggagggctggcccagggcttgttcaatgaggggacctggggtggccactagctcctgggcctgtggaggcaggggatgctctggtggattccagaagatgacagtgggctctcctctctggagggtggacgaaggcaagcgcctctctgactgccttgctttatccttggagaattctccccagtgcccctctgtccactctcatgccacagttatcaccccaagcctttaaccagcagtcccctgggtgctgagtacgtaaccaagaggggagtcctgagccgccattcagcccttctctggcttggacacactccacgttgcatgtccattcggttgcatgtcctgagtgctttctgtgtgccaggcactgtgctgggctctgggagtcactgtccccaagacagcagaggagccaacaaacagatgaaatggcagggagggagttagtgggcgatggagagagtgccaatgggagggaggcagagggttaagaaagcccctctgaggatgcctgctaagcagaggtctgaggccaagcactgtggggaagaggatacagcgtgtgcaaaggccctgagataggaacggtcgtgtttgggcaccagaaaggaggccagtgtggccggtgtggaagaagcaaaggaaagagtggccagagatgataatggagaggcaggcgggtggcagatcgggcagagctttgaaggccggggtgaggaacttgcaatttattttaaggacctagaggaagaggaggctctgggccctgggtggatgagctgccttacttcttggaagcaccagggctcatgggagaacctgaccgtcactcaacccccgaaacctggctggcttgtatgcagcctgtccccgcatcaggaggggccaagcgacacctcgctgcacacagcagcctcattcctgcctccctacctttgctcagacaggatcccctgcctggggtggcctctcctctccctgatttgcccactcttcctcaggaaaccttccctggcagctagagcctatggggccctcctcctcccaaccactctcctggtgttgaaatccactggggtagtttgctgtcaatgaagatcccagggtcttccacagagataatgattcaggtgatctgtgctaggacccaggagttcacatctttacaaacacttccacgtgattcctctgtccggcattggagagacatagctgctggcatgtttccagagctacttcaggcaacagggcacgcagtatgtgtgagggggagaagcagggggctcagtggaatcagaaggccctgggttcacatctcagctttaacacttacccagctgggcgactgtgggctaatcaggcagagctttgaaggccagggtgaggagcttccaccacctcttagagcctcagtttctttctttttttttttttggagacagagtcttgttctgtcacccaagctggagtgcagtggtgtgagcttggctcactgcaacctccacctcctgggttcacaccattctcctgcctcagcctcctgaatagctgggattacaagtgcctgccaccatgcctggctaatttttgtgtttttagtagagatggggtttcactatgttcgccaggctggtctggaactcctgacctcaggtgatccacctgccttggcctgccaaagtgctgggattataggcgtgagccaccgtgcctggctgagtctcagtttcttcatttataaggtggggacagtcacactgacctcagagtattgtgaaagggatgacaaatataatgtgcctaacccaagaggttgcccacagttggtgcttaatagatgcagcctggggcccactccacacttgcttccctaagggcctgaataaggcaatgctctctaaaccagggctcagcaaactttgtctgtaaaagggtcagagagtaaatattttaggctttgggggccgcatgatctctgtcacaacccttaaactctgcagggcagcacagacgcggccacagataaacagaaatgagtttgtgagttatggctctgttccaaaaaccctgatggtcctaaaatttaaattttatatggttttcacatgtcacgaaacaatatttttctttggatgtttttcagccacttgaaaatgtaaaaactgttcttagcttgagggctgtaccaaaacagggggtgggctagatgtggcccacaggccctggattgctggcccccgctccagaggctttacatgtcttagctcataggaccctgatgagataggcagccctatgttcagatgaagaaacggagtctcagagagactggaatcctcgggcaaggttccacagcagaaatagtagatattttagtctttgtgcaccatttggtctctgttgcaagagataactgtgagatttgaactcaggcagagctgggctcagagcccctgttattaaccacagtacactgtctcgtggaagccacacaggccacagatacaccacatttcagaaccagtgaccttatctcttaaaaccagaatctctgccttcatatgagcctaggtgggaaaggctgggctggtcaggcaggaaagacagtcttttgagcttagagggtggagggggcttctagggccattggccacctgagctgcagccccgggcacgctttgcagtcccctttcctgcgctgaccctatctggtaggggtgagcctgcctgagtaattaggtctgactgctgcaggcccgctgaggacttcacgctcccaacattctcctccgtcttattcatgtttggtatttttattacattattttgacatgacattccctaagtgacattcagctaaactgtgtttttgtagaatagggacttgccactctctcggcactgctgcattcatgatgacagccacatgtctgacatctcccccagggtgcaattacatgttgacaaaagaaaactctgaaaaaatttagtgtggaaggaaaaagctcaagctgccttaattaataagttaattaattttcattcatttgtactgttggcgatatagtggtgaacatgatagtcaagattccttaccacaatgaagcttactttctagtaggggagtcagacaataaacaaataaacaaggtaatagcagattgtgataagtgctatgaaggaaaaaaaatactgagatgggatattaagtggggcagaatatgtccctgttatccaacctctccttttcttagtgttatagatccactgatgtgcattgggaaacatactgcccagaatagagactgtttcccagcctcccttacagctaggcatggccaatggatatggtagaagtgagcagatgcctggggccttacgtgtccacaggcatagaagcgtgcgcctggcacttgctctttccctcttccaccagctagaaattctctctctcatacctctcttatctctcttttcctactctatctatctatctgtctacttatgcaccatctatatgttcagtaatctgtccatttgttcatctgttatctatccatccatccatccatccatccatccatccatccatccatccattcggcaagcatttatggagagcctgtggcagattctggggatgcaaaaactaaataaactcaatctatcccctcaagaagcccagagccccttcagcagagtaagcacctaagttgctttatgaaacataacagaaatcatagagttcaaattccactctgccactttgctcatatgacctcaagatagtgactttttacccctttgaaccttaactttctcatgaatacaatggagatgataatctctgcctctgaagattcgatgagatcagaaaggtagagcactttttagagagcctggcacacagcaggcattcaaaatactcttcttattagtctacgtgggaactggggaagtttcttggaggcttctgggcttgacataaaaggatgaaaagaatttggatgtgtgagattggaagaggagaaagggaattctgggcagagggtacggtaagagcaaaggcaaaggggcagggaaatttagggttcatcgaggagccagtgagagaggtgtgcctccctgagcatttccctccctgagcattctcctggcagcaggttccagagactgaaaaggacagggacagggtggggtgggggtgattgacaggctcagaggggtgaggacctgcagtccaagtgacccaaatagccacgggcagagagaactgggttatgtgcattaatctccaccccgggcaggctcccctccaccctctatctgggctctcgggccttgctgggtgggaggaagattgttttgacacttggatgtcgcttgggcttctcaaacttaacaaggccaaagagctcttgatcccccactacctgctctgtactatgttttgccttttttggcaaatggtgcctccatcctcccagatcttcaggctgtgacccaagagccctcctcgactcctttctgttcatcggcaaatcccatgggttccaccttcaaagtagtctgagcacttctcctgcctccccgatcatcaccctgggccaggcccctgatgtatcctaccaggactgttacagtggcctcctcactgctgtccctgtgctgtccctatgtcctccctcacccccgcagtctgttttccaatcagaacactctttttaaagcatgcattgatcctgccactgccctcctcaaaagcccccagtggagtcccagtgcacctggaatgaaagccagcgcctcacacagccttcaagaccctgtctgatctggccccggctacctctctccactcacatccaccagctgagctaaacctgctgcagccactggccctgctgctcctccaatatcccagactgggtccagcctcagggcctttgcacttacagttcctgccaggaatgctcctctcctagatctctgcaggtctttcttatctttcagcgttcagctcatccgttatccccagagggacctccctggccaccctagccactttatcctcatctattatctcatgaccctctttcagggttttggaagcactcatcatttccttcttgacttggtaattgtctcattcactagaatgaagtttccctgagaggacaggaactatgtctgtcttgatccctgtgcaacactagctgcctgttacacagtaggtactcagtaaatgtttgctggatgaatgaatacacaataccttccctagtggggatgttgaagcgacctctcataactagaaacacactcaacgggagcattttcgagacatctgagtggtgtggcccctgaagatcatgggagctaccacacccactgtacagatgtggaagctgaggtccagaaggaaagggaaggaacggggccccaggcacatagccctgccagagcagaaccaaggctgggacccagatcttctgcccctcagcctctcaggcaggcactggttcccagtccttgcctcatggaatcttcctgaaagcccccgaagtttgcagatctgccctacttcagccgctcatcttcccctgctccacgtggagagctcttctagatgggttggtttctggaaagcccacaaggaaggagggaaatgcagcctttcccctctggcgcctgtttcccttggtaactgtggggtatgggctgtgggcaggtgtgggtgtggagaggagagatctccagggtaggggtttgtgctgcctccagggccacagccaagggtggcccagccccagatgcccctaccagcctctttcctgcatcctgccagaccctggctgccgggagctctcattatgccattggcagccacatgaccctccctcgacctcacgaagattctggatgggagttcaggccatattcaggcagggtcaggccacagttcacagctcagtgtggtcatgtagctttggaatggcttcttctctctgtgagcctcagtctccccatgagtaagatggagcaaaacccaatgacattgcagggaaataaaaaggaaaatcttcttgctaccacaagaaatatcagcaaccacagtttgagcacctgctgcatgcacttgcctaagtactttaattgtagctttcaagccttctggactggggaccagagtaataaatatagttctaaaaaaaaaacccggcgagtacacataccctgaaataaacgctccacccacaagacgtatccccatgatgataatgtactctgatactttctgttcttgggttttcagtggtggttgtgatcccttagattgattttatgaccatcagtttgaaaagcactgtgttaactcatttaaacctcacaaaaccctataagagaagaactattaatatccccattttatagatgaggaagcagcttcagaggttgcgtcactctccccagtaagtgatggagctcagaggccaccgcagtgctcatatccttaagcatggtgcatggctgcccctttaagtgctggacctgggtaagaggggccccctcctgccacagggcagatggaaacctttcctcgatcctctggcaacttcccttccttggctccgggcaactcctcttttggttttcctaagcaagatgtcaggttagtaaaacagatcccagagtttaattaaaataatgagtggtattagaggaaggatgccagggccagccagagggagaaaatgagttacggttttgttcatggagaggggcggagggagagcacgagcagagggagaaagtctgtctgactctagaaaggcaataatgtttcgatgtggttttgctctcactcttgtctcctctgactcctccttccagagaatcccaaggatctttctataagatctaatcttgtcgctcctctgctttagagtcttctatggctccccagtgccttcagaataaatccacacttctcactgaggtttgaaggccctacgggatctgagtcctactaacggcacccctattgccatgcagctccctgcttcccacaccattccgatcccagaggtctcacatgggctgtgttctctccctactcctcttgcctgggctaactccagctcttccttgaaggcctgtttaaatgtcacttggggcatagagctgaacccaaatgataatacatgcttcctgtgctcatggttcagaggggagacagacaacacatacataaacgcataaaaggatagatcagccgggcacagtggctcacacctgtaatcccagcacattgggaggccaaggcaggaggattgtttgaggccataagttcaagaccagcctggggaacatagtgagacccccatttctaaaaacaaaacaaaacaaaacaaaacacacttaggtgtggtggcacacaccggtagtcctagctacttggcaggctgagacaggaggatcacttgggcccagaagtttgaggttgcagtgagctatgattgtgtcactgcactccagcctgggcaacacagtgagacgctgtctctactaaaaaacaagacagatcatttaagacagggatcagcaccaggtggaaaggcaaaggactaagctttttgaggaccatctgcccggcaccgttcagaatggcttgtgtgtatttacctgttgaatcttgctccggtctgagaggtggaagctctatcacctccacctcatgaggggatgagctggaaagtaggttgctcacagcttctcctgggttccacttgagcagcctggctttggaactcaagctgttaaccatcgcccttcacggtggctccaaacattgaggggatgggacaggctgggtaggtggtgggagaaagaaggtggggatgcaacttgatattcagtggcctgagaaggtgacctgtgagctgaacagtgggtctggccatgtaaggacagggggaagaataagggaagcagcagacgccttgagaatataaatacggcaaagagcccaaggtggctgaagtggtggtcccgcgagttcccatccacctgaaatgtgattggcccaggccagcgtgggtattgggagaggccatagctaagtccactgaaggaagctattggggtggtgcagggggtgggggctgtgatgctgtgagccccagccttgtgacagagcccacggctctttcctctctgtaggtgatgctggcaaaaggcctaggggatccagctggggagggactgccagtcttcccagcaaccaaaatttgggggaggaccacgcctatctcttggaatatcatgttttttcgcttatcgtattggaggcttcattcattcattccctcccatctcaccaaatctcacctgtcccccaaagtcctctctaacctcatctcctactacccttctctcacatggtcccatgcagccacagtggccttcttgctgttctcccatagattgagctcatttctaccccaggcctttgcactatagctccctctgcctggaatgctcttcccccactctgggactgccctcctcattcaagcctcagctcccaggaaggggttggtgtgggcaaaagggagtgccattccttgcagacctcacaatccctaaggatctttattttattttattattgttattttaaaggcaggatctcactccatcacccaggctggagtgcagtagcacaatcatagctcactgcagcctcgaactgctgggctcaagggaacctcccgcctcagcctcctgagtagatgtaactatgggcaggacccaggcgcctggcttctaaggatcttaaacaagagttttcatgatataggtataagattattcactgcagcattgtttattcgatcaaaaagtttggaaacaacctcaatgtccatcaacagggaaaaattaactcaacagagggtcatttatatgcagctgtaaatatgaacactatgcagctgtaaaaagaacagagatggctcaatatgcataaatagggaacagtccccgaggtatgctgttagcaagcaaagcaccgcgagaacagaatgtataacaaactcccatttcaataaaacaaggaaaaaagaatatgtacatatatgcattcacttatatatggatatgttatttgtggaagcgatcacaggaaattggtaacagtggctgcccctggggaggaggacggggtggctgggggacagggtgggagagaacttttcactgtgtgcccttttgaacactttgactttcatactagggaaatatagtagctattcagaaaactgacattccagtatttttagaattttgaccttatctctaaatgggttaggtacacaaacagggacagaatgataacaacgaaaaaagactgcattcctcaaacaacactacccctgcatcccttactgaaccactcctagagaatgccatgggtttaaaatacgaatatataaacaaatcgaataaatcctggggttatcttgtgagttatgtgagttacacatttatattatgttgtgattttatgcaggttgtcacgatttgctcaatgttacatcttaaatgtactgcaactttagggatgtcttcattttgttgttgttttctttataaattaatattccaggagtctcaaaaaaatagaagtcttccaggcttctctccgctggagggaccctgtcccaattctccttagggagtgaaagagacaagggaggcccgagaacagggacagtaaacccgagttctcaggaggaacagcagcccacagtcccaatttaggtgctcccaggggatggggacaggctgaccaaggcacagaggcagggccaggcctacccctggggatgtagatctgctgaacatgggcaagagaaaattcccaccctgtgaagctggtcttgctgcggactggaggggaatgtctgtggtttttaagctgtctcctctggaaacagcatctcacagcgccgagctaggagtgctacccagttctgaacaattccagagcccaggctttttagccactaaatcaaagtgagagatgttgacttagtgtagccatggcctgatctgaatcgacgttaaagtttcccaacagcccatgagatggtagaaaggatgaaatgatactattaataatgtacacacgcttaactcattcatgaccatccccctgcgctggcttcaaaccctgtgtccagcctgtatctcacttgattctcccagccaccctaggaggtagcagtgttggtttcattattcccactttacagacaagaaagctgaggttccgagtggggaaggaacttgtctaaggtcacagagctaaggagtgtcatgcatagagtaaaagtctccaatccagagctccctctgattcaccacctggggaagccaggggtgggcctagctcggtgcctcagtgcccacggcatggatgggagaggcccctcatcaccaggcaggcagagtgcagggcagaggcggatgactctagtctagactgtcctgctgaggctggtgatgggggaggctcgctgagccaccagctacagggagtctcagaatatctaccacatcagcaagaccttccagatctgcctgcaggaggcacctggaacatgcccacctctcaccacccccagagatctgccctgggccaggccacatcctcttctacctgaatgattgtagttgcctcctcactgtctttctgcttccatcctggcccgtacaataaaacacagtccattctccagattcatccatacggatcctgttagaacctaagccagaccagggcacttttctttgctcaaaacacctccctatctcccagcatactgaggacaacagccaaagtccttagaacagcccacaaggctctgcagggcctggcccctccgtatctctctggcctgatcccctttactcctccccttgctcactcccctccagccatgctggcctcccctctgttcctggagcacaacaggcatggtctggcctcagggcctttgcacttgctgtgccctctgcctagaacactccagccccatatataggcctgtttcctttctttgtgtctttcaggtctctgcttaaatctcacatccccagaatggctctccctgaccactctatttcaaatggcacccacaccccatgaataccagtccccttactcctgacattttgcatatatgcagtgatattatatatttgtctcttatttctttagtgttctccttttgcttctagaatgcaagctttaagagccacaggtctttgttctttttcttgattgtattgttgtgtccttcatgcctagcaaggggctggcatacagtagacacaaattaaagaacaaacaaatgagttccaggtctccaggcagactcctcaggactccgggacaacagagagtcctctgaaatgtctcatgaatctctctctccatgaaaggcaaacccagcattacaccatgggttgggcagtttatggccacatgtccaggtggctgtagcaacaatactcattagtcagtgtatttttgtggttgaaggcaaggtacactctgtttcctcaaggtagtcaaacaaacaccatgagaactatgtggagcttgaaggaaactgtgagctccaaactttcctgccagaaaaggaaaccaaggctaagagaagtaaaataccttgcccaatgtctctcaccactaagaggaaaagtcagccctcaaactctggtcttctcaccatgaagccaagaaaagatcctcagaggacactggcactggtgatttgttgttaagacaaccatgcagataagcacagccctgctgatcagggcctgagaaaaacaaggattctaggtcttccaaacaacaaaggtggccagtcatgcagcaccatgagttcagggtgaggttacaactcattgtcaatgtgttcctggaagacatccagagagctctggacattttctcctaaaagctttggtgagaggagagggaagacgtgtttggaaacattctctggactccattaaagcagatgttctcgggacccaggccaccatgtgcatgatgtcctgctgactcacctgtgggtctccccagttcggagaaaacacgtggccaaggctgggcaagaaggtctggatttcctgcacagcccttcaaggaggtggggggtagggacactggcctgaggacagagaacagacaagctggggaaccacttcacatttggcctgctaggccacgtgacatttggccgaaaccaactttggccaatgtgaagttctaagaaatatcttgttctgggatgagcacttatggtgtaacagtcctgcagagcattttcttccaaaaccttctggcctactgacatgccatggacttgccaaccatgtgagtctcaaaacataatccccacattctctgccattcctccatcaagagacaaggcttttgtctcttccctttgagtttgggctctgcaactgcttgttcagtagaatatggcagaaatgacccagtgccagtttcaggacccagaccttgagaaactggtatctttcacttcctgctcattggtatgatcactcttggaaccagatgcctcctgtgaggaaactcaagccacctcatggaggggaactgtcagacagcaacatctttccagccctgcgagcaagtgagccccagttgagccgccccggtggaggctgtgtgcagagcagaaatgaaccaggcctgtccatcctggcccacactgcagattcacgagcaaataaatgttttgttttaagccactaagttttggagggtggtgtgttatgtggctgtagagaaatagaacatcttcccaactgggaaggaatttcctgggccctgcaggaacccaatccagatgtaggattttaataataacagagaggcctggggttattttaaggaagaccaataaatcaggtcaggaaacatcatctgctgacttccctctggcactccctagccttgtcaatgagaatagctgagaacagtctaggagtcttccctatttgagatagaatcctctgctaatcaaacacacctcgggatcctctatggccagggtggaggtggcaaaagtggagaacaaatgttttcccttaattcaggatcttatatatttttcacagaatgtggaattacctggtggctatcgtcctacttggactatcaaaggaaataaggccgctctataggcaagcatcagaaacctctccttctattcctttcctgttttatttattgtgtggggctgccatggagatggagctgggaagagacaggggaagttcagcctacaaaatctttgtgaagctgggtgcagtggcgcatgcctgtagtcccagctattcgggaggctgaggtgggaggggtgcttgagctcaggagatcaagtgtgctgtgagctctggttgcaccactgcactccagcctgggtaagagaatgagaccccatctctttttttttttttttttgagatggagtctcaccatgttgctcgggctggagtgcagtggtgcgatctcagctcactgcaacctctgcctcccaggttcaagtgattctcttgcctcagcctcccgagtagctgggattacaggtgcatgacaccatgcctggctaatttttgtattttcagtagagatggggttttaccgtgttcgtcaggctagtctcaaactcttgacttcaaatgatccgcccaccttggcctcccaaagtactgggattacaggtgtgagccaccgcgcccagcctgagatcccctctcttaaaaaaaaactgtgaatgcctctttttgttggagtagggtttggactggttctttgcttgcttttcatcaaagtgggtttgtcatgtgattttaaaagtctctaaaactctgcctgccaaagtatccatctgtcttattttatgttagctagaacaccccaaggggccaggatggcaggacaagctccaaggggtgatgtgggcaatagcagtcaatgtctgctctacacttgatggtgcacaagagcttttattctcatgatcttggaatatcctttcaggaatccagtgaaggtgactggacaaaaactatggtatgcctgtacaaaggaatactactcagcaataaaatggagtgagctactgatgcatgccacaccatggacggacctcaaaaccatgatactgagtgaaggcagccagatgcaaaaggccacacactgtatgatgccatttacgtgaaatgtcccaaagagacaaatccatagagaaagaaagcagcttggtggttgcctgggcctgggtgaaaggggtgtggggagtgaatgcaaattggcatggggtttcttttggaaatgttctgaaattggattgtagtgatggctgcacaatgctgtaaatttactaaaaattattgaattgcacacttaaaatgaatgaattttatggtataaagttccataaggctgtttaaaattttttatggtataaagctatttaaaaaaaaaaaaagaacagaggggagtcagagggaggggacaaggggtggagggtggagttgttagagcttcatggggcataggagataaatggatatgtactggctggaaaggatagaagctgtgattttcttagtcacctaactggggaaatcccagaacaggaggcctctgagttcctactagctgacaagtgataaaagctgagagtaataatgacaagtgctaacactgattaagtgccaggcacatgccaggcaactatacagagcatgttacaggtatgaacccatctgctcctccaagaagccctttgaagtggtattgggagataattctccatgggtctctccaaggtctgcatgtcttcagctcaaaagacactgagacctttgttctagactatcatctcaaggacatctgtgtagcaaacacacttggaggacagagacaatatctctctctggagcagaaagaagaggatagagttgtttcccaaccagtacaataatgtctctatctgaggcaaaggctagacaggtttggcaatagcccctttataagattgcaggtttcctaagctctgggatcctccattgagacacagatctgctgctgtgtgtgcagaatccatttgggttgttttcattgctctcatggaacttgggagacaattagaactgacgcaaatatgaagcttgtgctgcttgctatactgtgactaataaagtcctttgtctctgacctgggatctcgtgtcttctgccgtcatgtatggcattgtggcaggctaactcattagcttgtgagcagtgcaaaatctcggacccttcgtagttcttccgtcatactcacatcacccctgttttacagatgaggactttgaggcccagagaattgaagcttcttgttcaagatcacacagctaacaagtaacaaagctaggactgttacccagaccgattgggaaaggaaggagagatgagtaggggattggagaagagaaccgctggaaatgacaggagctgaaggccccaaaggtacacagaaggtcatgcctctcagcttcccaaacccacacacccccagatgctgcctgtccctacatccggctgctggggctgagcagccaatttgggacgaccgtgatatatttaacggtgagtcatgctctcccccagcaatcagcagtggcaggctcgggaggatgcagggagcatctctggaaatccgtgcctgagggtcgccatgacaacgccatctgagtcgcttgccagcagctgggatgccagtgcctgaaccaaggcacaaaatagtctcacaggctgagtgcggccgaggacaggagcaggccccctgcacggcatccccaatgggtttgccagggattgatgggagggatgtgaggacttggtgacaagggagattcatgggctcactgtccaggtcacagtactctatggaagcctggggtccctggctggtgggaatgagcacacttggcgtgatgggtattttggtgagcaccatctcttcctgccttggttcttcttggtttgtctgtctcatagttgctctcccagaggccctgcccaatttgaggcttctatccaagtgtcacaacctctgaagactgacagcaacttgggaaggtaaccaagatcatcttccaggataattctgaagacttcagaacctagggcgaatcagccacacccacacactaacaccaaatacgaatatcccatgaaagcagcttggaatccattcattcattcataaatccattcatcaccttgtcctctcagttgttcattttaattagaacctgggtcctacaggccctatgtagaagtggatttggttatcccgtcctcatcccctttcactccccctctcttattctactctagctcactagtcttactgctgttcctcaaacatacagttgcttttctgcctcagagcctttgcacttgctcctccatctgcctggaaagctcttcccccagaagggaagctctccctttaggtttctgctcatatgtcaccttctcagagacacactaccaagaccaccctaggagaaagcacctaattcagcctcagtgataaggccaaatatatatatatatatatattatgtataatatgacatatatctgtgacttagtttcccccatccgtacgaagcaaagagagacaagctgaaaattggtggcctgtaagttgaatctaactcacagacctgttttgtttggtttacatagtgtttcaagaactgagcaagttgctaacagttataaagttgagagattttgttttagaatgcaaattttcaatttatctcgaaaaactaaggttgggtgtggtggctcatgcctgtaatcctagcactctgagaggctgaggagggtggatcacttgagcccaaggagtttgagaccagcctggccaacaggacaaaacctcgtctctacaaaaaatacaaaaattagctgtgtgtgggggcatgtacctgtagtcccagctacttggaaggctgaggtgggaggatcacttgaggctgggaggttgaagctgcagtgagccatgatcatgctactgcactccatcctgggagacagagtgagaccctgtctcaaaaaaaaaaaaaaaaaaaaaagaaaagaaaagaaaacaaagaaaaatattaagctgtgcattctgcatctgtaaaagcaactggctgaggcatgagcattccagtgccaaaggccctatgtggacctcttcattcatttatgtggccatgttctacctatgggagtctttgggcttgcagcccaagtctctaatccgaggtctctaagggtctttggtttgggatggaaagagtgtggcatagtggttaagagtcaggccgatggggctgcaatcctcactcacttcagtgttcacagcttcagtttcctcacatgtagtatggaatctcagagagttaatgtgcgaactgaacaaaacaatgtacctggaaaaatgcttaacacagagcctaggaaatagaacacaataagtggaaacttaaaaaagagctttttctggcctttaatgacagtccattccttgatctgactcactaggtctcttcgatcagaaatttgggagacaaggaagggctgttttgctgcaattcacttgatgtcaaagcaggaaagacctcggacaaagcttcaagtctaaccttttttgttctcgggtgagtaaaccaagaccagaggatgagtcttgcccagaagagtttctaaccattcttcccccaggtatttgtttcccggtgaaatttgcttaaagttggaattggctgagtgtgggccagagctatgggcattgttgtgaacacttgcttttaactgcccagtatctacttgctctttatctgtaacagctccctgatttttccctggcaccatccctcttctgatccccaggaaatggctccaggtatgggcatgtggttcatgaccacagtggttggctcagagatggccatatgatgcaatccaggccaatgcatgtcaaccacagagctcttaggaactactggtacccactggagctgctgggctggttagatacaagcctggggctgctgagagccatttttgctatgacttggggagctgcctgcgaggatgccaacacaaaggaaaaaaggtccaggtgatggaggaaaacagaaaccttagaacataatttgagcaacttgattcagctgagcctgaaggcgtgtacccctgggcttttcagttacataagccaatcagtcccttctgccttcctctttttttgctacgatcagttagaatcaagattctggattcatccaggcatggtaggtgaaggtgttgggtaagcaaaggcccagaagcaggaaaatgcagaacaagttctgggatttccaatgaataacctgcagtgggaagaggccagtaaactcacttaaagccagaacctggggagctttgaatgccttgctaagtcactttgactttatcctaagggtaacagggagccatgggaaaggacctgccagagttggcaatggtgtggggcagtgggagtgaggattattctggatattaagtctggttcagggttctcctgggatccaactccagcccagagtgcatgcagtggtgagagagggtgtcttccctcagcacccgcagcttccagtccctcctgactgtcttataataacagtgttttcaatgcagaccttctgggttccctgccgcgaatcactcagccacccttccagggagaaaacaaaaagcagtgtttttccgtgtctattttaggctgctgcctacatctttgttcttcgtgaggaacacacactcccggggggcccttttctcagctgtggcccagcagtcgggtctggaccaccaggctgggttccgttatgggaaagaaccagcagatgtaatggaatcatgccaattaggccaggagctgcgtggggatgatgttatcattaagttccagaagacgtggaggtgagggggaaggtagctcattcccgtccacatggctatcccagacggactgccttttttgatctgtccccttcgactatcctgagcagctaggaagagcccacccttgctatcccctgagggacagaatttagaagtctgcattgtatgagacacttgtgctcattttactgttgggctgaaagcagaagtagaaattctatggcaaatgggtggatccagcccacccattttacagatggtaaaactgaggcctgaagaggaagcatagtttgttcaggtttatagaacatttggtggcaatctatgaccaaaaagaccagaacataaaatctcagagggcatgtaccttatctgtcttggtcaacatcgtgtcccatcacaaaacatagtacatggcaaataataggcccttgatatacattggatgaatgaacaacatctctactgctgttttcagctttcacaaagaattctctcacacattccctcatttcaacgtcatgattgtctttgtagccaagaattgcttttgtccttattttgcaggtgaggaaatggaagttaagagaggcttagttgcctatccgagatcacacagcctaggtagagactgaatttgaatccatgtcatcttgatgcaggctggggcatcacttaaattttggtagaggaagagaccttggaaatgtccagctgggaggtaaaagccttggtctacaaggacaactctgactttaattatactacaacatttggagtgaggggaacaagaaagcaggtcctcaaaaatgttcaaaagagttaccatatgacctagcaagtccacttctaggtatacatccaagagaattgaaaacctatgtctgtgcaaaaaattatacattcatagcagctttattcataataaccaaaaagtagagacaccccaaatgttcatcaactgatgaaagataaataaaatgtggcctatccatacaataaagtagtattcatccataaaaaggaacaaaaacggatacaagctgcactgtgggcgagccttgaaaacattttgctaagtgaaagaagttagtcacaaaaggccccatattgtatgattccatttatgagaaatgtccagaataggtacacctaacgagacagaaagtatagattactggttgccaggagatgaggggaggaaggaatggggggtgactgttaatgggtacagggtttctttttggggtgattagaatgttctaaaattagatgtgatgatggcttcacaactttttgaatatgctaaaaactattgaattatacattttaaatgggtgaattttatggcatttgaattataccccaatcaaacccttaaaaaaaataccaagaggagcatttccatggcaagggagttttagaagggggaacatacaaatgaggaagggtccccagcatggacagctccatgctgtcttcttggatgtcccaggaagaatttcaagaaagtatttcaacccccagctccaaggattcacctgagggcttgttcctatggagttgagaatctgtaggatacctcctccaggtaactctcccagatatcccaaccacagacaagaaaatgaactcatgataactgggcaccactcagtgccctggtgctctgcttgtgatatctcactgaagccatgcaacaaccttgctgaatgtgaggtagtaccatcacccttgttatccaggtgaagaaatggaagctcacagagataaaatgacttgtctggggtcacacagcttttggctctctcagctacatcatagtgcgtgggacacacccagagtaaggcctgaggccactttccgagggaacccaagcaagttccttgacactgtgggccttagtttccccatctgttccattaaatcccagcttactccttcattgtcctggtgggggcttcagccagagcatcaccacctgcctctgatataatggtgcttcacatttcatcagatttcatgtgaacaaagccaaacatcttttctcagtgcctcacctgcccagggatcctagtccacatctatgctgtttttctccactctgtccttccagtgcttggcacgctgtgccacttctcaaaaaaccctgatgttgcctgccattgggttcaaggcagatgatgtgatttcacaggctttcttcttcagcactaaataaggtgcttttgtggggcccttcctttacttctgatgctttaggttcaactttggagtttgtagacttgcagagaattttccatcaaagcgtacaggcagagatgcaaacacacacccttttatatctccatccatccatccattcattcacccatcaatccatttactcatccatccatccatccatccatccatccatcatccatccatccactcatccacccatccatttatccatccatccatccactcatctacacatccaattgcccatccatccacctactaatccatccattcatccactcattcatccatccactcatgcatccattaaatcatatattcatctactcatctatctacccattcatttattttcccatttcctttattcattcattaattcaataaatatttaccaaaagccgactatatgccaggcaccatgttggccaatggatacagtggaagaaaagacaaaatgaggttcttctcctcatggagctcacagtccactgaaggaagataggcctcaatagacacacaaaatgtaagcataaattgggatgaatgctaccaaaacaaagtccagaatgataaagatgcctaatttccattgggagatggaggaggcttttctgagaaagttgacatttaagatgagatctgaagtatgatttatgatttatcagttaggaatgctcttggtttaagaagtagaaaatgctaaccaaaagaggctccagcagttagggttatgatcccacataaccaaaagtcctgaaatagggttaccccatcactgagggacttgacaacatagttaaatatccagactctctaccatctactctaccaccctcagaggactggcttcattcccaggctggcttacttcatggacacaagatagctgcctctgctctggccatcaggtgaagacatgcccacattcatactcagaccatcacgagcaaaaggaatggggccaccatgattgtctcagatcagctgtttgcaactggccctgattttgcaccccaggggacgtttagaaacattttcagtggcataattatgtgtgtgttttgggggcattgctactggcatcttgtgggtagaggccagggatgttgctaggcatcctacagtgcacagtacagaccccatgagagataattattcagatgtcaatagtgcctgctttagaccagttagaacaaaatcctgagtcatggggcacacagtagaaaggcgtaggggaattgcttaagaaagctttcctggatgatgtaacagctcaactgagtcttgaaagatggacactggttaataaatccaggtaataaccagctggccacgtggatgagcaaaaacgcagcccttccctcttttctgcctcttctagtcgatgtgagccccatatggtcagggacctcacctgacccattcacttctccatccccattcccatttgatgcccattaccatagttgttcaacacattgttgtcaaagaatgagggactaaaatggggagaaaccctctctggaggctgaagccccaactttgaaaattcctgggagtcacacagagtgaatgttgggggcaatgactctggaataagtataggaggatatcagtcaacatgaggaaaccccaagaaaacatttggttcagtcctatcattgtacagatggggagactaagacacacaaaaggggagaaaatggttcaaggtcactcagaaagggggtcagacacagccagaacccatgtgcccctttcttaacccgtgatcaacagcagctggtggatcctgaacaattgtttagagactcacggtccagctgaacacagttccgagttcctgaatttgggcgtttcccacctcttatctccttagaaagctttcttcctggattcacttaccttgggaccccagaaggatgctgagtggggccaccttctgtgagtgtgtactctgctcagatggcaaaatggctaccaaactgcccaacccaaatggccggttcatggacacgttttgtttggtccatgtttgtttaattcttaaaaaaaaattattatttgcattctttgccaacaataaaaataattgggacagtgtgccttaatccaaatttcccacttctcttcggtaatcagaaggtttgacagcattgtgcccatttttctgcatggcagctatttacaggagttgggcagtggctgctccttttgtcaggatacaagtgccccatttcatcccagtgccctcctggctatatcactcttgtacagggctgcctggccccagcccagctgatgggacacaggcgtgagtagtgaggccatgcagggaccacaagcaggacactctccctctctcttggaaggaagcaccttggttaccatagcaacatgctgctgtttgtaacacatcttccacctgaaaaggagaggagatgacaagtacatctctcttctcagcccaggcaacatcagctcctggcaccccccaaaacctaagagcgagaagggggagtgtgatctgtcttctccaatctgggccccaaatgcagatgccccaaacacccccatttgttcaaccaacccagagatgaggcgttgggaggggttgatttagattccatcttatataaaaagaccagaacatttttgattagtgatggaggaaggtgtgggagtctgagacagtgctttgtttctgggcaaatgtacacattccctgatgcctctcttctctccacgtcctctaaagtagaagcatagactccctctccttactactcctcacagccaaattcccctcagccaggaccccagacctttcccaatacccaggagcccctagggcagcaggcctgtttctaggctacctacagaacctgaaggaaataagggaatgaaataagagaatcagccagaaataaggcagggcaccgtgcggtattttcctttgaaactaagaggctgagagctggaacagcagcagaaatcagaagaaatctcattgagaaaagaggcacagagaggagtgccaattagcacccaggtcccctcctgggagtgtcaatccataaatattaataaccgtaatcatccagtattagttataatgccttgtaaattaaggtcattttccgtggagtaaatagctgcgttaatggcagcaaaaggtaacggcgttgctggctgcatgccagttgatgcctgccaggatgacagtataaatcaggaaggacacgtccaatctgtgaagacaggcagtggcatgggggcaggtggagtgacggggcagagtgtggccgcagacacacatcccacgcaaggcccttgggccgatctgatctaacagggacctgctttagacaggtgatgtctggggcagatgaagctcccagggtcactaggtgtaggtaggaggggagagaaggggccgggtgggtagggagagggtgtctcagagggaggtggcaccaagacttcagacacttgggttaagagcagagggccacgctttgagctgctgcctgtggcatttcactgcagaccttggcgcctttgctaagcgacacagacattctcttcttcctctacctcctttccctcctctccatcttccttctcttcctctcctctcctcctgccagggctgacttctccattaggcccaatagacacagcctggggttcacactacctctagggccccttctccaatgttttaatttcttttataattagaagaaaaaaagaactttcagcaggaagaaaatgttgtaatactgtatgtgatattaatatattcatctttataccaatgtagccataatatagcatgtttgtttttttttcatggagagaggcctaagtgcccgggggccacaaaattcatcacatggccctactttctgctccccacccctcctcccactaaccacggggccctaagcaattagcattgccttatggagtctcggtttcatcctttgcaaatgggctaataatggtgatgccttcccaagcaggatgaagtaaaataatattagaaaaagctttggccacaaagtggtgtttgcctccttttcaggaggctctgggatcctgggagttaggcgggtgatgtatttgaaaatctcagtggatggagtccctggtaatgctccctatgggctccccaagctaaatgcaccgtcagacccttctctcgggtctgacccatcatcttcctgggctccctggtttctctaaagagcaaatgcttttcttgaccctctgagaaaactcacaaggcacttgagtatactagatggatcaaataatgcctttaaattccaacggaaagaaagcagccattatgacgggctccagcaaggggagggagttgggggcctccttgttcctttactgctgggactggacacactggggtttgcaatacccagtgcagatgaaaatgtggggacccttgttcaaaaactatggatttcatgacagtgacagcagagcctctaacaaagtgtggggcccttctgagaggggcgtctggtactactgcactggttgcacacccgtgacaaagcctgttgttagcttgcagctgggaggacgggtgtggcagtggccggggaggggacagcagtgatgatgatgctgtttgatttcccccaactccaccttcacctagtacagtgcctggcatgttgtaggtgcctaagaagttctagttcattctctcattcccctaacacagggcccaccatggcagatgaggcctgtccccaccagggtggaagctggatcactgggcccggcttggcacctggtaacgatccctctccagggggctgtgccctggatcctctctctcctccctcctccaccttcccccagaaagagtgatcctttattttactcctggcctatggtttttgtgttggcagaagtggaggtgcttatggccagcatagcctccaaactaaacactgcagaagtattgagtattattattatttttattatctaaatttgcaaactctgccccctcctattactcagctccttccttttcttctttacttttcttcactgcccttgtcccctcctgatattatagtgcatatctatctgcttgtgtgctatctgtctcccagaccgaagggtggactccacgaggacagggactttgtcttattcactctggaaccccagagttagcacagggctcagcacatcaaagacactcaataggtatttgtagaatgtacacacaaatcttggaaaggtgggcagggatgctgtgtgtcctggggccaggaagccacctctctgagtctccctttcctcacctgtaaaaaagaggtaacagcagctcttgcaaaggctgaggagcagatgaaaggaggccacaccctgcaaaggcactgtgagctggtgagggagtgcagcgatatcacagttcctagagcccggcctgcaaatctggccacagctgccagtcaacagcccaggctcggctaaggtgccataacttggtgcccaccttggattttcacacccagctggctactggccaccagatggcatagaaggttagtccaaccacctggcctgacctgggaggctgcccagcctcagagagcatccttcctagcgatcacctgggctctagacctcagcctggtcctggcctggagggcggtggagggggctcagccattcagactgctgtgtggactctcacctgacagcatgtcattcaatccactctgtcaagaaatactatgataacaatcagggaaatgcaagccaaaatcacagtgaaataccacttcacacccactaggatggctagaataaaaaagacagaacaagtgctggcaaggatgtagagggactggaaccctcatatatagctggaggaaatgtaaaatggcaaaatcactttggaaaacagtctgggagttcctctaaaggttaaacatagaattaccatatgatccagcaattccacttctaggtacataccaagagaaagaaaaacatatgtccacataaaaatttgtgcacaaatgttcatagcagcattattcatgatagcccaaagtggaaacaactcaaatgtccatcagctgatgaatggataaacaaaatgtggtatatccacataatggaagcttattcagccataaaaaggaatgaagtactgacgcatgctgcaacatggatataaaatcttgaaaacattatgctgagcaaaagaagccagacacaaaaggtcacttattgtgtgatttcatttacatgaagtgtccagaatagggcaatgtagagagataacaattaggttagtggctgcccagggctgggatggaggtggggagagatggagagtgactactaaggggtaggagtttcttcttgggatgataaaaatgttccgaaattgattatgatgatggttgcaccactctgtgtatgtactaaaaaccatcgaattgtacactttaatgggggtaaattgtagctttaatttaatgggtaaattgtacatctcaataatatctcaataaagctgttatatgtatatgtgtgtatggatttgaataaaatgcatttgtaaggcatctaatatgagccaagtgaagagcacaaaatctctgcttgctcaggaagctaaccatgaagagacagaggaacagatacaagtgcaatttgactcgaaatatgaaaagcgcaatttgactttaagaaaaataaagcgggctgggttagggttggccaggactggagttgctttagatggaggagaggcactgtggtccaaggaagacacactgaggaggtagcttttgaacagagacttgaatgaagagattgggtggggtggggcacagaaattgggtggaagagtatttgcaacaggagaaatagcaagtgcaaaggccctggggtgggagcactgagccagaggaagctaagaggtaaggagggagaactgatgggggctggaccctggagggccagggaggttctgccgagacccatggcttggttctgagtgaagtgggagccgtggagggctttgagcagaagagggacatgctctgacttaggtttgcaccaaatctctctggctgtgagtggagaatggactgtggggtggatgtgggcaggatggaagctgggagaccagtgactaggctactgaaatagaccaggtgagagacgaagggggctcggccagggggtggaggcggaggtgtgaagtggtcagatgctagttgtggactagcaattctatccatggaacctccacttgcagggatttttattgccatttaacttgacccagatgtcagctgagatcaaaagcttcctacctgatgaacagtctttgaatgcctcccaatcgccaaggtcaatcacagcccctccccagaacgctataaatgccggggtccttgcttcttctgtcccttgggttcaaatgtcctgaatccatctggatgctgtctcagcctctgccaccgatttccatgagaaactcaacccatcaaacatgttatcattctggcagacttaacagaagagtcaatagtagtaaacaccttgtaagattcttctccaggttagatgagttaatgtatgtaaaagcacttagaacagtgcctggcacatggttggcactcaatgaatgttcactcctattatttatttattttcattttagattcagggggtacatgtgcaggtttgttacacgggtatattttgtgatgcggaggtttgggcttctaacgatcccatcacccaagcagtgaacgtggtacccaacaggtagtttttcaatccttttccccctctccctcccctccttccccttttctggacttcccagtgcttatcgttcccatctttgtgtccgtatgtacccaatgttcagctctcacttataagtgagaacatgtggtatttgggtttccgtttctgcattaatacacttgggataatggcctccagctgcatccatgttgctgcaaaggatgtaatctcgttcttttttatggctgcagattgttattcttttagagacaggatctcgctctgtcacccaggctggagtgcagtggtgcgatcatagctcacggcagccttgaactcctgagcccaatccatcctcccgcctcagcctcctgagtagctgggactacaggaacgcaccaccacaccagactaatttttaagtttttgtttgtttgtttgtttttgtttttttttagagacagagtcttgtgatattgcccaggctggtcttgaactcctggcttcaagtaatcctcccgcttcagtctcccaaagtgctgggcttacaggtgagagccaccgtgccccgtcctggcttctgttattatcacgtggctagcgtaaggggtgttgggtaggtagctccctttctgggaaacattggccccatccacccacatccgatggggctctcccatttcaacaggtcttaagaagccatctcctcaacaaaagtgggcccctgggaggaattctcctgacagccactaaaacagtatgcttgacctgcatctcataacgcatccaggaggaaatgaaagcacagacagctggagaaccaggcccaaggtcacaaaacttaggtgtagcagagctgagaattcaatgtgcatttgatgctaagccaggtgataaaagaaggaaagccagttttattgagtgcatgttatattccaggcatctttgtatgcactgtgcttttatttatttatttatttattttatttaatttattttttgaggcacagtctcactctgtcacctgggctggagtgcagtggcgtgatctcggctccctgcaacctccacctcccaggttcaagtgattctcgtgcctcagcctcccaagtagctaggattacaggcatgtgccaccacacccagctaatttttgtatttttagtagagacgggggtttcaccatgctggccaggctggtcttgaactctcagcctctggtgattggctcgccttggtgtctcaaagggctgggattacaagcgtgagccactgtgctcagcctgcattgagtttttaaaaatttcactttttatataaattatattaattttgaagggcagtacctgcacacagtttgaaaatcaaaaaggtacaaaagggtacacagttaaaaagggggatcttcctcccgcccctgtcccctgtcaaccagctctctgcctcagaagtgactactattttgtttcttagggatctttccagtgacggactaggaatggcagaacctactagttgcccacccagtatccagcctccacctcctccttgctaacagaaccccaattttgctcacaggtggccatatgcccagataaaaacactcacattcctgactcccttgcagttagcagcagccatgtgacctggtctgtacagcgagatgtaggtggaagtccctgggcagggaatttcttttcactccctcaaaagtcaaagtgcccggaaaagaagacttttgtgtttttgttttgcttttgccctttgcccttaaaaaaaatttcttgcctgggtgagactccatctcaattaaaaatatatatatatattctgcctggaatgtggacttgatacctggaggtggaggagcagccaccttgagaccgtaaggatcagagacacgtactcagaatggggaaaggaaagaacgatgcttgagtccttcagcagctgcaccagtgctgcgctgcccggctctggacttactgtgtttgctcaagccatcgtctgttggatttttctcatccttgcagctacatgccttcttaactgaaaccgtgcctaaataagcatttgtatttatctatgttctttcttccccacaaaaacggtagcatatactccacctacccttcaggatcttacgtcttcacttaacaatatatcttgaaggttgttacaaataggtacacacagagctgccctgaacttttaaatgaatgtgtctaagaccttgtacagatgctccctagagtgttccaccaagtccctcttggtgtgggtcgttctcaacttcttgctatcacagataatactgcagagacaaaacagggacattgttcatatcccacatgtgagggtttgtcttcagaagaattgctgaatgcaagggcagatgctttttcagtgttcttagattttgtcaaatttccctgcaaagaagtctggctgacgtgcattccaccagcaatgtgggagtgtacccacacgttgtctctaatcctttcaacaacaaactagatggtgtccattttgctgaggctcagagaattgtacatggcctgcccaaagtcatcacaggcaactggtgagatggggatttgtaccagggtctgtctgatgtcaaagctgtgcttgtaaacacatgacattgcttttcaggcagcctggattccagagactctcagaaaagagggaagaacgaatctgacccaggcgctggtctgtacctgagaagagcctttgggctgggctgtggggaggcccgtgtttgtcctgggccgcgtcccagctcaggtctgtcatggccttgctgtgtgagcaagtcctgccccttaccctctctctgggcctcagtctttccacctgtcaaatggatggcttggagttgctggttcctaaaatcctttaatgttaggcttcttgaaaatccccaagtctgagggtatcttgggagctgcttttcagacctcaaaatggaaacagcgatttttcctctattcctgaccgagcagaggtcagcagcgtcaggggcatctacttctatctgtggactgaggtcacattccctgggggaggctgggccatggtggggcagcagtccgctgccctgttttctctgtagggtacatcttctcccagctctgacagccagattctgaggacaaatattccagttatggtttcagatactgagtattttccaaagtgatttacatatctaatctggaagagaggggctactcttatccccattttacagataaggaaacaggggcacagagagatcgatcaacttgtctgaggtcattcggccagtaagcggcagccaggatttggccccaggaagtctggtgcaagaatctgtgcccttcaccgagcatttctcaacctcgacctattggcgttttgggttggctcactcaggtagggggctgccttgtgcattctgggatgttcagcagcatctctggcctccacccactagatgccccctgggtatgacaaccaaaatgacccagacattgtcaagcgtcccctggaggtcaaaatcacctccagctgagaactatcttaacacagctctggagatgtggattctaggcccatctggggactcttgggtttttttttttttttttttttgagacagagtcttgctctgctgcctgggctggagggcagtggtgcgatctcagctcactgcaacctccacctcctgggttcaaacaattctcgtgtctcagcctcctgagtagctgagattacaggcatgtaccaccatgcctggctaatgtttttattttttgtagagacggggttttgccacgttggccaggctggtcttgaactcctcggttcaagtgatctacccactttggcctcccaaatgctgggcttacagatgtgagctaccgcacccagctgattcttaacccttctgagcctgcttcaggctctggaaagacactgacaaaggcctagagaagaaccttgcaagagggcaatgccctgtgcaggcgatagaagcgtcgcagggcagccttctctgaggctggcgatgggacaactcagcgaggggcattggcgggcagcaaagaaaaagcttgggtggtggaatgggcttggaggttggctgagtgaccttaggcaagtgctgagattctctgaccttaggcaagtgctttagattctctgagatgcagtcttctcagccaaaatcagagttaacccttgtagagttgaggtgtgatacttaaataaagtattgtcatgatgggtgaagaaaaacaaaaccaaaaactatatccacgaagagtctagttaaataatgtatggtacatctaagccatgaaagattatgcagccattaaaatgaatgaggtaaatctagtttttgctgatatggaaagatctctaaggcttatttatttatttattttttgagatggagtctcgctctgttgcccaggctggaatgaagtggcgcaatctcagcccactgcaacctctgcctcccgggttcaagtgattctcctgcctcagcctcccaagtagctgagactacaggcgcacgccaccatgcctggctaatttttgtatttttagtagagatgggtttcaccatgttggccaggatggtttcaatctcttgacttcgtgatccatccatcttggcctcccaaagtgctgggattacaggtgtaagccaccgcgcccggtggcttattcatttattaatagttaaaaagtaaggtacccaacagtatatatgacataatcccattggtattagaaataaaaataatctttctacatagccttattgagcacctactgcttgccaggaactggagtaagcaggaggaatacagtgtggataaaacaaaactcctatttccatggaggttggtgcaaaagcaattgcatcaacctaatataaagacgtgcaagaaaatggcttcttctgagcctggagatgtgggagtgagatttctgtctttccattgtatgccctctggtatttgaattagtcttactgttgaatgcatttatttatttatttatttagatggagttttgctctgttgcccaggctggagtgcagtggcacgatctcggctcactgtaacctctgcctcccgggttcaagctattctcccagcctcccgagtagctgggattacaggtgtgcgccacctggctaatttttttgtatttttagtagagacagggtttcatcatgttggccaggctggtctcaaactcctgacctcaaatgatccacccacctcagcttcccaaagtgctgggactacaggtgtgagtcactgtggccggctgaatgcatttattttaatgatcagtttttaaaagactggattaaaaaaatgagagagaaagcaacgagcagtgtttggctcaatgcaaatggttgcttttattattatcatagtaataaaacatttattaactgtctcttgagcacctactgtgtgccaggtactttgctaggtgctgaagatacgtagtgagcaagaaagataaaaatattggtcctcaggagcaggtgctctaggtggggggacacaggaatcagagaagtaactgcaaatgtcattagtgttacaacagttggggattatgatggcatcggaacctaacagaggggaggcttgcaggtctagggagttgcccagggatcggagcctgggctccagccctctatcctcaagcctgggcagttcacaaggttggacccctccatggcttcagagcaaacaaaaacagctaaaattgatggaatacatacagccaacaggcacactgtaaatactttacatgtattaacttacttagaatccttactacaaccctatggatactatttttatgctcattctagagatgagaaagtcaaggcacagagagattgagtaacttgctgaaggccacacagctagtaggtggcggaaccagaattcaaacccaggtattctgctacagatgccatacttataactacttcctttcatgactttcttctcctcttccctgcttatcagagccagtcctctgtctccctgtcctccccagacatgaggatgaccctctctggccccagctgcagcagaacatgcaaggattggaggacactctccaatcttcccctgtcccaggggctcctaaagtgtcctggttttgcccttggagcccaagtagaagaggggacgagggggagcaggagccagccaggtatacgctggtcccccgtctgcctgtccttcaggcataagaatctgggttactcctagagcccaagtgtccagattgattctaactccagcccctgaatgagccacaaactgagtcctaacccgggtcacactgaatcttgaccctggccgcacattccttcataaccctggtcctaggctaagccttgaccctggtcacacactgatccttaaccctagttgcatactgatccctgactctgatcacagactaactcctagtgtgatctatgacccaggtcatgtactgacctcagtctcagactgaaccctgatccttgtcaaggataagccctgaccctcatcacacactgagtcctgaccctgctcactggttgagctctgacgcaggacacagactgagctttgaccctggagagacactgagtcctggcactcctcactgactgatccctgatcctggccatagagtcaaccataatctggtcctagggtgaaccataatctttgtcacatattgatctctaaccctagtcatacactgagttcagccctggcctcagatgcccagccatctccaattgctgctgtctactgcccagggattcagagactcccagaatgccctcttcccacctttccccagagcttaaagtgattccactggcctgtgcagaggtcacccagcctgtcatccccggggcccatctgggggacctacagggctctaaaaaagacagggaaggcatgatttagacagagctaaattctcgagatgctgcttttcatctagaggctcccaaactcttcctatttctctctgtctcgtctcttcccccattcacacacatatttctcctgaaacaaaattcatcagcaaattctgtctttaagaagggaggtcagacagcagccagcccagcagctgggcagaattctattatcaggaggaaatgcagccagcaggaaggactgtgccctccctcccggcaaagtgttactcactctccccagcttggcttccttctgaagggctgtggagttcctgacaggtggaggtggtggacgtctgctgatgttgaccagggagcccgtgctcccaccggtggctggctgccccagacctggcccctgttctgggaatctgccccagtgtctgagcaacacaggggtgaagagtttgaaatggttccccaaggtgctttccaggattgcagggcctgggtagggccttacatattgggagagtccttgtggcctctttggggaaggatgtttcccccttaagacccctgaaaacaggggtgcaggatggatgaggaacacagggctcaccctccacccccatctccaggcagtgcaaacatgtgaaacatgaacacatgggcaggcgttgaggtttccactcagttccccctccctgctctggcagggaaaggacttttgctcctctgggccagggagccctggagggaggggagaggcatggttgctgaggctgggtgggggcttccagatgggtgtcacccatgcccttccgaccatctaggacagcctgggagttgtgtctagttaggagagtcaagagtcaagtatccagtgagctggtcattcggataccgaggtgggaaacaggtgatcagcctgacagtcatcttgtcagttagacgtagagacaggcagatgggcaggccgtcactcagccatttgatcaggcctgcagtcagacaagcaggctgacagacagacggtcagtcagtcagaggaggagatgaacagacaggcttcttcatctgttagtcagatacaatagatacccagcagacagacaggcagacagacagacatagacagacagacagacagacaggctgtccatcagccatcttgtcagtcagctatagagacagctagtcagtcagtcagacaggagatggacagctagtcttagttactcatctaattacagccagccaaacacccaggaagacagacagacagacactccaacaggcatttgaatgaggagatggagagaaaggcaatttgttttgcatctaattagtcaggtacaagagccgcagccaggtagacagggagagagtctctctgtctcagagagggacattcagtcagacatggaggcaggcaggcaggcaggcaggcaggcaggcacagccattcatccagtcagtcagctatcctgtctgtcaggctctcagacttgcggtggacaagtcagtcagtcagtgtccgtcagaaccaacctaccttctggccagtgatgcagctggccattatgacagacatccaggctgggcagagacaaacactggatgctatgaggaatgttaagaaatgggggtcctaagctcacagaataaccgggggtcccaacacccctctcaagagcctgatacagcccctcaacaatcagggaaagcattctggaagaggagggaagaggcaccccactccaagagccatccctcatctccctctgaagtgcctggcctccctctacaggccacaggcctagagaaggagctgtgtgtgtgtgtgtgtgtgcgtgtgtgtgtgtgtgtgtgtgtctcagctctgccaagttctcctcgcctccctcctccactggagtgggggttgggcggccctcccaggccacttcccattttgggaattgggctgagaactatgcaagagacagaaataattcctttttcgagcctggccagggctgtagcagcccaaacattggcacaaaaccagtgctggggaggggcccaggagggggcagccaggggtgggacggagccctggggcccagggacacaaaggcctgggtgtctccagaagaacctcctcatccagtcccagggctgggtacaggtacctggaagattcgagactcttagtggagctgccaggccagaaaatgttcgggattggggaggggaccaggttacagaaagaacaagaaagaagtcatagagtctccactggtaaagacaacttgaaaaatggaccatttctggtggccaagaagggatccctgctctctcctgagaacacatcccccgctatgggcagacccactgagcactcacataagagatggtggcctgggaagcacctagcacacagtaggtgcacactaaatgcaagtgtccttggaccagaatcgtacacaactagcttcgcagccctttggcactgcttcctagggtgtgaccctaggcaagtgacctcagctctctcagcctcacatttcccctctgtaaactgggagtaatggcaaaacccgcttcccggggtggctacgaggattaaatgacatgacaggtacagaaaatctagcacctagtaggtctgtgatctatttgagtccttcctcctttctttccttctttctcaaagcattattttcatctcactggggtcttacagcaatcagccaaggcagatcttgatcgtcattttccaagtgacaccctcctgaaatcagcccgtctcttagcctcagtgtcccccttgtgtaaaatgatagctcgggacaggagatgtctggaaagccctttcagagcctcagcgctagagtcgctggtgatcctcaatgcttgattgcatcattcccagcatgcaggggcccttcccaaccactccgtggggatccctgtggttctgaggaagctgaccctgccccctgccccagggataagccagtcagcacatggcatcccccagctagagagcttgctgagtggggcatgtgattcaagctaagccaatttattgacttctgagctttggccaggaatgctgggagttcccttctcttctggataacgtagagtgcatgtgtgacgcctagaaatgctgcagcctttgggactcccatgaggggagccagcccaagagaaaaattggctcacagaggaggacaaagcagagtaaatccttgacacaatgatgacatcatgatcccctccctacccttgctacacactgcctgggcttttcagttgcactatccaataaatgccctttattgtccatgccagtttcatttgactttcagtttcctgcacccaaatacaccccaaaagacccaaatacaccccaacagtctagacttattgccagttttaatcctcaatgtgactcttctacatagatactattgttcttcccattttagagatgaggaaactgaggctcagagagtgaagtgacttgtctgaaatctcacagccagaaactgtcagtgctgggatttgaacctggaaatgccttatgctcttctcaccatgttataagaccttctcttttctcatctatctctgggcaagtgggagggagtaaaacagtaacagccaccaccaaactccagtaataatcatcccagggaagaccaatcacataacatcaaagcctggaagacgcttagagatcattcagcacaaccctccatttcacaaatgaggagactgaggaccagagcggggaagagacacaggcagcaggaggcagattgggagccagagcctgggacagcaagaggacattgttcctgcaagggcagaggagtcacctgctgctcatacctggaggaagagggggcttctttttagcaacaaaccatctcaccctttgggggaactatcccttcccagctctcaagccacgtggcttgtagcctggcctcacctctggctccaggtctggccaatcagaacggtgcattcccctggcaacaacgattggcagagtctgggcatgtgaccccaatcaagccaatcagagtgaaccctgggacttgtcatgggactaccggaaagagaagctccagcattctaatggagctccgccttcagcacaggtaaggacaggctccaggctcagagctgccagttcgagtttaataacctagtttatttttgtggtattcatttttaaccctgtgttcaatttaaggtgattaactccatacagtttgccagaaccatctaggttttaaaactgaaagttcacaggtgaatggaggcaagggtggttggtcacccctgcttcaacttatgggtatcagatactggttttccattaatggcagcttccttttaaaataaacatttgaatttaaaaaggggccggacgcagtggctcacgcctgtaatcccagcactttgggaggccgaggcgggcagatcatttgaggccaggggtttgagaccagcctggccaacatggcgaaaccccatctctactaaaaatacaaaaattagccgggcgtggtggtgcacgcctgtaatcccggctattcgggaagctgaggcaggagaatcgcttgaacctgggaggcggaggttgcagtgaaccaagatcgtgcaactgcagtccagcctgggcgacagagcaagactccgcatcaaaataataatagtaaaaataaaacaaaataattttaaaaatttaaaaagagagtcacttgagggaaaataccaagaaactaatagtacctttggtgaaaagaaatggcaaaaatattgtgaatactgtgtcatgtgagtgagtgatggtgttgagaaatgtacaatgcctgcaagtctggaaacccaagctcagttcctgggttggtggcccactggccgtttgactctaaacaggttgcttgccctctccgagcctccacatcatcccaagctcacaaggccaaccatcctcagaggtggggagaggtcagagggcaggcaggctctgttgtgggcaggcaggctctgttcacccttatcctcttaagggtgaggtcttaaggtatgagttgctcccagtgcaaaagctggcaccaacagcagcaactcacaaatctttggagaggcccggcattccccactcagtgactgctgagtttgactgatggggccatgtcggcaaattagccaccattcagcagagacaccctttagagatgctaattgcccagtgctcatgcgtccccacccctccctggcacaggcggctggctgtcgatcccctgccattattgtctgataacagtgcttgatttgtctacacagaccagggcccctgcatgcatgctgttagcatctaactaccagccagcacggcgcatgaagcacggttcattaatgctcttgaggggagcaaacaggtgctggcagaaatctattcccgtggacaaatctgtggacacgtgcaccctcatacgtgcccacttagcccccaagtataggaatgagtcagtgtcacgtgtgcatatgcattctgtgaactactcatacgccggctaagaagcagcctcagacacatacgcacaggatggagtacatgcatgtacataacaggcaatgctacatggggttgtgttaggattacattacagaacacctgtaaggcgtcttgaacagcgcccggcatgtggttaattactcctcagtaaattagatctcttattattttttcccagtgctcctttatttattgaggtataacttacacataataaaatgcacaagttttaagtgtttagtgcagtgccttttgataaatagatacacttgtgtacccaccaactcagttaaggtccagaatatttccatcatccaggaagttctctcgggttcccttccagtcaatacctccaaaagcaatcactgttctgatttctcttgttatagttgaattttgcttgttcttgagcctcatataaatggaatcatatggtgtgtccttcttggcaatgcctattgtggatgctcagatgtgtgcacagccactcacacttacacacatgtgcatggatactcagtcagactcattcagaaatggggatttctgagctgtaaatcccttggcctcagcttgcagttcagctaagcctctctgggttcagaggactaaaggagatggggagagcccctgatgctgggtccagccaccgtggggggctccttccacattttcttcagcttcccttactgagtgacctcagacaagaactgaaaatctgttttctcctgtgaaatgaaatgaataataataacatacagctcataactcccctgtattgagcacttattatgcagtaggcactgttctaaggactgcgcaagttcgagtccactctgtcctcccagcaaccctataatccaggtatcatcattacctgtcttatgggaaaggaacctgaggcacagagaggcccagcagcttgtctgaggtcacacaggaaggggcagagctgcgatttggacccggtccagctccagagccttcacctgccaccattatccctctttatgaagggattatgagaattattgattatgtccatgccttggaacccagtaggtgctaaataagtattgcataagattactaccaagaacatttacatccactatctcactgatgcctcagaacagccccattttacagatgaggaaactgaggctcagaagtcagtggcaaaagattctggtcttctggttctaaatcccacattctttctattcccccagctggggatattctattccacaaggcagatgctttgttttgtttgctgctatgtcctcagcacctagaagagtgcctggcacatacttgacactcaatacatgttttccaatgaatgagtacagcagggagttgggaggaatcacccagcccaatgccctcccgttacagctgggggacccaagacctatagagaggatgtgactcatccaaggtcacacagcatcttggtgccgttgaagctattgttttctcccttgcctggctcacctcctctacccttgggcctgagcaagccaaaagatttgggagcccctgaggctctctcaaaggccacgttaatggggagctggcatggagcctctcccaacttcattaagccatccaaggtcagcacggaagcctgccaagctaaccctcagaaaacgccggctgaaaggaaacaaggcttgccagagcttttgcgctgggatggggaccattcctggcaaacaaggtggggagggaggaccgggccagcctttcaaagcccttcgtgaacaaatgcttggactgcagcctgctctggtcattgtcccctccaagtcagcagaaacagccaaactcttcagtctagcagggaaaatggagaatggactggagtctgtgtgtgtggggacagtgccaatgagagcccaccctgaagatggaagggaaaaggcaggaagatggtgaagctaggtagggggagaccatcccatcctgagggtaactcttagttgccagtccccagcccttgggcatggaggtcagttttaaataacactgattggccgggcacggtggctcacgcctgtaatcccagcactttgggaagcaaaggccagcggatcacgaggtcaggagatcgagaccatcttggctaacatggcgaaaccccgtctctactaaaaatacaaaaaaattagccaggtgtggtggcgggcgcctgtagtcccagctgcttgggaggctgaagcaggagaatggcgagaacctgggaggcggagcttgcagtgagccaagactgcaccactgcactccagcctgggagacagcaagactccgtctcaaaaaaaaaaaaaaaaaaaaaaaaataacaccgatcacctcccttcatgtcagggcatccctaaaagcagagcctgagacagggattcttaggcacgtgattcattcttgctccacgtctcctttaggagatgggggagagagagaagcaggacaggatagggaaggagctaagccaggatgtagcctcagctgaggtctagcttcggcctgaattgcaccaggtgttgatcccaccttgcagaaagagggctgagcttttgtacccctgactcaatgagtccacagtctgcctggtgggaggacgggagagctgccacaggttaaaatcccctggcaggcgactcccatgggccaagggcaattgtgagaggcaggagtcgtgagaagggggcagtggtgaactgttagcagcggggaatgccagcagttggggtgtgggtgcaccagctcgtaaatggagtgtaggtgaggaactcacagtgtccaccacactggctgtcctcttttcttttaaatttaaaatgtgtgtattttttatttttgtgggtacttagtaggggtatctatggggtacatgaaatgttttgatccaggcatgcaatgcctcataatcgtatgatggaggacggggtatccatcccctgaaacatttacctttgtgttataaacaatccaattacactcttttagttattttaaaatgttgggtgtcctcttattgtattaattcatcactacctaaacctcccaaacttagggtcaacccttagaagaaaagggagactgaattgaaccaagatacagtttccaccaccctccatcacggccattgcatccagtgtacgaacaaaacaacagccctgctcacacatctaggctcacagcatgcaagctgtgcctattccagttgtaggactctagaaccttcaagacactgagggcagaacttcagaattgtagctttcaggctctctgagctaatgtacccacaaagggggcctccccaggggaagacagaatggggcctggctcgaggaccaggctgggcagatgaagttacaaggtgaggaaagacaaggtggcttgaccaggtctcacgggaggccccacgacagaccgtggagaggatggcgagacctgagattgtgagaaggtgtaggaaattaggtaccagtggagcagccttggggtaggtgaggacctggctgcagccctgaccccagctgcaaaacgacctggatgcttcggctctgagtagcgcttagagcagggccacacttcaacaccacccatgccaaactgaacccctttcacctgggtacagcactctacagtgagcaaacaatctaatagctcagcatctggaggtgggtgagttgggggctaaatttgacgcagggggaaactgaggcctagagaagtgcactaacttacttcactagcaaattctgatgaagcacctactctgtgccaggcactaattcaggtcctgagatacttcagtaaacaaaagagaaacccctgcccacatggagcacatattcaggtgggcgaggagggggttggggaaggaagtaattattgctgtggagaaaaagaatgaagcagggaagggagataagaaggcaggagggctgggcgcggtggctcacacctgtgatcccaacactttgggaggctgaggcaggcagatcacttgaggccaggagtttgagaccagcctggccaacatggcaaaaccccatctctactaaaagtacaaaaaaatcagccagaatgtggtggtgcttgcctgtaatcccagctactcgggaggctgaggcacgagaaaattgcttgaacccgggaggcggaggttgcagtgagccgagatggcaccactgcactccagcctgggcgacagagtgagacactgcctcaaaaaaaaaaaaaaggaaggctgggggtggaaactgccatttgaaaatagagggtcagggaaggtgtcacttcctaaagagaggatgcttgaataagaacttggaggtgagagaagtcgtgcagggaacagcgggaatagccgatgctaagctcccccaggtagatttgcaatgggagacggagagatgaggtcagagaggtcttgtaggggcaggtcctgcagggccatgaggactttgctgttacactgagtgatatgggagccactggaaggctttgagtgggaggtgacatgacctgacgtgggttctcacaggatccctctggctttcagggaagcgtgtgagtgtggatgcaggtgagcagcgagaaagtaactgtaatagtccaggtgagaaatgacagtggcttgctctaaagtagaatttttttttttttttttttttttttttttttttgtgagacagggtcttactctttcacccaggctggagcgtagtggtgcaatcatggattactgcagcctcaacctctggggcccaagtgatcctcccattttagcctctcaagtagctgggaccacaggcatgtgccaccatgcccggctaattttttgaaattattttttgtagagatggggtctcaatatgttacccaggctggtcttgaacccctgggctcaagtgatcctcctgcctcagcttcccaaagtgctgggattacaggcacaagccaccgtacctggtcctaaagtagagtttctcaacttcagcactatcatcatttgggctgaatgaatctttgttgtggggctgtcctgtgcactgtggatgtttagcggcatcccggcatctacccactaggtgccaatagtaccatcccacctggtatgataccaaaaatatctccagacaatgccaaatgctctctgaggggcaaaaatcaccccccgttgagaacttctggtctggagcaggagtcagccagctatggctcacgggccaaatgcaacctgccacctgcttgtacaacccgagagcaagctgagagcagatttcacatttttaaatggttccgttttaagtgattatgtaagtacctacagaatatcctcaattttgcctcttggcctgcaaacctcaaatatttactatctggccctttcaagaaaagcgtgccgactcttggtcaggagtgttcatgggggtgatgaaaaggggttggaggctgatacactttgaaagcagggccttgggatttatgcagaggtcccacacggagtgtgaacaaaggaggagtcatgagtagctcccaggtttttggcctctgtggctggaaagagatactgagatggggggaaatcggcaggagcgagttcgcagtgggaggacgtggggcttagttttggagatgttaagtttgaggaatgtcacatagacaggggaaggacaccagctttggagttaggcagggtcattgtctgaatcccagctctgccgtggactcactgcagaacctcaggtaaagaaggacttgcctctctgagcctcagtttcctcacctgcaaaaaggagggcatgtttcgtgtgggctggatctctggataaggggcttttatgatgaacactgaggcataggcaatatgcttttaaagtgttttgaggatcacctgcgtcagaatcagttgagatccttgttagggatgcagatcctgggctgcctctagagactttgattctgtggtctgggcgatggacccggaatctgaactgcctgggttttgagaactcctgacctagggcttgggtgtccaattaaagagcctgtggctgcctctcaagacttgcaggttcccaagtggaaatgtctttaaagatcacagagcccagcagcctacccccgttaggcaaatgagaaacccgaagaccagagaagccgagtgccttgcctgaggccacacagctgggaagcagcagagctgggtctgggatggttgatggataggtggaaaggtaacagctggttcaggtaacaagcaattggatccagacagtgcgggtaggatccaggtcagagttgaatttcattttgggaatcaaatccttctggacttgggagagagacatgtggtttcttcccatttgagagtgttaaatgactctcccagactcctgttcagctaatgctttggagaaacaggagcccattttctgtgacactctttggccagccaggccaccccagtctccaataagccccttcctgcagcccaatggacttgctgaacccttgtgggtagcaatgtggggcacacaccaccagtattagttacattgaaatctggatttctcaaccttggctgcacagtggaatcaccttgcgagctttgaaaaacaccaatccctgggtcccatccccagagatcccgatttcacaggtctggcgggtggtctggcattgggatttttcaaagatcctcagctgattctcatgtgcagccaagactggtttagctgcccagggacaagccatcagaatcacattgattcacagagtgagaaggtgctaccctttccaattgtcttcagacccccagactccctgaagtggaaagtcccagtatgaagccagtgacattttaacacctctctaacacacatcttcccttttaacccagagagtaggtatcaggcttcagcatctggctggaattttatgacatgatttatggcaaatggcaccagttcttcataatatcaaatttcctgttaaaacaactcgatttagtaaaattaatgacttaatctaaagaagactattaagcaaatcctatttcaggtatttcccctggacctaatggtggtctctgacccaaactggttccctcactcatgatcccttctggccacagggattggctcagagatgatcatgtggctcaagtctgtccagtcagaggcaatcttcatgggaagagtcaggaaaaaaatggccattttatctgctggccttcatgctgggagggtggaatctggaggcaatgtcagctgagagatgaggaatgactttccaaggccaccggcattagtggtggagcagggatttgaactaggcccacctgcccacaaaggtagtacaacttcccgctaaaccacatttctggtgaattccctgggattcttcattttatttctttccttttcttttttgttttttagacagagtcttgctctgttgcctaggctggagtacagtggccctatctcggctcactgcaagctcctcctcccgggttcacaccagtctcctgcctcagcctcccgagtagctgggattacaggcatccgccaccacgcccggctaattttttgtatttttagtagagacagggtttcaccttgttagccaggctagtctcaatctcctgacctcgtgatctgcccgcctcggcctcccaaagtgctgggattataggcgtgagccactgcctatagttccctcagaacttctgtttcctgggttttgagtcttcatacgtagggtttacttaagtaaaatgtaatggcaccccataaaatataacccaaataggtacctttgaaaagctgatagaagacactgtaatgatcattcaacacattctgggcactggagaaggtatttggccacttgtaaagaatttagtgccctgtgctttcagtggatgataagaaacttctggctggagttcgagctgaacatttcagaccatctcaccactcctcaaccaaaggaaggtgaattgtggtttctgccaactttgactaacctctgaattcatccatccattcatccagcaaaattttatggaagatttgcatggaggtaggcaaagtgctagatgcaggagagacatgcctatagcagacaaggtcctactactggggagatcacagcccagatggggaggcaggcgctaatcagatcgttgcttaaacctatgtgaaattacaactggaatggaggccacccaagagagacacagagaactttgaaaatccataactgggggatctgacctattgagagattaggaaaggcttgcaggaggaggtggcattctatctgggagctctagggtgaggaggcaaataactggatgaagaagagaggaagagcattcgaggcagagggaacagcatgtgcaaagactcaaggcaggaaggaatttataatagtaagtatgagatcagcatggctggacacggggaggcaggagatggtagtggaagatgaagtcagagagtgttaaatgactctggcctcatggagtcttataggccactgtgaggaaatttaccctctcctcccaacccgttctgcagcaaatcaaacagaaaactcccacctttccatccaccctcgcttatagcataaggatgtgaaaaaattccactgctcttacgatttttgcaatttgaaaaatagaacaacgcatccatacaattggggttgcttataacttggggagtttgagttacttaaggagaaaaggaagaagagcaaagagaaaggcaagaagactaagaataaaaggaagaagtaagtgaggagaaggctgtggggaggaaacggagtggacaggggagggggtgtagtggttcagggcctgggctctgggggtaacaactggggttcaaatgctaccctgccacctgttagctgcatccttgcatgtgttacttaacctctctgggactcagtttccacatctgtaaaatagggataataataataccttccttataggatgtcgtaagggttaaatgaggcgatgtgtgtaaaacgtggtatatgagtgttagctattttgccattgtcttcagaggctgggttgcaccctctaacctctgcagtgtcctgggggaagccatagacttagcctggacagctggacggtgagaggaaacagagaaccccattgtgatggggctagtatgggacaggctttggagaggcagctaagaaatcttcctgggagaccaaaattcctccctgctagagcgagaatgcctcatttctgggagaagaagcgagtttctgcatttttcttagtgatagggaaagggctctggctacctccctcataaagaacctccagttcagggaagatttatccccacagtgatgaacactggaacccaaaacagtgaccaaggggatctatggataaactcttgcaagaaataccagggcctatcatggagggaatgacatcacgttcagtaagttaggggtgggatgtttaggcagagccctgaagcatgagtaagggaggccaagggagccagggtaggggccataagatcatcctagtcagatggcagcatgtgcaaaggccctgagttgtgacccagcaccacgtgctgacgctctgagaaagctatctagtacagctaggagaaaaaaaggggcaagataacaggcatgtgttacgaaggtagggtggtagaccttccagggccttggtggccagaaaaagattttggaagttatcccgagagcaacaagaagccgtggagtgaccaatccctctccctcctgctgtttcccctcacccccatccacaaaatctggagacacagcgaacaggcttggaggtgggccatgcatggaatgatttgggaactcagaaaactctaatactgtctctgaaggggtaataatcatccatccattcattcattcatccactcaacaaatatttattacttgctctgtgtgaggcacagttttaggcactggggagtgagcagtaaaatttgaccaagttcctttctaatggagctgatactgtagtgaaatgagacagataagagccagataaacctataagataacacgtggcaaaagggctatgaaaaaaataaaggaaggccgagaaatggagcataaaggcagggacgggaggtgtgttacaatttccttgcgaacatgaccaagccaatccttcctgcccgcccttgttccactgagcactcattacttgcaccatcataaatacagtttaaagattattttttagctccctccaccccatgagcaataaacctccctctccagttggcaccaacagtacacttgtggtgaccgcagtgaccaacaaactgttgcacttccccacgttctgctgccagcccatctcccgggctggaaagccgcaagcccttggcactttcttctgccccttgcctgacagtgtttgcctttctttggatgatggagcagtgagatcatccaggtgccccccaggggcttggcagagctgcttacttggatctgctccaggtcagccaacaagatggatttaagggtggatttaaacagagttgacaacaggttccagggtctttggcaggggtggggtaagggggccacactttggtcaccttcctgaggatcctgtcgcccttatcagcacgacctgagtggatgggcatcagacacaataagagagagaggcctatgtatcaggaccccgctggataaatgggggtttggggatcttctgtgatttgcatttcttcaataactgctgccaggaagacggatgatgaagggttaaggacacacagaagagatgagactcccaatataacaagcagggaataagacttccaactccaaacaccagtcttctgaatgtgcctgccagaattctgatcatgaagactgccgaagtgttctgaccttgaacctcagaattccaaccccgtacattagttccaacctgggacatcagcattctgaccttgcccgctagagttttaattatgaagagcaactctctggccatggactccttggctccaatgatggattagaggattctgacctcagatggcagttgtctgatcttgaacttcagagttgtgaccttgaatgatgttgctccaatactggacacaacagcagcaatcttgagcaccagaatcccaatcctgggccccctaatctctactgaatctctcaatgcccaagctttccagcctgaaatagtagagctgacatgactccacaggatacaaagtttaattctacacaataagcttttccacaggcccacagcccctagaaataagccaaatgcttcgatgatgataatgatgatgatgatgatgatgatgatgataacaacacaaataatactggcttacatctgttacacatcaggcactttgctgtgcactttacatgtttcatcttatccatcctctgggtcaccccagggatcttattattcccattttacagattaggaacctgaggcctagagccagttcagtttgctgacgtgacatcgagagctttttctagccactgcagtagctgtttcttcctgccctggttggagattgggtttgggaagttgtaactcattagctaatcaatttacgatttgcctgagaatttccccgacttgtgttgccatccatcaggcatgaactgccttgatttttggagccaagtcccgccttggggggatagtcattcattcaacaaagatttgccacccgaggttgtgcttgatgccagaaataagaagagggaaggtgggatatgatggttgattttatgtgtgaatccgactgcgccatggggtggccagattaaacatttatttgtgtgtctgtgcaggtgtttctggatgagattagtatttcagtcggtggactcagaaaagtacctagccctgcccaatgtgaatggacatcatccaagcctctgagagcctgaatagaaaaaaaagaggcagaggacggagaaatttgccccttttgcttcctgcctgccttctgagctgggacatgggtcttctcctgcctttgcactgggatttataccatcggcttctctggttctcaggcattgggactcagaccaaattacatcaccagctttctcctgaatgttcagattgtggaacttctcagcctccttactcatgtgagccaactcctcagaataaatgtcttactgggaagctgggcatgggggctcacgcgtgtaacccagctattttggaggtcaaggcggaaggattgcttgaggccaggagttcgaggctgcagtgagctataattgtgccacagcattccagcctggatgacagagtgagacccggtctctcaaataaatgaataaataaacaaatctcttagtgattctgtttctctggagaaccttaattaatacaggggacctattgcttctgtcatccaagctctgtctctttcctcccttccaggtgggggcctcagaggcaagaaatgcacccccaacatttccagccacgtgaaggctctatgctccagaggtcaaaaattagagccacgagggctgcatatggttccaaacatattctgtttggcccactcaaattgttttcaattattttttttgagacaggaaaacaatggagcttcctgacatgtgacactgatgctgtttcactcaacaagcaaaaggtacctgcttcactcttcattttaaaatggaaattgaaaccataccgagatacccgcttccatctgttagagtgacaaaaaaatcagaaagttcacaatacatggtgctgatgaagttgtggggaaacaggcaccctcacacatcgttggtgggagaataaattggtacaacctctacaaagtgcagtttggtcatatggatcaaaatgtaaaatgcacaaatctgttataaaatctgacttccagagatttctcccacagatatactcacagacacacacacacacacacacagatgttaagtgcaaagacagtcaccacagtattggagtttttgttgttgttgttgttgttgttgttttgagacggtgtcacgctctgtcacccaggctggagtgcagtggcgcgatctcggctcactgcaagctccgcctcctgggttcacgccattctcctgcctcagcctcccgagtagctgggactacaggcgcctgccaccacacccggctaattttttttttttttgtatttttagtagacacggggtttcactgtgttagccaggatggtttcgatctcctgacctcgtgatcagcccgcctcagccacccaaagtgctaggattacaggcgtgagccaccgcacccggccttttgttgttgttttgagacagggtcttgctctgtcacccagactggattgccgtagtacaatcatggctcactgcagccttgactccctgggctcaagcaatccccccacctcagtttcctgagtagctgggaccacaggcacatgccaccacacctggctactttttgtagagatggggtctcactaagttgcccaggctggtctcaaactcctgggctcaagggatcctcccaccttggcctccgtaagtgctgggattacaggaatgagacactgcacttgggcatgtttttaacttttaaaatgatttgccaacgttgaaaaaccgggatagctcccatgaaaattaaaatttctggctaagtccagacccagtctggagctgaatggctgctgccttctcaggcaggcttctgctccagttcaccactagccccctccactccctgcctgaaaagtggctggccatggaataggcatgttaggctgggtgttgaccagtgtcctccttgaacttgccctcctacagttcttccagcaactgcttcactgggtgacaaggcctacctagctccggtagccatcagagtctgaggccccggctcttgcctaggcagggaggttaaggccttctcctcctaacccataaggacctctgagtcattctgccctgcgggcagagctggcttcaagggtgtgcaacctgcacagttgcacagggccctgcgctcacaagggctccatgctcggtttgctactctgctatcaccatctcaaaattctttcttacttttgaacaaggggactgcatttttatattgtacggcaccccacgaattctgtagctggccctgccagtaggtcacttggtaattagggacacccagtcccccatacaccctgcccccaaggactgctctcatccatctagaaaaccacctctttggattggccagttctcccaggcatgaggccagcaagggtcccaaatttttatacaagaggggcttggggacagtaacctggggtggggaggggaacaagaggacttttcttgggttgcatttgcatagagctttatgtaacatggaggacgctccatcaaagaatgggggagtgtgatggggcctgggggtgggaggtggaggaagtatctaacacttcctctccaaccattccttggcacagtcattgcatgaagggtttgagcaggcaagggtatcatcaggggcaggactaaagcaaggtcaggggtagactctcttgaggagaggaaggagagaaggaaaaacaacttaacacgaatgaagtacctgtgctcagcccagcacagtgctgggccctctggcacggttaagtacacctgtctttccagtagctttgcttggtaaagtcaccatgcccgttttccagccaaggaaatggaaactcagagagaagaagggtctgcccagggtctcattgctcatatgtggggagtatgaacccagacctccagagttccaaaccagagctctttccacctaccctgccagggagacggcacatgagaggaggaaaaacattggtgcagagaaagggaaagatgcctaccccaagtgggcataatctcaaaataaaccagagaaacatgttatgatgggaagactgtaaacattaccaagtccaaactggccattcaaggtcagggagggcctctctgaagaggtgacctatgagctgagatctgaagaaggagaaggggctggctgacactgcaagatatgaagccagaggcccagagaagttaagtgattcactcaaggtcacacagctagcttgcatcttccttcccaccaatccacccacaaacacccaataagcccctcctctgcaccaggccctgatgcaacttcagaacacaggtcagcaaactttttctataaaggtttagataataaatgcgttttaggctttatggccatacatccaaaagcagctgtacatggcaggtgaatgaataggcctgcctgtgttccattaaaaccgtatttacaaaacaggcagcccacccaccctgttttgagcacagaagtgagtaagatacagtcttagactttgagaacatcctgttttatgtggagagatgaaacaagttaagaagaaaatagaatacgagagagagcacactgaacagtgcaggataagcggaatggcgatcttataggagaaagatcactcctgtagctcagcagggcagacatcaagttcaggctctcagaaaagtgcacgctctcagaaaagttcacatacactgagaagttttctttgaccttgccccattaatctctgtcaaaacaccttgtttctctccttccaacatacatattacacttagtgtgattattctttcatttaatttttaatttgtttaatgcgtatctccctccagtaggttataaactctatgatggccatggattatttctgccggtttacatttattctccccactcttggtaagaggacttcaatttttctttgggaaagcacctctttcccattctcaatcccatcccagctccagccattgacatgtgacccagacgcagctatgtgattggctcagggctgggccaatgaaaatcagccctgggattttgctgggcctattggaaaagagacttgctttgccccaggaagaaagcctggatttgagggggccatctttcctgccatgttggtgcagcctgctgagaagccatgacaaagaagaatagagcttagagatgtaggataccaagtcttgatgacatatttaagcccctggatccaaccttgctggaaaccttacccaacccaagacttttttttttttaacattttgcctaagtccattggagctacctttctgtcacctgcagctagaagaatcctaacaaatagatacacacgtgattttcaagcacccagcaggttgcctggcccacagtaacatgcactaaattgtttatcagacaaaccacaggcaggattgaaacaggtcctcaaagcatgcacatactcccacctaaacttagaaggaccagagaagcctagaatggaagccaccttgaaacagaaagaatgatctagaaacaggaggaatgactgagtcgaattacagtcactatttcaagaaacaataaaggttgtgcaaatgtatccactgaaaagagataaaagaaactcgatccattcacagagacagtgggaattccagacaagtgataagcaaaggaaaggctggttctgccttgtcttgtctccatctttccttttgcctctcatatgcccctgacagggcaatcatcggctgcctcttcggtacaactgagtctacaaagactctgagaggtggggctggccaagctcaagggctccaaggatcacacaaagcttagaaagactcagggatggcctgtagggagtgattagtgacaattgatgatctgtttttagaaactgtttggttctaggcccattacctggtggatgtaagtgatggtgtggaattggcaaatgcaatattattctctcaaagacagtgcctgcctgccagcccatggtgggcagttgtggtagaaaccagtctcatttcagagcaaaaatggagcagctgccaggtgcagtggctcatacctgtaatcccaacactttgggaggccaaggtgagaggattgctgaagcccaggagtttgaaactggcctgggtaacataggaagaccctgtctctacaaaaaaagagtacaaaaattagccgggtgtggcggtggtgcacacttgtagtcccagctactcaaggggctgaggtgggaggatcatttgagcccaggaggtcaaggttacagtgagccatgatcgcgccactgcattccagcctgggcaatagagcgagaccttgtctcaaaaacagtcagggtgtgagggaacacctcaagtgtctaacttaattgtgtgtctcctctctgtaaatggaaggcaaaaggccacttctttctgcaggcaggtagagacaagaaaggtggaaggagcagggtgtacctggaagagacccttaccttttaaggaagacccctctgatcagtcatcacaagatcatgcacatttgctcatttattcactcaacaaacgtttaccaacacctacctgcagtaacaatagtaatagtgaaatatactgaacacctgctgagtgccaggcacggcttgagtgtttcatatagaatttgcccaacaaccctggttgttatgaggctttccaaattacggatcaggacattgaaacctagagaagttatgtaattccccaaagggcacacagctcaaaagtggctgagctgggatttgaacccaggcagtcaggctgcacagcctgcacgcttaagctttcctgtttctctgtaggccaggcctggcatccacagaacaacccacaagtgaattttcacgatgttttgtgcgaggaaggtatgaacgtcaggtttccggtgcacagaggagggagcagtcagtgctgcctgaagggaagtgtaggtggtggtaggggggcggggggtggttaaagaaggcttcacagaggaggtggtggggaagctgggccttgaaggtggaaagagagaggctgcaggcagagaagaggaagaaatgggtgcaaggcagaggaacagcttgggcaagagggtgaccagcgctgaggaaggctggagcttttgggggcatgcagaaaggttagtgtggtggtcgcagagggtgtctgaagaagggatggggaggagatgaaggtggagagttgggttgggatgtcgaaagccaggctaaggagtgtggactatcctgggggcagtgggaactatggaagttttgggaagggggtgatgaagttgagcagactgcatttgagaaagtcggctctggctgctctgcagaggttgaactggatgggaaaggctggaagcagggagcctattctggggctcagaggctcccaggaagggtcagagttcagcagtgacccacaaggtcgcacctctgatctcacctccttctactctcttgcctccggtacactctgctccaaccacattaatacctgaatgttccttgagtgccccaggcacgttcctgtcccagggccttagcactgcttttctctccacccagagcactcttcccccacatgcccacatgcctgtctccctccctttctacttggcaccttctcctttcctgaccagcctggttaagccccagcactcccctccttccctgcagaactttctccacagtgccatccaaaatattatatcaggccgggcacggtggctcacgcctgtaatcccagcactttgggaggccaaggtgggtagatcacttgaggtcaggagtttgagaccagcctggccaacatggtgaaatcccatctctattaaaaatacaaaaaattagctgggcatggtggcgggtgcctgtaatcccagctacctgggaggctgacgcaggggaattgcttgaacctgggaggcagaggttgcagtgagccgagattgagccactgcactccagcctgggcgacagagcaagactctgtctcaaaaaaaaaaaaaaactacataattatttgatcttgtcatttcgtccataaacacttcagtatgtgtatctaaaagataaagattttaaaacatagtcgtaatagcattatcacatctaaaaacacagcattcattcctcaatatcatccaatattcagttagcattcatctttctttccctgattgtcttacagtctcatgatttattttgcatggttgttttggtccaatcagtatctgtgtttatttttttaacagtcttgctccttcttctactggaatatcagtgccatgagagctgggatctttgttttgatctctgctttgtccccagcacccagcacaatgcttgacacatagtaggtgctcaataagttccactgaatgaatatacacaaccaatcctgataataaaagtttgttattgacctgttgggcattatgtgtctgttactgttatttgccataattatcaaatccttacaatctccttatgaggtacgtgctgtgattaggtccattttacagatgaggaaacagctacgtgacccaaggactcacagcttaaaaaaaggctagggcttaagacccattgcacagcctgagggtctgtgaccactggtggaggcaggggcgttgtggcttcccaggagctgcctccacaccttacatccagagtccagccacttttcaccgatcttccctgccaccaccctcttctgggctgtcatctttcttctctttcctggaataatgcaatatcctcctggcagcggcttatcccttctttctctaatgtccattctccactgctaaacatcctccaatgcacaggacagccccacggcaaagaattctccatcgccaaatgtcagtagcactaaggttgagaaactgggctctggttgaaaaaccagacacattcttcatccagagcctggcataagcagctgagagtcagacttctagcaatgtgttagtaataagagtgaaagtcccaaagtttgtaaacaaattcctttttcatcaattagtattctcagttatctctaggataacatcattcattcatttattcaatgcatgtatttcatgcctgctctatggcaggcactgaagacacaacagtggacaaagcacacaaaatccctgccctttgaagcttacatcaaagtgggagagagagaaaggaatcatataattaagtaattatatgtcaggttgaaacaaataaagcagccatggggaatgaacagtgctattttatatgtggtggtcaaggatggccttgctgagatgacatttgagctgagacttgaacaatgtgaggggtgagtctcgtggcatcagcaggaagaccgtaccaggcagaagggacggacagtaagtgcaaaagccctgaggtgggagggtgcctagaacagcaaggaggccactgtggatgcaacagagtgatggagagggagagtggtagggaaggaggctgtaagggtgctgggaaaaggggaaagatgccagataatgggccctgtgagtgggactgaggagttgggctttttctcggagtgaggcaggagccataggagggttttgagcgggggcgtgagttgctgtgtgtggagaccagacgggggatgggaggctggaggcagcagatgggactagaggctcctgcaatggtacaggagggagaggatagggtcaggaaggcagcagtggggtggcaagaagtggccacaacctagacacgtcactcacacttgcatctcactctctcacttgcattctgccaagccgtcctgagtggaagaggaagggatgagccatgctgggtgtgtcagagattgccccttatcctggcaacaatgataacagcagctgccccagatggcgactccctctgttcccagcactgcacatggtgctccacagcttagcacctctgatctccgccatcccatgttgtcttctgtggctgggcttcctggccgtgtgcagaatcacccagggcaacaaatggtgtggggaaaatggggatatccccatgcaatggaatgaagttggttccttatcttacacaccacatgcaaagacctaaaataagactacaactgtcaaactctcagaaaaaatttggggaaaagctttatgatttccccctattgccaaagattcctcgaatataataccaaaacacaggcaacaaaagaaaaaacagacaactcggtcttcaacaaaatacaaaacttctgtgtattgaaggacacaatcaacagggtgcaaagacaacctatggaatggaagaaaatatttgcaaatcgtatatcttattagggattaatatccagaatatataaagaattcttacaactcaataacaacaacaacaacaaaaaccccaatttaaaaataggcaaagtacttgagtagacatttctccaaagaaaatacagtagtccccccttatcacagcaatatcactttccaaggttttagttacctgcagtcagctgtggtccaaaagtattacatactataagatattttgagaaagagagaccactttcacatagcttttattatagtattttgttgtaattattctattttattattagtttttgttgttaatctcttaccgtgcctaatttataaattaaactttatcataggtatgtatgtgtaggaaaaaacatataatatacagggtttggtactatccgaggtttaggcatcctgataagggggtgctagtatatacaaatggccaaaaaacacatgaaaagatgctcagcgtcactaaacatcagggaaatgcaaaccaagactgcaatgagataccacctcatgcccatttggatagctactaaaaaaaaaaacgtaaacaaaaaaatagcaagcattgacaaggatgttgatatagtggctatttgtcccctccaaatctcatgttgaaatgtgatccccaatgttggaagaggggcctgcctagtgggaggtctttgggtcatgggggtggatccctcacggatggcttgatgccctccttacggtaatgagttcttgtgagatctgcttgtttaaaaaggcctggcttctctcttgctccctctctcttcatgtgacacacgtgcttcccctttgccttctgcatgactgtaagcttcttgaggccccatcagaagcagatgccagcactatgcttctggtacagtctgcagaactgtgagccaaaataaaactctcttctttataaattacccagcttcaggtttttctctatagcaatgcaaaatggactaatacagataggaagaaattggaacccttgtacaccattggtgggaatgtaaaatggtaacagtcactatgaaaaacagagcagcagttcttcaaaaaattcaaaatagaattaccatatgattcagcaattccacttctgagtatatacccaaaagaattgttaaaaatctagttggtttctgcttatccatgcccagaagaattgaaagcatgaactctaagagatatctgtaccccatgtgaatagcagcattattcacaatagccaagaggctgaagcaaccaagtgtcttttgatggaggaatggataaacaaaatgtagtgtatacatacaatggaaaattattcagtctttaaaaggaaggaaattctgacacattacaacatggacgaagctgaaggacagcatgataagtgaaataagccagtcacaaaaggacaaatactgtatgattccacttatatgaggtacctagaacagttgagttcaaagggacagaaagtaggaagggggttgccagggcctaggaggtgggcccaggagaatttaatgggcacagagtttcagttttgcaaaatgaaaaagttctggagattggttggacaacaatgtgaatatactttactgaactatacattttaaaacggttaagatggaaaatttcatattatgtgtattttaccagaactaaaaagaaaccacttagggggtgagtttcaactgtggggcctaggcatgagtattttgcaaagcccaggtgatccttatgtgcaggcagcatggagaagcgctactctgtgaggtgtgccccaggtattacccccacctcccagtctcagagaggtgaggcgccttgggggctcatatagccaggaagcagaggaggtgggatttgaatccaggcctgtacccaggtccacagaagtgtgtctcacatggcaacattacatcttatttgttatttatgtcatcagagaaaacatttaaggagcattggcgccctggatattaacatgagaattctagctcccaccccacccactcccgatacgggggctgagagattcctcccatttctggccccacctagtcatgcccactcctgctggagacaccaaaatcaagttgatttcacctcagggagaaggtaggaccttatgcatttagtttatctattaaaataatgcttaatgctaaatctgtctctcccatagtcccatccaggagcctttgggggtaaagtcgtcctagatccagagctaagaacactcctaagtcatagggtgattctggacaaatctctctcctctcagcactgccccagcatgagaagggaatactgggatcttgcttctcactttctgaaggtcactcatacaactcagagatcaaagtcatgggctgggcagtcagggagtcctgggtgggatctgtcccagccttccattcactgtgtgaccctgggccagacacttcccctctctgagcctcagtttccacggctgtaagatgagggtagttatccctcccttatgggggggctgtgaaaatcagatgtgatggggcatttaatgccctttgcactatgccaggcaagcacattgtaagcactcagtgttagctgttgctgccaccactgtggttttcattttatctaagagacagagatgaggctgactgtgccctgccagacctagaatttcttcttttacgacaacctcctagaggttctctctatcgggggtgggctgtctataatacaacaccaggtcattctgaataaatgatatgtcctacagagctttggttggtttccccagaatctcagatcctaagacaaggttctgagtacaagtggcttatatgataagtgatcccagaaaactctggaagaggggagggaacatgagacagggataggaaagaggtcaaacagggtctgttatcaaacaagtaattgctgtgagcaactgaagctgccctggggaccagtgtagaacacacacctctgagttatacccccagccaggggagaagcacgtacacatcgtccccatcagccggcaggtgagtatcccactagttcctgctggggtgttagtgccctgcctttactggactccagtggccagagaaagcctctaaccttacaatgagcaggtatcatttgatgagagcagttttttgaaaaggagcttatttatcttgcaggattgtcaggaggattacatgagaggacagtaaaaaagaaaaaaaacaacaacagcaaaacccaacagttattgagagctttctacataccaggtcctagtctaagtgctttgcatacattaatgcatgtaactcaatccaatgaggcaggcacagtgattggcccaaaattgctgttggctgaaggaaccagggcacagagggctgcaatagttgaccccaaatcacatggttagtgagtagagaagccaaactctgaacttgggcaatccagtgctaaggtcaagtgcttcccatcctgatgacattatcaagtacaggaagtacacaaagtgctgggtatggagttggtgcctaacgcatgcttgttctcttctagttagttaagctttggccaacccattcatttgaccatctctttttcttcctagcatttcacattcacacagcaagtcggtgaaagatcaggggccatgcccaggcctttctggccccgccacccgtacccgctgaggctcagggatctttctgttactccaggatgtttgaccaggatcatctcttagcagctggtctctcaggggatttgaaaggctatgatgggctgtgtgatcctcagcaggtcactggagcatcctgggtctctgggtttctttatcctgtggggatgtgggatttctcaggcacagcttcaactctgatcatgtgctatcatccttcatccttcagacaaccctgtggagtaggttttattatcgccctcacttacagattaggaaatggaagtgatgagaggtgaagcaaattggccaaagtccacagctaggacaaggctgggctgcgattcgaagccaggtctgtgtgaccccacaatcaggattcagaattgctggcatattatctgccaggataaaaacaggcatctggtttgaccaagctggggccagcaagagcctaagtcgatgactcatcacactgaaggggccccatagattctgagttggttcccgcatttcttttgatgataatacacagatccttgtggctcaggtcaaggaagctggaacctcattacactagagacgtgtagctggagcagaggaattccgtgaaaacactaacaatcgttgctgccacttactgaatgcttcccatgagtcaggcgctgggctaggctctttacattaggggcatctcctaacagctcttcatggttgcctctgttataattctcatttcctagataaggaaagtgacactcagagaaggaaaggggcttgcccaaggtcatattcatggtaagcaatggagacaagaaatcaaccgcatctgttggactccagagctgattcttaatcaagtctgtgatgggaaaaatattgaccactgttcctaaagaaaggccactctaagctgggcatgatggctgtcacctttaatcccagtgctttgagaagcttagatgggaggatcacttgaacccaggagttcgagaccagccagcacaatgtagcaaaaccctgtctccacaaaaaaaaatttctaatgtagccaggagtgatggtgtgcacctgtagtcccagctactcaggaggctgaggcaggaggatcacttgagcccaggagtttgaggttacagtgagctctgattgcaccactgcactccagcctgggtgacagagcaagaccctgtctctgaaaaaagttaaaaaattaaaaataaataaataaaggccactcccacttttgaatacaataatacttcatacttataaagtactttccatttacaaattacattcacatctgaaatctcattgaatcatcaaaagagccctgaaagggagctatgactattatcaccatcaggcagatgaattcactggacctgagagctaaaatgatccacccaaggtcccaggatttagaaacataggcttgggaaccagacaaacttgggttcaaaccttggctctgcaattttcattcctttgataaatatttactgagaacctagctgtgtgggctcaggcaagtgacttcgcctctcagagcctccatttcctgttctgtaaaagagtcttcataccacttatcagatccattccctctctcatctgaaaatgccagacacttgctttctcaggttccctcagagctagagcatgagcatgtgacctgtcctggccaatgggattttaaaagaagtctgctagggtgctcctgggaaagggtttcctctcagaaaaaaaaagaaagtgggccaggcgctgtggctcacacctgtaatcccatcactatgggaggccaaggcgggcagatcacttaaggtcagacatttgagaccagcctggccaacatggtgaaactctgtctctactaaaaaccccaaaattacctaggcattgtggtacatgcctgtaatcccagctactcggcaggaggctgaggcaggagaattgcttgaacccaggaggcggaggttgcagtgagctgccgagatcatgccactgcactccagcctgggcgacagagcaagactccatttcaaaaacaaaagaaagaaagtggagcataggagaaaatgtttctcttcacggattaaacatcactgaatgtacgtctgagggctggaactgggcagccatcttgtgatatgaagcatcaagcatgaggaccaagccacttgcaggggttggggagcagaggagcagagagatgaaaagaatctagaatcctggtggcatcattgagccattaactcaacctaaaaccaactgccttggaacttcatattatattcaatgatgcatcttcctccttattgaagctactttgagttttctattctgctgcttgcagcccaaagcatccctaactggcatactacctggttgtatccctgttggaggaatttcaatgagatagcagatatgaagcaccactaatcagtgctgggcacaacaaacataagctaccctggaaattaggaagttatctcagggctttaatcctgagactatcccagggatcacagacactcctgggctggcaaatcagttccctgtctctcctactgagaaaagcctgtcgagttttccgagaaagccaaagccccgtggtagccccagcaccgcaaccctgtcacaccaatggggctgtccccatcttctaaacaagaatcaatcacactgccttttgcctaatgggttttgattttcgctcccctgatggcaaagcctagggcctgtgctttggtttgtctccgagttgccagaacatcccatcaattattaacagtgtcagctcagtctccctggccctgctgctctcagaaggaaagggtttgcagcaactcggcccacccagccctagaaaaaagactcttttccttagcatttataacaacaatccccacctgctatgtgctaggctttgagcaaaattttgacaaatgtgatttaatgaagaccctgtaaggtgagccttttatctccattttacaggtggaaggttgggacttggaaagttggagaaattagctaaaagctatggaagtggggagtggcacagaaccagatccatccttgctcttcagcatatgagatatggccacttttgtatcttacaatcacctagaaatgatcctccatttggtcctgtcactctgtgagttctaagcaatttccacaggctttgcttgttttgacaagcaaggcatccaagctggggggatgggtggggatgggatgggcaaggtgcagatgactcaaaggaggccagaggcacagggacctgggttgcaggtgggcagtgagaaggggtgacaggtccccaaaccctgagacacagtgactgactgcttgcttgcttgcttgattcattcattcgttcattcattcattcgttcattcattcatttattcattccacatgctcctcagtgccaggcaccatcatgggtgctgggaatcaagcagtgaatcaactcatggtactcacattcttgtgggtgtgaaacagagacacacaaagaaggaaatataatttcagatggcgtttaaggcctctgcaggaaaggcattgcatgatgcaacagagagtgaggggagggaaactgtttagaacagcggtcaaggaaggtctgtatgaggaggggacatgtgagcagggacctgctcaaatgaggaagggggagaaggggctggccaagggggaatctggggaagagcattccaggcagcggaaacagcaagtgcaagggtcctgaggtcagataaactctggcctgtttatggaacagcaaggccagtggggctggagccaagtgaaccagaggagatcaaaagagatgagcccagagaggtcatgggggccagattctgcctgggccttgtatgccaggatgaaaagtctgaattttattttgagtgtgatgggaaacttctggaggattttaagcagatgaataatgtgatccaatttacattttgaaaagctcactttggctgctatgtggggaatggattgcaggggcaaaagtggaagccgggagactggggaggaggctgcggcacttgatcattatagaaagaacactcggtttggatttctggctactcctgactgcctgtggtgtgaccttaggcaagttacttaacctctttcagcctcactgtttgcgaaaggtgggataataacagagctgcgttgttacactccatacacagtaggtgtttgatcattggcagccaggatttctattctgagggccagtgagcctgcctccctccccatttcagctctggctacagaaaatcctagatggtccatctgccaggaatgtgagctggcagccccagactgggatcatggagaggtcacaaggctgtccctgctagcggattaacccaagggagaggagaggttctttattcccaaacagcacctcttgcaagccccggtgcttgggtcttgctgccagaccaaaacatggccctgtgcctgcttcttctctgggagggcaaattgtccagttccctgtaccttgttctcatgtcttagggatgggacagggagggagagtcacatttgggcctaaatgggatgtgcagtgggagaacctgtgtcatgcctggaaatagcaaaataagtctgttgatcctaagctgattaagggtgagtgactctgtcttaggaggaggctttttggacacaaaattgggggcgggattatggagagagacagcccacagcctcagaggaggaagccaggcccaggagcctctacatccttgttagggccaacagggaaacgaaaaaaacacgtgggggctccctccaccctcttaccagccaccccttctccatccactctcaggggcctctccttgggtggctagatctggaggaaggaccccacggagtctcccttcagactgggacctgcaggtgggccttcagtgagaactgagccggagaccccacaatgaaaggctgggctggacaggagtcagccctagctagtaagatatggctggatatttaggcttcctcctctcctctttcttttaccacaaatctacttacctgacccctttttttaggccccacactcagttacattctccccatgtttcccaagttggtcttgctggatttcaacatcaacatctctcttttctgggttctccgtgaacctcacagaacctcttttatagccttgcacacactgttttgtcatttgctcccagcacccagcacttcgggcacatgaagacaggccccatctttcccaggcaaccccaaatcccagcctgacgtagagaagttgctgatcaaccagtgccctcctgccctgccttggctcccaccccaagccttcctcagtcccctacagcccctgccattacccagcagcaccaaagactctctggcccactctttgtgttcaaactcattcctgcctcctcctcctcctcctcctttatttttcacattgcctcatttttcgctcctattttgaaatttacatcttgttccaagagctgaaacatctttacaagctgcaccaaaccattctggaaataaactcaccaaataaataagtaaccagggggtgacccctcacccgcaagcatccacaaccaactgcatgtgtcgtgtgggtccacacccacccctcggggtcccttcttacttatgtttaaactatctgacagtatctcaatgtcctgtaagcatgtctgtaagctgcttttttcccttgctggggcagagtgaggttataaatatggagatattaaaatcacagggtgatccaatccagcctaggtctgggacttcacagggaagcaaaccctactccaccccagcaagccactgttgtctctctgtgctctctctcttattcgtcagtgtccatcttcttgctgtggctttttatgggtccctgtgaaacctctccaaccaagtaggggtataacgtcttggataataaaaagatggagtgaccagtgccacatgggaaaagtctgagggggttggtcctcacctctggggactcagtcctagcccctccccattactaatcttcatcgttgggaacaaagccagagtcctccagcagtggtcctcaatatggggatgcaagcagatccccccagaccagcagcccccagatcccagactcaccttggcagccacagaggaattgggcttctccagtaggtcccagagttttttcctcttctctgcgcagcacgtgttatcgaactcctcgccttcccgctcccgtagggtctcggcctcacgcttgagctcctcgttcatctgctctttcttctggtggtagcgggcctggcagcaggactccaggtagatctcgtcgatgccccagtagtcgagctcttggctgaagctgagcgcgcacatctcctccatcatgtgcagtcgcccagtgcggtagaagttgaggatggaggtgaaggcgcccgggtggcggtcaaagaagtactcgttgtcgtcgaggctgtagtcatcgcacacctcgagcagcgagtcgtgcgtgttgcagtcgcggagcttgcccagccgcgtgcggggcaggcggtccagggtacgccagagtacctcgtgcgccagccccccgacgttgaggcggacccgccgagagcacgccttgctgcgcacgatctccatgggctcgggcggcagcgagctggtggagcgggagccatgcttcgtcatgcccgccggcatcgctgatccggccgcccccgccccccctgcccccccaggccgctgtcactcgacggcaaggcccgctgctgcgggggaggggggcagggagcgctgtgggctgctgggggtgcagggggccccgcgggcgcgcgtcacggccgtcttctcacctccatcccgacggctgcgaggcagaaagcgaaagcggacgcgggtcagcaaacggggagctgggcatgctgtccccccgccccccacctctccaccaggctcccagccggccttgaccttcccccgcgcttaagcggctcagtggggtaggacggatggtcgctgtccctcccgccggtgctgaagtccgccgcaccccatggatggagggaggggccgcccctcggggcggggagagggccccaagagatgcccctggagcccgggaggccccaccctgggcttctgcggcccaggcgcgacccagccgcccggggcgctgtccgccccttagagtgctgaaactctcttcattatgggtctcccgatcgagtcccgaacctggccccgccatggggagagagggggagctgcatgaaaactttctttctttatctttttctttctttcttcttcttctttccttcttttttttttttttaacgagttctcttcttttccttccccttctcgagataatcaagattttgggggtgggggaatggcagcgggcttttttccaaatcttaaaagatttgggggaattccgggggttccaggtgcccacctgtccgaggtcacaacagacggggtgtgcacaacagcccctctgtcctggagcgacccctcttcccaaacactggagcatctcctgagattgctccagcgacaaggtgagccgcgaggaggaaaagcccgctctcgcctctccctctgagcccccaaccctaccgcaggaggggcgggcagagtcctcgggatccgcctgctccgtcctcccctcgctccttccccgcccccttctcctccttctcctccccctcctcttccttctccccctcctcctcctcttcctcctcctcctcctcctcctcctactcctcctcctcgttcctctcccgcgatggctttttataactccgggttctgcgcctttccccgggcttggaagggaaggggtgggggaggtgggaggcggggaaatgagctaaattttctggccttttcaaaaggtgccatcctcctaccgcgcactagtgatttcggggggttcccctgagcaccccctgcatgtagggctcacgccttagccccagaatggggattgcgcgtcccctcaggcctcagcccttgcctgcctcccaccccgctcccctccagcctggagctgcggagcccgagcagaccaacaggccgagctgcggcaggcaaaccccctgtccgtgtccccatgcacccccacggaaggccgtacgccccaacactcacccccagggcggccgcctcctggggccagggaccgcgcatcgtcccggccgcccgggcgcccccgcccgtgggcagcggcggtcccggggccgggctgagccgggcctaccccggccgggcaggcaactcgcccgggctgcaggcgccgcggggccggggcgcgctctccgaggcggggggcgccggcgggcgccgggggcgcgggggcaggaccgcggccgcgcggcacctcctccacctcctcctcctcctgctcccgcggcggcggcggcggcggctgcctgggcgagatcaacaagtcggggctgagcttcggctccgcgctcgctgctattctgtcccgcacttcggagcgcccggagccgggcaccaaggcaggacggcgccacctgcgggtcggaagcgagcgcggcttaactcctgcctgcccggcccagcctgccggggaggccgggggcgggctccgggatcgggccaaggagacgcgcgtggccgtgcatccctctccacccaggccacctgcacagctggcctcgcgatcccgccttccttcgtcccgtcaacaacgtgtgttgaacgcctcctgtgcgcgagccgcggtgcagggcacggtgacaggcgtctgagatacagctgtgaatcaaacacaaacatccggccctcgtggagctggttggaaacagatcataaacaaaaaagcgaaaggatatatgaggcggtgacaagcgctgggggaaataatgaaacaggaggaagggtcagagggtgggagggggcagatcggaactgtaaatagcccttgctttcatgagcttccattctagattttagcggggggtcgggggtgggggacggaggcggacaatgaatacatcagtacatatgcaatgtggcaggtggtgataaccgctaagaagaaaaataaagcgaggtatggggaagagagggtgaagagtgagctggtttatatagtctggtgattcattcattcattcattcattcatttattcatgttaagttggacatctggttattgacagcttcctatgtgcaagcagaatgccaggctccgtgaagggaaagtcttccccctggagctccccatccagtgggggaggcaaaacccatcacataatcccagaaatgaaaactggaggaggtacctggagaggcaggcaagggttctctaaggatgccacagatgggccttgtgtttactcatttattctttcaaatattcatttactgcatgataagtaaataggtgtcagcggccgggcacagtggctcatgcctgtaatctcagcactttgggagactgaggcgggaggatggcttgagcccaggagttggagaccagcctgggcaacatagtgagacccatctctgccaaaaaataaaaaattagctgggcatggtgctgcttacctgtggtctcagctactcaggaggctgaggcaggaggatcacttgagcccaggaggtcaaagccactataagctgtgattgcacctctgcatttcagcctggataacaaagtgagaccctgttgcaaaaaaaaaaaaagaaaaaaaaaagtgccggggatgggtacagcagtgagctcccctgccctggaggacaaaaactgaacaagatacagtgttccaacacaggttcctctctggcccttttcttcctttctaaaattaaggggttcatttccataatttccatagagttgcacataatattattatatattttttacttgtccacttatcatctccaccatcatgacccttgtccaaggtaccatcgtcttgtctccctgcaacctccctgcaacttggctcccatcttggcctcatccctggctcccatgcctggctcccatcttggcctcctacagttcattctccccatggccaccaaaacaactgctacatttcatggaccatgaaatgttggaccatgtttctcatctgcttaaaaccttcccaagactttcccttgctttagactaaaacctaaacttctggcctattgccctaattcagcccgcccccctttctgagcttgtagaccagtggaggaagacaggtaactaaaaaagtaaatttttaaagagagagtttcaggctacagtgattgttataaaggaaatggaacatcatgatggggtggaaaaagagagaccaagctgctagtgttacacagggtggtcaggaagggtgtctcagaggagattaatagagattgaaagataagaagggactagccatggggagaatgagggaaatgcattccaggtggaggaaacagcaagtgcaaatgacctggggtgtgagagacagtgaacaatcacattccctcctgcttcagtctggtgttcctagggtcagaaagggttctcagctggcccctctgtaagcctaatctgttgaaggcaacttttctccagagatctgggcattcccacaggaggtttcagaaagcaataaatccttcctgatgagagggaaaaaatgactctataatggtgaaatttccaggcattactgcaggcattacggtgccttccaggtacagctaaaataacacctagaagtgcggttcttctctactccatataaccaaggagtggagatgcatgtttgttgggcacctactacaagtagtcctctgaaggtataacatccatcagcttccacatctgtaaataagagatgaggttatttatagatgtggaagctaaagctccgagagaaggtgtcttgcccaatatcttgctggcaagtgctggcacaaccagatatgggaatctcttgtttgactccaaaatcaacgggctatccaaataccagagcagcctctctgcaaagtcctttctccatcagttcatttattgattaatggaatcattccagatgtttactgagcatctactgtgtgcctcagcatgggtgttggtgctgggaattgagggtgagtaatttatatggtccctgtcctcgtggagccacacacctctcttgccaaggccaggaacagacagaaaaccttgttacttgtttttcttctgtattgtttttttcatttttaaattcccttttatctgcattcccctcccactagcccataggaaatggttgtcatgtgtcaaccgtatattgttttgtttgggtttgtttttgcttttgcttttagagatcgggactcactctgtcatccaggttggagtgcagtggcatgatcatggctcattgcaacctaaaactcctgggctcaagtgaaccttctgcctcggcctcccaaaatgttgggattacaggtgtgagccactgcgcccggcctgtatattgctttgtttgtatgagttcttgaaaactgtgtttggtgttttgtgtgcactttaaaacttgcatatatggtttgtgttatacatcacattctatttatttttctctaagatccatccacgttgctgtgggtacacccagcctgctgcttgtaatagctgcacagttgttcacgatgacacaagtcccctttccactgtccacccgctatgtggtcacccagaagacctccaactcccaccaccacaatgaatgcatccacgagcatcctcccatgtgtctgcttatgagccagtgtgatgattttttaaaaaaacatttcctgcaggttcagaattgacacatcacagagtatgttgcacttaatttaactaagcacacccaagtctccctacagatgtctgttccaggctgcatctcaccagcagtgcttgagagttcctacagctccacatcccagccagcatttggtattatccagatatgtaggttttgacagtctaacacgtacaaggtaacatctcagtatatttaaatttgcatttctctgattactaatgagtctgagactctcttcatatgcttattgttctcttgtataaatatcacctgtgcacatagtggcccatttttctatcaggattcctgtttttttcttgatgatttgcaggattcctttgtataatgcagattttaagtcccttgtggattttagacattgcaaatatcttcttctgctttgtcacctacctgttaactttgcctatggtgtcctttattaagcagaaatctttttaaagtgatcaagataatctatttttggctgtatagtttgtgcttttaaagtttttgtttgagtcctcccctgcccctaagttgcaaacagttttgtttattaattttatatttttattttttactttaggtctttaaccaattgtgtgtgtgtgtgtgtgtgtgtgtgtgtgtgtgtgtgtgtgtgatttggtagggagccaacttcattcattccctatagctggctagttttctgaaaactacctatgaaataacttgtcctttccccagctgatctgtgggccacctttgtcatatgaagcctcttgcactccccactctgctccattgggcttcttgtgcttatgtcactgtggtcctgtttttattagcatggctttatagtgagctttagtgcctgtagcccttgtctctcttctttgttcttttttagggcacacttggctatttgtggacctttaatcctctctacaaactttttagtaagtttgttatgggacagtttctcttcccttgcactcatttcctaatcctgatcaccagtttgccaccaaagcctacccacagctcctctacccagtgaaacccctgaggaatgttgccatggttaatactaagtgtcaacttgattggactgaaggatgcaaagtattgctcctgggtgtgactgtgagggtgttgccaaaggagattaacaattgagtcagtggactgggagaagcagacccaccctcagtgtgggtgggcaccatccaatcaaccaccagtgtggctgaaatagagcaggcagaagaaggtgggagaagctgacttgctgagtcttctggcctccatctttcttccatgctagatgcttcctgccctggaacatcggactccaagttctttggcttttggactcttgggcttacaccagtggctctcaggtgtttgcccacagactgaagcctgcactgtaagctactctacgtttgaggttttgggacttggactgagccactactggcttccttcctcttcaatttgcagacagcctgttgtgggacttcaccttgtgattgcgtgagtcaattctccttaataaactccctttcatatatacctctatcctattagttctgtccccctgaggaaccctgactaatacaaatgtggacagacaggtccctggaaagaaacctggggccaatcttccaatcagctggaaagccaaggaaagcaatttccctacaaaaatgagtgagacaggtattttgatgttattatgtttgtttgtttgtttgttaaacaaacgggatatgttacaatgtctggagatatttttgactgtcataactccaggggagagggagagtggttgtcctggcatctagtgggtagaggccagggatggtgccaagcaccatgcatggcccaggacagccccaactgtaaagaattctcctgccccaaatctcaacagtggcaagattgtgaaaccctgcatgagttagatggaaggcaaaggtgtttcccagtctggaaatgccattcttcaaccaaccattaataaacacctactatgtaccaagcattactcttgacactggagctacagtgtaaataaaatagacagtactgcgctcacggacttatattcttgtgggagatacagttaataatcaagtaaataagtcattctgcttgtgataaacgcaatgaaaaaaagtaaatggaagcgatagagcctaactgagagagacatcagcaactttagatagagtagtcagggaaggcttcctggaggaggcaatatgtctaagctgagaacctgtgggtaggaaaagccaaccatgtgaagttctgaggaaggaggtacaggcaagggaacagcacaagcaagggtcctaaggtgggaatgagcttgatgtgttctaagaacagatggatgccaagaccaagccatgcattgcccggttgggattttattctcaaggttaagggaggagtttgagttttttctaattgtgatgggaagccatggtagtgttttaagcaaagaagtcccatgcactgatatgttttgaggcgatggctccagctgctggtgtgcactatgaagtatttgaggataaaaaatggcggcaggaaaacccacgataagatttctccaattgtccagggcaaaggtaatgagatttggactcgatgatagtggcaaggatggctgggcagtttcacagccacaagtctctgatgggagactggtatctagtgggtgggggccggggatgctgctaaaccccatgcaatgctcggcacagccccccactataaagaattcttggccaggcatggtggctcatgcctgcaatcccagcactttgggaggctgaggtgggcaggtcatctgaggtcaggagtttgagactaacctggccaacatggtgaaaccctgtctctactaaaaatacaaatagccaggtgtggtggcgcatgcctgtagtcccagctattcaggaggctgaggcaggagaattccttgaacctgggaagtggaggctgcagtgaaccaagattgcgccactgcactccagtctgggtgacagagcaagactctgtctcaaaaaaaaaaaaaaaaaaaaaaaaaaaattccagcccaaatgtcaatagtggcaagattgagaaaccttagattaattaaatggaaagcaaaggtccccaagcccaaggccagtgctagatattccacatcactcagattcttccccactagtggcccgatatttacaaagtgtggctccagattcagataaagaacatctgggtatgcctggagcttgcaagtgcaggcagtgggaatggctctgtcacttttcagctaacagccctgttgtgactacttgtccatttatttactcaaccaggattcagtgcaaaatgactcagatggcagtgtgacctgtggctcagaggaaggattctggagtcagaatggtgctattacttacttgcagtgaccttgggcaagtgccctaacctctctgagcctcaattttctcatctgaaatacagggtggtaataaaaagagcacttgctttatagggttattataaggaatttgtagaaagcactcagtcatcaccagctctcattgtctggtaactgcaggttacctaagggcaggagctggtctgtcttgctcatctcatataacagaatgcttaaataatagagacttaaagaatacagatacttacttatctcacataaaaagttaagaggagggtggcatgaaagttgattcagcagctcaaccctgttattaaggacccaggtttcttccacccttttgttctgcctccctatgtgtatgggcttttcatgcccaggcttactgcctcattgctacaaaatggctgctgttatgccaggcatcaatcttcataaaatcatattcaaaggcaggaaggaggaggtgacaaggatggccaaaataactctcgcttctctcactctctctctctttttttgtaatcccgccacccactatcaacttcccctaccatctcattggccagaacagggtcatatagccacccctaggctgatcactagcaaagggaacaggattcaccccatagggtgagattattcctgtattaacaaaattcaagttcctttaataaggaagaaattaagacagaagttgggtgggcagccacagtgtccaccatactgttcaccagtggccagcacaatccctattacaaagtaacgtttgacaaatgtttttgaatgaataaataaaccctcttatttgagggcatataagaagcttatggaacagtttggaggtttctcaagaaactaaaaattgagctaccatatgacctagcaataccattgctggatatatacttcccaaaaagggaaattagtatatcaaagaaatatacactcttatatttattgcagcactgtttacaatggctaagatttggaagtaacctaagcatccatcaacagatgaatgaataaagacaatgtagtacatatacacaatggagtactattcagccataaaaaagaatgagatcctgtcatttgcaacaacatgggtggaactggagagcattatgttaagtgaaataagcaggtacagaaaggcaaacatcacatgttctcactcattggtgggatttaaacatcaaaacaattgaactcatggacagagagagtagaaggatggttgccagaggctgggaagggtagtgagggcttggggagggggaggtggggatggttaatggataaaaatatagaaagaatgaataagacctactatttgatagcacaagaggatgactatagtcaataataacttaagtgaacattttaaaataaagaatgcagttggattgtaactcaaaagccaaatgcttgaggggatggatgccctatcctccataatgtgctcatttcactttgcatgcctctatcaaaacatctcatgtactccataaatacatacacctactatgtacccacaaaaattaaaaataaaacaaatgaagaagcttatgaataagacacatctctgatctcaagggtatccagttctattcgttgggataaggtatacagaaataaattcgacaatgatctctcttattggcccctccccatctccaaggctttgatgaggaaaccccctgagatcatttaagatctcagtatctcaactgacatttgtatatatcttaaaaaaaaaaaaagaatggctattctgcaaaagttactggggggaaaaaaaaacaaaaaaaaaccagaaatggctggtacgtaagcagtgttccagccctctaggcaatctctattccaaatagcagagggcatgagctggtggactgtggacttgtgttgtttggccatgagagtattttttaaaattgtaatcaacagtgaaacatcagaagagtttacataaaatatggatttgcagcgtcacttgaaaaattaaaggatctgattaacactggaaccacattcttgcatggcatggcaattatggctgacacagagttgtggctgcccttgagtcacagctgctcctttaaagcaggacatgctctcctgtttgctacagtctccacctttccctaaagcccctcgctcaagtcatttctttttttttttttttttttttttttttttgagacggagtcttattctgtcacccaggctggagtgcagtggtgtgatctcagctcactgcaacctccacctcctgggctcaagtgattctcctgtcttatcctcccaagtagctgggattacaggcacatgccaccaagcctggctaattttgtatttttagtagagacagggttttaccatgttggtcaggctgttctcaaactcctgacctcaagtgatccaccctccttggtctcccaaagtgctgggattacaggcgtgagccactgtgcccggcctcactcttcttatttatgttacctgcatggtcctggtataaatgtgagtctgtgcttcttgcatgcaaaggccaagggactccaaagaggctatcttgcctctctctgtttccccagactctgcacagtgcatgatttagaattttcactttctgaatgaaaagactgtaagttatttgaaggcacatagccttcatttctaacaattttctgccatcataagaggagagactacctagaaataaagccattagaggggaaagttgggtgcccctggattttccagttatgtgagctcataaattctttttacctaagccaagttgagttgtcattgtgtcatctacatccaaaagagctcaactgatataatcctctttccactgacgagaaggttataatctacttttttttttctgagacaaggtttcactctgtcacccaggctggagtacagtgacatcatcacggctcactgcagccttgacctcctgggctcaagcaatcctcccacctcagcctcctgagtagctgggatcacaggcatacaccactatgcctggaaaatttttgtatttttataataatagagatgcagtttcaccatattgcccaggttggtcttaaactcctgggctcaagaaatctgctcacctcagcttcccaaagtgctgagattgcaggcatgagccactgcagttgtaatctacttgagccctatatatacttatatatacttataggaaacaaggcaaaaagagtaataaaaagcagaatattctatagagaagggacaccccatcccaatgagaacttaagtacaggtcagttgtggtggcacacatctgtaatcccaacactttgggaggccaaagtgggcggatggctgagcccactttttattaagccccgggcaatatggtgaaacaccatctctacaaaaaatcagaaattagtcaggtgtggtggtgtgcacctgtagtcccagctacgtggaaggctgaggtgggaggatcgcttgagcccaggaggctgagattgcagtgagcggagattgcaccactgtactcctgcctgggtgacagaacaagactctgtctcaaaaaaataaaaataaaataaaataaaataaaatatctcaagtacagccatctcatttaaagatagggaaataaaaagctgatttaggggaacaggatcccagtggtcagccagtgagtggggaggcaagtaccaacacccgagcacccaacttctaggccaaggccctctgaaaatgttttctgctcaatcctctctgcagacatcttctgctgagaagtgttcagatttttctcagaggctgagtgaggtcaagtcaacccaattcgtccatgtaaatacaagtgatataccctttaaaaggtgctggcaagagacgtgttcacttgaagtcaagcttttttctttctcttggactccataatacctgtcatcatttatttataatcccactgagtatcctacttaggttttttggcacatctgggcactgagcaaggctaattaatcccccttcccccatgaattcctgggtaagaataattgctttatgagggtggttataggggtacccgaagcctcaaggaaaatcattacatctctgagtggatgtcgctcaggacaacgggtctttgctgtggccctgcccagacaaagcaccagcagcctgagggatttttccatcagcttggactccagtcttctcacccatctctcttttgtcacaccccaaaataataatcataatcataattaaaaacaggataatggtggaatcttcctctcagggttgctgaaagaagtaaaaagataatgcaaataaagtgtttcacaccttgcctaaaagtagtaagtactcattaagggaagagtagtagcaatgctaacaatgacaatatcagctaacattgattgagcacttcctgtataccaggccctgttctaaatgctttgcatgcgtctgatctcatttaagattctttccagctctttcactctcaggctgaatattctgatataaacaagacctattaaatgttagatgatacttgagtgaacagatgtctgattctagtgcctgttctattttcccctagcctgattgtctttattaagccctgggtttcctggcccaagttcctggtaagtggatgaacttggttttcttttctttcttcattttcattttctaaattaaataaaatttgttttagagttggagtctatgttgcccaggctggccttgcactcttgggttcaaatggtcctcccacctctgcctctcaagtatctggaattataggcacatacccagtgtgcctgactgagcctggttttctgaccaacccaaacatttacccatctctccttcctttcttttgcctatcacctatccatcaacctaatcatcccctcatccatctatatactcagcaaccaaattattcaactacatacccacccatccatctacccactcactcatctattcgttcactcacccacttactcatccatctttctttccattcattcatatattctatccattatccatcttgctaccttctcatccacctacttatccatttatccatctatccacccatccgtacaccatctgtctttccactcatccatctatctgcccattcacccacccacacaactactccctcatccaccccaaatattcatgcatctatccaccactcactcgccagtcatccatccgtccacccttctaatctatccatgtatctatctgcccacccagccatctcaacccatctaccacctaacatttgcagtgatgctctgtgctaatccctagcttgttgttttgggctccctccctgggaggaaaggtgagtgccatcagagggtccccacagaggaagacagataaaccagtgagcctctttgtggcctggaccttcaaagccactgacttccagggtctgtggccaaacaatgatgaaatgcacatggaaaatgagaagccctgcaattacatggaaagagacagaggctcagccctcccaatgttacagctgaatgcagcattccaggcatccctaccaagccactccaccatagggtggagatggatggaggcacatgcttccagcagagcaattagaggtaaactaatatctctttcccacagaggagcctgggaactccaagacgcaatggaaaggaggcgagtcagcaaaaggaggaaatcaaagccacagagatcaagagctaattaactgatcctcctaagataatgtttcattaaaatccagttcttctgccctgtggggactgatatctctcctactgcctctccattgcccttttccacccattcctgatctcatctgcctccgctctgatctttccccaagtcttctccctcctccaatccaacctccccccagctactagggtagacttttaaaggcacaagtctgaccatgtcactccctatttataagtcttcaccactcattgcctgagacaaagggcaaactcccaagataaggcaaaggccgttcattcatttaacacagatttcctcagtgcctctcctctctcacaagcttggggatggtaggacacagaaacaagtttctgacccttgccctgtttctccagcttctttacccaccactcctttccacattcctgcatttcagcaaaaactttccaacctccggcttagtgatagccagtccctagggaaactgttgttagtatccatgctttgctcagctcacttccacattgactctgggcttggccttgtgacttgcatttaccagtggaatgtggtggcagtaatgccagttccaggcctaagccttgaaagggtcgggaagcttctgcttttgtgctcttgggagctctgaaccactgtgtaggcagccaggctaccctgctggaagggaccatgtggaaaaaccacatggaaagtgagaagccctgcaattacatggaaagagaccagaggctcagccctcccaatgttacagctgaatgcagccttccagccatacctaccaaggcaccaggcatatgaatgaagtcgtcgtggacgtcccagcctcacctaacatctgactgcagctgcatgagagacccccaagtgagagcagcagcagaaccatccaactataagccccattctctttctattagttcttatgagagctattcattctcatgagctttttagaaagtgccaacctggctgggcactgtggttcacgcctgtaatcccagcactttgggaggctaagattggtggatcacctgaggtcaggagtttgagaccagcctgaccaacatggtgaaaccccgtctctactaaaaaaattacaaaaattagccaagcgtgttggcaggcacctgtaattccagctactcaggaggctgaggcaggagaattgcttgaacccaggaggtggaggttgcagtgagccaagatcatgctgctagactccagcctgggcaacagagtgagattccatctcaaaacacaaaccaaaagcgccaatccacaaagacatgagaaataataaaatagttttgtgttaagtcactacatcttggagttgtttgttacacagcacgagatatctgatacagaggccttgctcctgctatttccacagcttagaatgtttctccaaccccagccatcttctttaccccacatggtgaactcctattcacctttcagagcccatattcagcatcaccttccctgcctcccatagtctgagttaatgtctctttcctctgggaaactgtatgagactaacctacaatacttatttttctgtttcttccgctggctatgaatgacaatatttactcatgtaatgctcacaagaaccctatgagggagacggtattattatccattatcctattttacaggtgaataagctggggcacagagaaatgcccccaaatcaccctggtattaagtggctcagcagagatttaagcccactcagaacccaagctcttgtccactgtggcttcttagtaaagtataaaaaaggtatgacatttattggtctcatttaacacaaaatccagaagtaggtgatgccaggacctgtctcagcaacagcctagctatctcagggtccttgtttgatttctgtgagagtctcttgtccacatcgtcacaaaacggctgccatgctcagcctctcacatgacaactcccagagagggaggaagaaggaacatctcccatatttcagaagctccccactgattttcccagccatctcattggtcagtactggatcacatgaccaccactagcccagttactggcaaggggaacctgatatccatgtttggcttggccctgtcttgatttggaggttgggcccattttcttgagcacaaggctgcctaatatctgaagaaagccagggtttcttctagtgaggaagttggccaatcaattagtgtctcttctgcagtggtcagctcttagaacacctgaaataaagtcacatacagaccctgttcatcccaaggatccagatgtcccaaaggtcaatctcccagatttgcataatgtgagttgtcttagtccatttgtgttgctataaaggaatacctaaggctgcataatttatagagaaaagaggcttatttggctcaatgttctgcaggctatacaagatgtggcactggcatctgcttctggtgagggcctcaggctgcttccactcatgctgaaaggggaagggcagcccgtgtgtgcagagacctcatggcaagagaggaagcaagaaagaggcaagggaggcaccggctcttttcaacaaccagctcttgcaggaactactagagtgagaactcacttcttaccatggggagggcaccaggcctttcatgagggatcaactcccatgacccaaacccctcccattagaccacacctccaacattgggaatcaaatttcaacatgaggtttgcaaaggtcaaacatcctaactatagcatgggtgcacctgccttgtctctcccaggccactgtgaagctccacggaaggtcctggggcaataagatagtacactgccagctcttccccaactcatcaccctcccatccttgcagacacacactctgaaccatgtctcaaatggccatgactcccaaatgccagaccaataacgtgtttgcattttcactggtccatcatgaaatgaatgagaaaaaacagggacaatggaatgagatttgtataaagctaaattgattccatttaaaggatgatggtgatttactttcctacttaaactctctcatggcttcccagggcacttagcataaagcccagcctcctcttcctgacaaggtctgctcccagagtggctcctgccaccccctcactcagccacagccttcctgggatgctctctttctccagcacaccaaaccccttgcctctttagagttctttggatttgtagtctctttctcctggaatgttcttcctctagttctttacaaagctgcgatctctcatcttgatctcaactcctatcgccacctgcctggagacttttcctgactgcctccaaggccacaggcacatccatctccgtgtcagcatccatcacctcctgctgtttgcttgtcctcagcatctgacactgtatttatgctgatttgtttctttactggatggcctctgctgcccaaatgtgaaatctatgagggcagagaccttgcccggactagtgcagtcccttcctccctggtctccagcttcccagccctcagcatgcacggtgagatggatcctcctagaatacaagttaaaccatggcccttctctgcccagagccttccgtggctgctggccacactgcctccctcctgctcctagaacctgccccagagcttcccatcttcacatttgccattgcatctctccagaacattctttcctcagatgccccagtggtttgctcctctcatttccatcgagtttctgttcaaagctcccccagggaggccattcctgctcactctctttcaaatctcacttcccatctcctgactcctttattcttctccaaagcacttatctccatttgaactgctttatattttacttatttgcctcatttcttacagtttctcccatgagaatgtcagcgccgtgaagacagggatatatcatttttttggtctgtgttactcactgccgggtcctgttgtctagaacagtgcctggtacaatgagaggtgctcaaaatatttacttaaaaagtgcataacagctttcttgaggtataattcatatatcataaaatttgcccacatgaccaggaacagcagctcacacctataatcttagcactttgcgaggctgaggagggaggatcatttgagcccaggagtttgagaccagcctgggcaacatggcaaaacccccctctatcaaaatatacaaaaacaaaaattagccaggcaggcatggtggctcaggcctgtagtcccagctactcaggaggctgaggtgggaggatagctagagcctgagaggcagaggttgcagtgagctgaaatcacaccactgcactccagcctgggtgacaaagtgtgacccctgtctcaaaaaaaaaaaaaaaaattgcccatttactagtacattcacagaatttcacaaccatcacagtgatccattttagtaggtttcattagtggtcactccctacttctccctatttccccatccctggaaaccactagccaacttcatgtctctatagatttgcctattctggacatttcatgtacattcagtcctataataagtggccttttgtgactggcttttttctcttagcataatattttcaaggctcatttgtgttgtagcatatgtcagtacttgattcctttttattgacaaatattattccattggaatgggggatacatcacattttgcttatccatttatcagttggtggacatctggattgtttccaccttttgggctattcaatatagacttttgagtgagtggttgtgttaattccaatataaaacctacctttctgctttaggggtattaaaatatcctttcataagctgacagtaggagtaaatgtatttcttaatgtccttacctggcaaaataaaacactgggtctttctgttgactttaatggtacaagggtatgaaaggccaaagtcttggagctgcagatcactaggacctgggttataacaaaggctaggtcagcggctcagggaagccaagccctgtccctctggccctgccatgtggttcagaccatgactggtaaacaagagagcataacgcagcacttctcaaactggggtatggtacccctctgagggcacatactgatgtcctgaagagaaagactacatttcccagcctcctgtctgtccagcaagctgtggtcatgtgattgagttctgaccaatgggatgaatgcaggggtttttctcttctttgcttcaccctctttcctgctgggtggaatgtggacaaaatggctggagcttaagcagccataacggcccctgaggtggaaaccactggttacagatgctagagggtccagaaaggagggaacctcatgattgtggagatgtcacaccacctctggcctcccgtatctgcttgaaagagaaaaaaaaaatgtggccatgcatggtggctcatgcctgtaatcccagcactttgggaggccgaggtgggcagatcacctgaggtcaggaattcaagaccagcctggccaacatggtgaaaccccgtctctactaaaaatacaaaaattagctgggtgtagtggcacatgcccataatcccagctactcaggaggctgaggtaggagaatcccttgaatccgggaggcggaggttgcagtgagctgagatctcaccactgcactccagcctgggagacagagcaagactccatctcaaaaaaaaaaaaaaaaaaaaacctgtggtattgaatgaaagcatgttaatatataacatgttgctatgttactttgagaagtctgtcactcactgccaaatcccatcccacctgatgtgcctccatgacctcctcacagatgaggaaactgacgtgaggcacatctgccctgggatattatttctatacaaagatttgagagaaaaaaccaaatttctctttttatttctcccaaggcttatttaatccatttcaccccttcttttttattttaacatgaatgcatgcattctggtgaaggatggacagcatccggtgaattttaaagagagcttttgtgttgtctgcttgttaccagggtctaccccaaagtcctctaatgcggcagtccccaacctttttggcaccagggactgatttcatagaagacaattcttccagcgacccaggggtgggggtgggaggtatggtttcaggatggttcaagtgcattacgtttattgtgcactttatttatattattattacattgtttgaaatagtgagataattatacaactcaccataatgtagaatcagtgggagccctgagcttgttttccttcagctagatggtcccatctgggggtgatgggagacagtgatagatgaccaggcattagattctcataaggagtgcgaaacctagattcctcgcctgtgcagttcacaatagggttcgccctcctatgagaatctaatggtgccactgatctgacaggaggtggagctcaggcagtaatgtgagtgatggggagtggctgtaaatgtagatgaagctttgctcactcactcgccattcacctcctgttgtgcagcccatttcttaataggccaaggacctatactgatccgtggcccaggggttgtggacccctgctctaatgggtacccagtccctctgctgccagccggaggatcactgaaagaaagatcctgaacactgtctcaggcagcagagggtcctgcatttgaattccaggtctattacctcttagccacacgttctcgggcaaaccacttcacctctctgaccctcagtttctttctctgtaaaaacggggatactcatctatgccttggagggtgggtaaaggtgtgactcagttctgtctgtgagaggcctgggcccacagcaagggacagagtagatgctctgtgctctcctgtcccaagagctgacctcaccattccaggcacggccaatgccctccatcagaatcacactcagaggcagttccacaaacaaagatggtttaatagatttcagcatgtttccacttgacaatgttatacgaaaatagaatctttattaaaatagcaaggcataacaatcactgctactcaggaaacactgtgtttattctttttaatcatcaaaatcaatgactttgggcaagacctgtgaaatctcagagcctgtttctccatctggagaacaggcaggtagggcattgccagctccctgtgagtgggggccactggtgggaggagatggccctggtcgcccatgggatgagaaacttactcctgcttctgtccctggagaaggtcagggagatgccagtgtggccttaaggcaattctaacacttgcttatctcgttttgtaacagagaagagagagctctcagccttggccacaccagcatggagcccccttccccagcgaatttatttttcatggtcactttctatttttggcagtgagtgatacatgttatccactattggcagcaattggggggaaaaaaagttcattttaaaaacaaagtttaggccgggcatggtggctcatgcctgtaatcctagcactttgggaggcccaggcaggcaaatcacgaggtcaggagttcgagaccagcctgaccaacatggggaaaccccgtctctactaaaaatacaaaaatcagttgggcgtggtggtgtgcgcctgtaatctcagctacttgggaagctgaggcagaagcattgcttaaacccaggaggtggaggttgtggtgagctgagatcgtgccattgcactccagcctgggcaataagcgtgaaactccgtctcaaaaaaaaaaaaaaaagtttaaaaagcgagtctgtttaaaggagaatatttggtaaacaacaatattaaaatatagcaaataatagtaacaataatcacaatggtaaggaaacacttcattagatcaacttaagagtattttattcttggctgggcgcggtggctcacacctgtaatcccagcactttgggaggccgaggcgggcagatcacgagctcaggagatcaagaccatcctggctaatacggtgaaatcccatctctactaaaaatccaaaaattagccgggtgtggtggcgggtgcctgtagtcccagctactcaggaggctgaggcaggagaatggtgtgaacacgggaggcagagcttgcagtgagccgagatcacgccactgcactctagcctgggcagcagagcgagactccatctcaaaaaaaaaaaaaaaaaaagagtatttcattcttgccactgagcttaaaaagaaagaaagaaagaaagagtattcctaacatatgtccagtaattttgattcttaagcaagggatgaagaaatacaatggcatccaggtaacttcctaactagcgcatagcaggtagctaacccactcatctctccctcttttctttatagcttctattttttttaaagagaaaaataacgattaaaacaagggcaggtttaaataatcgtctcctgagctgcacttcagtatctcaggtaacagctggagctgcctggtgggagcacatcttttccttgagtgtaattcactaatgactgtggttccaaggaggtgcgacctttaaagggaattggcccttctttgaaggcaggtgagaatctagtctcagtgacaacccagcctgatttggaaggggggagtcataagggttttcgcccagcacaccagggttgcagcctgcgcaagaccttccatagctatttctgccggcttgcttccttcccttcccagccacgatgaggcagctgagggttgccacggaaaccggctctgtcctcccactggaggctgccagctctgatttcctgcagagttaagaaggaggcggcagtgggggtcacccaggcgtgaagatgggtttccctggggatatcctgcctcctgccaatcacagcgtctctctgggaatcctgggggtgcctggaggctgaggcccagggaagcccccaaaccccagtgctgctctgagaagagactagcctctgggacattcagaggtctggggttcttttatctccctccagctaaagctagagggacctcattatgtgtcttacaagatgtacccaagtttaggtgcctctggctctgtcagctcctgaagtcgagaagaattgtcccatcaccagtccccttgagcccaaagaacaggagttgctcatccagcatttgctcctgggacagtaaatctgcctgcagagttctacagcttatgagctatgtggccccaggcaagtcacctcacctctcagttttctcatctatgaagtgggcacaaccctccttctcttcatagagatgctgtgaggagtagacatactgtctgtagggtctctcgcaggcatttaaagggtctcaataaacaggactttatattaataaaaatagcatcataaaaaaggtttgcaggccatttttctctttaagctgttttttattttaattaattatttatttattgagacagagtcttgctctgtcgcccaggctggagtgccgtggcgcagtctcagttcactgcaacctccacctcctgggttcaagcaattctggtgcctcagcctcctgaatagctgggattacaggcacgcaccgccacacctgactaatttttttatgtttagtagagacggggtttcgccatgttggccaggctggtcttgaactcccgacctcaagtgatccgcccacctcggcctcccaaagtgctgggattacaggcaagccggggcaaaggcaaattttcatcactgatacatttgttcaaagggtggtgcactcaggctgggttggaccaattagctggtccccaccacctcttacaatgtcacttctaagagttagaacagggtctcacactcagatgccttcaggtccaggaggcgctgtgaatgcagaagcagacccggtcagaaccctggtgaagccgagagcacatgtcctgcataagggaggcggctgccactcagctctggccaagagttacccttgggaatgtgagcccagtgtggccagatataccaagttttcaagagaagctggacattttgaatgaactctcccaaagatgataacaactaaggcatttttttaagtgaagtccaaacaaaacacgtctgcagactggatcgtgatcacagttggggcttctgcactagaatgcatgaaatcggcaccttcttttttggcttgatcagtctaaggagtcctggctggctccttccagccatcttgtctgggctgtgtcttccttagctccctacctgagtgctgacactgagaaagcccatcccatctggtgcctgtcactctagaacagagaactccactcctcagagcccagtgtttggagggtgcccctgttctgcaccgggaatgcatcagccttgggggaagctctcctgcattttctcaagtagtgtgagcaatggggcaatctggcaaatggggccccagggaagcagatcttctaagggactcctttggttttagctagtttaaggattattgggggactgactgctgaatgacatcaatggacacaaaggacatcctgagtggcctttctgtggccagcatccgctttgactggataaggcccgggccatgctagctcataagaactaggaaggtgacacctccgggagttgggggcagagcagtgaagactcctagttctgccttatctgaatagcatttgtggatatcacgaggtgagagtaacgaggtgaattgggagcagacaaagcctgattttggaaagaaaactttgcagtggataatccatagagctttcaatgtcttttctttgttcaccctcttagcttttccctcccctggacccagccttctgggagaaaagcagggaagtggtaatgctagcacctgcacccgggccaactgtgcacacagaaagctgggaggctggggcaggctggggcaggctgggcagaggcgagcacgtggatccatctgctccctgtgtcatgggcggatgcggtagcggacgggcacgtcgtgttccggctgcatcagaccgaagccgtacctgctgaggtcaaactcagggatctccacatctgcgttgatcagctccaagtccaagtgcaccagcacaaggaacacaaatctgcagagagatggcatggaaggtgtgaaggagaggagtagggcagggggttatcgggaacaaggcaggggagccatggctgcctcctaagtctgactccaactttgagtaaagtgaggagaggagtgaggaagtagaagaaacgcatttgctgctcaccacatttgccagccccctgtaaggttaggcaggcccgtggatgagttctggtgaatgggctgtgtgcagaagtggcctgtgtcactcctgtgtcaaagcattcgcgagccagtgtgtggctctccagctgtccctcctgcctggcagccatgcaggcttcacattgagacggtggagccgaaagagggaaagagcctggcccgagtctgtgcacagagtggggaagccctccaatcccacagctgataccgtgtgagtggaactacacctctgttggtaaaagccactgagactcggcaggtgcagagctgagcctgtgctgattaatacggcgactcctctggatcctccagcccacacactttgccgcctttccccacactcctggaaccctcactgtctatcttggccaggactgctgctaacccttaggtgtctttgtgagattagaaacaggcatcgctctcaagacattttactgccatctctgagaaaattgtcctaaatagaccaactttgcaagaacaagcactctctactgccatcttctgggaaaactgtcataataactattcgcagctgccatgcctatgatgtaatcagtgcccccataaatgtggaggcagccctacgggggatgtcaacggttgctgcctccctgcctcatcttaccaatgcccatgttcgtaagggtcaggagaatatcttatgactcttttcccaccactattccctaccccaacccaggcgcccgatgcagcactgagcacatggtggggattcttttgtctcactgaaggagtgaagaagagggcagatgaggagagaggggagttaacactctggacagatctgggctgtgccgcttatgggaatgtggccctcgccaagttcttacccactctgggtctcagttctcccatctggtcaaagaggggaaaggcatgttgagtctcttccagctctgaggctgtaggaaactagagggtgagtttctaagggatggcggttttgtgcccacccctggatttgaactcctgcacctccacttcctgggaacacggcaaatgatctgacctgcctagactcggttttagatggaccagcagggttgtcatgacaattcagtgagataaaaataacaacaaattagctaatttattggaacactgtgcgctaggcaccatctaagcatttagtacccgctatctctttttatctgtccaaaaacttgatgaggtaggaatgccagtcggttctgctctaacacttgttttgaacaggtgaatttgttccaataggattgatatattagggcaccatttgaatataatgcaagtttcacatttgctcacgtgcaatttcacttgtgagaaacatgaggtgaagacgaaagactgcacccagctgaacctgggtgtgcagaaatccataaaatatacacatgcacacaactaagcatcgatctacagccacagttattacagcacttacatagttcttagccaggtaacatgtataaaactttactaccattttttttactgggttcttctctctctctcttttttttttattatgtcactgatgaggtttttgagtgttggccccagtcccccttttccctcaatccctgcagttttttctttctttctttcttttttttttttttttttttttctggagacagagtctcactctgtcgcccaggctggagtgcaacggcgcaatcttggctcactgcaatctccacctcctgggttcaagagattctcctgcctcagcctcctgagtagttgggattacaggcacgctccaccacacccggccaatttttgtatttttagtagagacggggtttcaccatgttggctaggctggtctccaactcctggcctcaaatgatctgcccacctcggcctcccaaagtgctgggattacaggcgtgaatccctgcagtttttgttgcatgatttcacacagcaaggtgattttaaggaatgcatatgagctgtattatgttcataattgactccattttcttgaggaaactgaggctaaaggtttatgtaacgtgcccactcacttagcacaatgcatgcacaataatgatattaacaattatggtaataattaacatttttcaaatgcctacaatgagccagacagtgggttaagaacttagaaagatccaattcatttatcctgacactcctggggtatagttataatcagaaccctcattttacagttgaggaaacaggctcagaaggtaacccagcttatgattgcacaggggctggacaggaggacagggcagatgtcataacccctggtccaatctgtttgtgatcctggtggccaaagctcctggggttcaagggagataatttatgaggctctcggccccacaggtattaaaataaccaagtgggaacagtgaagttcggccagttcctaacatgaagttctgaacatgcggcagcagctgcagacgggtagctacggtcagctgaaaggaatgtccagtatttggaatctggacaccagtcttggagggaagaacctgctgccagatctgattatttcaaaagaaatccgaaatctggcttttttacacgagctcttctgatttataaaagcacacagttgtaaaaccacaaataagagatggctcacgggctgtccatgtgaagcctctgccaaaccattctcctggctgagccctcagtcccaggagagaagggcgcctgccaaccaggggatcaggagccaccctggccctgccctggccccccactcactgtttgatgctgttgaccgcataactcctccccaggcagtgattgtgccccgccccccagggcatgttgtaattcttcagccgtttcccatccttgtaaaagtctttcttctctgatccgtcagggttcaggaatcggttgtatttaaatacctgaaataggaagaaggtccttttctgaccccattcccagaacaagctcacaccaagaaaaatgtatgaggatgttcatgacagtcatgtttataagagggaaaaactggaaaccatatacaggtcaattgataggggattggttaaaaaattatggcaaaaggtttgtgtgtactgacatggaaagaatttctacaattggttgttgagtgaaaaaagcaagtttcagaatagtatatattgcatgatcctatacacacaccaatcttttcatggcatgtgaatgtgttgtgtgtatgcctgtaaagccatgaaaacaattcgcaaggcacactccaaaccttggtcagagaactctgtagaactggagaagaagggaaatacatattttttacatttaagtatatatttctctgtatttctttatattctatgatatatattacttttgtaatgtaaaataaaagaaattaaaatattttttaaaaagaaaatgccaatttcctttggttacactgcacagtggtaaggcaagggttgtagctgagcacagagcttggcatggagtagctgccgactgaaagatgggtggaaggataggtgaatgaaccagtggatagactaagagatggaaatgtggatggaaagatggatgaatggagggatggatagatggatggatgggtagatggggtggatggatggatgggtagatgggtgaatgaatgggtagattgatgggtggatggatgaataaatggatgaatggacaaatggatggatggatgagtagatgggtggatagatggatggatgggtggataagtagaagaatgggtggatggacatatgagtgagtgggtagataaatgagtgggtggatggatggataaatgagtagatgattgaatggacagacggatggatagatggatggattcatgggtaggtgggtggatgaaagagtagcttcatgggtggatggatggatggatgggtggatggatagattaatggatgggtagatgggtgagtatgtggatggatggatggatgcatggatgcatgggtggatggatagattaatggatggatgggtgaatttgtgaatggatgaatggacagatggatgcatgggtagatgagtggatggatggatagatgagtggatgggtggctggatggataaatgaatgggtagatgggtggatgaaagggtaaattggtgggtggatggatgaatggatgggcggatggatagatgaatggataggtagataagtgagtgtgtggatggatggatgaatacatgaatagacagatgcatgagtagatgggcagatgaatgaatggatggatagatgagcatgtagtttagggtctgacacacagtaaacacccaatctgttagcaattgtgaaagtttacttcttctcaaagtctggggcaaggcaaaagtgttgagaaactgacattataacaatctgaaataaggaaaatggctgagctatcacaaagcactcagtgtgaatgaacatcccctcatgttctagggttcctcagagacccttgaacatgaggggatctgggtctgactccaagagaagctgtgaaaaaaggtaggagccaaagagatatcagaaggctggggagagagtggggccatcaatatctgcttatgcatgatcccatttaatcttcctatcaatctcatgaggcaggtgctattatgaggtccatttcacaggtgaggaagcaaacacagagaggtgaagcaatctgggcaatgtcacatagcaaacaaagagcagagccaggctgccactcagatctggctcatcccaaagtcactgattgttctcccacagaccccatatgaccaggcgcccctgccatttacctctgggtctgtgtagatttctgggtctctctgggggctcaggaaggggaagaggaggaggcggtcaccacgtcgcaggttgaattctcgcccgtctgccatgggcatggccaggtccaccacaacctcgcgggtgatgaagggggcagctgtaagcctgaggctctcactcagcacgctatctgcatggggcaggtgcaaggaagagtcagcgggctatcccttcacctgctcatatgccaaccccagctcttattttacagaggaagatgaagaggctcagagagggtgcctgcctcgcccacacagtcacatagcaaggtgaaaaaggacacacgatgacatgtggtctctgtggtccctcagagacgtttgaacatgagggtatccaggtctgaccccaagagaagttgtgagggaaggtgggagctagggagatatcagaaggctggggagagagtagggccatcaatctctgttcctgtctgcccggcatatatttctcttctggaaacgggcccctgattttcctctagggtccacccctctctcattctcaggggttagactgctgcttctatgctcaactcctgggatggggctgtgactggccaatcagagcatccctctgagccctgtgattggttcaggatggacacatgacccaaagaaagccaatgagacacagtcttgggactcttggtgggaacactgtaagagattcagagtctcacagagccaggaggaagtcagccttgagctgccaacagctactgccagcctgagactggagccaacccagtgggaaacagggctgagaggtggagaggaactgagtagtcctgacgacattgttaaagtgcatggatccacctgtgcctgaagccaatcctctgggctttttagtgacatgtctcaaagtaccttttcaccttagtcaattgaagttaggttttctgtcacttgacccctagctgaggctggagtatggagatgccaggtgtgtgaagataggaggcttagggagaccctaggtcggaggacacactgatggaccctggaagacaggagtccatgttggggagggctttgggggtccatgatgacgcagtcttaggggctatcttggagggtctgacgatctcaccaagcacaggtgtgctgtctagaaccttctgtgggagagtggtcgtctgcgagacaggctgctccgcttgccaaaggatactctcgagctctccgcggacagcagccagggcttcaggattcttgagaaggaagagcaggagccagaaggcagcgggacccatattcccctgcaaggagaagggcccctgttatgccattatgagggcagagctgactcgtctctgccagggacacagctcgggccaagacagaggggccagtaggcctgggttcccactgctgccaaacacccaggcatgaccagtgtctatctccagcctcaggacatggccaaaactgccctgtggcccaaaatacctacttcaaggccactcgtggcatccctgactgtgtgcaaagtcactaatcctaggtcacacaggtaatcttcatagctaatcagcaaaacagtgtcagtaataggaacagggtatatcagttaagactgttcacatctgagaatgatcacattgttggccccaattcttccccaatcgcagaatccacgctccttaccatgtgaatttgctgttcctcctattcaagagccagagcgtatttcccctgccctttgaatttatgctcagccgtggacttgctttggccaatagattgaggtggaattgaaggaacagccactctacgcctaagccgcgagagactttgtgtttccacttgctcggcaagcccactgatcccaagaggaggatgagagactcatggacagagctgagctgccccaatgagccagacccacagacccgtgagttaaataaatgctgatgggtgtatgccgctgatgagttgttatggatgtttgttatgcaacaatagctaactggtgtgatatctaaagatttgcttccaaatataatcattcttgatgtagtttgggaagcaaaaagttccctatatgctttgtatcttcaaattctatcagtcacttgaagaataaatgtgtgtgtgttgtgtacgtataaaacaaagccgcaatcatcattgatgactgaaagctatgaataaaaattatttaaacttcccaatagataaacacttaggaaaacgagtggaatttcttgcttcaaggcttcagtcttagctgaacattttcatacacattttagcctcagctctttggtatgtggctaaaatgtgtatatggcaccctttagtgatccagatatgggaagaataccaactaatctcaatttgggggaaggtttttgtctgccgtgactattctattcaatcataataatggaatattaaatcatcattaaatatcatgtttacccactaatttcattacagacataattacacatgggcaaaaggacatatgcacaaagataattattgcagtgctcatgtaatagaaaaatgctggaaacaatctcatgtctatcaataagagatcaatgagatcaatgaagatccatccattggatgatgtgatgcaggaagtcattaaaaagaagctggctctgtgtgtaccgatgtgggactgtagccaagacacacagaagcatgcaaacgcaaggtgcagggtggtggctcagcatgctgccatttgtgtgtttgtttaaagagaaatatacatgaagaagtacagaccatctctttttttttttgagacagggtcttgctctgtcacccagggtggaatgcagtggcacaatcatagctcactgcagcctcgacctcctaggctcaagtgatccttctgccttagcctcccaaggagctggggccacaggcatgtgctacccagctaggttttttttttttttttggtagagatggaggtctccctatgtttcccaggctgatctcaaactcctggcctcgagcagtcctcctgccacagcctcccaaagaagcacagaccatctctaagagacaccagaaacgggtaactgaggttaccttgggacagaagctgggaagacaagaggataaggaggaaggaggctgactttccttgcaaataccttttaaactgttcaaaattttttaatggacacactaattttaagtgaaacagaagccacccaggctggagtgcaatggcacgatcgtggctcactgcaacctccacctcctgggctcaagtgatcctcctacttcagcctcccaagtagctgatacaagcatgcaccaccatgcccggctaatctttctattttttgtaaagatgaggtctcactatgtttcccaggctgtatccaaatcatttctacagtgatgtacaatgtcatgagagatgctcatgttacaatattaaaccaaatagaaggttagattaaaacagctgcatgatcttaaccacagaagaaaaacctatggggaaaggctggaaagaaatgcaccatagcattagtgatggtgagatagattttgccttcctctttagtgcccgtgaggccaggaggaaccacactcctctgctcaatacttccatcacgcaggtgccattattaggccttttactgaaaaggaaaacgaagtactccccggtcactacccactgcccagcatatagtggaggctcactgatatttgtcaaataaacatctgcatccctttggattagaggtggagctccaagacagcctgggaggtgggctagaagatccctggactgagaccaggtagaggtgggttcaaatcccagctccccactttctgtgactgtggacaagtcacgtccccctttgggtctcaacactgggggtaacattgccacctcctgggtggacgcaagggtccagtgaggctgaatgcaagcaatcccacacgtgctgcgcccatagtaggtgctcagaagtggttactcctcccccactggcccctcccctggatttgaaaacaagtcgggggggcctccggccctttctgagagttccaccagcacctcaggtccagctgacacagcaaggtcacctgctgtccatcacttaaatagccaggcaaatgcggatgataaataattcaacaccagcttagctcagcgccaaggccattttatctggcccagatggttagatgggggccaccgctcattaattaccaagcaggagtggaacacatgggcgcttggctatctctgcctgcaggaaaaagctgtggcaagttagggaggtgaccaagaccgccttttacccaactgcacagatgtgagtgtgagtgtgtgtgtgtgtgtgtgtgtgtgcacacacaaccataagagatcctgaatttgccaccctggaatttgagctttcacccacggagccttgcctccgtttactcaggaagacacttcttgtttgtcttcattccctcctactgcagccaaaggccatgacccaaaagcagtgccacccctgttctagctttcctgtgaatggcagtggctgacctctgggaggcactgactgcgggccagaccacacccttggtgattcacatgctccttcttgttgcctcctgacaacatggcccatcagtggaagtgggggacttccgctgcccgctcctgcctgcatccgcttccttgtcgttggtaacagcaccccactttccttcaaagaaccacctcctcttaagtctaagtccatgtgggccatccaggactgacccatccttccagacttcaagtgtgggcatgggacccaggcggaggcactgagtgatccacgcagagtggggcatatgacgtgggctgggccagtgagtatcagtcttgggagctgtgctagaatttaggggaagggaagccctcctccatgggattgctaaattgcctagagctactggaggccattgtagtcatcccccagggggagaccctctgaggatgtagcctggcagaagaagggagacctgagggatgggggtcacagattgtgtttcttttaatttttatgatttagaagattccaacggaataaaagaatatcccgagtgtgatgatgtgttagtgtaggtcataaattgtaacaaatgtgccactctgctgagggacaccagcgatggagaggcgaggcattgggagaagggggctaagggagatccctgcacctttccttcaattttgttgtgaacctaaatctgctgtaaaaatagagtctatttaaaacaaacaaacaaaagccctaagtgcaatgtgggattgtggattggctcctggaagagaaaaagaatattagtagaaaaactggggcaatgtgaataaagtatagactttagttactagcaatgtcccaatgtgaatttcttagtcttgatgaatgtattgtggttatgtaacattagggaaagctgggtgaagggtatttgggaactcctgtactatctttgcaactcttttataatctaaaattatttcaagataaaactactgaagacaaaaaaaaaaacaaacaaaaaaaccaaccctctttacagatggtgaaacttaagcccagaaaagtgacttgtttgaggtcacataactagtttagtggcagaggtgagattccacccgagtctgtctgactctcaatactgtggttttgctttctactccgttgtcagatgcctcaaggattcttctcgatgatcactatctcagcggagctatgtgcaggcccagcagctcccgtggccccctcccctacctctcaggaccacccaggaatttccagggatgtgtggctgtggctgctgaggatgtgatggggtgaaggccaagccagatatcgggaaggaagagaaggatcagatgtgatggatggggctgagggacatcatgtcaatcaatggtttcagtcctggcattaccagcatcagtgggctcagagctggcagggaagcctgacctgtgtttggaaactctcctccgtctgccccccaccaccccaccccaccttcccttacagcctcctcttccccttgcctggaccttaggtctcggcccacagagtcctccctggatgcctgagactcccactgctccttccatcactctcgattccaggttcaggggttctggattcaggaagctgttgtgaggatcctatgagatggtggttgcaaagtgctcaacaggatgcttggcccagggtaagtgctcagtatcttttgagattattattcctgactcatcatctccgacctgacagcagcaatcacagctaccatttttcagcctctctgcagcatctgacccagcttcccactcccggctctcctcccaccttcctggcccctcctcctcacccttcccaccactggagagccccagggatgcccccttcttcacccaccctcgcctgcagtatctcctccagtcctgaggatttaaactcctctatgctgacaactcccaagcctggacctcaaacttgaactccagactctcttctccaggtgtccactcccccatctccatctcaaattcaacatacccaaagcccaacccccgatcttctccctgaaacttcctcctcccgccatctccctcttctgcccatggctctgccatccctcctgtcactcaggcccaaacctggattcatccttgatggcctcccccaaggtcccatccaacagcggatcctgttggctttactttgatatatgttcagaatctaaccacccctgaccctggcccagcagcaccctctcttgtctggatcctgctgctcctctctgctctccctgcctctgcttccccaccccctacagtctcttgtcagcgctgcagccagaatgatccctctaaagcgaaagacaggccaggttcttcctctgctcagagccctacagcaggcacctgtctcactcacagtaaaagccaaagccctccccatggcctacagggacctgtgtggtccggcagctctgcctccccaccgtgtcacccttagtcctgcctcagggcctttgcacttgctgctccctgcctgggaaacttcattctatatatttacatggttcacccctcacttccttcagtctctgctcagatgtcacctttcagtgaggccttcctgggcctgccttcctgctgcatctcttctccatagaacacattccctctaatacttttttttttttttgagatgggagtctcactctgttgcccaggctggagtgcagtggtgccatctcggctcactgcaacctccacctcccgggttcaagtgattctcatgtctcagcctcctgagtagctgggattacgggcctgtgcgaccatgcctggctaatttttgtatttttagtagagtcagggtttcatcatgttggccaggctggtctcaaactcctgatctcaagttatctgcctgccttggcctctcaaagtgctgggattacaggcgtgagccactgcgcctgacttctaatacattttagatgcttacttgtttgtttatttatttatttatttttgagacagggtctcactatgtcacccaagctggagtgcagtggcacaatcatggctcattgcagccttgacctcctaggctcaagcaatgctcttgcctcagcctcccaagtagctgggactacaggtgcgcaccatcacgcccagcttttctacaaaaaaaataaggtagtttttgcagagatggggtcttgctatgttgcccaggctggtcttgaactctaggactcaaatgatgttcctctctaacttcccaaagcactgtgatgacagcttatgtgtttattaattgtctatcttctcccaccagaatgccagctccctaagggcagggatttttgtctgttttgctcaccgctctatccccagcttctagaatggggcctggcccatggtaggtgctctaaatatttgttgaagatgtttcttgagcacttgttatctgcaaggcacagttacaaaattgcacatgtattcctgcctcctttcatcttcacaaccacgtcttgaaacgggtgctaccatctccattttacagatgagtaaaccgaggtgctcagaggttaagtgactgacttgccaggaagtgtcaaaatcaggattcaaactcaggctgggaggtcacagagcctgtgccagaaactcctaggccaagtaccctcttggctccactcccaaaaggcccttgaaaagttttcccacctgcctgaattctggacgctgtcaacgactcaacctcagaggacatcttgtccccagctcctgcccagctctcctggccctgccaaaggctgttccctggactttctgccactcaaacccctcagccagcatccagttttgctgacaccagtcattcccacgagagttctggagacactttggagctccaagtcatctctgcacataaatatgttattaggcactgatgtgggggacaactgccaattgatcccagtccccaccccttgccagtctctgcctgcaaggacagttaatggctctgaggaaactaaaaataagctgcaagtcgatgggagaggaattacccagaaatgtcagcttgtgcaactgtcaccgtcgaagtggggccaagagaaagatggggcttggggatcaggagagagggcaggaaccaggcctggagctgtgcagcatggaaggctaccatctttctctcactccaatatctggtccatgaccaagtccactgactctgtcttcctgaaatttccaaaatctatccacgtcctcatcacctccatggccaccacctgaccctgccaccacagtttcctccttgttgccctgtttttgcttttgcccccaagatcctgtccctcctctgctcagaactctcccaggcccccatctcgcccagagaaaaatcccaagtcctcatttatgaggacccacaaggccctcagtgacctcttccctcggtctcacgccccctccctcactctgcttcagctgtgtgatccaactctactctgcaagatccaaccccagggcctttgcacttgctgtttcccttatttggaatcttctatccccatatcttctccaagtctctgaatctagctttcttatcatccagggctcatctcaaatatctcagggaggcctccctgaccaccccagctagagcagacccgaaagtctctctattcacagccctgtttcatactctacatatcatcatctaaaatcaccttgtatatgtttccttgactctctgccccctgtcctcctgaccccccaaatggtaatcgacacaacacagaatctttgaggtctacggtaagtactcaaaggattttttttaagaggtggaatctcactatgttgcccaggctggtctcaaactcctgggctcaagcaatcctcttgcctcaccctcctgactagctgggactacaggtgcacactaccatgcccagtgtctcaatggaacttctaaacaattcttcaaaataactggtctgcacacttcaaaaaatgtaaatgtaatgagaaacaatgaaacgcacagaaaccgtgccagattaaagaaaatgggtcgggtgcagtggctcatgcctgtaatctcagcaccttgggaggctgaggctggtggatcacgaggttaaaagatcaaaaccatcctggccaacatggtgaactcccatctgtactaaaaatacaaaaaattagctggacgtggtggcatgcgcctgtagtcccagctattcaggaggctgaggcaggagaatcgcttgaactcagcaggcagaggttgccgtgagccgagattatgccactgcactccagcctggcgacagagcaagactccatctcaaaaaaataaaaaaattaaaagaaaagaaaacagaagagtcagaatgactaaatgcaacgtgtgattctggattggatgctggaccaagatgaaccaaaaaggacattattgagacaactggcaaaactggaatacagattgtttattagataatgatcatgtatttgggctcattatcctgaaattggttattgtactgtggtcatgcaggagatgttcttgcttacactcaagcaattagggataaaaaagcatgatatctgcaacttattcccaaattatttcaataaaataatcccagtggggaaaagagagcataagagagagagagacagagagagagaaagcaaaggtggtaaaatgtttaaaactggggaatcaaggtgaggcatatataggagttcattaaactatttattaaacttttctataaatttaacatttttccaaattaaaaaaaaacaaaaacaaaaaacaaaaaacaaaaagaagctgggcgtggtggctcacactgtaatcccagcacttccagaggccgaggcaggcagatcacttgaggtcaagtttgagaccagcctggccccatttctactaaaaatacaaaaattagccaggcatggtggcaggcaactgtggtcccagctactcgggaggctgaggcatgagaatcacttgaacctgggaggcggaggttgcagtgagctgagatcgagccactgcactccagcctgggcaacagagcgagactctgtctcaaaagaaaaaaaaagaaaagaataccgaatgaatgtttctgttcgtgatgctatttgacagtaaaggaagtcagggaactggtttgggcagtgggtatgtgtgcacacacccacactcacatcagcacacactcacaaatgcacacctacatacacatgcacacacaggcatagtcatgtgcacacctgcacaggtgcacagacatgcacacacacatgcgttcatatcgcaaccacacatgcacacctgcacacacccacttgcacattcacacccacctgtgtggcccacagctgcagcaccagggcccgtgcctgcatctcctctgacacacccatctcctccaggtgcagcaggtaactctccagccatttgctccggtgggcccgcctggccagcctggctggggatagcagcttccacaggcgacttttgacactgcacatgtggtccttgtcccctgcagggacagagcacagagagtaggggttacagattcaccatcccacacccagggctggccaggcatgacctcccatgaggccaagggtcttctgaatgtcactcattgagggtggggagttcctgtgggaaagaagctgcaggacaggcccacagcaggaagccctttcaataccaaattgcttattatctgtcttacccccagtaaaaagaagcaaggggtcttgtctcctgcaggtgggagcctgatctatttcaatcacctctatgtccccatcacccggcccgtagcaggtgctcaataaatatgcattgtattagtctgttttcatgctgctgacaaagacatacttgagactgggtaatttatttatttatttattttttaaaaaataggtttaatggactcacagttccatgtggctggggaggcctcataatcatagtggaaggtgaaaggcacatcttacatggcggcaagcaagagaaaatgaaagccaagcaaaaggagaaaccacttacaaaatcatcagatctcatgagacttattcactacaaggagaacagtatgggggaaaccacccccatgattcagttatctcccactgggtccctcccacaacacatgagaattatgggagctacagttcaagatgagatttgggtggggacacagcaaaactatatcatgcattaaataaatggtagttctttccagagcaggagaaggaacactaaacactgagcagcattctccctccccagggtccaaccccagagcaatgccagcccatgtgcatgaggaggaggccactgtgagcaggctcagcacagcagcaatcacagaaagacatcagcaacaacctaactggcagattgggctggagtctcaaactcaactcactccagagaaggcaggccaagtaaaagagagacgggccagaaaggggccatggcacttagcccaccaaccagccctcggcaggagagggaaacaccccagcatggccagaaggcctgtgctttcaaaggaagctgataatccagacaattatgtataaccttctgatgttttttaaggttagcatccaagtaaaaagtttttaatcactgtgcagaccacagaagcatctctgaaggtcaactttggcccacagatcactagcgtgcatcaccattaaacagacaatggtgtgtttatgttctggaaacatacagcagtgaaagtgagttagtacattttacctacagacacagagagttcccaagggcagactggtaaggggataaagccgggcactgaagaatgacactatttagatattgttttcttttctacttctttttttttttttaaaatattttcatgaaccatacatgagccttaatatacattgttttaaagctccacggtaatgctatttatatgcacaaatataaagtttaaaacaaaaatataaaatataaaatttggttttctccgaaatcaccccttggaaaagtgagagtcattttggattgctctgaagtttcaaagtattggaaactccctcactgactcttctgaaccacaagccgtgtttcaggaagactcgccccaccagcgattctaaacctggctgcacctcacagggcatttgaaagggtcgaaaatgtagactatgttttttttttaaagtatgttggcttcattttcaaataatacgctgaatatgtttaacttttagacttcaacttgagctcattgttttacattgaaatgaatgtcaccatttcgggtgacatttcaatgtaaagcaataagcttaagtgttcaactgaaatacattatcttcctatgtttctccacttttcaggctctctgaagaattacctgggagctcttaaatctctggatgcccaggtgccaaccccagattgatcatgtcaaaatcacgtgcgtgggaactgggcatccagaggtttaggcctgcagggcgcgggcagtgttgaaaccacctcagttgatgccaactctggatacttctaagcatcatctgatgggatggctaaaaaaagaggcaaagaaatttaacacagctttagaaataactggcattctttgaagtctgaccacacaactgcaatcttgaatatcactgtaaacacggcgtttacagatgactttaaaaagcaaggcaggaccattctccacttttcccctgtgcctacagcagttctgagtacataggaggcactctatatttgcacaatcaatgaataattaagcaaaaaaggtaatgcagtatgaaaagacagctgacagaaagtgagaaaatatttgtaaataatatatctgataagggtctaacacccaaaatatataaaagaactcctacgactcaacaacaataaaaaacaaacaacctgatttgaaaattggcaaaggacttgaatagatatttctccaaagaagagatacaaatggctgataaacacatgaaacaatgctcaacaccattagtcattagaaaatgcatgtaaaaaccacagtgtgataccattcacaaccatgaggatggctactatttaaaacataggaaataagtgatggtgaggacgtggagaaattggaacccttatgcattgctggtgggaatgtaaaatactgcagttgctgtgaaaaagagtttagcagttcctcagaaagttaaagaattaccatatgatccagtaattctagttctaggtatatagcccaaagaactgaaaccagagactcaaacagatactcgtgcaccaatgttcatagcagcattattcacagtagccaaaaggcagaaacaacccaaatgtcggttgataggtgaatggataaatagaatgcagtatatacacacaatgtattcactcttaaaaaggaatgaaattctgacgcatatgccaggcatggtggctcacgcctgcaatcctagcaccttgggaggccaaggtgggcagatttcctgggctcaggagttagagaaccagcatgggcaacatggtgaaaccctgtctctactaaaatacaaaaaaaaaaaaaaaaaattagccaggcatggtggtgtgtacctgtaatcccagctactcaggaggctgaggcacaagaatagcttgaacccgggaggcggagattgtagtgagctgagatggcgacactgcactccagcctgggcgacagagactctgtctccaaaatctcatataatgagaatcctagaacaggaaattcagagacagaaagtacaatagaagtatactattcgacagaaagtagaatagaaagtagaatagaagagacagaaagtagaatagaagatatgtcgggctgggaggaaaggcaggtggggaattattgtttaatgggcacaaagcttttgtttagaatcatgaaaagtttctggaaatagataacggcatggttatacaacattgtgaatgtatttactgccactgaattatacaattaaaatggttaaaatagtatattttatgttatttattattttaccacaatttttttaaaaggcatatgaaggtcatttggcaaaaatgagtcaaagatagtgttgtataacaaagaatttgcattctgggcgggtgcagtggctcacgcatgtaatcccaacactttgggaggccaaggtgggcagatcacttgagttcaggagtttgaagccagcctgaccaacatggtgaaaccccgtctctactaaaaatacaaaaaaggataagctgggggtggtggcaggcacctgtaatcccagttacttgggaggctgaggcagcagaatcacttgaacccgggaggtggaggttgcagtgagctgagatggagccactgcactccagcctgggtgacagagtgatactcaaaatacaaaagaatttgaattccaaggtttcagttacccatggtcaaccatggtccaaaaatattaaatgaaaaattccggacataaacagtcataagttttaaattacatgctgttctgagtagtgtgttgaaatcttgtgccatcctgctctgtcctgcctggcaaaaaacacaggataaaaatatagcagtgggctgggtgcagtggctcactcctgtaatcccagcacttggggaggccgagacgggcagatcacctgaggtcaggagttcgagaccagcctggccaacatggtgaaaccccatctctaacaaaaatataaaaatacaaaaattagccaagcatggtggtgggcgcctgtagtcccagctactcaggaggctggggcaggagaatcgcttgaacccaggaggcagaggttgcagtgagcggagattgcaccactgcactccaggctggacaacagagcaagcaagactctgtctcaaaaacaaaaaaaatatatatatagcagtgattggatcatggatcaaatcagtttacatttgtatatcccttagagcagtgtagaggacacactaaaccttacccaagagttatctattgctgtgatatattgttagcacaaagcaaagtgccagcaaccacgtgtttagtatgcatttgtggaaaaaaagaaaaataagaatatagtcacattcacttgcacttgtgtgaaggaactctagaaggatccatttgaaactaataaaactaatcaattatgagcagtgggaattggtggaaggggatgtgacaagaaaaggaaggagacttaccactgttattacttaatttttttccagccttgctgaggtataattgacaaaggaaaattcttatttaagttgtacaacatgatgttttgatacacaaatatggtgtgaaatgattgctgcaatcaagctaattagcatatccatcaccttacataggtgcacactcacacgtgcatgcatggtgagaatacttaagatccactctcttagcaaatttcaagtatacaatacattgtatacttgtatattaaatctccagaacttattcattttataactcaaagtttataccctcaaccaacacacccccatttccccacctcctgagccctggtaaccactgttctactgttcctctgaattcaacttttttagctcccacgtataaatgacataatgcggtatttgattttctgtgtctggcttatttcacttacaatattgtcttccaagttcatctatattgttacaaatggcaggatttctccctttttatggctgaataacattctttcgtggatttacatacacagcagtcctgtcttatccagtttcactttccaaggtttccatcacccatagtcaaccatggtccaagaatattaaatgaaaaactccctaagtttgaaatcgcacaccattctgagtagcatgatgaactcttgtgccatcctgctccatcttgcctggggggtgaatcatccctctgtccggtgtatccacactgtagaccacacctgcccattagtcacttgggagccactgtctcagttatcacgtcaactgtcatggtatggtagtacttgtgttcaggtaacccttattttgttttcattacagtatatcgttataattggtttcattttattatgttgttaatctcttactgtgcctcatttataaattaaactttatcaggccaggcatggtggctcacgcctgtaatcccagcactttggaaggccgacgtgggcggatcacctgaggtcgggagttcgagtccagtatgaccaacacagagaaaccctgtctctactaaaaatacaaaattagctgggtgtggtggtgcatgcctgtaatcccagctactcaggaggctgaggcaggagaatcgcttgaatctggggggcggaggttgtggtgagccaagattgcaccattgcattccagcctgggagacaaaaacgaaactctgtctcaaaaaaaaaaaaaaaaaattaaactctgtcatagttatgtatgtataagacaaaacagtatatacagggttcagtaccacccatggttcctgacatccactgggggtcttggaacatatcccctgaggttaagagggggccattgtaccactatctctgtatctgttcatgcactgatggacacttagtttgtttccatgtctcagctgttgtgaataatgctgcaatgaattggaggtgcagacatctcttcaagacagtgatttcatttcctttgaatatatacctagaagagggattgctggatcatgtggtagctctatttttgattttttaggaacctccatactgttctccatgatggctataccaatttaaattcccaccaccagtgcgaaagagttctcttttctccacatccttgccaatatttgtcatcttttgacatttctaacgggtgtgtggtgatatctccttgtgattttgatttgcatttccccaatgagtagtgatgttgaacaccttttcatacctgttgccatttgtatgtcttctttgggaaaaatgcctattctggtcctttgtccattttgcagtcaggttatttggatttttgtgttttttgaggcagagtctcgctctgtcgccaggctggagtgcagtggcgtgatctcggctcactgcaacttccacctcccgggttcaagcaattctcctgcctcagcctcccgagtagctgagactacaggcgtgcaccaccacgcccagctaatttttgtattttttagtagagacagggtctcaccatattggccaggatggtctcgatctcttgacctcgtgatctgcccaactcggcctcccaaagtgttgggattacaggtgtgagccaccgctcccagatgttatttggaatttttggtattgagttgtatgagttccttatctattttggatgttaaccccatatcgggtatgtggtttgtaatctactttacatttttaatgtttaaaccacgcgaaataatttttaaaataaaataatagaaaatctggcaaaccccccaaaaataatttccagtgaaacatcatatactgtagagattcaaggaattcagtgcatatgggagtgaggaagagaagattctggaaaactgagcttggtggctcaacctggggccctgcagatgagcaaagctgtgtagttaaagggggagtctgcataaagccccctcctgaaatgtggtcgtgggaagaaagcaaatgttcgaaatggttacagcacatttatacaattcactacagacgttcaacaaaacagatacggagaaatgcaactatttacttccattcctaattatttcaatatttaggttgccccaaaaatcaaaaaaagacaaaattttaaaaatcttcccactgggaaaacagaggcttgctgtctacttgggattccagtacaatttgctattttgttgttttttttcttttgagacaaggtcttgctctgtcactcaggctggagtgcaatggcgtagtctggctcactgcaccctcaacctcctgggctcaagtgatcctcccacctcagcttcctgagtagttgagactacaggtgtgagccaccacaactggctaattattattattatattttgtagagacaaggtctgtctatattgcccaggctggcctcaaactcctgaacaaaagtgattctcctgccttggcctcccaaagtgctggattacaggtgtgagccactgtgcgcagcctcatgctgtattttaatgtctgcataaaggccaagtgttgttctgggaaacagagtagccgcaagccccagggagttatggagcatttgaaatgcggctggctcgaatgcagccacatttaatatagggtaggggagacactggattccagagtcagcatgagaaacaaaatgtaaaatatcttatcaataattttaacattggttaatgctaaaatgctaataatattttagatgtattggcttaaataaaatgtattattaaaatcgatttcacttctatttttcttttttagtgtgtctaatagaaaattttaaattacaaatgtgattcccattatttgtctatgtacagcactgttctagaaggataacagcaaacagatagcaatagttacctggggatagatttagagggaatgtggtcaaaagagaattttcctttttgaaatatttgatttttttttaacaaaagtcagaggagcccagttaagaggcccagtgctgtagcagagtgcctgaccttgaacaagtcacctcacatctcagcatctcagttttcttgcctgtaaattgggataataaaagtacccaccacagagggttatatacagatcaaatgcgttattaacatctaaagcacagagatgactgacacagtcctaataaacgctatattattaaataacaaatcttactgaatgttagcaaattattagcccaaggagaacatgttcatgaattgcttctttaattaagaaacaataataaattgcgaaatacagagcacaaagtttgaagacagagagcattgaaatcccagctcttccctttctaacgagatgaccttggccaagtcactttgcatctctgagcctcagtttcccccatgtgtaaaatgagggccatctagctcataggatggtcaggaggattcagaaagatcacacacagaacacacttggtatcggtagaagtttgtaaaatgctacttgctacattctctccattattacgaggtatttcttattggtgtgataaccggatgccatgaatgagggctgccaggcccacggtgattggcagcccaccaatttaaaccagattggtgtatctggtttaaatcccagagtccccatgctatgtagcctcggctgagcccctgcccatctctggacctcagtctcctcatccaaaaaatgaggacccagacttgaatacctctcaagttttttctgggaaagccctctaggccctctagatttgggggcatagtacagagaggcccccagaagacacatgtctttaaagtcttgtgttttacctttgaaatgcatcagagttttgcatcagactctgtgattctttgatataagaatgcctttttccccaaaacaatgttcaaataaacagccccccaaaataatccagtaaaataaatgttccagacagaagcactatgcttagctagggggtctgtttaactgtcccctgcccccaactccctactgtatgagaaacaccagactcaatggcctaagggttctcaaaggattaactttcttttaaaatatatttatactttaaaaagtgaaggaagaataatgtatgcatacagaaaaaaaagaagaaaaataaagaatctaagagttcaagtccacatcttgtaaaaaatgattttctctccaccccttctcggccttcccaaaggcaaaaatctatacatactcccacatttttaaaaatggccgggtgtggtggctcacaccggtaatcctagcactttgggaggctgaagcaggcagatcacttgaggtcaggagttcaaaaccagcctggccaatgtgatgaaaccccagctctactaaaaaagtacaaacacattatccgggggtggtggtacgtgcctgtaatcccagctactcggggggctgaggcaggagaattgcttgaacctgggaggcagaggttgcagtgagctaagatcgtgccactgcactccaacctgggcaacagagcaagactctgtctcaaaagcaaaaacatatatatatatatataaaatgtatgtatatatagtgatatagtataccctctgcctgcagcttgctcttttttgtaacagtagatttcattcactaccagtatgtcccactctgttttagatgcatagatggcctttagatgaatgcataatttatttaatcagcccttactgatggactttaaattgtttctagcatttgcaattataagcaatgtgacaatgaatatgtttgtgtatctgtagacatgtgcaagcatttatgtaggataaattcctagaagtggaagtacaggatcaaaggaatgtgcattttattttatgtttcagcaggttctgccaaaagaggctgcaatgcttcaagcaccccacagcaatgttcgggggctgctttgcccacatgcctctggtcccaattaagatgagaaatcaccgtcccacattgccacctgctgctcatattgagaaatgcatccttcctatagccagcccagggctgctcccagagtgatggggggagttcctctgcgtctaatcagactcctctggagcatctgtgtggaggaaatggtaatggagaaacccaatttttcctggggaagcaatcagtgctaggatgtggcaggtgctttatgcacaggattttgcagacagacagaccaagtttccacctaccagctgcatgtctatgacaagtgatctcacctctctgagcctcagtttccttatctgcaacatgggtatgtgaataacaaccttccagcatggatggcaagatttgataagctcaaatgagttcctctaaaaagataataaaggacacaaacagccggctcataaacaggaaatgcaaatggctactgaaacacaaaaaaatacaaaaattaaccaggctcagtggcacgtgcctgtagtcccagctacttgggaggctgagttgggaggatcgcttgagcctgggaggtcaagattgcagtgagccgaggtctcgctactgcactccagtctgggtgacagagcaagactctgtttcaaaacaacaaaaaaaccacacacacccagagatgtttcatcacagtagtcagtgatatgccacatagagccagatgtccttttttccatcagattggcaattatttaaaggctgataactgcatgttggcaaggttgtggtaacatgcaaattaaagcaataagttacccacctctgcccatcagattagcaaataaatggaaagattgatggcatctggtggagcagatttcttccctttaggtaggcggatgaattgctctgtggttttggaaatgatgtggcagaagcagataaaaattttaatgtatagggcctttgacctggcaaaaccacttctaagaagtgggcagagagaaatgaaataaccagatggtagaacagatacaagtacaatgaaatggtataaaagcaaaaagaaagaaagatagaatattgacatctgtcagagggaaatggctaactactgaaacagccatgtgagggctaaaaaaatgtattggttttttgtttttgtttttgttttgagatggagtcttgctctgtcacccaggctggagtgcagtggcgtgatcttggctcactgtaacctctgtctcaccaggctcaagtgatcctcccacctcagcctcccaagtaggtgggattacaggcgcttgccgccatgcccggctaattttttgtatttttggtagagatggggtttcgccatgttggccaggctggtcgcaaactcctgacctcaagtgatctacctgtctcagcctcccaaagtgctaagattacaggcatgagccaccgtgctcggccagatgtcttgtatttttaatgttaatttcatatccttctactttgctggattcatttattgctggagtttgttttattattgattttctggggttctccaggtacaatatcagatcatctgcaaataggaatagttttacttctttacccattctgatgtctataattggtttctcttgtttaattgcatcagctaatatctctaaaagatgtttatatcaacagagaagaatgtacagctatattgttaggttaaaaacaggttgtaaataacagatacaatttttctttgtaaacacagagacactgtagatgtgcatatttgtctctagttgtgagaacatacaaaataccatgaagggataataccaccatgctaacattggcttcacaggaagctgggcttggaagaaggggtattatattttatacaacctgtaactctgaattgttaaccacaagattatgattctctcataatgtaaacaaaatcaataatgcattaaagtttggctttttaaaaatatataagcaaaaggaaatgggtgatgaagtgtttgagcactgactatgacaatgcttaacctcgtatctggcacatagtaagtgctcagcaaacagtgctttttctttttttcttttctttctttctttctttctttcttttttttttttttttttttgagacggagtctcactctgtcgcccaggctggagtgcagtggcacaatctcggctcagtgcaacctccacccgcagggttctagcaattctcctacctcagcttcccgggtagctgagattacaggcgcccaccaccacgcccagctaatttttttgtatttttagtagagacagggttccgccatgttgtccaggctggtcttgaactcctcaccttaggtgatccacccgtcacggcctcccaaagtgctgggattacaggcatgagcctccgcgcccggccacagtgctttttcttgttacctcagccaattctaacagctgccctctaggaagatcctgctgttccccccattttgcagatgagatcgctgaggcacagagaaaacacacagatgctgggagggggagctggtaaagctcttcaagccgtcagagcccagactctgtcttagccactcccctccacggtccctccagagaaaggaactggggcaagtagaagtaacttgctccgagtcaccagcaaggaagcagcagcgcaggaattcaaatccaggcctctgctgcaagtctctgagcccagcacacacagcacttcccagccttctcaggacacttgtcagacatgcagttttccaagctctcccctggagacctggattcctatggacctggatggggctgagggacctacgttatgaagaagggcctgagaggattctgctcatcagggaagttgggggcacatggcccagggaatggcgccgcccagtggttcctacggcccctgcacacggaatcagccaggacactctaccaacactaagtacgctctgcagccacaaaaacagatgaggtagatttttacaaatcgatgtggaaatgctgtagacagggagttgagtgaaagctgtaagcggtacaacaattcttctagtgtgatatatctaagttatagaagtacaggctaggcagggcgtggtggctcatgcctgtaatcccaacactttgggaggccgaggcaggcagatctcctgaggtcaggagtttaagaccagcctggccaacatggcgaaacactgtctctactaaaaatacaaaaaataaccaggcgtggtggtgcgtgcctgtaatcccagctactcaggaggctgaggcaggagaattgcttgaccccgggaagcagaggttgcagcgagccgagattgtgccgctgcattccagcctgggcaacagggcaagactctgtctcaaaaaaacaaaaacaaaaacaaaacaaaaaacaggccaacagctaaaagaaatgcacgtgtgcactgaaagatacgtacaagaatgttcacaacaacctcttcctaacagctccaaatgggggactactcaaatgtctatcaaccaggaatggataaacaaattgtggcatatttctttaatgaaatactatacggcaataaaaagaacaagctgttggccaggcacagtggctcacgtctgtaatcccaacactttgggagaccaacgtgggaggattgcttgagcccaggagttggagaccagtctgggaaacatagtgaaacctcatctctacaaaaaaatttaaaaattagccaagcctagtggcatatgcctgtagtcccagctactcaagaagctgagggggaaggatcacttgatcccaggagattgaggctgcagtgagccgagatcgcaccactgcactccagcctgggtgacagagtgagaccctggttcagaaaaaaaaaaaaaaaaaaaaaaaaaaaaaaggcatgctggctcactcccataatctcagcactttgggaggccaaggcaggaggatcgcttgagcccaggagttcaagaccagtataggtaacatagcaagactccgtctcaaaaaaattgtttttaagacaaaaaacaaaaaataaataaaaactggactattgatccatacaacaacctggatgaatctcccaacatcaagttgagtgaaagaagccaggcataaaagggcacatactgtgtgattccatttctaggaagctgaagaataggcaaaactaattggaggtaaaagaaaccagtccagtggctacctcgcaggggtgaatactggctgggaaagagcataaaatgtttagatccacttctcagtgcatttatttatttatttatttatttatttatttatttatttaagacagagtctggctctgtcactcaggctggagtgcagtggcgtgatcacagctcactgcaacctccaactcccaggttcaagctattctgcctcagcttcccgagtagccaggaatgcaggcacccgccaccatgcctggctaatttttgtatttttagtagagatggggtttcaccatgttgaccaggctgatctcaaacgcctgacttcaagtgatccgcccacctcagcctcccaaagtgctgggattacaggtgtgagccactgcacctggcctctcagtgcgtttagatgtgtgtgctttcctgtatataaattatacctcagtaaaaaacaagaagttaaaagcttcaaaaataaaataaaaataaaaataacacacatctgtgtgtctgtttagagaaagtgctcccaggatgtactccaagctagtgatggtggttgcctctgtagagggaagtggtgggctgaggctggggagaaagtggagcgctcttttattcttccctgtaaattattctatatggcttgaattttttataatcagcacgaactacttgtaaaaacttttaaagcaactcaaaccttaaaacacaaaaaggaacacacacacacacagagattctccagccccactctaaatgtgctgaatcagaatttccaccaggaacccaagctctggtccaagccctggctccccaccattgcgctcttgcatacccccagtgatggggatcttactgcctccctgggcattggatgtctttctgcctgtgttgcctctggtcctctaccttgaattgggctccccctctgggtctttccatcctcccccccacccactggggcccccatggtgcttacccactgacagggagccacgggccagtttggggagcagccggtcgagctggcgaaaggtgtggaagacatcagctgagtggacgcggtcctgggcctggctttcatgggtgcgtggcagcgcctcaattccgtaaagagtcaggtagccggctctgggggcggcagacagagggtcaggggtcctcctgggacactcatgtgtggccacagctactcacaagagcttcattcatacacccagtgagcaactactaatcctactgtgcgccaaagaccattctgggcactgaacagtcggcagtgaaaaaaacaaaaatccctgtcctcaaggagctgacctctcagcacagggagacagacaacagacgagaggatgagtaaaatgaataatgcgccagctggtgccccgcggcactgtcagacacaaagctgggtagcaggatgggagggcgggggctgtggtgtcaggtgccaggtgagggaggggctggtgtcaagctgacagctgaaggctgagaaggagtcagccatgggcagagcagagggaggggtaggaagcagagcaagcaccaggtgtgatgtcctggggcaggagggagcccggtgctggggagcagcaaggaggctgatgaggctgcagcagagagctcgaggggacggtgctgagatgggggcacagagaaggggaggagatgcctgctcccagggagggattcagggaagacttcctagagaagggagggtctgagctgagatctgcaggatgatcgggggaagcagaagaggaacgtgttcaggcaacaggcacagcctgtgcaaaggcccagagctgagagtgcaaccgtgcctggtgggagaggtgccagctgtggctggtgcaggcactggagccggggtgtgaggcagaggatgggagggcctgggctgtcagggctggccacgcaaggcaggcatttgcagcagtgagaaggttgtgcttgatctgaggggctctgggaggcccgagaaggaggtcagggcctggtcaagtgtgaaaaagggtaagacatgggagctagcatgagctctcatgtgctctcactgaggcacacttacgcacacgcacacgcacacacacaggaccacgctcagaggacgcgccttcacctccagccccctttaaatgccccaggagtccagccccagcccagcgggctgacctcagtcctgggagggaaactgcaggctttcattttgtcatctctgcctcagcagagagtcacaacaaagagacgcaaccaaagccccggggcctcaccctctcaccctccccttgagctcctggatccctgtgcagacaaagaccagagaccaggatctctcaggagaggggttttcccagatgaagagagaatggaagcaggaatgagggtaggtgggggccgagagaggcctgcgtggtccctgctctgtccctcacctgcacagtggtggcagaagttgtaaaggtgcagcccacacactggattcagtccacaaatgtgttttatcaagggagttcctaaaaacaaactaaagcttccttcaaacatttggggaaactcacacaaaatccggatttcctgctcatctcatcttgaaaaaggaatctggctgacctgcggtcccacctggaaacctagcaggagcagagttgcagccgccccttttagacagacacgtgcttgccaggccactgcggtactcccaaggccctgtggtctcggtgacactgcagttgacactggtcatcatttatcatcacacttgcactgttgttttttgctaactcagagaaccatttcccggtacatatatttctaccaaaacaggcaatgaaaaataaaccaaaaaagtaaaccggccgggagaggtggctcacgcctgtaatcctagcactttgggatgccgaggtggttatatcacctgaggtcaggagttcgagaccagcttggccaacatggtgaaaccccctctctactaaaaatacaaaaattagctgggcatggtggcggcacctgtagtcccagctactcaggaggctgaggcgagagaatcgcttgaatctgggaggcggaggttgcagcgagcagagatcgcgccattattgcactccagcctgggcgaaagagcgaaactttgtctttaaaataaaataaaataaaatgaaggaaaagaaaacaaaaagaaaaagtaaacccagaggaccacaaggttttgctctgtggaagcgaagccggcagctccatatcaaaagagcacggctgaagacaggataatcccatatgtaaatacacacacgacccacaggcggcgctagagccacaaagaaaaataaagctgaaccaagctgggtcacaggagggagccatcacgaaaatgggactcaagaaagacctctctgagcaggtggcgctcgcgataaggcttaaacgaagtggggtgggagccacgcagacctgtggggaacagcattcccaggcaagggaacagaaatagcaaaggccacaaagagagagcgtgcctgacctgctcaaggggcagcagagaggtaggtgggaggaggggaggccagggctacaaggtgaggacagaggagaactttgggtgtgactcagtgaggccagggccaacacaggccaggctggtgggtgtaagaggtggcacctcacagttcgggctgcctgaaccggcacccctttcacctctgtgtccctcccatccaactggcccattctctttgtatttcaggggctgctgattgatggcagtggaaaggcctacagctgccaagccagggggcaggagctccagcccaggcctcaggccctgaagacacagttaccgggttacaggtatggatttacgtctgattccccctgagctgattcccctgtgcctgccgctgtaccatggagcctagccagacccagctgcccctgagcctgcctctccccagcctatctctctctgacttctttgtctgcacagggacccaggagccaggagacctgggaggatcactactgtgaacttgctgggtggtttcagctggccctctctggacctcagtccccatcatacaatgcagggtggaccagaccagcatcacccacaccaattacagcccttgacactgtttgcaccaccccagggcaaaacaaaaagaatggggactgttcgtgtgctgagagctgtggctgagagtgcagactctgggaccagccctgtcctgaccccaacacaggcctctgggcaaatgactcaggctctccaggtctcagttttctcatctgtcaaatggaatatgtaaagtcctagcctcctagagcgattgtgagcattaaaagagctgagacacgccgagtctacacatatgcacacacatatcataaatatacccacatgcccatatgtgtcaacgaatgactgccctttatcctagaactatgttgctctaatttcttggaggggttgaaatgtccttttttaaattaaatttaaattaaattaaattctggttggttaagggcatcactaaaatcagggagctgtccttaacaccactctatccctctcactcacgcccacgctcccccatccccaccgctgccccagtcaaatcttccggcagagccagtgaactctatctccaaaagctacccaaattctcaccacctccctgggccaccaccattctctcaccttggtgacacctggcagcctcctgctaggtcctcctgcctccctctccacccctccttacccctacagtccatcctccatccagcagccagagggggctttcaaactaagttagatcatgtcctgcccctgtgcaaacccctgatgtcacccgatcttactcagcataatttccaaagccttccctgacctcccgactgcctgaggcctgcttctgcccacttctctgacctcctgtccaccttccctccttggctctttatgctgtagccacactggccgtctctctgagcttcctcccacctctgggcctttgcacctgctgtttcccctgcctagagtgttggcgtggtgggcactttgcagttaggtcttggctcagaagccagacccccagagcatgaccctgcctcgtcagtcggcctaagaaagccccccagatgctgtcaccccacccgtggatctctgtcatcgtgtttatcactctctgacataactcaattcggcctcccccactggagtgtcagctgtgtgaatttggggacttcatctgtcctgttccctgctgtatccccagagcctggattagtgcccggcactgctgaaggaaggaacgttcggttgtgcagtttttaacatacatttacaagaccagataaaaggttaaggtcccaagttgatctcccaaacattttgttttctgttctgtgaaatcccaaagtctggaagccacaggacaagatgacctctgaagtcttgctctgtgacttcctctctgaatgacctgtaaggtcccatttccagccagtgtctccttttacagttcatgagctaggtcagatgaacagccggggccctggtgcatggcgtctttcctacagtctttgctttgggtgtctcaaattgcttcccccacccacagagtcctcacggttcccttggccactgctcatggctgacacaggtcaaagtgccgggccccagcaggagggtgggggctgcacagcctcacctgagcaggaagctgtaggagaagtcgaggagacccatctcgtgccagccactgcctgcttctgtagcatcgcccaacagcactgcatggaggttggtatacatggcttctgtgagtgcctggagctctctgtggagaagagtcctgaggcaggaaacaaaagcatgaaaatttggcttccaaagggaaatacacacctacaggcacctccctccccaaacctaagggtcccagagctcaagctccccattggcaaagaggtcctgcggaagagtagcttaaataagaggatattattatgactgtcatcgtcaacaatagttcccatctgttatactgagcctaatctcatttcgtcttcagacaaacctgggaataagagttactattatgacacccattttacagatggagaaactcagaaacagagaggaaagtgacttgcccaaggtcacacagccaaagcgggactgaaatcctggtctgcccaactccagcatctgaattcttaaccaggagagtctttccctccctaaggcacacagcttggataagggacccatagcgttctggaagagaaggaactgaaaagcaactcatctctccctgaaatctaaagataggaagatctgttggaatagctgtggtgttccctgactcaggactgccaataagatgtgaccctggccaggcatggtggctcccacctgtaatcccagcactctgggaggccaaggtgggagaatcacttaagtccatgagttcaagaccagcctgggcaacatagtgagactccatctcaacaaaaaataaaatattagccaggggtggtggctcacacctgtagtctcagctactcgagaagctgaggtgggaggatcgcctgagtctaagagttcaagaccagcctgggcaacatagtgagattctgcctttacaaaaatagaataaatacacaaagaatcactagccagatgtgtagtaggtgcctgtagtcccagctactcaggaggctgaggtggggaggattgcttgagtccaggagtttgaagctgcagtgagctatgatcacaccactgcactccagcctaggcaacagagtgagactctgtgtcttaaaaaaagaaaagaaaaaaaaaaaagacatgacctcacatgagagtgacacaaggaaaaagggatgtgggctggagatctggtcccatcgtgtggacctgcacagagtgaggagaggccccgtctggaagagtgtggcagaagctggaagctcccctatactgagcctccatgatatggagtctacactgagccatgactgaggatatgattagaagccaagaaaggggtatcttgcatctaagtctaaggcctctctgctccttgtgtaggatctggaccaaaaaggatatccctacagcaagtgaagtggggtgtccatgggcggtgcacagcccatggtcaacagcaacacctagtggcagcaacaagaacagtgggagagtgccaatcagggccctgatctgtcatgcctgctgtttgggaagtaggatggactgctgtttgggaagtaggatggacacctttagactgagtaagccagaagtgcctgggtaatccaccagggcagggtttgcacagggcgtccatgaactcctgggtatgaaaaggtttgggatgttcaagttggaacatagtgggaaaaacgacagacatggctcatgactcatgtatgacaatgcatgtgaagggttccgcacggtgcctggcacattgtaagtgctcaatacatgggatctggccttcaatggaccctgacccagctcttctccccaccccactccaagcgctggtcctcagcagagacaagccctcaacagatgtggctgctgtgcccagaagacatcacgccagcttgtaagaaattccagaaaattcctgaggcaaacactgaaggaaactgggatcctccctgggtagcaggggcagattcagtgagctgtggattcctattgctaatgggacccccagggtccccctggaatgtcaggacccaggacactcaggctccaagcagctgcccccaggccaaggttcagaggaggcatcatgtctcatcaacatccacttcatcatgctggccttgcttcagccttaactatcttgcaaaacagtttcctagatgctcttcctaacctccagagggtattcctcctggagacagatcactgaagatcgccattggactgtgtgaactctgcaggggcggacacagggtcttatcagccttggtatcttagatgaaggagaatgcgctgtgaagtcagtggacctgggttcaaatcccagtcctgccacttactagcagtagactttgagcaagtcacttcacctctctgagcctcagtgtcctcatctgtaaaataaggataaaaatgcccacctctttaggctaatgcacagatatgaaagtgagcctatcagacacctggcctataatagctgccttcaaatggtggttggcaccgttctgcacaccctacatccagggcaatgaccagggtacaatgggtcctcagatgtctgctgaatgaatgcagagcaaacatgttcatctgttctcttattgatatgatgactccatatgtggctgggcatggtggctcatgcctgtaatcccagcactttgggaagctgaggcgggcagaccacctgaggtcaggagttcgagacctgcctggacaacatgatgaaatcctgtctctactaaaaatacaaaaattagccaggtgtggtggcacgtgcctgtaatcccagctacctgggaggctgaggcaggagaatcgcctgaacccgggaggcggaggttacagtgagccaagattatgccactgcactctggcctgggcaacagagagagactctgtctcaaaaataaataaataaaataaaatgattcctccatatgtttcaggagctgtaccacttctggctatgtggcctgagacaagtcacttctctgagatccagtggctgcatctatgaaatggggctgtaagttacttagcctccagcattgttgtgaagactaatgagataatgcatgctgcctggcagagtatggactcagaaatattcatcattccacctctctccttcattttacagaggaggaaacagaggctcagagagggaaagaggtttgtccaaagtcacaaagctagggagtgatggggctgggatttgaatttaggtgtggctgacccaaaccctggtctcctcctactaaaatcagggctgcctccaaacaaacaaacaaacaaacaaacaaacaaaaaaacccgccagagatgagagacaaagagttcttcttccacccaattcttttgggttgttttttgttttgtttctgtttgtgttctcaagacaaaatgtctttaccgaacatttgctttggaaccaagaataacttgggccacatgagtagaaatgagtcgcccaccctggccctcccacaggtgccatctccagccactcacagtttcatcctggccttttcatcactggggctgtaatgtggaagctgcacatcaaaaatcctctccatgaggaagatggcataggcatggaagtcgagcctggtgcgaggctcccacaccaccgcgtcgtaggagtgtgggtccaggagaacggtgacatacctgcccccaaccagtatctgtgggaagttgccagggatagagtgaggagtgtcactgtgaacagcagccgctctcagtggtcagggccttactgtgtgccaggcactgccccactggacagtaacacactatgttctcttatctatgcctcactaccacctaccaccctgtgaggtagggaccatcactcacccatttatagctgaaaaagtgaggcttagaaaggagaagaaatgtgcccaagatctcatagctgagaagtggcaggactaggactggaatttgggaatattgaggctttttaaaatcaaagactgtgttctctaccacctcactcttaagcacctgccatgattatcttggttattgccatatctccagtagccaggagagaaggcggcagatggatcctgtgcacatcatggatggatggatgaatggatggatgaatggatagatggatggatggttggatggaagaatggatggatggatggatggaaggaaggatggatggataagtagatggatgaatggatgggtggatggatggatggatgaaagaatggatggatggatggaaggaagaatgaatggatacatggatgaatagatggatggatggatggatgctgttgggtaaattccagtgggtggattgtagaagagtaaatgggcagatggatggattggtgaatgggtaaatgaatggaaggaaggaaggaagggagggaggaaggaaggaaggaaggaaggaaattgctgggtaaatacttgtggatacaatgttagatagatggataaatggaaggatagatcaatgaatctatgttggatggaaagatggatggaagggcagctagaggttggttggaaaccaaatgtaccaataaatgttgggtacatggatgagagaatgctaggtagatactgggtaaagtgaaggatgaatgttgattggatggaagttggaaggatacatggaaggtgggtgggtggtggtcgtttgaatagatgttgtaaggatggatggatgagatataaatagatgtatatccagtggggagacatcgaatactgaatatagctgagtgttgggtggatagtggcagatgaacagaaagatgcgtagataaacagaaaaatgaaagttggtggaaactgaccagttatccctcagtatccatggaggattggttccaggacctcctgcagataccaaaatctatggatgctcaagtccttgatttaaaatggcataatatttgcaaataacctacatgcatcctcccatatactttaagtcatctctagattacttataatacctaacacaatgtaaatgctaaataaatagttgttaaactatatttttagggaagaattacaacaaaaaagtctaaaaaagtttagtaccaacacattttcccccaaatattttcaattcgtggccggttgaatccagagatatggaacccacccatggatacagggggccaactgtatacagatgaaagttggatgaacattggatccatgagtggaagaactctgggtagatctgggcagacacatgaagggatagaagatggataaatgaattgacagatgtcgggtgaatctatggaaaaactgatgggtgagtggatagacggaggttgacgaatgaatgctgagtagatataaggatggaaggacgcttagtagacaccaggtggacaggcagaagaatgggatgggaagatggatgttgaacggatggaaatggaatggatagatggaggtcagctgcatggatatacaagtattggatagatattgagtgactgcataactccacgctgggaagagcaagagggagactgaagggatgatgttaggtcagcattgagagtgcagctggacaggcagctggatagaaagttggctcgaccactcagatggatgttggatggtggggtgggggggttggcatagggacatatgttgaaggaatcaacagaaaccagatatgaggcccagctgctcatccccatccctcccgaggcacaagaggcacttacagtaaagatgtcaccgtgcttctccttcatcctcgtgaggaagctggcagcatcttttccaaagtccaaggcataccccaaccaggggatgctgcccaggtccaggggaggctcaccaggtcgcctacagaagccatggcacttgtcaccatttgataaggcaaggaagggcataaagagtgtaggttgcagagtgtgattttgaatggagcagtcggggaggtaatctgaatggagcactcggggactattgcctcacctgctccttttctcttgtaacatgtggatgaccacaccctccctctttcccctccagcccacttttccccctttaaatactgaaaccctcagagtcatctttgaagaaaggcacagaccacagactgtttctgtgattctgtggtttttcttctccctggcattgtccttaaccttggtaaaataaacatctaaattgattgagacctagcttagatactttttagtttacaaattggcgaccatgaagggactccatgtaggtggccctggcctttgacaaatctcctgttggtgtttggtaacagcttggtatctgtcttcattggtcaaaccagtagggctgggagctccctgctgcagagaatcccgaatctctgaaaatttgagatctaagagagctacaatttgagagctaagttttattttgttgtacaactccttttctggagtattacttgcttccaacaaggaaggcaagttttcctgcttccatgacgatggagagcacgtaactcccttctggagtttcaactcacttccaacaaggaaggcaagtttgaagttttttttcctgctttgtagatggtaaagtgcaggccaggcacagtggctgatgcctgtaatcccagcactttgggaggccaaggcaggtggatcacttgaggccaggagttgaagaccggcccggccatcatgatgaaacgtcatctctactgaaaatacaaaaattagccaggcatggtcgtggtgcatgcctgtagtcccagttactcgggaggctgaggcaggagaatcgcttgaacccaggaggaggaggttgcagtgagctgagattgctccattgcactccagccagggcgacaaagcaagactccgtctcaaaaaaaataaaataaaatttaacctgaaagactggttcaggccgtggtgggaagtgggggtcagacatgactcattataccctccagcattcatatcaacacagaccttaagtctgataagaaacctttacatctattcgctctgaagcctgctacctggaggcttcatctgcatgagaaaactttggtcttcacaacctcttattataacccagacatttatttctattgacaataactcttgcaaccaattgccaatcagaaagttttaaaatccacctataacctggaagcaccccccacatcaagttgtcctgtctttctggactggacaaatgtatattgtcaatgtatttgattgatatctcctgtctccctaaaatgtacaaaccgagctgtgccttgaccacgttgggcacatgtcatcaggatctcctgaggctgtgttgtaggccatggtcactcatatttggctcagaataaatctcctcaaatattttacagagtttaactctttttgtcagcagtgtttatgtatgtgtgtgtgtttatgtgtgtgtgtatgcgtgtgtatgtgtgtgtatgcatgtgtatgtgtttgtgtgtgtgtgtgtgtgtgtgtgtgtgtgtgtgtgtgtatgcctttatgctttcttttttctctcctaggttcttgttttttgagaaaaagattttttcttcccagtcgactgaattctgttttctccatttacttctgcctgtctctccttcctcttgccgccctctgctgcataagggacctaaaataatttctaacagcctgggattccttaaagaaaacagagaaggtgccagactccttctggggagaaacctctgtttttccttatgaaaccctaagagtgtaaaaagacaagttcctctcagatcttaaactgattgtttttgtattgcgttatctgatttcttttttttttattaactaaaatagctattactacaggaactactcttgtgtgtttaagagagggagtggttaaaatacttagagaaatgcttttgtaacaaagtgcactgtaaaagcattacatggcttagtctcatgatatctctctccttttagagacccaggattcagtgtggactctgcccagagctcagaggtccagttaaaagacagagactaaatttaaatctacctatctaaataaagtttgtctcctcataaaatcctacagaagatttctataattttatgtttggcttgtggcttggcatccatttttaatctccctctaacacacccagtctctctctccctctttctttctctctctctctctgtctgtctctctctctctttagagatatacatttccctatctgattttcacccaagagttgttcctttagtatgcaagtttggctgacaattgcctagggtaatgaaacaggttatcaagaaattggaagtctaagatagttgtcctttttagacccaggagtcaaacactataacttaacagcaccaggacttaaaaacgatacagaaagtcacatggatgtaataacttttatttaaaattgttttatatcagctttcctaggcaaataaaaacataaaacaacttagacatattaagaaaagccaggagctttataacaggagaaaaaaaggggtcttatgaatcttatcagatctactgctgcctgtctgtctatgtatttatatgtcctgtatataatgtttcactacaaaaaaatacataagaggtctaataaattggcttaaagaaaaaaatcaaatactttatcagaaaaatagaaactttaagcccaaatggtttttcaagctcacatgacttaagtaaatctttaacaaataagctggttttaaaattattggtaaaataaaattagaaatggtttcagaattgtcaatatacattattgttttatatgtattagtcaaggggttatatatttatctctgctagatattataaggtgacaaaatttggcatgaggattatgaagctataaatccagcccaaaagagaattatcattgtgtaactttttgataaataaggcatttaatattgttcatttaatgaaaacagttaaatcctgagttattggcaaaaaacaaaaaacacacatgtatttaactttaaagttcttacttaagtaaacatctgaaattcacagctataaaaatgattaacagggaaataactttaaatagtgactatcacagttttcataagtaatctaggtaaactattttaaaaaattaattaggtaaatgtaatgaaataaatgcttataaataaatgtcatataattcagaatctaaagtgatattaaattaaataatagatacccattaaatgtctgggtcatttccaatttttccttaaaaagttacagaaaaacatttttcttaaaaaagtgttcttattaaaaggaaatagttttgtctaattcaaaggttgtttattaaacaacgtaaaaagaataagtaaataagaagcatgtaaagaaaattataaaggggtatctttggcaagaaaggttaaaagaaaaataattgtatatggaaagaatcccgtaaaaattttttgtcctaaaataaaatgattgatcatttacgaaagagagatgtttaggataaaacaggaagcatgttgtaaatggtttgtgtaagtcataataaggtttataaaaagagaatttatgaaaaacattttatgtgaacaagttgactataattaaaaggaaattatttataatagtctttctagagattgggttttgatattaaaaatgcactaatacactaaagaattggttagaacaaaattttcttaaggtattattttactgttaataacattacatgagattttaatttttttaactcaaaagttcaacttttattgcatcttgctattttcagctttctctcctctttgagaaggactgagagaataattctctccatcaacattttcgtcagctcatataaattttttccctcaggtcctaactgttgtagcctgatgctaaaaatgctttatcataaaggtctaaaggaaatgttttcatccaatataacattctgtgctcctggcatttcttaatatgtctaaattgttctgtgttttgatttgcctaggaaagctgatataaaaaaatttttaatgaaggttattacatccttgtaactttctgtaatgtttttaaagtcctggtgctgtttagttacagggctttgactcctgggtctaaaaaggacactgagtcctgctaaatcttaaacactgacagcagttaaagcatcatcttcagacctaggaggagatgacattcaaaataagctgcatttgtgagacatggagccagaaatgaaaactattcaacctctctaggcccagggactatcatggaagaggtgggcatatgagattgtaagggctgattctgagagattaaattagttcagagtttctctattaattaaacattaacatcaaaggcacactgatgcaagaccagcatctgggctcctgtgtcagattaacaaggttttcttgaagcattatcccaccctttaaaaaattataaaagtttagaaaatggtttatggaaattacatcttagggtcaagatgattaaaatttaatagatttgtttataagatttgagaaacaggatttaattggcctcatgctgtatttattagagcttattatttggaaaattaagtctcctctctcaaagaataaaggtttttaggccaggtgtggtggctcatgcctgtaatcccagcactttgggaagctgaagcgggtggatcacttgaggtcaggagttcaagaccagcctggccaacatggtgaaaccccgtttctactaaaaatacaaaaaaattggctgggtgtggtggcaggtgcctataatcccagctagtcgggagtctgaggcacaagaattgcttgaacctgggaggtggaggttgcagtgagccaagattgcaccactgcactccaacctgggcgacaaagtgagagtgtctcgaaaaaaaaaaagaataaaggtttttgccttttttctgaaatctctgagttatacctttggctaaatgaatgacttattttacaataacctgtgattctattttgtgatgtcaagtgttttaaactttctatatttgacaaactttccaaaataaaatagtcaattcagtccttttgacctcattaattttttggcattaggtcctctgaagtccaaaagagacatattcggcttatttggtaaaataaaatcatacaggaagcattgtcaaatatgaaatggtgtttaatcttctttggattatatttatataaatgagttgcttatataaatgagtatgtgttccaaaattgtatgagattcctgtgattctgatatgacttagtatacatcatcagtagtaattatgattattatgtaaaactattgaataccacagacgtaaccaaatttccttgtcaattgtgtctttaactatggctgttctaagacttttgtcatccacagttgttttagtttgatctttttataggtgatttataatcagctatagaactctgaggagtactcttaaacatgggcttctgacaaccttagagattgtgccattggaatagggagaaaaacttccaggactgtcatggagaactgatgtattcatgaggactgctaatcccatcttgagcagaacaggagttaattgcatgaactgaactaacaggagattgaaataatcttttatgagtttttgtttaaaacatttgttgattctttttgttttgttttacagagtcaagaaaactttctcttcttttaagctatttatagcttttaacaattcagtaaagtatactctcatgagaaaaatttaaaacagaatttctttctctttacctattttttccaaaacttggaaactatttgtgagtattcttaatttatggcaatgtagttatttgcctaagtatcttttttcttttataacagggcataattggagacactggttattttaccaaggctttaactggaatgacatattttcagactactttgagaaaataaggctgaactatagagctaataaaagcaccttggaaaaactggcttcatataccctgtcgtttacagggtcctgacctgtggaaagcaaagaatgtcactttttgaattcactcaattcatacaggtatctgcaggcacagctaaatccttggctgggtgtgaggcttttaaaaaggtctagactcagattccttatggaaaagcttccagcaaagccaattttaaaaagaagagagagctcatatggcaaatgatcagtcttgctgcattttatgaaaataatcaagccaagtataatataactaaaacttattttacaaataagttggtcctactatgattttgtctttaataaaattggggaattggagagagaaaagtcatgtttcaaaattaactatagtacacctgttattagagtctagacttgtctaatgtttttccatttttattattttccacaatttggactgaattctaaaaattctcctggctccaagtctccaaaagaatgttttcaatgttttcccttcttttttttttcctcccctcatttttcctgatgtgaaatcactaaaagttaagctgtgcttttcttaaagccctataaactgaacttaaactttggaagaaaataaaagcaatctctttatatgcagaaatcattttcatacctgcctactgatatacggacttgagagtaatatggcctctatcagttttccaggttcgttctttcttttttgtttatctgcttacttcctccttttttcctgttttctttctctcttattttctttgtgtgatgtgagacttcacaacctactaaaactgagctttcctaacaatgtgggacctattcgtctagaaataaaccatcctagacatgagagatcagacaaaacctgagaccggagattcattttcttctaaaatgctttctccaaaagatcttaaatagaaaaggggggcaggcatacatggtggttcatgcctgtaatcccagcactttgggaggctgagacaggaggatcacttgagcctaggagttcaagaccagcctgggaaacagagtgagaccccgtctctactaaaaattaaaaaaattagcccagcatggtagcacatgtctgtagtcccagctactagggaggctgagacaggaagatcgcttgagtctggaaggttgaggctgcagagcaaaaaacgtgcaggaagaaagaaaagaaaaaaaaaaagaagaaaagaaaagaaaaccagggagaaaagaaaaccggggagaaaggaaaataaaaactcaggacaccaattcactctgccatgaggaaaaaattaaactgaaagctgagtcatgcaagaagctgcctttcctactattcctaagcagatagctacagataaaagtttcagtatctccataggcagctactctatgttcaccttattttatgtaaagtgctgatttactgtgcatgagagaaatacatcattgactatcgccctacccgttccttttctcttgtgacatggggattaccataccttccctctttctcttacagcccacctttcccccgctttaagtattgaaaccctcaaagtcgtctttggagaaaggcacagacctctctactgggcatgtccttaaccttggaaaaagaaacatctaaattgattgagacctgtctcagacactttttggtttacaggtaccacttcacccaccaggatggccataataaaaacaaaaattttaaaaaaggaaaataaggctgggcatggtgtctcatgcctataatcccaacactctgggaggccaaagtgggaggatctcttgatcctaggagttcaagaccagcctgggcaacatggtgagaccctgtctctacaaaaaatacaaaaattagccaggtgtggtggtgtgcacctgtagtcccagctactcaggaggctgagtttgggggatcacttgagcctgggaggtggaagctataatgagctgtgactgtgccactggactacaacctaagcaagagaacgagaccctgttcccaccaccaaaaaagggaagaaaataagtgttagcaaggatgtggagaagtgagaaccctcatacattgctggtgggaatgtaaaatcgtgcagctgctttggaatgcagtctggcagttcctcaaaacgtcaagcatagacttactacaagacccagcaatgtaccctaaagaattgaaaacgttggatcttatacaaatgtatacactattattcgtaagcagtgtcagaggtgttcaaaccagagtgactccatgttgaataggagctgggtaaaatgaggctgagacttgctgggctgcaatcccaagaagaagttagacaatttttttttttttttttgagatggagttttgctcttattgcccaggctggagtgcaatggcgcgatctcagctcactgcaacctccgcctcccaggttcaagtgattctcctgcctcagcctcccaagtagctgggattacaggaatgaacaaccatgcccggctagttttgtatttttagtagagacaggatttcatcatgttggtcaggctggtctcgaactcctgatctcaggtgatccacctgcctccgcttcaccaagtgctgggattagaggcgtgaaccaccatgctgggccaggaagctaggcattcttaagcgcaggatgtttacgatcaagggaacacgttaaatcatgcttacccaacagacccaagacttaacagatccaggacttaacagacccaggaaacatcctgctgtcccgatattttatgaacaaaagccttcttagtttaagaataagttttgctttaaagataataatatagattcttatggaagattgttaggtaacaatcttttgtccccagcccttgtggtagaagagcacacctctcccatgatttttatcttctatataaacaagaagaattgtaactaaggcagacacattcctcctcttgccttcggaaacgccctggtctgtctatggtgtggccactctttcgttcctttaccttcttaataaacttgctttcacgttactctgtgaactcactctaaattatttcttgcctgagatccaagaaccctctcttggggtctggatcaggaccgctttcgggtgacagcagcattattcgtaatagctgaaaagtgaaaacaactcaagtgttcgttgagtgacgaacggataaacagaatgtggtgtatcaatgccacgaaacgttactcagccacaaaaaggaatgaagtactgattcatgctacgatgtgggtgaaccttaaaaacattaagcccagtgaaagaagccagacacaaaaggccacatattgtattaattcatttatatgaactgtccagaattgggaaatcaatagagatagaaagtacattagtggttgcccagggctggaggagggggaaatggggagtgactgctaatgggtacatggtttcttttaggggtgatgaaaatattctggaattagatgatggtgatgattgcacaacccggtggatatactagaaactattgaattatacacttttttttttttttttgagacggaatcttggtctgtcgccaaggctggagtgcaatggcgcgatcttggctcactgcaacctgcacctcccgggttcaagcaattctctgcctcagcctgccgagtagctgggattacaggcacccgccaccacgcccggccaattttttgtatttttagtagagatgggtttcaccatcttggccaggctggtcttgaactcctgaccttgtgatccatctgcctcagcctcccaaagtgctgggattacaggcgtgagccaccatgcccggccgaattatacactttaaaaggggagctggagggccgtggcatgatcatagttgactataacctcaaacgtttggactcacgcaatcctccagcctcagcctcccgagtagctggcactatatataggcacatgccatcacacctgactttgtttttctatttttttatagagacagggtcttgatgtgttgcctaggttgatcttaactcttgggctcaagcactccctgtctcagcctcccatagtgctgggattacaggcatgagccactatgcccagcccaaaagggtgaactaaatgggatatgaattatattccattaaagaaaaaagaaaacagggtggtgtgagacagtgaggggggctggtttacaaaaggtggtcaaggagggcctcctcaggagatgccacgtgagcaaagaccagaaggatgtgaagggagtgctctgggaggggcagggagaagagtgttacaggcagaggcaacagcaagtgcaaaggtactggggtgggagcatgctcggtgaggttttcgagacagcaggagccagcgtggctggagtggagaatgtggggacgagacgtaggcgatgatgctggagatgactttgtggaccacgagggccaaggccaaggtgggagtccggctcctatgccacgcgtggcagggatccactggagggtttgcagcaggagccagtaagtgatgtgaccacacctttaaagggtcataccagagaaagacaagaggaaggaaggagatgtgtcagggaactaccgtgacccccccaggagagcaatgtggtggaagcaatggccatggtccccggggagccagacctaacatctgagtctcccactttcagcacagggccttttgttccacacccagcagttcagggaagcagccacttctcttcctcctttccccctccctctctacctccctctgcccctgtctcctgctccctttttccctctacctggctgcccccagtataacccaaagggtgggacagctcgtgggcaggagcaaatggccagatttgagggccaaggctgggaaggatgggagcagaagcaaagatgaaatttgagggcctaggaagtgcctctcccaaccattccctcctctccccagcccatcccggcttctctagtcaaagaggagacttgcaaatttgagctctgtgagtctaaggaggtgcagggccttgccttgtgcctcatctttttgtgagcccctgggctaaggccacttctcctgaagtctccacgtgtcgtgctgcccaagtagccttggaataactggttcatggcagcccccttccagcccaggtcagagcctggcagactggacccagaagcagtgatttttgcataagaggcaggagggcatggtcacgatgagcccaaactttagcaccatacttcctggcttcaaatcccagccacgcttcttgctggctgtgtgacttagcttctccatgcctctatttcctcatctgtaaaatggaagcaataatgctactgactgcattgggctgtgccaaggatgaggggagttacagagcacctggcacctagtagctgggaagcagctgagaagcaggagcagtaagattcctgggcaccatttacctagtgccaactacacatcaggagctatacttggcattttccaaacgtttccttgtttggaaataatggctaacatttaatgaacgctgatggtgtgggagacaccacactgaggactttatcccagtgactcaatgaatcctccccctaaccttatgaggaagcaattattactgccaggcccattttacagaggaggaaactgaggtgcagagggctaagtcacatgccagagggtccaacatagaggacttgggtttctaatccagacaggtctggctgcagtgcccaccctcttgacactaccctggcccccagtcaccctaagtgggcattttcacctccattttgcagagatattccagagacctactcaaatgcaggccctgaaattttctcctaaaacatctttgcaggcgggagcaggctttcttcccctgcctttctcctggctgtggccggagctccccagcgagccaggtgttattcctggcagctttcctctttccccagaaaagtcccaaggaggcgcagacaaaggcaggaagcccggagcccaggcgcctgacccctgatgttggctcctccagccttgggccctcaatccaactcaggccgtggtcacattccagggtgactcagcctgcagccagcgggggcgaaggaggctctgttttggggactgtgggctctagccccacccacggacactctcacttttttttaggtactgccaggccctggcgggcagggcggtgggccctgacctttccatccccggctcctgcccacacagccggtttcctgcccaccctgggtcagatcccaaggcatcttttctgatttccgactggagccccatcacatgggttcctctaaaaacggcctattcctcactcactgacccctgtcgcctgccctggatctctctcccacttgaccctttgtgaaccagggaaaggagtcaaggatgggatgtcacccgcctccatgccccctgacgtatcgcatcttcactagatggaagagccatgaagggagggcgtgttgttcactccagcactcagaacagtggctggtctgaatgaatcatgtatgcagtcggtgctcaatgggcagcacctgcctcccagagttgctgagagggttaagaaagccaatgcaggttaagcacttgacacagagtccatcttctagattgtccagagcagaggctggcatggttcagctgtgcaatgttgggtagactgcccaacctctctgttcaatcatttcaactcaatgcagggccttaagctctgggaggatttaatggggaacaaaagggggcttagttgcacaggtgagctggagcaacccaaaattctgtttaacctgcttaacccattcttcccccagggctcacccacaggcctccagggttttcagtctgccattaacagggtttcccagatgctcttccatacctgccccgcactgctaccactgtgcataaaaagcacgtggccttgccctagtttttgttttctggtttttgaaatagacacaaattcacagaattatttctcaacacaggaaaaaacagcagaggaagtacagtggtaactagaatagctgcatgctggagaggcaatagggagtagtggggactgtggcaagatttagagagggtgctaccactgagtcccaggaaagtattgctagatcttcccatttttcagaagaagttggaaatctagatttttgtgtatggaatcccccaattttctccccatgtcccacacagcacaaacccagcccatccagggctgaatccagtcacggaccactgttgggtgacctctggtcagtgcatgttagaatgagacagatttatttgtgcctacaaattctgcatcctgcaagggcccagaccagccactgggccacagtgaccctcgcttgatgccactatgccttccggacccccagaaaaggagcctcccaaccaagagatctctctcagtgctccctgtggtggtcacacaagcccaaaggaagagatgcagtagcctggtgatatggctggggcttgagagaccacctccatgagccacctcgaagtacagataaactgaggcctgggaagcaggaagaatgcttctgatactcacaaggcaaatcaattagtttcaaggggcccacaagccatactcctaactctcagctcaccaccctcatgttcaccgaatggggctcgaaaattcttgctgtaattgcagaaatttgaatttgaactgggaactacatgacattaagaattatctttttatattctcaggcaagaaaatagaattgtagttgtcagttttatatgcattctgaaatattcaagggtggaatatcatgacatctaattttttttttttgagatggagtctcgctctgttgcccaggctggagtgcaatggcgcaagctccgctcactgcaagctccgcctcctgggttcacgccattctcctgcctcagcctcctgagtagctgggactacaggtgcctgccaccacgcctggctaattttctgtatttttagtagagacggggtttcatcgtgttagccaggatggtctcgatctcctgacctcttgatcggcccgcctcagcctcccaaagtgctggaattataggtgtgagccaccgtgcccagcctatgtctaatattttttaaataatgttaatgactgtcaaatcaaggtataggtacatggggcttcttaccgtattctttttctttttctgtatagttgaaatgtttcctaatttaaaagttttaaattaaattctaaaggtaaagacggagttgctcactcccagaagtagtggtgtcttactgggataagcatgaattttggaggggcctagatgtggagtataatttttgtatgaccttgggaaagtcacttcatctttttaaacctcagctgtatgataagggtgatggaaattacctcaaggcttggtcaggataaagaaatgagacaagggagctggagagccttgcttattttaacccaaactggatcaccattcagacggcatcagggtcacccacttgtttcacttgtttgcccttttttttttttttttttgagatggagtcgctctgtcgcccaggctggagtgcagtggcaggatctcagctcactgcaacctccatctcccggcttcatgccattctcctgcctcagtctcctgagtagctgagactacaggcgcctgccaccacgcccggctaattttttttgtattttttttttttttagtagcgatgaggtttcaccgtgttagccagaatggtctcgatctcctgacctcgtgatccgccctcccggccattgtccttctttaagaattttttgcttgtagttgcatttcttagtatctaaaagtcacatggttctaagacttttgagtgttcagattaccagtataatgtgtgggaagactgagaattcattcttcctgtgaattaaaaattcttgcaaagccaggcgtggtggttcacaccggtaattccagcactttgggaggctgcggtgggaggatcgcttgagctgagtttgagaccatcctggacaacatggcaagatgccatctctacaaaatttttaaaattaactgggcatggtggcacacacctgtagtcccacctactcaggaggctaagatgagaggatcacctgagcccaggagttcaaggctccagtaagctataattgtacactgcactccagcctgggccacagtgtgagatcctatcactaaaagtaaaagctaaaaattcttacagcccagagttttaatccagacagaccttgagcaagttgcttagcctttctgagcctgtttcctcctctgtaaaatggagataaccagagtgtccctagctgaactggaaggagaaagtgagattggggatctaaactggggtccccagggtccatgcacctaccctcaagctgccagtgaccctcattcccacacttctccccactacccactgttgacccttccaaggtgcccacaggtataaaaatcaaaggctcagcagggcgcggtgactcacgcctgtaatctcagcaccttgggaggccgaggcaggcagatcacctgaggtcaggagttcgagaccagcctggccaacatggagaaatcctgtctctactaaaaatacaaaaattagctgggcatggtggcacatgcctgtaatcccagctactggggaggctgaggcaggagaatcacttgaacccaggaggcagaggttgcggtgagccgagatcgtgccattgcactccagcctgggcaacaagagggaagatccatctcaaacaaacaaacaaacaaaaaaagagcccataacgtattcacatgatggaagactccagagaggatcaaaagaatggattcgatctccttgtagcaaaaagatctgcttgtagcaaaaagaacagatgtcaaaactaaaatctggagtgaaaagagcaagcaacataatgtctgaaaacatttctatacagtgtattgagaaagcctgacaggaaaaataattcatttcttccctgagacatttattcactgtctttttcttttcttgttttaaggcaaatgattgactacacagttgtaaatttcagctgaaaagatgtctggaggttgaagaaaaatacagtgagcttattgtttgaaaattcaactaccatattgtttaaaaatcaaaaagttcccaaggtttccggaattttcagacacgaatgtaaactaactctctcttacgtggctctgtattagctacaagctcatgtctatgtatgtaagagtaatttttatgtaagagtaatttttaaaacatctgggagactgaggaggtatgaaaactaaaggcaatgtggtaacttggggccggatcctggaacaaaagaggacagtaatgggaaactggataaaatcccgtgaagtttgaagtttagttaagagtaacggaccagtgttggtttttagtggcgacaaatgtcccataacaatgtaagatgttaacaatagggaaaacggggtgagagaaatacaggaactttttgtactatctttgcaactttctgtaaatcccaaactagtctcaaataaaaagtatatttttttaaatatggaaggttctacccagactcagcaacaggagaggcccagagagggagagaggactagacttcaggggctgggggagggttaaggggcttcggtcttacctataacaggataaatatttgtgttaagtcgaatgtattcagctattccttatgcaattcaagttaacttaaaaaatattttatgaaaaggagagctacagctatctccttgatttgaggctgtctttactttttctcctaaatcacagatgctcaatggagctggaaaacctttgggaccaggaggctgtgacatctgaccctggctccgttctgtccaggctgtgggacctcaggggaaggtagagacttcataggcctcagtttctccctggcaaatgaaattactaagcccaccgacccccgtcttccagacggggaatcccggggtgggtggttccagggcatgatcaagacatcccccaggggctctacactccgctggctcaacactcccatctgtgtaatgggttgaggagcgaggctatccctataggactgccgaaagcaaggcagggtttgacagcgcgtaggtgggtgccaggtgcaggcagaggctggagagtggagagcgcttcttccacccgggccacgcagaggctgtccccgcacggctccccacccacaaaccctcggtcctcacctgaaaccccctcctaggtccctgccgtcgcgctaagggccagactcggacttgtcgcggtgggcgattcgccccgggggacctaccggaccccgcaccttcccaccttgcaccttcttggcagggggagcacggcctggccccctcacccacgtgcggggccccgggactcccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagcagcagcaacagtgcggccaggaggccgaggagcgcggcccaagccatcgcggggctggcggggctggcggggctggcggggctggcggcctggcccactcccaggtaaagttccccgcccccacccggcgcgcccctcccactccgcccaccccagcccgctttggggcggggtggggggggtgggggatggggccctccgaggtccgcaggggtcggaccggggcgctctgttagaaaccctgctccccccagctcaggcctgatggaaaatgtgggagggaggggaggggagaaggagggggagggggagggggcggaagggatgtggtgggctggggagtgatcaaggggaaaggagatagatgggggactgagggggatgtggtggactggggggtgatggaagggaggggagagggagaggatttacaggaaggaagagattatatgcggggagggaagagggatggggaagatgggagaggacttttggggaagggaagaggagggaatgtgggaagacggcgggacgatggggaaacagccaaggaggtatggggaggagggggcacagtgggaggagaaaatgtggtgggaggggacgaacatggaggaggagtgtaagggggtcaggaggagctttcccaccacattccacattccacctagacagaggaaaccccccaaggctcctcctcaccccatcccccaccccaggcgtgctggggacctggagttttccattctgtggtctgggctgggagggctggtctggattatatcgcaccctatagtatcttcagtaactactgggcagggggtacaagggtgtctcagggagtcccctcatcctcacctgctttggggacagatagtgcccgtgaagtatgcaccctctacctggtgcacgttagggcctccggatgtggtggccattgtcatcgctacctggtgcttggggtgccagccccctgtgcccgcggctctgcaatgtaccaccccagggtgctgatgagaactgggggtcaatccagcctcactccacgcccctgcccccaccatccccattcccaccctgggaagcgttgggcaggtagctcaacctctctgagctcacctcattatctggaaacagggagggcagagttgtgcttacctctggggctgttgtgaggaagtgatgagagcttgacactaaaaggaatcacaaactgttgagtgcttggcacactaagttttatgaaaccatgggctgaacctggaggtaagacccaggaggtcttgttctagtcctgtatccacccattcagtgccgggtgagcttaggcacgtttcattccatagtcccagcagagctctggagaagctgttgctcctcctggtctcctggcttccatccttatcagccagggtcctgacaaggcccttcgagaaccagcatgatccgccccttctcacctttacctgcctgaccctatgcccccgactctctccctcacccactctgctccagccacactgatctccccatctttccctagaggtcccactgcagggcctttgcacgtgctgttccctctgttcggagcattcttcgcacagcctgctctttccaccacctccccggtgcctctatctctgctcagctgtcactgcagagaagctgtctttggccacctggtctaaaacagtcatctcctcttactgatttttgtttctttgtttttttgatagtttttttttctggcagtacttcacatgtcctgctatcatactcaagattcattcatttgcctgcttaatgttggctgtcgaggcagctggatgacccccttgtggcctcagcagattcagaacagcaggaggcaaaaggagttttctgatcctcttgtttatttttccagcttatctgccagagaagccaacaatcccaagaaggccatagaacgggtccagaggattttctccaaatttggggagctccaaagggctgtctgctagcagtggggttcacagctgggcttggccgatcctcagctttgtgaccccaagcagactgctccacctccctaagctgaggttcctcattgacagaatggggaaaagagaacctcatggagttgaggtcaggaacaaacgacctggtccatggggcacacctatgtgagtgcctgtcacaccatgagcatcagggaaagttaaccgcaattagcgcttataccagttccgctcctctccattatctgtgatcaggcttggtctcaattttcccatctgaaaaatgggaagaacagttccttcctcatggggctgctttgagaactgaattaaatgaaaagagaatgaaatcacccagcacagggtctggtatacaataggtactcaataaatattagttcttctactccccacccctggcttcagtgcagaccaatatcacctcaatacaaatatctcttccagatactctcttcccttctcgacccatagacaaaatcctcccagggaaggagaggcagctgctcacacaccaaagggagatgaatgtgagcctctggttcttcctggatttgttcaggagtcggcatatgtttaggaaggtggccaggcccccttcccagagaatgacccaccatgggtctgagctggtccaggaaatccacctttgctagtgatttgtcctgaggtgggcaccttccagatatctgttgcgggcttctagaaaaatgtgtttccttcctatttgccttctcttctgctttgggggcaatcgtgtgggaatgtgattagtgggggagctgaggggggctgtagtgttatgagggaaggccaagaaaactgcagagccccaaaccagagctgcggaatcaccatccctggaaccacctgcctatagatttctcatttaatgagctaaccacacgtctgtgctaggacaccatgagtcagatttttctaatacttgcagccaaagacattcccaactgagacgccttctagatatggctgaagggaggaccaaatgaggcaatgatgcatccggagcacctctgcaggactggcccatgcgagaattcaaaagtgttgctttgttttattatttttactttgcttactgtgtaagctttctatgtttatcaggctgacaggacatccaaccctctggctatggcatcttggaggaacaggcaggccttgaaaatagcagaaattccgaattcccctgccccgggaggactcaaaggaccctgctgaggacagagctgatatggcctcagaataaagatgagggaagaccatcccaaggaagacccctctagcccatggcaaaagggctggaatacgcaaggatttgaaaagcaagttttgctttccatataaacctaagcaagtcgcttaatctgtgagcctcaactactttacttgtgcaatgggcatgttgctggtagtggtgatagcagggagccaccgagagagcttccaagtgtgccatctaagccctcctctggggaagggaagctcctctggggaagggaaactggacccccgggaaaatttattctcccagggacgaacatccagacatttccctgtaggagcctcagtgtgttcagatgttcactgtccagtagaaacaagacatctaggcaactctcccatctcaccaagcctctgctctcttctgtggccactgtggggttgtgagagtaatgtcaagacccaacccaattagaacacagggaattttgcctgggaaagggagcccttctaccctacacccctgctttctctcttccaaggatcaggtctgattcatgtctgcatcctaaaggctacaaataaactgtgtccggaaaggaaaatattatgtgtattgccttcttcaaggctaaaaaccagtctcaacagagaggggcagttttaaatatttttttgtaacaatagttctaactttagttagtaactgaagccatctgaaacactttttcataataatttatttattccccacaaagaacctataaaatgggtagtaaaattattccgaattcacagatggtgaaatcaaggtccagaaagagtcacttcacccaaggtcacgtagtacttcctttgataagctagagcatgggaatttgatggcttcttaggacaagctaacttactccctggtgctgcaaacacaccctgggccttcccacctccacacctttgctcatgctgtttacctgcctggaagccctctctttctctaccttttgatttttccaaatcggttaggagcaggttctccaggagagccaagatgagatgagatatactaaaggcttattgagggagtgccagggagtaaaatgaagagggagccagagagggctgggagaaagggacagaaaggaggacaaatggaaggaagggacagaggaaagaagggaccgtgggctgcagtgcattcttagaaaggtcaagtctggccgggcacagtggctcatgtctgtaatcccagcactttgggaggctgaggtgggtggatcagttgaggtcagaagttcaagaccagcctgggcaacaaggtgaaaaccccgtctctattaaaaatacaaaaaattagccaggagtggtggctggcacctataatcccagctacttgggaggctgaggcaggagaattgcttgaacctaggaggcagagattagagtgagccgagaccgcaccactgcactccagcctgggtgacagagcgactctgtcaaaaagaaaaaagaaagaaagaaaaagaaagtaagtaagttagttcaaggctaacaggttgtccttgagcctcctgaggagccctatgtctcccaagaacaagtctgcttcccccagtgattggctaggagcaaaccctgggaagcatggcatatctgtcaatcaggctccaccaagggaggtcccagaggtgtgttttcatggctgctgcagctacgaaaggaagcacagctgccgtctaaaactggaacaatgcaagaataaattcttccacttacagaagctaaacgaggttgagaggtggaggggaaggagagacccaaaccgcaacgtttctggtgtttttgtgctgctaaagagagagtggtaaactcaagtcttcgagcaagtattgcaaatgaatgaagtgagccagtcatatcaggaaggcaacagggagggatgggaacaatggaaaactagagagggctgccccatccaaaaggaagcagcttctggcagtaccagccaactaaagccacgtagaaatacatgcctagtgtggccagatctttagactcaagagaagccagaaataatggctccaattattttaaaacgctgcatagaccaacagcacacacctgcccccagatttttagccctgcagtctagttgtgccaagggccagtggtttaaacatttggggtatgtaaaataggtttggagttgggatgttgaacaaaattgctctgtagaattaaggaaggacaacagagttttagggggcagcctgaaagagggggcaaagaccaggccgacatgagcacagattgggggcctgtcccagtgtgacatcctctgtggaattaggagccaataaatgaccatttctattggtgatgtgtcatactgagtgtttagttgtttgctgtcttgggctgtggaataacaccacacatacactcatatacatacacacgcacacacacacatgcactactctcacatacacactcacatgttgccccagttacccccaaacgttcagaaacaatctgctacacacgtcaagtgaccaacgcatcctggtttgcccagactttcccagttttagcactgagagccctgcatcctgggaaacctctcggtcctgggtaaaccaggaaggttggtcacgctatcaccacacctcagcgtagcgtgtgagtggccagagattgggtcagagctgtggcagccaccttggagcctgaggagaatctttgctaagtcacacaattaattagccacccctggaactgtgctgcagtagattagatcatagtctccaatttttacccactccctgtatcagaattagacattcacgcccttggctgcagggttgcggtgcctcccactatgagcagagaatagtatctccctgactcagtgatggtggactcgggcctgtgactcaatttgatcagtggaggatgaagaaatgaccagttgccagttctgagcagaggtttcacgaggaatcacatatttccacttgaccttggtttctgccttgagccatgacccacagggcaaacctgagctcaacctgcagcctgaagtagagaacccctagctgacctgcagaggtccgaagaagaaaaatgtacgtgttgttacaagtcatggagattttgagatcttcttaagcaacaagaattgactaatgtatactttatctctgaactttttagaatccttttggttgaatgttctttgtaccagttaaattagaataggctgctttctactcttggagccttggtacatctgtacaagaggatgatgacgacaaggcccccctcccatggtggttggacgaattcaagaagatcttgtgtctagtgcatgcagtaggcacttaataaaagagatgatgctaggccggctgcagtggctcacgcctgtaatcccaacactttgggaggctgaggcaggaggatcatgaggtcaggagttcgagaccagcctggttaacatggtgaaaccccgtctctactaaaaaatacaaaaattagctgggtgtagtaggggacacctgtaatcccagctactcaggaggctgaggccggaaaatcatgtgaaaccagaagggcgggggttgatcgcgccactgcacttcagcctgggcaaaagagtgaaactctgtctcaaaaaaaaaaaaaaaagaaaagaaagagagatgaagcaaggctgggctcagtggctcacgcctgtaatcccagcactttgggaggctgagatgggtggatcacttgaggtcaggagttcaagaccagcctggccaacgtggtgaaaccccgtctctactaaaaatacaaaaattagccaggaatgctggcgtgcgcctgtaattccagctactcaggaggctgaggtgggaggattgcttgaacccgggaggtagaggttgcagtgagccgagattgtgccactgcactccagcctgggcgacggagtgagaccctgtcttagcaacaacaacaacacagcagcagcagcaacagcaacaacaacaaaagagatgaagcataattctttcagcacatattaccaagtatttatttgccaacactgtgcaggcctctttatcaagaattttactgaagaaatgaaagacagaaaacctcttcacttggtcttttttatacatgaagagaaagcaggtctgaatcagaggcagagggttggaagaaatgacctgttttctgccatctgggccttgctgctgactgtctctaagaatttgcacaggcctgggcctttggagatttgaaggtctctaaagtgcaaggatgtcagctgcaggggagccatcctccagcatccttccccaggagagccaggattatgtagggaatgtgcttggctaagagcccagaggtggggcagctacccagatgcaaacatggctgggccaggcggcctttcgttcagcgttcccaggctaattccacctagaccttgtcttagcctgtgagaggatgttctggagtggtcttgcccctcttcccaggctatctgccagaggtggtgggtgctacaggagagggactccagcaagcttctcatcctttggttttcccaggacgggggacaggtggcctcacggctcccaaccagctgccttggcactttgtagtggaaaaaatgatgaagtcagacctcagtctcctcaactccctgctgtcctgcctgagagccagcctagcatggaaggcaaggagaaaagagacccatgttgatctgtcacccagacagaccctgagtgatgatgctcctgccaccctgaagcaccccaagaacctcagaacttctggcttctcatcttgaaaatgggacagcagtcatagctgctttgcttattatgtcaaggagttactaaagaggatccagttagatagtgggggtagaaaaatggctgcctaaggccacatttaccctctccttctagaaattataccagagcatcaagaataatggaaaaacaaatatacaaaaccaaaccacaaactccatttttagcaaagccaggagagacatataattcatcggcttcagagtacgtgtgaagcagctaagacagggcagaagccacatgggagtggtgagtgggctcagtgatagcaaatctcagaaagcatcagcaaaactacacttcctagggatgagggcttgccatgagatgaaagttatgttccttctttataaaaatgaatgtagaagcttgggtgaatacgattagcagcagaagctctcctggatctcgtttggttcagagaaacagaggaggtatagtgaagaattacagagagaagacatatttgcaggaagcagtctgtctctatggcagcagaggagagccacagttacagagcccatgaagctaccctaattcttccttacacccataggagcaatcagcaaaatacctgacccaggaaaaccaagcccttccaatgacaagcttttgaaaaagtgtaaaagccttgatacaaagatattatgataaattatgaagagcagaaaaatctaccaatagatgaaagtgttaacacaaaatggatgaaaattatatccaaatcatattggcataaattcaaaaaagaattgaatggaggctgggtgtggtggctcacgcctgtaatcccagcactttgggaggccgaggcaggtggatcacctgaggtcaggagttcaaggccagcctggtcaacatgatactctcgaggctgaggcaggagatcgcttgaatgtgggaggcagaggttgcagtgagctgagatcatgacattgcactccagcctgggcaactagtgaaactccgtctcaaatttaaagaaagaaagaaagaaacatcttaggagaactgaatggagcaactacctctgtgaaggaggacaataaggaaactgaagaactcaaaaagaaggcaggcaaaaggaggtaatgaacatgaagggttagcactcaggaaagaagtagaaagaaaaaaaaatatcagaaatgaagacaaaattggaggggaaggaaataggccctgcagaaaatacagcaaggacacggttaacagaaatggaaaaagaggaaaaaaatgagacagaaataaagaaaacattagaaagactagaaagaaaattggctgggtgctgtggctcatgcctgtaatcccagcactttgggaggccaaggcaggcagatcacttgaagtcaggagttcaagaccaccctggccaacatagcaaaaccccatctctattaaaagtacaaaaattagccgggcatggtggcacacacctgtaatcccagctactcgggaggctgaggcacgagaatcacttgaaccccagagacagaagttgcagtgacctgagattgagccactgcactctagcctgggcgacagagcaaaactctgtctcaaaaaataaataaataaataaaaataaataaaggtgtgagcatccatgcaccagataacacagcaacagatagttacagagcaaggacattttaagtcacttctctcagctcttgaaataccaagggaaaaaaaaaaggaaatagaaagtcaaaataacatagtgaaccacaaacactggctacctagtaagccacaaagaacatggcaataatttttttaaaagcagaataaaagtacaatagtctcagatcgcaatgcaacaagcctgtgtgacctccattcctctccctcccaccccagcacctccccagagggcaataatcccccagccccacttcaccaggcatcagctcctgtgtctgttccatgttagatcatgttagatctcatcttggccagacacggtggctcacgcctgtaatcccagcactttcagaggccgaggcaggtggatcacctgaggtcaggagttcaagaccagcctggcctacatggtgaaaccccatctctactaaaagtacaaaaattagctgagcattgtggcaggcacctgtaatcccagctacttgggaggctgaggcaggagaatcgcttgaactgggaggcggaggttgtgagctaagatcgcgccactgaactccagcctgggcaacagagtgagatgctgtctaaaaaaaaatctcatctcaaacacacaaacatttcactgctttaaaaaaaaaaaaatagaaatctttggtggatgttcagccacgctcatggttcacagctccaaactctgatgcacaggcaatcacatagcccaaatgtctacatgtcctgcatgtccgcagagggctagagtgagagagcctgggctccacggccagactatgtgaactcaaagcctggcacccgcccccccacttaaaaggcctcaggcatattgcttatctgtgcctttgtttccccaggtgtcaaatggagttggttgtgaggatgaaaagagttaatctctggaagtatggaaagccttggataaatgtgggctattagcattattttcacagcctcccaacctccctccactaataccagacacgctggagagagttctctgtctccctaaccatttatttggtgatcagaaggaccttctgcctgtgatttctgacctggcaggatactgggggaccacttttgcctctgcctggagatagcatgtctgagaatgaaaccgacttacagggcagcagaaccaagagatagggaaatacagtttcttgagatatcatttgaacccccggattcagccatgcctgaagccagaatgctcctgaccacatgaaccattaaattatttttgtttgcttgtttcagccaatttgggttgagtttctttcacttgcaatagaagaaagttctccattctgaagctgaataaggtagtatgtgaagtacttgtttcatacctggtgcttaatggatgaaaccttattacattctcatttcgtaaaccttctccagggctttctgggaggcaaccagatatgaattagagtgacacagctttgcactccttgcccagcctggataagatgccccattcgcagcaagctctatgcagtcagggccagcttcatggacatgcaacctgggtgctcacataggcccctgcacccagaatggtctcatgctcggcttagcgctctcctgtcaccagcttgaaattcttaattatttttgaacaagggtccccatgattttactttactctggtacccacaaagtatatagctggtcttaataccagtatcatctccactttccaggtgaggaaactgaagctcaaagaggggaagcaagcagcccaaggtcacacagcaagaaaggggtggagctgggaatcaaattctgattctgaggcccaagttcataactgcgatgtgccagtgcctggacaattcctcatatgtggatggcacttcacagtttatactctagtgcatagcatttgaccctcataccagctttagaagcagaaattgtcatgctggcatcaggcagagtacttgggtttgttcaagcctcagaaaccaaccctggctaatttaagaaaaagaaaaggtggggacgaggtattggaaggaaaagttgaccagctgggacttggaaaggacaggaacaagcagctccgggaacgcggggagcaggagccaggggtgtggggagcaggaaccagtggccaggtcttcggggctccagctgtttccaatctcagcattccttccgcttcagtttctgattctcccacgagaaagtctgattggccatgtttgggtcatgtgcctgcccacagaccttgatggtcaaccaaacaaggtgggaaggatgatcccccaaaggcgggtcagaaagtggggtgggagggctgaaagctgggcagggacggctgtgtgcgcattttacagatgaggaatgggaagcccagacagaaggcaaggccacagaaccgggaatggtggagtctgggctccagtcagaggcccaggctgcctctcttcactcccaggactccaggctggcaggggaacaggagggcattgttctccctgttggagtgaatggccgcctcctgggaaacccaggacccagatggggtctccccagggcgcaggaaactgcctcagactgagctgtattcaggggtcgaagcctcctccccaccctccccctacagtggacagactcccccttcaaatccaacctcactgctcagctctagccctatggtttttaagagaagctagtgggggaaaggcttatttttccaatgtgcattttttccggtatgtaagatactgtgtggaccaaataaaatatgtccagacctggaaacagcccaagcatagctagtttataagtcctggaatgctccttcctgcacacaaaaattaagggtctgtttacatagatatgctagtgtgttggagttgaacttttccttactctgaactcagatatgcaaagaaaaatgagccttttacattttccatggatgtcatctagttcagtgattaggagcaagagacatgctggagccagagaacctgggtttacatcttggctttgccactatgtgacctcaggcaggtcacttaacttctctgagtctcagtttcctttaagggacatatgtacacacgggtgtggcatttaataaaaaccacaaaagtccctgctactgctctgtgtccatggtatgatgttggtcatgagccctcacactggaagaaatacaaaatcttaagccaggctaatcatttaaactgtctatttaggcaagacaggcttcccctggggtatttcagggacaaactccattgatcagtttcccaccttcctctgctcctcttcaagaagcttctgcctgaacaccactttggtaacagggaaactgagctccgaggagagaggtcaaggttaggaaatgtcatttagtgagtgtcccttctgcacaaagccgtataggtacgcaagctccttgaatcctcataaccattctggatggaaagaatcaggactcccttaaccaacattgtggagcttgcaagtaacggaggcagcattagattccaggatgttcaacttcgaggcctgccttttctctgctcctattaactgtgtattcccattcctggtcataaggcaagattcagaggcatctgtgctccaattgaccatggcgcttgatcccaaaaggaaaaactctttctctctctctctacctgattaacaataataataacaataatttaatggctcaagcagggaaagtccagtggtgggaaatcctggcttcagggaactgggaagaaaaacagcttcaggaatggcaggatccaggggctccatggatgttgccaggactcacttctctctctaagcaatgctttcctttgtattggcttctccctcaggcagcctctccctgttttgtatcaagatagccttagcagtccttatgccctggcagcttggtgatgccagcagaaggagactctgggactaactctggttggccttattaaggtcagatgcaaatccctttacttctttctctagctcatatcggtcaggcctgcgtcgccttcccacttctagatctggaggtagagactagggtagttttctcacattgatgccctaattaatgaccttcctgcatccgagccctttgcagtgtgagtttatttccacatgatctgaatctgggcttggccttgagacttgctctgaccactggaatccaagggaagtgatgctgtgcctgcttccaacctaggcttcaagagtcttcttcacttctcccctctctgttggaactctggatagccaccatgagaacaaacctgggctagccagctgcaggaggagaaaccatcttaagaagtgcctggtcccccagcaaagactaacagcgcaacagccagctgacctatcagagtttgttttttaagcaatcttatctaccttcttgcaggactaggattgacagatgacaaaaaaaaaaaaaaaaaaagagttaaggcacatctgtaaagctagaaattggaaggctgctagggtttgaatcctggcatggccattccctagctattaggcttagtttcctgtggctgttataacaaattgccacaaactcgatggctcaaaacaacagaagtttattctcacacagttctggaggccagagggtgagcatcagtttcactcagctgaagtcaaggtgtcagcagggccatgctcccacagaggctctgggggacaaatcactccatacctcttccagctgctggtggctgccagcattcctttgcttgtagccacatcactgccatctctgccttggtcttcacgttgtcttcttttctgtgtgtctgtccaccctcccttggtcttcctcttacgaagcatatgacatgcatgcttttaatacatgtgataacatttagagcccagcaagataatcccagataatatcctcatcacaaaatccttaatttgatcatatttgcaaagactttaccatataaggtaacattcacaggctcctgggattaggagaacctgatttcttagaggtccaccattcagcccactgtactagcatgtggctccaagtgagtgtcaacctcactgtgcctcagtttccttatctgtaaaatgacagcagccacctcactgggtaattatgaagatttaataagtacttagaatggtgaccagcacatgataaaagctttgtaaatgttaaccttcaataatatcaagggtcggtcgggcgcggtggctcacacctgtaattctagcactttgggaggcagaggcgggaagatcgcttgagcccaggaatttgagaccagcctgggcaacatgacaaaacccagtctctacaaaaacaaaaacaaaaacaaaaaacctagccaggcgtggtggcatgtgcctgtagtcccagctacttgagggggctgaggcacaagaatctcttgaaccctggaggttgaggctgcagtgagctgagtttgcaccactgcattccagcctggggggcagagagagactctgtctctaaaaaaataataataataagatttgactgtgactgaaattcgcacaagaacaaatcccttctctgtcctgtttgctcgcgcctgtcttcatagcacccaccatggagacttgcacatagtaggtgctcagtaaatattaaatgcacacatgccactatgtagctgtgtggcttcaagcaagttgtttctcctctctggtcctcagtttccttctcccttcacgaagagcttcttgtagggaaagtccattcctctttctgggagggtgtgtccccatcaggggtagagggttcaggggtcaggagccggccacagctgctatctccctgagtcaccaaatttctcaacttgaggccaagtgtctaaatattgtgactgagccagttagagataagatgtggaaacattgatttggcccaagcaactgcagtcacggtgctggagccagacctccctggatcttctcagcagcatgagtgagtgtttagcacctgccaggaacacaggctgctgacctgcaaacagatggggaggcccagatgcctggcttggcagcaagagcctgcctttgccgtctctgtttacacagccagcatccagtcaaatctctgtggctccagtggagaaactaaggcccaaagggagtgaaggatgtgtcgtccagggttacgctgggagactgctatcccatgaagctaaaacccgcaagtcctaactcccagcccagcacctgtgggaacccaccaggcccagggagaaggaaggctggcagcgtgtcacaggcagggagcgtgcctgagcaaatgctcaggggtgaaagaccagatgcaagctcaaacactagagtgaatgggagaaaaggccacgtgtccaggactttggactcaattcagagaataaaagggaaccatcgatggttttaggaagaagagcagcaggatctgagaggctttttccaagtgcttatagaccaccagcatcagaatcgcctacgacaggagctgggggaggttgtcaaaatgtgggttcctggggtccaccctagatgtggctccccattgtagcaggccccctctgaggggattctgaagcacacccactgttttagtgagtaggagatgcagctaacatcccacttataaggtctaatctcagacaaacctggtttcaaatcccagctctgccacttacttgctctgtgattttaggtcacttacgacacctctctgagcctgttttctctcctccgtaatgaaacaatcttagcatttgcctcaaaggtttgttctaaggattcaataagataatgtaggtaaagtgctctacatagatccagagccctcctagtgctcaaaaacactggtttttagagattcccttgggcagcagtggggagaaagcaatggaggagggcaggcaaggaggcagggaagccagtgaggaggcagcagtgggactccggggagaggtctgtggctagggtgtggacatggtgacgggtggggtggctcctttgcaccgtgccaggtggtgccgatcttgtatgctcgattgcgaaagaagctctctggagttggtctagggcaggagagaagaggatgagcaaaaaaaccaaaagaggttgatcataaaacccatattcgcagtcacggactgggtgcttagcgtgggccaggccccgtgttagctgcttcctgatcttcatcctcacaaccacctgacagtgtgggtagcacttcatcaggggttgttaaccccgacactagtgacacttgtactggataattccttaattaaggggctgtgctgtgcactgtcaaatatttaacaacacccctggactctacccactagatgccattaacactcccaccttccagttatgacaaccaaaactgtctccagacattaccagaggtttcccgggaggcaaaatcacccctagttaagaaccagtgctttattctccttttacaaggagggaattgaaggctcagagagccaaagccctttgcccacagtctcccagctaagaagtggccggatttgaactcaggtctgactcggagccccggatgttaacctttgccgtgaaggaggccacatctatgcagtggcaggcccagatggtctatatgggggtcttggggacagtggtcttttccgaaggggcagctggaaacacctgctaagcagatgggctgcgtgagcgtttgttgggggtggttgtagaagcgatgatggggattatgagagagccaaatccccctccagaggctaccaccatttgccctggacagagggactgagggagatgggacgtggagggcaggcaagaaggaccaaggtggcactgttaggagaagctgggtgaggtcatctatgcctggagccccactgccgggagcctcccaaaaacactctccaagacctttgggctaaatatttatcctgtgaatgctcttttccttcctgcatggggagtggggctttggaggtgggtccaagaaatttggggagacagaatccagagaaagaggaaggggacaggccagaggtcagaggtcaggagaaagtagtcagaggccaggaataaacattcatcctggcatctaaagccttccagagtgagctccactgccaccacagccatctcactcagggaggcgtagaattcaaaatatgtttttgttttcttaagagacatggggaataaaattacaattttttttttggtccagtctttttttttttttcttttttgagacagagtctcactctgttgcctaagatggagtgcagtggcgcgatctcagctcactgcaacctccgcctcctgggttcaagcaattcttgtgcctcggtctcctcagtagctgggattacagccacccaccaccatgcctggctaatttttgtatttttagtagagacaagatttcatcatgttggccaggctggtctttaactcctgacctcgaatgatctgcccacctcggtctcccaaagtgctgggattacaggcatgaaccaccatgcccggctcagtcttgatatttttaagcaagggagttggaggtgaagggaaaattaagtcaaaaaatcttacccagaggacaggtgtggtagctcacacctataatcccagcactttgggaggccaaggcgggcagattgccagaggtcaggtgttcgagaccagcctggccgacatagtgaaaccccatcactactaaaaatataaaaattagccgggtgtggtggcgggtatctgtaatcccagctactcaggaggctgaggcaggagaattgcttgaacccgggaggtggaggctgcagtgagccgagattgagccactgtactccagcctgggtgacagagcgagactctgtttaaaaaaaaaaaaaggctgggcgcagtggctcatgcctgtaatcccagcactttgggagcctgaggagggcggatcaggagtttgagaccagcctggacaacatggtgaaaacttctctctactaaaaatacaaaactaggcggatgtagtggcgcacacctgtagtcccggctactcaggaggctgagacaggagaatcgcttgaacctgggaggcagaggctgcagtgagtcaagattgcaccactgcactccagcctgggcaacaagagcaaaactctgtttcaaaaaaaaaaaatcttatccagagaagaagtcatttttttagacacaagaatactttgtttatacagatggttgctataaaaggcctgactttgtgccgatagagaagatggatttatggtgaaggcagctcctgaatgagctcagtaatcaaagtcaaggtcctgccaggttaagctgcagcaggctccgctccctaccaaaaatgacaggctctgctccatctgatgggttctgctccagatgatggaactcataagggcatcatgctgtcaaacggttttactgccaagactgttgttcatgtgtccaaagcatcacgtctaacctctaggttacgatgaccccagagcttgcaaatcttggtggaagaattgcacggagcctgaagtatgtttttcatcggaaatggtgctcattaaagaaatacgtgcctgttagccatcacttggattgtacatgacatcgttgatgttgcgtgtgtgtgtgtgtgtgtgtgtgggtgcacgcacgcacttgtgtgtttacattttcttttccttctttgttcctccactaaagcagaaaaagtgttagaagatgtttaagagagatgtggaaacagagagaaatgcagttttatccactcttctctcttgtaagataaaaaatgtgtctctgggcagggcgcggtggctcacgcctgtaatcccagcactttgggaggctgaggtgggcgaatcatgaggtcaggagatcgagaccatcctggctaacacggtgaaattaaaccccatctctactaaaaatacaaaggattagccaggcgtggtggcgggcgcctgtagtcccagctactcgggaggctgaggcaggagaaaggctgaacccaggaggcagagcttgcagtgagccgagatccgcactctagcccgggcgacagagcaagactccatctcaaaaaaaaaaaaaaaaaaagtgtctctgggtgtttttaagccaaaagccattcttcaccaggagggcttgtgggaaagcagattctgactcagtaggtctggggtgaagcctgggatgctacttctccaatgcactcccaggcaacgcagcagccgccagtctgggagccatgcctgggagtggtggggccttagcacacagtgtgtgtccctgcctctggacacctcctgccatccctgctcttccctcccgctgctaagtctcgccctggtctccctgccttcttagagatggcgcttcctttagcaagtgtttgctccacttaaggattcagggaacatccgggctggagagatgctggagaccatcccgtccaactctcttcagttcccagttgcttttgtggcaagagctaaaaacccaactcaacccacacacgtttatatagacttgtggaaaatacaaagggctttttttttttggtgcgttttaaaatataaatggtatcatattgtgtgcgtcattctgtgcctgtttttctctcttagtaaccaatcttggaggttttttaggtcagcagagaaaaacctccccattaacagcagtacaacattccaggatctaaacaacagccttgacattactgacatttacggctggacaattctttgctaaggggctgtcctatgcattatagaatggttagcaacatcccaccggcatgattccagtagcacccctcgcccccatcagttgtgacaaccaaaatgtcatcagacattgctaaatgtgtcctgagaggcaaagctgccctggttgagaaccatggggataagatgtagaagagcaaattccaaagaggtaagatgagttacttcctggggcacaaggaaggactggaatggggatagagagttctcattctttatgacttcattcattcatccatttcatacatatttattaagcacctgccatgttccagacaccatgccaggtgctagggaggcagcagggaagaaaacaagccaataccttcctattgtggctctgccattctccctggggagacagacatgaaacaaacaaggaagacatcagtacggaagatgtgctaaaaactatgggagaaagtaggacaaggggagctgggagtgctggggcccaggtggggacttcagagcctcacatatgatgttttaatgtattaaaaggagaatatctccatgagttatttggatgatttaaaatttttttattacttgagcctaggagttcaagaccagcctgggcaacacagcaagacctttctctgcaaaaatttttttttaattagccagatgtggtggtgcacatctgtagttccaggtacatgggaggctgaggtgggaggatcacttgagcctgggaggtggaggctgcagtgagccatgatggtgccactgcactccagcctgggcgacagagagagaccttatctcaaaaaatattttttttttaagatggatgggctaagccagtcccagcctggctccctgaagcaaggagatctttcaaggggctgaacccgggtgcctgggcagcagctggcctcagccccccattccttccttcaaatccccttgcttaggacaataaactcctcaacaggtaccctcagctgcacttgcatggagctgcaccgccatcccaagagctcgtggtgggcctttgaggcaccctttctccatctgtgtgggttcctccagcccattgttaaaagatagtagtaatgtctaacatccctgtaaaaaaataatccccatgtttctcgaggccctaggtttctggtccctgctccctctctgactttttctcctcccactctcccccaactcactcagctccagccacactgactttctttctgctcctcaaacgttcaggctgggtcctgccactgggcctttgcacttgctgttcctaatgccaagtctttccccatggtctccccacagccagcttcttatcaaccaagtcccagctgacatgtcgcctccgcagagaggacatccccgaccaccccagccaaaggaggccttttctccaaatctccttacacgtctctctcacatgtgtgtttctgttacagtttgaatctgtgtccctgcccgaatctcctgttcaaccgtaatccccaatgttggagatggggcctggtgggaggtgattggatcatgagggcggtttctcatggtttcacaccatcccccttggagctgtcatcccaatagtgaattctcatgcgatctgcttgtttgaaagtgtgcggcacttcccctctctctttcttcctcctgcaccagccatgtgaagatgcctgtttccccttcaacttccgccatgagtaaaagctccccgaggcctcccaggaagcagatgccaccatgcttcctgtagagccagcagagctatgagccaattatacctcttctctttataaatgacccagcctcaggtatttctttatagcagtgtgagaacagactcatagtttccttcattgtacttgtgacttgatgaaatgattctgtttgattctttgccgggttgttgtcagctccataagaagaggactttatcttgttctctgtgtacaaacacatagtaggtgctctgtaagtacttgttgaacaaacatgtaaatgaatgaatgaatgagagccagtgtgatttggatgactgcgtgcatgtgctaagtaaactgttttccatgatctctggggttgtgtgtgtgtgtgtgtgtgtgtgtgtgtgttcagtttggtttttgccacatctttataccctctgttctattacaacttagcatttttctttttatataaagaaactcatttaaaggaatcttgacaatatcactagaaacagaaagccagtatcagcacatacttgctataaatagcaaaaaaaaaaaaaaaaaaaaaaaaagaaaagaaagaaagagagagagagaaagaaaggaaaaccctatgcatataaattccatgaagatgtgaaaaagttatcaaattctcacagggtatgattgctactgtagtttctaagcctgaggctttagaaaatcgatactctcttgaaaaaaaaaatttaagcctgaggctgttgtgtctttcttaaaaaggagattggcaggtgtcagagaggtgttcaagacaagttaactccaacccgaggctttctcaatgatctttctccaattcatcccaacacccacttgccgcagaccctgtggaaggccccagatccaaactcccttcctgctaacagcagctgtctggggagatttccttccagttgagccatccaaggactcctccccagcccttatctgtggaatggaaaaaatactagcccacacctcatagattaagagaatcaaatgagctcatttatagaaagcacatggaacaatgacaagcatgaaataatagtcactgatgtttactgagactaacagcatgtcacacccagtgcaaaatgcctcacgtcctcccacagagtcttcataacaacctttagctcatggaagtactatttttaccctatttggccaatgaaaaagcagaggcccaggaaggtgaagtaacttgtccaaggtcacacagcaaggaggcaatagagctgggatttgaaccccggctgcctgactccagagctgtacaaagccagataccacagaggctgggttattgttcgtccagacccatgttcccacaggtcctctcatcccttacctgctccctttctaccttgtatttctatcctcctgctctgaggagattcctctccctgaagatgcttgggcttgagggaaccaggaggagaggaggtgaagttggcctggatgactctgtggtcaggatcctaatgacccagtaattttcctccaagtccagtattctcaggattaagtcctaatcatccatctacccactcacccactcattcatccatctgtccatccatctatccatccatccattcatccactcacccatccattcatttacttattcatctattctcccattcacccatccatccacccacccacccacacatccacttatttacccacccatttcatccattcttccatccacccatctatccatctatctatccactcacctgtctatcaatccatccatccatttatccagccatccattcacccacccacccattcatctgtcctcaatccactcacccatccactcatttactcactcattcatctattctcccatccaccctttcatccactcacccaccatccatccatccatccatctacccatgcatccatccatccacccatccatccatccatccacccatctactcattgacccactcatttcacctattcttccatccacctatgtattcatccacccactcacccatctactcattcactcacccattcatctattctcccatctacccccattcatccaccagtccatccatccatccatgtaacatttactgaaggctcactacctgcctgcaaggttcaggtgagggacagagcaggactgtacaggtgtctctcagcctctaccctccctcattcctgcttccatcttcttctgatctgggataattcctctcctgggagatccaaggatgatggggagcaaaaggcggtggggtgaggggttggggcttcggcactgcctctctactgaggccccagtcccttctctgtatggacaaaatggaaacttgtggtttttcttcctgcattgaaccagcaggctgagctggggctgaactcctgggacattaaaagggggtgagaggtgaagatgcatccaggtggggggtgtgtgtgtgtgtgtgtgtgtgtgtgtgtgtgtgtgtgagagagagagagagagagagagagagagagagagaggaggtggagggcgaaaggcctgtgcatctctgtctctgtcaggcacacagagaatggcagtggtgagcctgcaatgtattgggaagacattattgtttgctcagaaatggccaagaaccccagctcctccctgccaggagacacaggattctgcgcctccaggcacaaccgtcttccctcccttccactttcctccctcctcctcaaacccttgcccaggtgccccccggctggctgggttcaccagaggatagatgaccacatactaatcccagcctcctgtggaggttagtcccaccctccaccgaggtggaaaattcctgcaggtagagtcagcagtggttcaagtcccaccgttgtccatgagatcggactacacagcacacacggccgcttttttttacctaccacgtgtcccacgtctcctacagtcctttaatccctgaccagtccttcagaggatggacacgctctgatctttgtagcctctctttctctcctcagggatcacacctcactgtagaccacagcccaatgtcccaggtgactcacttactagaatttgtaattcacttcatcctgccaccacgcccctgtgagctagacacccaaattgactccattttacagatttggagactgaggtgcagagagattaagtccctgtctgaggtcgcatggtggatgagcagcagacaccctggcgggcagcctggctcctgagccacgcgtcaccaccgtcttagtggaaaatcggccacaaggagggattccccttccagtctcctggcccttgccaaaggatccatactagacatgagaggaggaagggagtccacaccgagtctggcctcaaaccctcattccttaggaaactgcgctaatgtcgccccctccctccctgtgaccaccccaggttgtatctgcaccttcccagctagcccaggtgtcattacatatttatctgttgatcactcggctccagggactgccatatcggcccaggaagtcacgatcttgtctgtctggttaggggctgtggtctggcactgggcacatagtcagtattcaatgaattttggctaaagcccttttggatcgatcatctattgccagtgtggctcagatgcagcccccgccactgactgtgtgactctggcaggtcacaacccctctctgagcctcccttccatcatctgtaaaacagacttatctctgagtcctacacatgttaaacactcaaaggatttctgttgcatgaattagtgaaatccgagctggaagggcctctagagcccagggttgcaaactcatagactccaaaagccaggcaggagccagaaaccaccgagggagctgggtggggacggaggcagctgctactcagctctagtcacaagcactgccatatctggtttctcaagaaaaaccagaaatctagagatttacaagaagtttcccaatttctaagtattggcaactaatttaaaacatttaaacacatctgtggacgggatgtggctgcaggccgtttctttgcaactcatgattcatctaactgctcgtggcacagatgagatcaaagcccagagaaggtgagccaccagccccaggtcacagagcacaggaagtgaagaggaaacagtgacctttctccttcggctgcagccctgttgcccaagctcagggcaacccctgagccctgatcccaagggaggcagtgccgccttctcctctaggcctggcagttccagggtgacaggaaggtcacgatatctctgtttgggtgcactgcagcctccgcttcctgccaggaccaggctgtatcaggcactgggatgaagaaaacattccaagcaatgggctggcctagaaggtaagagctggtggcagagagggggtaagcacaccccttccttacttcagggacgtgcaaaccccttcagcaggcctgggcagagctgggaacagggcggatcaagccctgcttctggagaaacatgctctgccattggaggctgggagctctgtccccgcatggctcgtaggaccttggaatgcatttgtccagcagcttctaatacaccaggccctcatctgacccgcacccccacaacctccatgggctctcctccctctgtcccctcttgatctctctacgcaggcacaatggtgcctgctcagccctgaacacagcagccctgctcccacctcagggcctttgcacacgctattccctctgcctggttcacttcacccattatgcagatggcttactgtagacctctacttgaatgtcgccttctctgtgagaccctccctacctgttcactctgtttaaaaatgcaaacatcccccacagtccttagcctccatctggcttcctttgaccctgctgtgcttaggatggtgggacacatatgttacacgtgtttatttgtgtttccctttcctgttgctgctgtaacaaatcgccgtgaacttgggagctggaaataacatgaatgtgtgagcttacagttctggagggctgaagcccacagtgggtctcagcaggctaaaatcaaggtgtgggcaggaccacgttccttctagaggctcacagggagaatccgttcctccagcttctcaaggccacctgtattcctgggctcacggctccaacctccatcttcaaagccagcaacggcgaggccatctttcccatgctgcatccctccgcctgcaacacctctgcttccctcctgcactaagccccttgtgatgacactgggtcacgatgtcatcatctgggtaatccagggtcgtctcccccagctcaaggagactgctcagcagcctccattccccttggccgtgtaaccttgtacattcacgggttccagggatgaggacgtcttggggaagggcgcatgagtctgctgaccacacacaccaaacacaccaggcgttggctccaggaaggcacgtggtttgctgctttatgtatgtccaatgcctggtgcatagcaggtgctcagtagacccttggagactgcgtgggtgctggagtagaatgttgtggccgccaaagggaggcaggaaaggtgactcagctaccccagtggtcctccccgtcttactgatgaggagactcggggagagctgagatgctgagggctgaagagctgtgacttagcccctacccttccacacccatcctgtgcccacaaagaggggtgggccctgggctgtgtcggggagccccaaagagaaggcctgaagtccggcagctttaaaggggacagtcctggccatgagccctctctctgagcgcccctcacaacccctacaagctcccctcccaaggctaggccagcagtgcctgcagggggctgcccaggcgtggtcctgccatgtgggaactgcctgtgtggcccagcaggacccagatgagtcacaggaaagctggggtgccctccctccagccccacgtgtctccctggcttcaaaggaaaccgactgagggtccaagtttcctcatgactgaaaaatgttccaccccaaaaatgttccacatgagcaacagctcacccagaaagaaagagaaatgaagtaagtggcttttcagcatggggagagacacttggccatgcacagctacaggcagagatctgggaaacagaacgccggggaaagcaagtgaggaacaggagaactctgcaaatcagaacactcatcataaaataattctgcttgtttcacaaggacacatatacatccagggacatatatcatgggcctcggtatggaggctcaaggagaaaacaaaacaaaataatttattttgttttaaattattattattatttgagacggagtctcgctcttgttgcccaggctggagtgcaatggcctgatctcagctcactgcaacctcaacctcccgggttcaagcgattctcctgcctcagcctccccagtagctgggattacaggctcgcgccaccacgcctggctgatttttgtatttttagtagagatggagtttcaccatgttggccaggctggtcttgaactcccgacctcaggcgatccacccgcctcaacctcccaaagtgctgggattacaggcgtgagccactgcgcctggcctaaattattattatatgtttattttgttttaaattatttttatattttacaatggagcttcctgacatgtgacaatgatgctacggttttttgttgctgtttttttgtttgtttttgagatagagtctcactctgtcacccaggctggagtgcagtggcacaatctcggctcactgcagcctctacctcccacgttcaagagattctcctgcctcagactcccgagtagctgggagaacaggtgcccaccaccacgcctggctaattttttgtatttttagtagagacagggttttgccatgttggccaggctggtctcaaactcccgacctcaggtgatccgccacctcggcctcccaaagtgctgggattacaggcgtgagtcactgcgcctggccaatgacactatgcttcactgaacaagcaaaaggtactctgcttcactcttcatttaaaaatagaaactgaaaccatactgagacacctgcttccatctattagagtgacaaaaacatcagaaagttcacaatacatggtgctgatgaagttgtggggaaacaggcaccctcacacattgttggtgggagaataaattggtacaacctctacaaagtgcagtttggtcatatggatcaaaatgtaaaatgcacaaatctgttataaaatctgacttccagagatttctcccacagatacattcacacacacacacacacacacacacacacacacacacacacaccacactatgtacaaagacagtcaccacagtattgtttgtagttgttgttgttttgagacagggccttgctctgtcaggctggagtgcagtggcgcaatcacagctcacagcagccttaacctcctgggctcagtgaccctcccaccttagcctcctgagtagctggaaccacaggcacgcaccaccacaaccagcttgttatttcatttgtaaacatgaagtctctctatgttgctgtggctggtctcaagctcctgggctcaagcaatcctccagcctcagcctcccaaagtgctgggattataggcgtgagcttctgtgcctggtccacagtattgctttataacagaaaaggctggaaacaacctaaagggccatcagtaagaaaataactattaatgaatatggtccggccatgcagtggaatactatgcagctgtgaaaaaggacaacacaggtatgtgtgatgaattagaaagaatgataggtatgttaggttaaaaaaagcaagctgcaagacactgggtgtaacatgcatctatatatgtaaataaagagtgcatacaatcatgtgtgttttcgtacgtacagactttcagtggcagagcccgtgggaaactggaagcagcattgcttagggaaagtgaaacctgggggttaagggtggggagagacactcgttttcattggatacttttttctgtcattgaattttttcccatttaaatgtcttacctatgttttaaacataatttttaaaatataaaagcaatgctcacttgtcacaaaatctaagcaatgaaatgcaaatgatatgaaaccagttgtccctaaccactcccctgaaatcactactattaacatctttccagagttaacaaaaggtcttaagtttagatatgcttctttttttttttttttttttttttttgagacagagtctcactctgtcacccaggctggagtgcagtgaaacaatcttggctcactgcaacctctgcctcctgggttcaagcaattctctgcctcagcctcccgagtagctgggattacaggcgcccaccacaatgcccagctaatttttgtatttttagtagagacagggtttcaccatcttggccaggcaggtcttgaactcctgacctcgtgatccacccgccttggcctcccaaagtgctgggattacaggtgtaagccaccgcacccggcctagatatgcttctatattattcgaacttgtgcaacaggctgtgtgatttgaaattaaacacaagggccaggcacagtggctcatgcttggaatcccagcactttgggaggccaaggcaggtggatcgcttgagtctaggagttcaagaccagcccgggtgacatggcgaaaccccatctctaaaaataataaataaataaacaaatagatagatagataaataaaggaaattgaacacaaaacctcccttttgagtcaacgattatcaaggaggctgttatagttgcagaggtggcctggacagagtggtggccatagagacagagaagtggccagttgtaggagcaaatgtcacaggttcaactgacagggtcagacgcacaggcagggagaaacaggagggaggacatgccatgagctcccttgtctaggcccacactgaggtgacacggcccaagtgccccagcccgacagggtagactgcgatcagggtcaggaattcagtgaggcaggtcctggagcactgggagggggtacgagggtctcagatatctggggctgggactcttgaggtcatagcaagataagtggatgacatactcagtttcaagagttaaaccccagatttacatggctgcctggagtctggattcactggtgtgaaatttggagggagatgacgataataagaatactaatactaacagtaacaataactatcataagaacagaggccaacactctgtagcacttactacaggccaagtgctatatacgtgttaactcataatcccacaatcaccctctagatataggtgggtatagagaagcatgcccccatttcacagatgagaaaactgaggcccagagaggtgaagtaatttgcccacggtcacacagcttgtatgggatagagaagggcagggcgtatcactgaacaaaatggaggtcccttcaccccagagttgcaaacccagcctccctcactcccactacccctctgggcctcactgcatggatggacagtggcaacaacccctcctgggcctccctgactctaccctcgtcccccattccccacaacagtcccttctctatccagcggccagagcgatcttcctaaagttctagtctcatcttcccttggtctgctctcaggcagggccaggcattaggtgaggccagcaggtgccggcacaatgtcaggagacccccctcccaggtgagcccctgctctggcctgattcacagcgaggcctccttaggttttgaacactcagtgtccctcttgcacagatgggaacagacagtctctggaatccccccaaagccgcatttgaagtttctttccaggcagacaggccctttccaggcggatggctgcttcaatccagatgaggatggaggcctggggatctggcagctctgggctgatggcaccacgtccaggggagaggtttctgttttcctgcagtggttctctggcctatgcttgctggatgggggtgttggtaaatcctccagcttcctggggcctggggaggagcaaccctgaggtggactctgcacccactcccagaggccccagcaggacggagccccagctgcccaactgataacctgctcatctagacacccagcagtaccagctgccccctcccctctgctctcagagcttcctgcgatcagctccccgctaagttccctgcccttggactctctaagtgtctgcttctggaagaggcccaagccaagacctgggagacaggtcagtggctcagggctctgtggctcatgatatctgcagtattctctctgtggcctgggtcttcctgtcttctgggtgatccctcggcctttgggaggccgaggtggttggatcacctgaagtcaggagtttgagaccagccagcctgtccaacatggtgaaaccccgtctctactaaaaatacaaaattagccaggcatcatggggcacacctgtaatcccagctactcgggaggctgaggcaggagaatcgcttgaaccccggagggggaggttgcaatgagccaagatcacgccattacactccagcccgggcaacaagagtgaaactctgtctcaaaaaaaggaaaagaagagaaaagaaaagagagaagaaaagaaaagaaggcaaggaagttccatagcccatacagtgggtatcttaggcagggctctatcagatgaaaaatatagcagaaccctgactcaaattggctgatgtcatgagaatttacgtcaactgtctctggtaaaagcaggagtagagataggcttcaggcatggttggatccagatgctaaatcaatgtctacaaagatgcactacctctggctctcatctcttttactccacacagactctccaggtcatgatgtgaccaaggttgccccttgccactcccagctttattctcaccagctcagcaaccccagggaaaagggagcaccaatttccaattgtttcagaacaaggtcagtggcaatgttactcaaactcgaacgtgcccatgttcacactggggccctggggactatgataaaatgcagattctggctcataggtttggggtggggactcagatgctgcattcactgcattttttttaagatagagtcttgctctgttgcccaggctggagtacagtggcatgatcacagctcactgcaacctccactcctggcctcaagtaatcctcctgcctcagcctcccaagtaactgggacttcaggtgcatgccattatacccagttaatttttgtattttttgtagagacctggtcttactgtgtcacccaggctcgtcttgaactcctgaacccaagtgatccacccacctcggcctcccaaagtgctaagattacaggtgcgagccaccccgaccagcccagatgctgcatttctaacaagctcccaggtgctccttgtgctgctgatctggaaccatacgttgagtaggaaggtctttgcatgatgccattcctctcagctaaaagcacattgtaggccaggcatggtggttcacgcctataatcccagcactttgggaggccgaggcaggtggatcacctgaggtcaggagatcgagaccagcctggccaacatggcgaaactctgtctctactaaaaatacaaaaattagctgggcgtggtggcgggcgcctgtaattctagctactctggaggctgaggcagtagaatcacttgaacccgggaggcggaggttgcagtgggctgagattgcagcattgcactccagcctgggtgatgagagcaaacctccatctcaaaaaaaaaaaaaaaagcacattgtatacatatgcagaatattcatctaaagaaaaatcgtaatcaaaattaaaaagtaaaagcacattgtgcacacacaggaaactattgctgcatcccaagagtcccgcatgcagtagctcatcaactggtcacaaggacgttagaggtgggtgctctcattacctcatttctccacaaggcccagacacattcccaagcctgcacagctgggaagcagcgaagctgctttgaccccaagtaatgaattctccagatggaataaacaagggccctgctgatggcccttaatgctctttgcaatcctcctctattacaaaaccaccgtgctgagcaaccccacaggtgcgtgtgtttgtaagcatgcactagtaggtttggggaaagagattcctacaggcgaaattgctgtatcaaaagatgatgtatggttctattattgctaggggctgccaaaagggaaagagactgcccatttccccacatccatgccagaactgcatgttcttgtttttgccactctggggagaggcgcccttcctcatggccctaggaaggtagtgaagttatgtcccagccccaggtaggcagcctccttcctgcaaggggtcatccagggagcaccctgtgccagcccacctctgggcatcctgttgtcatggaaatatttcaaggcctgctttcatcctgaatagcaacttcagtggaaagagaaggcctctgttatgggctaaattgtggtccctcaaaattcatatgttgaagtcccaacccccaagacctgaaaatatgactgcatttagagatggggtctttaaagaggtggttacgtttaaatggttgttagggtgggccctaatccagtctgcccggtgtccttataagaagaacagacctcaggagcgcacatgcacagagggatgaccgtgtgcagaggcagcaagagggtcgccatctgcaggccaaagagagaggccttgacggaaatcaaccctgacagccggcatctcgagcttggacttccagcctccagcactgtgagataataactgtgttgcttaagccacccggtctgtggtcttttgctatggcagttctagcgaacaaatatagtctctttccctgcacacctagaagagttcctgggaagatgcccatatgcctggcttggttcacttcccgtctgttaccaattgctgtggccaccagatgctgaactctaatcggtcaggccttggccaagtgctcatccctggagctagggatgggctcagcctgccaacctgggttcacttttccttgtttgattaaaaattttaatttaaagcaagtgacggctggatgcaatggctcacttctataattccaaccttttgggaggccaaggtggaaggatcacttcagccccagagttcgagaccagcctgggcaacacagcgaaacctcaactctacaaaaaatatttaaaacttagccaggtgtggtggcacccacctgtggtcccagccacttgggaagctgaggtgggaagatcactcgagcctgggggatcaaagctgcagtgagctgtgattgcaccactgcactacagcctgggtaacagagcgagaccctgtctaaaaaaaaaaaagaagaaagtgaggtcgaacctgtggctaacaaggggataatttacatgtctgagctcaagttcagatgtacaagttggattctcttttcttttttggggggtggggacagagtctcactctgtcgcccaggctggagtgcagtggcgtgatctcggcttactgcaacctccgcctcccgggttcaagcgattctcctgcctcagcctcccgagtagctgggattataggcacccgccaccatgcccagctaatttttgtatttttggtagagatggggtttcaccatgttggccaggctggtcttgaactcctgacctcaagtggtccacccgcctcggcctcccaaagtgctggtattacagacgtgagccactgcacctggccatcaaaattagaagtctttttaaaagtccctttgatcccacccatggtaggcaaaccctacctcaggcatcgggtcaggctgcaatttccaactcatatctgcttttagcccctggagatttcacttaaatcctgtgagctcagccatctatccccaagatgcagttcctccaagatacctggcaggcaccctggcaggagggtgtcacggttctctaacctggctgactactgagcctctgggctccatgaggacaggatgtctctctcactcgctgctagcccagtccctggcacagccctggggcttggcaaatatttgttgaatgaataaacaggctgtggcttataagctggttcagattccagctccccactcactccgcatggaagaatcacttcaatcctccaagccccccgttcttcatctgcatgggggatattttgttgttattgttgttttttaaacttgggatttttttttttttgaaaaatagaacagatacagatacaaaaaccacacagcataagcatgtgacttaatgatttattataaggcaactgaacaccctcgtgaccacctctaggtcaagaaatgtaactttgcctgccacccctggaaacccctgcagaaccctgtcctctcaaagccctgcccctcccaaaagtcactgctaccctaagtgttatggatatcacttgtgtttctttcttgttttaccaaccatgtgagcagccccagacactatacttaatcttgcccactttttaaaaacttgatgtctcttttagtttctattcctcctccatccctttcttttccttacaatttacctgcgcagtacctgggccatttaacctgcagagatccctgggtctgggttaggctgatgacagcaccgtgtcatggttcaacacgttctgtccttgggattttctgtaaaacggcagctggatcctgaggctacaccagggatgtttccaagcttctgccctcacgggtcgtggtgagaattgaagggggatgggtgagtgtttgatatcagcgagcagcccccagaagcagccgccaaggctgttcggagatgctcacgaggcctgaacatggacagcccgagggacatcccatctcaacagtccatcctggcttctctccccacccagacccacccaccccactttgggaaagttctagggccatggctggctcatcccagcgagagctggcagcagaatggcctgtaattttagctgtttctcttccctaaaattatttcccatctggaaatggtttcccaaccctgcccaggaaagagttggtggtgcaaggaacatttttctattaaaaaaaaaaaataggggccgggcactgaggcaggagaatcgcttgaacccggcaggcggaggttgtggcgagccaagatcgtgccactgcactccagcctgggcaacagagcaaaactccgtctcaaataaatatataaaaccagccaccaaacactgaatctttgcagcccaggctctggaggcctggctgagtgccagctgtataccctgccttgagggaactctgtcagcgaggagcagagggtgagagggcatagtcagggctctgctgccaggatacccccacccacccagtacattcggacaaggactttgttgcagggcctgggacagccccaggcgagctgagaaggatccgacctggggttgagtggcctgcccagctgctgccacactcgaggtctgtgggttattctaggtcccacagggcatgaaatcacagagcagaagttcttcctatggggattctcttgcagctgctctgagcatttcaagaaaaaaaaaaaatccctgccgctaacatctccccatcacctcgctaattctcttctttctttcctttttttttttttttttttgagacggagtctcgctctgtggccaggctggagtgcaatggtgccatctcagctcactgtaacctctgactccctggttcaagcgattctcctgcctcagcctcctgagtagctgggattacaggtgcccgccaccacacccagctaatttttgtatttttagtagagacggggtttcaccatgttggccaggatggtcttgatctcctgacctcgtgatccgcccacctcggcctcccaaagtgctgggattacaggcttgagccgccgaactctcttctttctaacaaagttctcacaggcccctgactcctgactgtgcaagcaagagcatctggcaagaatatcatgatattttttagcacttcttgtacttattttcataattttttttttgagacagagtctcactctgtcaccctggcttgagtgcagtggcaccatctcagctcaacctgcaacctccgcctcctgggttcaagtgattctcctgcctcagcctccttagtagctgagattacaggtgtgcaccaccatgcctggctaatttttgtatttttagtagggacaaggtttcaccatattggccaggcagtcttgaacttctgacctcaggtgatctgcctgccttgacctcccaaagcgctgagattacaggcgtgagccgccatgtccagccttattttcttatttccttttttttttttttagacggaagctcactctgttgcccaggctggagtgcagtggcatgatctcggctcaccacaacctccgccttctgggttcaagcgattcttctgcctcagcctcccaagtagctgggactacaggcatgcgccaccatagctggctaatttttatatttttagtagagttggggtttcactatgttggccaggctggtctcgaactactgaccttgttatctgcccacctcagcctcccaaagtgctgggattacaggtgtgagccatcgtgcctggcacccagccttattttcataactgttttcatgataaatgatataggttttccatgtttgctaatgatataaagtttcctctgcagaaacaggtttaaagaaaaatgtgggcagaaagtccgtttaaaatatatattaaggaaaataaaacacagatagcacaaaatccaaagctacctggagttttggtgcctggagccatggtgaagagggcatactccagatctgagggcccaggcttgcattctggctgtgactctgtgggccctgtgattttaggcaagtcacttgccttctctgagtcatggtgctttacctgtaaaagaaaggaaaataataacacctccttcctatgatgatctctgagaattcaataaaacaatgctgagaagacactcagcccagtaccaggcacatgggttgcatttaattctgtcagaacacaaggtgggtgctatttttattcctgttgggaagctgaggcccagagaggtcatctagcccatccaaggttgcacagcttgtaggtggtggaggtggaactagaacccacaaagttctaatgtgagactgggatttgtgctcttaaaccactgtgctgctattggcagatccatctatccacccatccatctgtccgtccatccatccatccatccatccatccacccacccatccatccatccacccacccacccatacattcattcatttggtcagaattcatggaattgttctgagttcatggtgttttctcaaaaagcagcaaagtgcagaagttcccagagtaggttcaaatcccaacctgccatgtacaggacacctgggcaagttgtcccacctctccgagcctcagcttgcccatctggaagaggggaacattgatagccctttgaaattcccgcaggaggtagaagactgttttctgggacttcacagtgtcctacgtgccctgcatctgaccccatggtctgcgttcacctctaagtctcagtgaatcaagctccgccatatgtctgcctcatcctgcctccctcctccctttcactccaatttagccagactcagccattggggttccctgaacagcccctgggcctttgtacactttgttcctccagcccgaaatgtcctcttgcttccatctggtaaccatgattcctccctgaaaaatcaggtgggcttccccctctgccccaggagcatcccctgaggctgagccaagctctgcctttctgggctcccccagctccccgcttctctgacatggaaaggtcatggatgtaataacttagacaaactcttgtgctctgccactgtccaccttcttggtcacaaatgtctgcttcccttctttcatgcaggtacatgcacccctctgcaaacgagtccacacacatgtttttacacaatcatggcatgtgatccgaaggcatgagatctgccttcgtacatgcaacatgcaatggtggaacggcattacctctggctagtgacctctcctggactcagctatcacctctgcagaaagggggcagtaacaggacctgccgcacatctgctgtcatgaagaccacatgagctaatatatgtgggaagcccttagcacagcgcctgggagagcataagcgctcgatgcaaggcagaagaaaggcgtgtcctggtgtgacagggcccttccgaccagggctggtactaaggtgagaaaagcgaggtgcctaccgtgcaaaatgtaaggcagcgttcactctcagagcagtgcacctgccgctgggtcctcggagccacagagcagtcccgctcgccccctgctggtcactctgcagaatgacgtcccttccctctgctctcaggggtccctgagcctcggtttcttcacctgtaaggtggggtaggagaatctgcctctcagtttgcagggcaaacaggaggcactcctccaacatcagtgtcctcctctcaatgccagcacttaatgagcacctactatgtgcaaagaaagatgactgagacatgatccctacccttcaggggtttagcgagtggagaggggaggaggtaggctgggaacagtgactaaagtaagacacttgtccctatgcagcacctactgcttaccccagagcagtcagaaccactgccctggcatctgtccatctgcatatgtttactaagcacctactgtgtgcctgagcccaggctcagctgtggatttacatggattaaggggtttaatgctgtcagaacacaaggtgggtgttctttttattcctgttgggaagctgagggccagagaggtcatctagcccatccaagcttgcacagcttgtaggtggtggaggtggaaccagaacccccaaagttctaatgtgaggctgggatttgtgctcttaaaccgctatgctgctattggcagatccatccatccacccatccatccacctacccatccatctatccaaccatccatccatctatccatccatccccatccgtccatccacccacccatccattcattcaacaaatattcgttgagcacctactgagtgccagacacagtgctgagtgctggagagatgccagtgaccagaaagacacagcccatccctgcccccagcagctgttcacaaagagaggatgggcaataagcaagacaaataagtaaaatatatggcacttggtgattcttgctgtatataaaaatagagtaaaagctgtgcacggtggctcacacctgtaatcccagcactttgggaggctgaggcgggaggatcacctgatcccaggagtttggaaccagcctgggcaacatagcatagtacagaccctgtctctactaaaaacacaaaaaattagctgggcatggtggctcatgcctgtagtcccacctacttgggagactgaggtgggaggattgcctgagcctagtcgagatcgaggctgcagtgagccgtgattgtgtcactgaactccagtccaggtgacacagcgagaccctttctcaaaaaggctgggcgcggtggctcacgcctgtaatcccagcactttgggaggccgaggctggtgaatcacttgaggtcaggagtttgagaccagcctggccagcatggtgaaaccctgcctttactaaaaatacaaaaattagctgggcgtggtggcgtgcctctcaggtactcgggaggttgaggcacgagaatcgcttgaacctgggaggtggaggttgcagtgagccgagatcgcaccactgcactccagcctgggtgacagagcgagaccctgtcttaaaaaaaaaaaaaaaaaaaaaaaaaaggcagcacagaagactgagagggtggggctggagtgtgtttcaattttaaattaggccttgagggccattgagggaccttggctctcattgtgagtgagctgggagtcatggagggttctgagcaggggaggagcctggcctgacttaggcccttgcagaatcactccaccaggaggccagagtgttaggacccagggtggaggctgcgagctcggggaggaggtgaccgcacacaggatggcggctgggcttggcggggcagtggagtggggagacagagtctggatgtatcctgaaggtggaacagacaggattagctggtggatgggacatgtcggtggcagacagagaggagtcggggatgaatgactccctgagcctctggggagggtggagctggctgcccttaaggctaagaaggctgtgggcagagcaggtttctgcgggagatgaggagtgggttgcggatgcattcaccctgagttgcctggcagtgtggacgtggagtttgggtttaccctcgtgttgacaggtacacgctcgcggtgcggttatcacgctgctgctggtgtcaccacgcgggcgctgcagggacggacctttcccatcgccaggctcttcggggactgctgcaatgccccgtgcagccgccagggagcgcccgagccgcacccaggacgcgcggggaccgggtcatcccgcgggctacctgtgcggggcaggacgcttagccgcacccttggcctccgactactcggagtctgttgcattcctccttccccccgcgcgccgtgtgacagccaaaactgtccccagacattgccaggcgccccctggaggggaaagtcgcccccacggcagtcagagccatggcctgcgcagccacattcatttactgagcgcctactgtgtgcctgcgtctgggctccgcaggggctcacgggggtttctccttttcatccaggtttctgttcagatgtcaccacctcagaaagaccctgtcctagacacgctccattcaatgacccgaaaggatcttgttgaaatgttaacttattacatttttgggtttttgttgttgttgtttttggttttgctttgagacaaggtcttgctctgtcacccaagctggagtgcagtggcacaatctaggctcactgcagcctcaacctcctgggttcaagtgatccttccacctcagcctccaagtagctgggaccacaggtgtgcaccaccacacccggctatttttttttttttttttttttttagtagagacagggtctcactatgttgcccaggctagtctcaaacttctgggttcaagtgatcctcctgcctctgcctcccaaagtgctgggattatgccactctgcctagccttctttattgtctgtctcccctacccagcagacaaacccctgccctcttagagtgcaacttccagtgagccagatggtcacctctttgaagtggtggcatttgagttgtgccttgaaggatagaagctgccgatcatggcagaatttgaagaaaggtctttcctggcagagggaaaagtcagggcgaaggcctaggggctgctcaagtccctgccttaaggcatttagagcgtcctgcccagtgggtgatgggtccccaggccacacacagctgctggccgagcgccccaagtcatcaggaagccatgtggtgtggacaagggccaggcagcctggacacacaaaggcccattgacagctgcatgggaaaagtccagggcacccaagccggaagcccaaggctggtccctcttgtcaactcccaaggagctttgggtggggacaatagaaaagccagaccttctcaggagactcaagtttccctggggtggggcaaaaatgcaggtggcctggtcactgggacatgcagggcagctgtgtgaggcttttgcagtcccccagccctggttctaagtctagccctgccccctgctagcagagtgaccttggtcatgtcatgctccctctcagaccctaagttccctcatctctaacacagggtgaaagctgggtgcagtggctcacacctgtaatcccagcattttgggaggccaaagtgggtagatcgcttgagtccaggagtttgagaccagctgagcaacatggtgaaacctcgtctctacaaaaaatacaaaaattagctgggcatggtggcacacgcctgtagtcccagctactcgggaggctgaggtgggacaatcacttgagctagcaaggttgaggctgcagtgagcgaagatcacgcaactgcactccagcctgggcaacagagcaacactcagtctaaataaataaataaataaatacaatggggtgaaaaatagaagcaaccttccagcaatggtgtgagactgcctgggtagagtagtgggaaccaggcctgattcagcaggtgtttaagagcaggtggtcagttccagcagtcagctatagtggctggctggagtggccatctgtggcggtcagtagtggtggtcggtcatagtagtcaactttcatggtcggctatcacgacactaagcatgaggaccgtcaggtgagcatggctggggtgtttggtcagacagacctgggttccacaggtctcctgctttccagtgtggggcagatatgatctcctttttccaagcctctgttcctccatctgtaagatggggataatgagagccctacacagggcaatgactgtgaagcgcccagcactgggattatagaatgttccagggctttggagggcagcctcagaagagcaggccaaggaaagcgcaggcctcccgactgaaggaggtctgcagagccagcaggtaaagagtggctataaacgaacaggagctgggcctccctccgcgggcagtggggacgcatgagggcatgttcccagcctgatagcaggaagcatttctggaaaagcccagctgaatagtgaagatagcagagcaggaatgtgaagaacgcagacctgggatcagcttgctgggctcaagtcccctgtactagctgtgtgtccttgggcaagttacttgacctctctgtgccttggtttcctcatctgtgaaacagggataagatcaacctaactaggctatggggttgatgtgaggtcctgatgagagaatatttctacaaagaatgacagataggctgagggccttaaacgatgacgcaggccaggcatggtggtgtgtgcctatagtcccagctactaaggaggctgaggtaggaggatcgcttgagcctgtgaggttgaggctacagtgagccgagattgcaccactgcactccagcctgggtgacagagccagaccctgtctcaaaataaataaatgatgttggactgagaaagcatcaacactcacccaggctctggggggaaggtggatgtgagcaaggccaggaagagccaggaggaataggaggcaacccctgtatgtttgtgtgagcgcagccaggtgccagggtcgggggcggcaggagcagaaaccctgagaatgtaaaacaattcagcagcggccgggcacggtggctcacgcctgtaatcccagcactttgggaggccgagacgggcagatcacgagatcagaagatcgagaccatcctggctaacacggtgaaaccccgtgtctactaaaaatacaataaaaattagccaggcgtggtggcgggcgcctgtagtcccagctactcgggaggctgaggcaggagaatggtgtgaacctgggaggcagagcttgcagtgagccgagattgcgccactgtactccagcctgggtgactgagcgagattccatctcaaaacaaacaaacaaacaaacaaacaaacaaacaaaaaattcggcagcagtggcaatggcctcagggactctgagagctactaacacagccacctggacccacataggaaaagcaagcattctgagatcggaagtatgaactttggcctgggacaatagggagccactgaaggtttggtagtcaagggtcagcccctcttaccctgagagttgatataactaggatactccacagcttcatccccagcacctacctcggggcctgcaacatagtaggtgctcagggaaatgattttaaatgaagaaatgcattaatgggtgaatgagaaactggctactaaaagctggccttattttgcccttcacccacatagcactgggtacctccagggacttagatacagagggaccagcaaaggtaaatgtccggagtgggaacaagctcagggagacagaggagcagtgaggaggccagagaggctggagtagagaaaacaaagggagaacggggaggggaggccccgcggaggtgagccggctggacctctcaaggccttgcgagtagggaatagcgctttcttccaagtgcagtgggagcctccagagggtttggtggttgtgtgtgtgtgtgtgtgtgtgggggggggggggtttgtttgattggtttgttgttgttgttgttattgttgttgttgtcgtcattgtttttcagacgaggtgttgctctgtcacccaggctggagagcagtggtgcaatctcagctcactgcagcctcgacctcacaggctcaagcgatcctcctacctcagcctccagagtagctgggactacaggcacgcaccaccatgcctggctattttttttattttttgtggagacagggtctcgccatgttgccagggctggtctcaaactcctggactcaagcgatcctcccgccttggcctcccaaagtgcttggattacaggcatgagacaccatgcccagacagttgcattttaaatcctcctatcaaagagcataggcattattatccccatttcacggatgaggaaactgatgctcagagattgaatgatttacctaaggtcacacagctacgtagagacagtgccaggattcagcctcagcccattgggctgtgggatctgcagggctggaggggatagaacaatgccagctggagccagcactgctccccatctgctaagctctgccctacgacctctaggtgacactgggtgttggcaggcatgaaggacctacaccgtgggactgtggggaacacgaccaggccctgatcagtaggtctgctgagtcaccaggcctggcccagagctaacctccggcagccaggagccgccccagggtccgtccttggtgccctgcccagcagctgccaagcacagccactgccacatgagctggatgtcctgcagaagccagagtgacaaactacccccaaatctgccctcctccctgtgctgtgtggcctctggcaagtcccctgccctccctggcctgcggtgcacctgctgtctcgtgcaagccccaggccgcagtgcccctccctttgtgctgggtagaatcctggccaattgctgataccgagtttagaccggagggcagaaaggcgggacaggtaagtgcagacagtggggaaggctgtgggccccacaggactagactcttgtgggtgtggcggaggacaaggctgcccatcagagccccaggggcccaggctccacccaggtaacaggacacaagaagagagagcctcctaagcagaactcggtttctataagcaagacagatagatagggcaagccagctagcatttattgagcacttaatatgtgctaggcattctacagctattctcttacttaatcttctcaatagcgggtgatgatcatgatgcatggtgattcctgttttgcagatgaggaaactaagacctaaagaggtaaagtccttgctcaaggtccccaagccaggaagtggcagagccagggtgaaatccaagtccttgtcattccagagcctctgcctggacctggaagcccctcagactctaaagctctaatccccccccaacccccccagcaaagtgcagcattcaggactgagcctcaagggaccagccaggtctgattgtgaacctcagagcaaggcaggattgtcagtgcagtaacgtgagactggtggggcctgatggcctccttggggacagcctgggacaatcgcaaacagaagctggctctgtgctggagcttgccctgtcctggggacctctcccacccaggacgagctcacctcaacatgtaagtcacctgggacccgaggagcccattctagggatgtaaaacctgaggcccagaatgtccctctaacgtgcccaaggtcacacagagagtgagcacacaattggtactactggaacccagttgcctgtcttgtgcagcctcagtttcttttcctcccgggatctcctgtgttaaaaaaaaaaacatacaacgtggccgggcgcagtggctcatgcctgtaaccccagcacttagggaggccgaggtgggcagatcacctgaggtcaggagttcaagaccagcctggccaacacagcgaaaccctgtctctactaaaaatacaaaaattacctgggtgtggtggtgcctgcctatagtcccagctacttgggaggctgaggcaggagaatcacttgaacctgggaggcagaggttgcagtgagcccagatttcgtcattgcgctccagcctgggcaagagagtgagactccatctcaaacaaaacaaaacaaaaacaagaacaaaaaaacgcacagtgtactctcttgaccctcatcatcttccaacaagcaccctggtcctccgtcccacctaaggctgaacttctggtggaagctgtgcatactcccccacccactttcacaccccgccaccctcctcaccctgcaccctcctcacctcaccccctctcctcaccccaccctctccacaccccaccctctccacaccatcaccctctccacaccatcaccctctccacaccccaccctctccacaccatcaccctctccacaccatcaccctctccacaccccgccctctccacaccatcaccctctccacaccccaccctctccacaccatcaccctctccacaccccaccctctccacaccatcaccctctccacaccccaccctctccacaccccaccctctccacaccatcaccctctccacaccccaccctctccacaccatcaccctctccacaccccaccctctccacaccaccaccctctctacacggccaccctctcctcaccgccaccctctcctcggtgcccttgagcaggccttcatcccctgtgtcaccaaatggctcttggtgttgtgatccttgctgccaagtcccagtgtgggatcccgtgctcagagccacttctcagcaacgtttgacactattgacctccctctccttctcgaaacatccttcttgaaacagcctctattcctgacactagatgctccatgggccctgcctctcctcctcctccctggcagctccaactcagtggctttaaacaaacatgtgttctgatacatctcagactcccaacagcatccttgatctctctccagggctctggacttgaatgtcgagttacctacttgaaatatcctaaaaacacagcctggttccccacaaagacttatttcattcctccttccttatctccgcactctccagtctttgttcctcagtgacaccaccctgtagctcaagcatcaaagtgacgtatcattctcaagtcctctgtttccctcccaccacctccaaaatttgtcctgagttttccatttctctgtaaccccatggccaccaccctggtccaggctgctaccgtcctcacccttgacctccttgctgtttctttttggggtttttttttttttttttttttttttgctgctacatttgcttcccatgctgccgggggaactttcagaaacataaatcaaaacatgtcacttgcctgctggaaaccttccagtggcctctggctgcctttccaaagactcccaagtcctcacattggcctacaaggccccatcttcttctccagccttccctcctcccttcctattcagccacattggcttcctttcatgttctccagcaagccaagttctttcctgcctaggggcctttgcacttgctgtttcttctgtctgtaactctcttccttctgctcttcctataactgcctctttctcttcttttaaagcccagctcaaccatcacctttccagagatcacttccctgatcatctaattgaaggacctcacccttcaccctggtcactctcaaccctatcatcctgtttattcccttcataactcagcaatgtcgggagctcacttacttgttgacttgtttattgtctatccacctctcttccccagaatgttggtcccatgaaggcagggatttaatatctttcttattcagtgcattagatggaaaccaggtacacacagcacagtgcctggcacatagaaaatgctcaataaatattggatggatggatggatggatgagatggatgaatgaatggatgggatggatgggatggatggatgatagatggatgggatgaatggatggatgtgataaatggatggttgagatgaaccgatggatgaatggatgggtggatgggtaatgaatagctggaatgggtagttggatagatggatgatggatgggtggatgagatggatggatagatggatgatgagggatggatggatgagatggatggatagatgggatggatggatgggatgaatggatggatgaaatggagggatgaatgaatgagatggataggagggatgaatgaatgggatggataggatggatgaatagatggatgaataggtggatggatgaatgggtgggtgggggatggatggatagggtgaatggatggatggatgaatggatagttggatcgatggatggatggatggatgaatgagatggatgggatggatggatgaatgagtgggatggatgagatggatggatggatgaatggatgtgtgggtgggggatggatggttgggatggatgaatggatgagatgaatggatggatgagtggatgacatggatggatggatagatggatgggatggatggatggatggatgagtggatgggatggatgggtggatgaatggatggatggatggatggatgggatggatggatggaaggacggatgggtgggtaatggatagatgggatgggtggatggataaatggatggatggaatggatggatggatggatggatgagtggataggatagatggctggatggatggatggatgagtggataggatagatggctggatggatggatggatgggatggatggatggatggatggacggatgagtgggtaatggatagataggatggatggatggatgagaggatgggatggatgggatagatggatggatgggggatggatggatggatatgcaaccagataaacaaacctaaagtacacctttaatcatgccactctccttctccagaacctaacttggctgcccactgcctatggaatagacagcaaactctcctctgggacattcaaagcgttctgaactgattccaaagtgggggtgcagtgagtgataagtgagaagataagtcattcatactgaagcattaggaagtggatcagttaaccatctctctccttgatctgggcatgagccatttgagggcagggtcatcttcatctctctgtctagacattgagcccttggtcagcaacatcagagatgtctgatgaataaatacatgactgagtgagcgagtgagcaagtgaaagcagccccactctgccccaaaaagccagcaagcgaaaagcaggaagcttcagacccagagggctgaacagttcaaatttagaataggagagcagtttcactgtttcaggtcactgctcctggccaaggtttcaaaagtatgtaaagctggggctctgcagcaacaggaaaattgaaacttaccagaaactagactggcagtgtctctcgggagggactgatttgaatgccaatgacctgatcctccaattataagagcagcacagtgtcagactaaaaagcacactcccacgtaattgcaaccaaagccacaaagactcccacaactaagagtggcacttcttcagtgtcccgtcctgctgacacacttttggtttttgcagaccttgggcccttccattgtgactcttggtttgcaggtggaagaggagcagagctgtgaagaggagagcttggggtcacctcagctctgccagaggttctgtgacctgccagaggctctgggaccttccctgagtcatcatctgtggagaaaggacttgccactgagtggtgtgttctacttgtaccgctcttctgatcgatcagcgtctttgattgggttccctgggaaacagactcagagagctgggcacgcaggtggtttactggggagtgctctcacgcacagcacctgtgaagggggtagagtggtgtggggggcagtgatgtggggctggaatgcaggcacaccagaggcctcaccagagctcagaggctggaacagcccttctgagttgcctacatcaggaccatgaaatggggtccttagacccccatgtcaacccgacgttggaggtggcctgcccctatggaggaggcagtcttaggcaaggcgattctccttggctgaaggcgaatcctggagcctctgtcctgaaggagaatccaggtggcagactacaatctccactgaagtccactcctcttcacttccaccgcctggagccaacccatcacctctcatctggatgcagccttaagatcctccccagagctcagcattcatgcttggcccttcaccaacagagtccaatctgcaccaggaacccaaagccacaggaggtctcccagcacagaaatcagatcacttcacttcactgcttgaaaccctcaaatggcctcccagaacaaaacacactcagaataaaatcctgagtgatccctgcctctgcctatgacctctcccttcactgtgcttcagccctttctctctctctctcttttataacaatccatcatgacgttcaatgttctctttttcttgagacagcagctgtgttccaccgcagggcctttgctcttgttgttcccgctgcctgacgttctcttccctcagatcttcccatggctgactctacgtccttcaagtttcatctgacacgtcacctcctcagagggatattccctggttatccgatctaaagtggttccacattcctcgcacgttaccttccttttaaaccacttctcactgtctgaaactatcttatgactttactagttgacttcctgtctccttccatcagaataaactccgtgggggtaggaatcacatctgccttgttcaactctgttacctgcagcctctaaaccagaaaccaatgcgttgtaggtgttatctatttgttgaatggcttaataatgatttcatgattctgtctccttacttattgctaatcttgctctttttactgtttgccttaatcaatcagatttgtcaggatttatctgtcttcaggtgctttctttttaaagaacacctttttcactttatttatcacttctactttgttttttctatttcattaattgcatagtttacctttaatttcttattcctatccttttggcttcttatattttctattttcttaagttaaatacttaatccactttgttttcaatttttaaaaataatagacgtctttaaggctatacattttcctctgtaggcagcattagctatgtctcacacactttggtatgaacagtgtctgctttttaagactctagataagtttccatgttggttctgattttcctctgattcaggggccatttagaaataatagctatttttcaagaagttaaaattttgaggttgcttttgataatttattctgaattttattggattatgaaatgagaatgtggcttggaaacatctctactttgcaacttcactttgccatttacaaactctcactagaccagagtttccttgctgagcatgtttcctcatctgtaaagcgagcacaataaacagtggctacagatttatgccaggtgtggtggctcatgcctgtaatcccagcactttgggaggccaaggcaggtggatcacttgagatcaggatttcgagaccagcttggccaacgtggtgaaacctcatctctagtaaaaatgcaaaaattagccaggcatggtggtgcacacctgtaatcccagctactcaggaggctgaagcaggagactcacttgaacctgggaggcagaggttgcagtgaggtgagatagcaccattgtactccagcctgggcaacagagcgagactccgtctcaaaaaggaaaaaaaaaaaagagtttctatggccacctgggataggaggcttttcttgaagccactttaccctaataaacccattgtctttacttatgttgtatttatatctgcagcggccttgatgctgtcactgaccactgggacaccccaggcctgacaggcagctcctgacaccaactcaaatgctagttccgccgggtgcagtggctcacgcctgtaatcccagcactttgggaggccaaggcaggcagatcacctgcggtcaggagttcaaaaccccatctctactaaaagtacaaaaatcagccaggtgtggtggtgtgcacctttaatcccagctattcggaaggctgaggcaggagaatcacttgaatctgggaggcagaggtggcagtgagccaagattgcaccactgcactccagcctggatgacagagcaagacttcatctcaaaaaaaaaaaaaattattttgctgagagaaatctggactatacattccagctgtgaccaacttatgacactgcagctatatttttattagtcagtggatctaaaaccaaaaagtgtgaaaaaagaaaaatttctcaatgataggcaaacaaatcttaatatgtggtttattactttgtatttggttccactgattattctgtcaacaggaatgttagtggccttgccaccagcaaggttggcaatcttggctcccagttacttctcttgtaggtcggtcttaagaacaaggctttggccaggcgcagtggctcacgcctgtaatcccagcacttcgagaggtcgaggtgggtgaatcatgtggtcagaagttcgagaccagcctagccaacatggtgaaaccctgtctctactaaaaaaaaaatacaaaaattagccaggcatggtggtgcgcgcttgtaatcccagctactcaggaggctgaggcaggagaatcgcttgaacctggaaggtggaggttgcagtgagccgagatcgcgccattgcactccagtccgggtgacagagcgagactctgtctcaaaaaaaaaaaaaaaaaaaaaaaaagaaaaagaaaagaaagaaagaaaaaggcgttaaggctttaggattggatgtggtggctcatgcctgtaatctcagcactttgggagactgaggcaaggggctcacttgaggtcaggagttcaagaccagcctgggcaacatagggagacctcgtctctacaaataacttaaaaattagccaggtgtgatggcgcatgcctgtagtcccagctactcgggaggctgaagtaggaggatcacttgagaccaggaaattgagcctgcagtgagccgagatcgcgacactgtactccagcctgggcaacagagcaagagtttgtctcattaaaaacaaaacaaaacaaacaaacaaaaaaaaacagacaacaaaaatagcaagagtactttagatttatagacggtgctttgcagtgaagctgccatgatgaaagcttccattgaccgaccacctgtcgtgtgtgaagcattgttcttggtaactcacatatgttgctgcatttcctcttcacaataacttcatgtggaaagttttaccacctcccttctccaaatgagaaaacagtataagagaaatgtgactttaccaagagcacccagcttctgagtgggttcagcctgggggtgtctggctcttcctacatctggaatcttcagattgagaaggttcattgtcatttactcagcaaatatttgagcatctgccccttgccttctgtcctgcagtatgccgaattctggactaggtgctggagatggaacagggagcaaaacagcgtcctttgtcccctgtcccagttgggaagaaagacaaagaaaagacaaacaaaacaaaacaagacgaaaacagcacttcacagtatatatgatgttagagagggacggggcagctaagattctcaacagttcatttcagtactaaactgttttacttctattctgtttcttttcttttttctttttttctttttttgagatggagtctcactctgttgctcaggatggagtgcagtgtcgcgatctcagctcactgcaacctccacctctcgggttcaagcgattctcctgcctcagcctcctgagtagctggggttagaggtgcccgccaccacacctagctaatttttgtgtttttagtaaagacgggatttcaccatgttggccaggctggtctcgacctcccaacctcaggtgatcctctgcctcagtctcccaaagtgctgggattacgtgcatgaccctctgcacccagactctattctatttctgtcatcaggcggattgacagacacaaaaatgtagtgtctctattgccctagatctctttagccatgtccgaggaccaaggaatgtaaaatttatttgtttttgagacagggtgtcactctgttgcctaggctagagtgcagtggtggatcctcccacctcagcctcccgaatagttggaagtacaaacgtaacaccatcatgcccagctaattttatatatatatatttgtagagacagggccttgccatgttgcccaagttggtcttgaactcctggcttcaagcgatcctcccacctcggaatctcaaagtgctgggattacaggcgtgagccaccgtgccgcccagcccagggttctgttgtaatgagcgcgtccttcttgtggtgtgtcctttcttcacttgcagtcttcactcacagccctgccatttcttgttcctgtgtaatctgtcactttgtggcacttccttttcctctgtgttgacagagcctggcttgtttagccactcttgtgtcctcagggggtttgatttccttccatgttattgctattatgtgttacatagcgatgaactagccaggacacattgttatttttcccctggtttgcctccctgttcgtaatcctccgtcaccgttcacatttctattgattttcagccaaactcgggggttggcaaattacggccacccacctgtttttgtaaataaagttttattggaatgcagccaagcctgtttgtttacatattgtctggggctgcttgagctatgagggcagaattgagaagttgaatagctgagtgacagagactgcatacagcccctgtgacggtggaaaaaacaactgtttttcctctgctctcacactacagcaatcaacactaaagactttttttttgagacatagtctcactctatcacccaggctggagtgcagtggcacaatctcagctcactgcaacctccgcctccgggttcaagtgattctcccacctcagccgccagagtagctgggattacaggcacccaccaccacgcctggctaatttttgtattttcagtcaatatgggttttcaccatgttggccaggctggtctcgaactcctgatctcaggtgatctgcccacctcagcctcccaaagtgctgggattataggtgtgagccagtgcacctggccacagaacatctccatgaccaaatgtgtgtctgtttttccccaagcaccaagcagtggacaccagcggggcatcccccaattccactccgatgctgtctacctgaagatagcctcgggtcacacaggttgagggctcagtccccaagactgtcccctccttcccaccagtcacaagtccaggcttccagaacttctgaccgatcagctccaaacccgctctttgggtttaatttatttgctaaagcagctcacagaactcaggcaaacttacttttacgtctactggtttatgacaaaggttcttttaaaggacgcagttaaacagccagatgagacacacacagtgaggtctggaagggtcctgagcctgtccccatgccaccctcccagcacgtggatgagttcttgttcaccttcttacaaacctccgtgtgttcagctatctggaagctctctgagccctgtcctcttggcttttttttttttttttttttttgagacagggtcttgctctgtcacccaggctggagtgcagtggtgcgatctcggctcactgcaacctctgcctcaagggttcaagcgattctcctgcctcagcctcctgagtgagctgagattacaggcatgtgccaccacgtacagctaatgtttgtatttttagtagagaaggggtttccccatgttggtcaggctggtctcgaactcctgacctcaaatgatccacctgcttcagcctcccaaagtgctgtctctccatctgactgcaaggaaatgaagttgcagggaagtgaagtgacttccccaggccatggagttgttggctgtagaagtgcaaccagcagatcatctctcctgggccctgctcttcctagaattcacagtggaagatgtataccctactcccacctattccttacctccgagcctccctacacagcagagacctctctcctacatgactgccacccaccattgtcctagaaataagtcaaacagtggcatttgtcagtcccacatctagtcgtagcagggtgctgtgtggggcgggcgtggtggcagagaaaaggtgtgtcttggagcagtgagaaaagtactcagggctgtgcttcctcaaggagtctcatggcatgtagcctgcctggaaagttttctgccagcatctagcaggttgcatttcacaagcggcataaatcctccttaaccgtttgcccttacagctagtttgcatgtgatggtaaatctgaattgttactcagtgactgtatttattaagaacagcccacctgcaaggtactgtggcatcgagggtaccaggttaggaggaaactagcatttttttttttttagacagagtctcgctctcgttgcccaggctggagtgcaatggcactatctcagctcactgcaacctccacctcccgggttcaagtgattctcctgcctcagcctcccaagtagctgggattgcaggcgcctgccgccatgcctggctatttttttgtgtatttttagtagagacggggtttctccatgttggccaggctggtctcaaactcctgacctcaggtgatccgcccaaagtgctgggattacaggcgtgagccacagcgcctgacctcagcaaaagaatttggtaagtctagaggtaaagcttaatactgtaaagatgctaaagatgctgtcttcccagatcattaatttagtgcaatgtcagtcatgatcctagattttaaaaagcaattttttaaaatatagagacagggtctctttgttgcccaggctggtctcaaactcctggcttcaagtgatcctcctgccttggcctccaaagtactgggattacaggcatgagccaccatgcctggcccttaaatagatttttaaatataacttgacaaaataaatctcaccggattgagaaaatacataaacatagccaagaaaaacaatttttttgagtcagagtctcattctgtgtcacccaggctggagtgcaatggtgcaatcatggctcactgtagcctcactctcctgggctcaagtgatcctccagcctcagcctcgtcggtagctgggactacaggcacacaccactgcacctggctaattttttcttaaatttttgtagagacagggtttcactatgttgcccaggctggtcttgaactcctggcctcaagtgaccctcctgcctatgcctggctgaaaattttgatgagaatggggttgtgtaagtatgttcaccctgacaaaagagctgtttgctttggatttatggacttttctgtatgtatattacacttctataaatgtttacaaaatttggggtaggatatagaaagtagagataaacttgtcttataaaaacatactacagggctatcataattaaaactgtaaggcataataagacaaatagctcaatgaaatggaagaatcttgctacagaatttaatgtgtaagacatggggaaattattgattgttcaataaatactgttgagacaattagcaatccatttggaaaaaataaattatagaccgcccctcctgaccatatcatacacaaaatcccctttaattccaggggttaaagatataaatagcatgatcattcactgatggtagaaggattaattcatactgcctttttgtaggacaacttggtaggctccttcaacatttaaaatgtgcaggtggggcgtgatggctgacgcctgtaatcccaacactttgggaggacaaggcgggtggatcacttgatcccaggaatttgagaccagtgtgggtaacatagtaagaccctgtctctacaaaaaatacactaattagccaggtgtggtgtgtgtgcctgtggtctcagctactcaggaagctgagttgggaagatagcttgagcccgggaggttgaggctgcagtgacccatgatcgcaccactgcactccagcctggggtgacggagtgagaccttatatcataaacaaataaatatatgtatgtatttgtgtgtgcatgtgtgcatatatatgtgtgtgtgtgtgtgtgtgggtgtgggtgtgtatcccttgctccaacaatttcatttcttgactctctcaagttggcctacacatatatgtgcacatggattgatgtgcatctgtgttcactgtggtgcatataatgtgatagtggaaaactggaaactacctccatgtccattaggaggggaatggctaaattacatacatccacacaagagattaccatgtgtcacaattcaaataataagataggttcagtcattcatgcaacaaatatttattgagcaactactatgtgctaagaccagttcttagctctggggatagagcagaaaacaaaacagtctctgccttcatggggattatattttagtggggttgacagccaatgaacaaagaacaataaaaatatagtacgattcagagtgagaatattgtgaatcaataaaacagggtaaggggggacagggacagggaggtggcatttcagactgggtgctcatcaaatcttctccaaggaggtaacatctgggctttatttgagggagctcttcattcacggaaaagaggtctccagaaacattaagaaaaaacaaaacaaaacaaaagtaattacaggacaacttatggtttttaaactatgcctttgttttcctaagcatgcatataggtatacaggtatagatctggacatcagccaatggctggacatggtggctcacacctggaatcccagcactttgggaggccaaggcaaaaggacggctggagcccaggagttcgagaccaatctggacaacatggtgaaaccccatctctacaagaaatacaaaaattataaaaattagctgagcgtggtggtgtgggcttgtagtcccagctacttaggaggctgaggcgggaggatcacttgagcccaggaggttgaggctgtggtgagctacaatcgtgccactgtactccagcctgggtgacagagactccgtctcaaaaaaactaaaaaatgtagacatcagtcaaactgctaatattaaaggagtggtttaacacttattttccagcaagcacatattcacgttacttttagaatagacttttcaactctgtgaacaaaagctatttagagcacatatgcaaaagagttgggtcagcagaagcagcctaggggttaagagcgtcttccctggggcaaaaatgtccccagccggctcagctgctagctttgtgacctcaggcaagctgtggcttcagtttgtctagagtagctgttccatttgggtttgtacctagagggaggaggccaggggtgctgctgaacacccgacaatgagcaggacagctcccccatttgtcaagagcaatgtggagaagccgtgctccagaacaaggggcagtgcccgcctctcaagggttgaggactcacggtgtgcaatgcacttagcataggccctggcacatagcaagtactcaataaataggaactatttttattactggacttccctgaaaactaaaaaaaaaaaatgttgagagtatggaggacgtggtagtgccaggaatcagttctgctgaatcccaattccagcagctggctggaagggatctctgacctccacagcaacaacagtcttcacggggtgtgtgtctgccaatgggatggcctatacagagctcctcgttccttctgtttggtttttctggtttgaatctcatctcctgccagtagttcagggacattcccaccagatcacctggtctcttgtacgtattcagctgtgctctctcagacattccctgtggttcagaagaaacacactcaagcttctcttgtgggaaaaccaaaacccaaccccacctcacctcccacccccagcttcccgcgcttcctgtggccctgacctcctctttccaccccttcccaggaaatccaagagacacccactctgctgctatctcctccttccaccccatcaggtcagcaaaacggctcctgccacatttccaacacctggccactgccaactcactgcttctccctcttcctcttgtatcgcttctctgctgccttcagcacggctgaccactctccctcttggcctgcttgtcctcccacccctcctcctgctcactcatcctccttttctcaaccaggttctcagaggctgggccaaggctgctgccttctcttactccatgcttcctgttctcaatcccccagcaatctcacccgctgctgggtccttactaacctcctccacccaaagactccccagtctgcctgtagcccccaccctgctgtctctgccaggttgtctcaaaactccctgaactcagcagtcacaactgatctcgtatctatcccgccaatctggtctgactctagtgcccccatctcagggaatggccctgttacctgtgcaagtgggaagccagcagcttaggtggagtcctccatccccatcacccctggcaggtcctgggagcacgacctcagtatctcccagtctcccctcctccgtcgtccctgcacccatctcactcgcccctgcttctcttctgcttctgtaccatcgctcgttctccctgcaaccagagccatctctcaaagttgctatggaatccgaatcgcatcacgcagccctgcctgctgaaaactcttgaatccactgctctaaggatgaaatgcaaactcctccccctgtgcgcccccctgccccctctactccagccacgctggcttcctccctgccctgcagctgtgtgccacacgctccttgtctccccctagctcacttgcttccaccttccctacattcccaactggaatgcccaccctaccatgcactcgtcacctgcagcttccccttttggaccaggtattgaggatacaattttaatcataccccccagtggaccgtaagtttaatgagtccactgatcctgtcttattttctctattattatgtccccggcatctgacactattaatactgtgagtggcaaacattcaacacatagaagccatgatgacaatctctgagcagaatctggcatataaaccctacactgatcccagagaaccttctggaatcaaactccatcaaccctcaccacccccttcacccccaagtcccctcactcaagtgtcttatgcaactttcttggtaccacctgggtgattcttgaaagaaaacccaagcgtgggcatgcctgggcagcacagtggaggactgcttctgttacactgcgtagctttttactcagcccgttcacctgcagcacgggtcaggcagtatttaccccagcaagacccagagctcagctgagctgccttaagttgaactcctgtaggaaaggaaaggaaaaaggaaagacccccaaggacccaaactgtcctacacaaagagaaatgaccaccaaggtttggttcttgaatatgtattttttactgaaaaaatcattcataaattaacatacaaaaatgtacaaacacatgagtaaataatgtaatgacaaaggactatttttgtgaaaagtgttttttaaaacatctttagatttcagtgcaaaaatgtacccctggcacctcttaaaacgtaagagcaagctcaaaaacacgtagtgatggaaataagctagctacgctcaatgccatcgtcaatggtgagtggatacaatcaatccatgtggctcctgctcagctattaatgtctgtggtagaggatctctgacaagaggacctattatgtcaaaatgagtattcttgcaaatacccccccaccccccaaaacagcatgaacaaacggggacacctttccctgcacacagcaatcaaagacaagattaaggggccacccatcagtagccttgaagattttcagctaccaatatatgcacaaggtcacatttggttcctgtttttttttttaacatgacaatttcacactattaacagcacacgggcctggctgtacgtttttaactatgacatttcccatatgatattcgaggcctggtggacacatgactgacagtgcacatccagagattctacactcatcagacacagacatgaccgcaaaggtatcaaagtgaccccactttaagcagtgaaaaaagacctttccttttgttctcaaatcagcattttctaaagtcaggtgttagccttttgccaacagtgtgtacttgatggtaattatggcaacatagagcttcaaacaagatcgcctgacaacactgccgcatacacatacggcacccaggactcagaatcagtctgtcctggcaaatccttccaaatgacatcatagtgttgtcacattgaaagcaactcacagccttcagtgaggaaaggggagaggagaatgagaaggggagaaaagccaaggcagggacaaaggcccggtgggggatgggggttgcagggtggaggggggtctttattgctatatgcaccataaaacaaaggaaaaccaaatgaacttctgtgtgtaatgttcacttgtgaaggtattttaaagcatgaaatgcttaagtcttaaaaaacatatgctatagcttaccggcattttcaagggcaggaacctgctctctcatatgagccgataagagctttgcaatgcaatttattttctaaataccactctattcttcaaaagaacaaaaacacaaacaaacaaacaaacaaaacaaggcctggccaatcactcccacagtttgtggggatcatatgtccacagaaccatcacatgcaacgaaaaaagccctaacccacacacatacacacacacacccctacacacacccatgtaaactatgaaaatcaaggaagttgaaggcaaacaaggcaattaaaaaaaaatacgaagtactcttcagaaagtactcctcatcacaatatataaatatgttttatggaaaacaagggcgggggaggaaaactggcattttccagaattctgcagaagccgacagagactacaatttgagggctttggtttggggaaaaacaaagaggcacaaattcaaatacaatttagaacatgacttcaaggctgggcgcaatggctcacacccgcccataatcccagcactttgggaagtcaaggtgggcggattgcttgagtccaggagttcgagaccagcctgggcaacatggaagaaacccctgtctctactaaaaatacaaaaaattagccaggtgtggtggtgtgcacctgtagtcccagctactcgggaggctgaggtgggaaaatggcttgagcctaggagatggaggctgcagtgagctgtgatcgtgccaccacactccagcttaggcgacagagccagaccgtcttaaaaaacaaaacaaaaaataatatgacttcaaaatgcaggtgggggtgtgagcagtgcacctgggctcttgctgtctggagctttgttagtctaatttcaaagcttcaatccggtcttacctggatcccagctgccccacagcacacaagtgtcaccagctccctggctcctggctccctatttgagtgctccttggttctatgtatcagttactaatgttgacaaagaatctttccagaaaccaaaaagggacacagaggaatcactgaagccagctggtaatgtaggcacattgttcagaaactgtggccaagttccacaagagaaaaagtaagagggggagggattcccatacacacccccgccccccgccccccgccccgccatgctgatgaaaagacagaacacgaagcctggagagccagagatgtgtgtgcagcgagccccgaagggcctgctttaggcaggaagcagcctgctctaacagcagcctcccgcttagcggagagtgggatgagcacatgcgcggccgacagggaagagtgaatccagagcagaagtcaagggcaagactcgtgggggggggaagaaagggacagaagccagctcccagcaataaaggtcgggttattttgttcttttgtgacatgccctatatccactccctcgccaaagtgacagcaattcgggagatgacattcttcaactgcattttaactgagttcctgcacttgccaaccaagtaagtggcctaatacataaatcctcaatttgaattggagccagctagaaaattaaattttaaaaaggcattttacatggcttatttacaattatacttcttcaagaagtgattgttatatatttatgtctatttatctttcccaaacaccctcccctccaccctcaatccccacccaaagaaggtaattttttaaaaaaatgaaaccaaagagaacaccagagatctagaagaatggtgtggagtttcatttgctcttcctaaaacgcagctgccctgtggtgggtttgcctctgctctgaaggccaagaggctccaaggtcatgtgtagggacaggctccacggcaggaccacggcaggaccacggcagatcacagttcatcatgggttctggagactgcggctaagacaggatgtggggtaggagatggggagagagcagcgggacagacgtctgtcttgtgaaaacagaaagccagtgctgacgaaggaagtccccaagctcactccctcagttccagcggctgatccagtgaaggcgtttgtgcgtgtgctgtcacattttccccctgaactctgtgatccttcatgagacacagtatttctgttctcttgctgtgtagaccctcccccctccaaaaaaaaatctcatcggactgctttcttggtggcggtgggtaaagcaaacgtacattctctcctctcagtactcgttcacctgagccagctcgggtgtcaggttgacagttatgtttttatacaaggcgtcgtatgtgatgtttgcaaagtagttcaggttgttgaggccatccagcccttgccgttcttttgacttcctcagcagagcatacctgtttagggagggaacagagaagaggtggctctgagtgaggatccatgcctctgcagccagaggatggagcagggcgtcccacagcagaggacgcaacccatggcagcacttctgcagcacaaggtgggcgcacggccaattctgctatgccaggctgagtgctgtggtcagaaacacctcctgtgtttcatgccaggtgcttcacttaattatttcatttaatgctcacgccagcccctgctagcaaatgaggaagccaaggcttaataatgtgaggtaacttgcccaaggtcagagagtggggaagtgggaggtaaagcattaaaaatacaacagatgagaaagttcatactctgtattcagtgccattttactcccatgaaaacagaatttcagcaattagaattggttgtctagagcacagtcttccccacaatttagaaaagacacacacacacacacacacacacacacaaagaaagaaaaggtaacacagcaactgcagccacccagacagaagctcaggacaccattcggaacgggagcctgcggaaagggcgccactgctctgtcacctcagggaccttcatccaagctgtttcttcccaaattccccaaaggctactgtggagaccacaaggctgaagacataggacaagtgatttccttcgaagaatcttactattgaaaatgttcaccaacggtctgatccccacactgttctgcctcagagttagaatacatgcaacagctgtcaaacagctgtcagaacagggcctcggggtggggagtaggagaaggggctgtaatatgctctaagatatccggacatgaaagtataggggatacttctaagagacagagataaattccaccaaccttccaagaaactggacttctcctcgatggtgatgaggaatggacttgtactttcctgtgtcaccctctggccggctcacagaatagcctgcattctgtactctgtccaagaccaagagaacaggcttttagatacaacggtaatagcccaggagtgaccaaagcctacaagacatgttacaagcttaccctggaaatcacacacagcaaaagctctcacccgcttaactgactcattgtgtcatttcttaaaaactgagttaaaactcaattttaactgaattaaagtttttatgtgaacggaaaaaataggctgggctaggtggctcgtgcctgtaatcccagcactttgggaggccgaggtgggcagatcatttgaggtcaggagttcgagaccagcctggccaaaatggtgaaaccccatctctacttaaaaaaaaaaaaaaaaattagccaggcgtggtggtgcaggtctgtaatcccagctactcaggaggctgagacaggagaatcacttgaacccgggaggcaaaggttgcagtgagcaaaattgcaccagcttgggtaacagaaagaaaatctgtctcaaaaaagaaaagaaaagtacggaaagaaatggttacttccagggaataaaatagaatcaaaatggggattaatacttagacacttgtatcatctaattttttttttttaagagacagggtccactgtgttgcccaggctggagtacagtgaggtgatcatggttcagtgcagcctcaatctcccaggctcaattagtcctcccatctcagcctcctgagtagctgggactacaggcgtgtgccaccacaacaggctaattttttttattttttgtagagacaaggtctcactgttgcccagactggtcttgaactcctgggctcaagtgatcctcaagcctaggccttgtgaagaggtgggattacaggtgtgagccacagtgctcagcctatcatttgaatttttattagcaaaatagtccttgtaattaacaacaaacacatacttttcaaaagccaagctacaaaggaaacagataccaggtagtattttgcatttgttccttatgaggttactgtttacttactccataaaaatattactttattccactcacacacaggattgttcacccaagcttgtacagtacaagccttatgtgatggcgcagctaaatctatgtagacatatcactaatattccacccttcagtttggagtggttccaatgaaatgggcatttagtacagagaacactggtgaagtgaaaagttttgttagaacctttagcaggaggggcacttagttataatatgccttaaaaaccctatttgcatccattaaaggacagagcttaaaaaaaaaaagagccttaaaatgactacattcgcttataggaatttttcctaaataggaataacaggcaaaagaattatctactatatcacactctaaatagtggaaaatggaaaagattctaaatatacaccaggaaatagttacataaattacagtacatctatataaccgaattaaatggagccacttaagatcctgtttacagagtatttaatgttgatataaaaacagtaacacctattgagagcttatcacatatcagatatgccagagctctatacacattacatcatttaatcctcacaatcctgagatttgtgattttaaaaactgacacacagagattttaaattactgttcacttgccactttttaaacacaaaataaactcaatgaaatggtaacatgttacttattgttgtgggtaatttatttttatactcatttgtattttataatgaacgtattatttattagaagaaaaaattgctaaattataatttgttgattttcgcatgtcaaaggagaaaaatgaaaatagctgctttgttgggatatacagtttgttttttaagatattaagatatttttaaattaagattaaagatattttctaaaaacttggatgtgtgtggtgtgtgtgtgtgtgtgtgtgtattttttaagacaggtctcactctgtcacccaagctagagtgcagtggcacagctctctgtggcctcgaactcccgggctcaagtgatcctcccacctcggccttccaaagtgctgggattacaggtgtgagccatcacagctggtcaatttcatttttttccttaaccttttaaactgtagctactagaacatgttaaattacacacatggcttgcattatattcctatcggatagtattggtctgcagtctaaggtagcatttctagaagacaccgaaagaacggcagaggtacctgttccagaggtcgtcatcttctccaccccaaccccagaaagcattaggaaagccattgattttccgaaattgttccactgttaagccactcactccgccaaagaactcggtataaggaagcctaggaggagatgtgggacatcaatcatctgtgtgttacagggtaactgttttccctagaaggttctcatttgaggactaaaaacagtgctctctgtgctcctgacctgaaccatatgaatgtatcaaattagcaaaattaatttttgcaaactgatttttaatagctttagtgagatataattgacatacccatacacaattggcccatttagagtatatcattcaatggttttagtttattcactgaattgtgcaaccatgaccacaatctatattaacatgtttcatcactgtcccccgcaaagccttgcacccattagcaatcaccccctgctcctcctatcctccttagccccttataaccatttatctactttctgtcactatagatttgcttattctggacatttcagacacctggaatcatatgatacacaacctttgtgtctggcttctttaacgtaatgttttcgaagttcatccgtgttttggcacgtatcagtatttcattgctttctcctgccaaacagtgctccaattgtatggatacacacattttgtttatccatccatcagttgatgggcatctaggttgcagctaattagatttccttttcacatcgctcaccatcctttcagatttaacctctttaattaagaagaaatgatactcacagatacatatacttatccaatttggttgcaaaatgcctcggcatctgtccacatccataatagttgcgatcactttccggtatgtgatctacatcatgaaaaatcaaacagtcccaatccaagtctttcattgcctcttgaaagccaacgttgaaaagcatggctcgattaaagggttgggtaccaacctaaaagaaacagaactttatctttaaaagaatcttgaaggaaaatctttgctgtctttcctgtgcctaaagacgagtttattagaaccaactggaaaagatcactgggctagtgtaaccaggtccaacaccacaaatcaactcacagtgtggctcagaagtcactggacctctggcatgggcacagtggctcacgcctgtaatcccagcactttggaaaaccaaggtgggcggatcaggagttcgagaccagcctggccaacatggtgaaaccccatccctactgaaaatacaaaaacattagctaggcgtagtggcgcatgcctgtaatcccagctacttgggaggctgaggtaggagaatagcttgaacccgggaggcggaggctgcagtgagccaagatcgcaccattgtactccagtttgggcgacagagcaagactccatctccaaaaaaaagaaaaagaaaaagtcactggacctctggccccaatttctttaaaaatgtaagtgatagcaaacgcaagcttctctctcccaaggctactgaaggcagaaatgcaaccgtgtaccagcatttagaagagtaccccgctccacaaagggaagagacaacactaccatttctactccttaccacttgctcttcagcacatcaaccaatctctaactgttcataaaccaaatctagtacaaagagtggtttttagttttgtcttgttttatttttaagatctaactaagacaacagtcactgagcatgccagggactcaagcctatggacaaagaattcagtggctcatgaagaaaccagttcaaatcagttaacagcctaattagtgttacagctacattgactcccccttgccactatcaaaatacccaacttaggaccggcagatagaccgttagcatttcccagatgcccagccttgctgaacagtggtgctcagcttttttctcactccagtataaggcaagctccagggtgaccacttaacagcaactcagactgtgagactcaaaagtgtgcccatagagagaggtgagcatgcaaaagaccctcagactgacgatcagtgtattcagggaaatctgtcaaccttttgtttatctatggatatagcacctctagttcaaggatcacatacttcaaaatgcctacagaagccaagtcagtaatgtaaacatataaagtaggcccggcaagagaaaaccacagtaggacagtcatgttccatctaaaggcaaataaaatatatgcaggaccaaaaaaaaaaagatttacagactgaatttgccatgcggtcttcttcagtttgtgacctctatatctggttccctaccaatatttttaagattaaaacaaaaccaaaccctcaggcttagagaagtttgcaaatgtcccaggccacttggttgattaacagcagacatgacaagcactgaggtctcttgactccaaggccacatcctctgtgctgtaccttgctgcagctctttatcttaaggggaacttcctgggtctggagcctgcaggcaccaacaaaaccataatacaagaggcctttgttcatgagccaacaaagctctctcctggattcaagtgtgcccagtactgggcaacagacatctcaaaccaggagcacagaattgctctctgctcccccttcaaacctcaggcaactcgatcctaagatttcagttttattggctcttcacaccaacagtggattagcttgcagcaacctaaactgctgtctcagaagagaaaaaagaaaggaaaagaaaggactactcacttgttcaaccacataaaatgcaaactgcaagcgctggcgctggagcatgggaagcaggtgtctgaacaggactgggaggtgctcgtggcggttccggaaggggataaggatcgccacctggagtggattacagcaaaagaagcacagttaggactctcagctttcactccttagcaggacacccctgatgaattgctgaccaacccatgggagttctgggaggctggctatcttgtcctcagctttctctaaacaaagatctatgttggcaagttggcccttggacctagatgaatgtgattcttacatataccatatcttatagtacatagtaggcctataatttattctaggccataactcataggaaaacacacattctacactgtgacaaaaatacatctataaacttacaattaaaacaagcttcacaaaacagtatttccccttacaatgtgcaatgtacaaatgctggttattcaactgtttttatttcccagcgatgggctggatactgatgtgttccagatctgctgcatcagcagcacttaacgaggctggcacagaatacgcattttaatagatacttgttgaaagaatggacttcagctggggtcacagcttaacgaaaactactgatgtcttctgactatggtcaggcagaaaaaaactaaatctcaatgtcaagccaggtaactttgctttttaatccactaatcttgtagtaaccaatggagaacaggaatgaagcactgactctgtagatgacttctgcaaatgggtcattagagaccaccaacgccctcatccccttgctttgttaatattcctggtgggaagaccaaagggtcttgctcggtcatcagaataatgcaaatttctgtatctacaaaaagagtccttgtggaaacccattcctctaaaatgtttctacatttgcatggaatggtaggatgaaaatgacaaaatgtcatggttagctaatcccatggtgattcggaccaaaggcaaaccccaggtgggcttctcagcattttggctgtgacttcacaccctaccttccaccgaggcatgcaatcagaaggcttccagtgacctccgagcttgatggttgggtctttggagaagagttcatgaatgtaatccattccaatttcactcatgtttatgtctattgggccctctgaacagagacggggaaaagggattaagaggtcagaaaatgataggtttccctatgcctggggttttagtctctggagagcgcaatgctttttcagctgaatttgtttttagcaaggatggaagtcccttcctctgctttccatctcaccgtatttcagttcctcactattttcaaggtgaagaggcaaatcaaggaattaagactttagagttctgcttctgtcaggggccaggtagaaatgaaaactttaagtaaaacagtagctgagcttttttttttttttttttttttttttgagacagtctcgctctgttgcccgggctggagtgcagtggtgtgatctcagctcactgcaacctctgcctctgggttcaagcaattctcctgcctcagcctcctgagtagctgcggttacaggcatatgccaccacacccagctaattttgtatttttagtagagatgaggtttcaccttgttggccaggctggtctcgaactcctgacctcaagggatccacccacctgggccacccaaaatgttaggattacagtcgtgggccactgtgcccagccttcttttttttttgttttgtttattaatatgttttaataaatagagacagggtctcactatgttgcccaggttggtcttgaactcctgagctccagtgattctcccaccttggcctcccaaagtgctgggattatagctatgagcccctgcacctggctgcagctgagcttttctgagaagaaggagaaaagcagctgagcttagagtcatgtcaggtttgctcctgatgcaagtgcagccacactacctctctcaatccattcaccagtgggtcaggaccctgagtgattatgtcctaactcagaatgctggtcatctctgacttaagtcaggaagtggtacagtaacaatcaataaatgctactgaaacaatgaactaataacattagttttaggcctgtcaacgcctatttctgatacacaaatctcagccttcccaaactaagcttacatctagatgcagacaaatgcaggttttaaagggaaaacctatatatgtgtggtgagacatgcaaatgaaacagtaaggcttccaacacaacttacatacttataattaattattcatatatggatgagaatatgttcaaataccatgcacgactatttctaacattttccctattttcactatatttgtgcataaaagtcaactttgcaaatgtaagattttccttttcttgatctcacttcttaaaaaaaaacaattttaaaaaaagaagtggggaaccatattaagaagcctaaaagtataggaaaggtataagagtttactgtccttgttttagcttacacgagattcaaaaaaaagaacaaaaagatctaagaattgttttaactagcactttgttaagaaaataacttccaagcaaggcatggtggctcatgcctgtagtcccagcttctcaggaggctgaggcaggacgattgctccctgaagttggagaccagcctgggcaacatagtgagacccccacctctaagatcaagcactacaatcagtgagaggtttatactaaaaagacaaagctgactgcctatacagtgatgtgctttgacattttcaccagtgacggatggcatatacggtggttgcataagatcacaatggagttgaaaaattcctactgcctagtgatgacatagctgccatagcattgttgtgttactcaagtgtttctggtgatgctggtataaacaaatctactgcattgccagtcatataaaagtgtatcacaaggctgggagcagtggctcacacctgtaatcctagcactttgagaggctgaggtgggcggatcacctgaggtcaggagttcaagaccagcctggccaacatggtgaattcccatctctactaaaaatacaaaaattagccaggcgtggtggcagatgcctataatcccagctactcgggaggctgaggcaggagaatcacttgaacctgggaggcagaggttgcagtgagcggagacggcaccactgcactccagcctgggcaacaagagcaaaactccctctcaaaaataaaaaagtatagcacatacaattatgtagagtacattatactagataatgataataaactatgttactggtttatatatttattatactatatttttaaatcattattttacccttttgaaacagggtcttgctttgttgcccaggctggagtgtagtggcacgatcatggcacactgcagcgtgttgcccaggcctaggtgggagggttgtttgaggccaggagttcaagaccagcctgggcaacatagtaacaccccatttcttaaaaaagtaataataataattttaaaattagccaggcattgacaacaggcacttgtagtcctagctcctcaggaggctgaggcaagagggttgcttgagcccaggagttcaaggctgcagttttttttaaaactttttacaagttcacaagtttagaaagtagaaaggtataatagtaaggttcatctaccattaaagacagacaaatattttctgaataaatttggtgcagccaaagtgttcagtgttcataaagtctacagtagtgcagagtcatgtctcaggccttcacgttcacattcactccacgttcactcactcactgactcaccagagcaacttccattcctgcaggctccgttcatggtaagtaccctacacagctgtaccattttttatcttttatatctcattttttactgtaccttttctatgtttagatacacaaatacttaccattgagctacaattactgtatagtaccatgctgcacaggtttgcagcccaggagcaataggccataccatacagcctaggggtgtcgcaggctacaccatctagatttgtggaattttactctaggaggttctcccaacaataaaatcacctaatgatgtacttctcagaaagtaccctcgttgttaagctatgaatgactgtattcatactttctctaggaagttcaaacagaacccaagttacaaaggacaggcaagggcaaagggaagagtgaaaaagtaggaaaggtagaaaatggcacccaagaacacaggcaaccttgcagcaggctttgaagaggagccaggagcacaactttcacaaaccctgtttccaatggcagggaggtatttatattctctctgcaggcagacagagagatcaagagtgccctcccctttatccattttaaaagcagaggaagacaggccagagctgtactcactcatggaagggagtctttcagggcaggtatggtttgcaaagtaggtgaagtcttcaggaagaaatgttgtagtttgcaggaaggtttcactgtggttcaagtcaagaggataatctagggaggtaaaggaaaaaagtcgatcagactggtatgtgtgatcaaccgtgcaattatcagatgcctaccaagtaagtctttctcttagctatcatcttggtagaaggagacaggactctggactaccgctttgatgcagctaaaaatgtgaacccatcaataaaaatgtcagccaaatggcagattttaaccagtgttcctattcctattgattttataggtttatatgcagcactcagtttacagtcaactgtaattaaatgtaattttaaaaacagcagttgccctcctctcatttctgttttctaaaggaaccacttgcccttcttttggccaagtatctcagcatttatatgcagtattcacctctgtcagcctctacggctggtcgtgatgtttctgttttcagtcttacctaccgacctcccacttatccccttccttctgccacccctgccacacgatccccttccattccccagtctcccatcggtcacatatcatagctgtggttaggacaatcttcagtctttgtattacgatgctgctgttaagtactagtcgtcgctgagaaatgtggaaagttatgcatcttgtttttctgtttgctcagttttatatgcaatgattctaattcaacaccacgcctttcaccaagacatttcctcctaagacatacattaggtattctctcaacttcatcctcccagaggaggtgtggcagcttctggccttcttccatgccaaatgtgcttggggggaggtattctctcggtgatgattcctcccttctgtactctgtgctgcctttctggagaatacagaacaggagttggatgtgagacctcccagtcctctgtctcatcttttctatccagttttccgtcttgccatttatctgccctactttccaagagatttcctcaactttactcaaccttcctttaatcatcatctctgctatcatattttttaactttgaagagctcttgtttcctgaatgttcatttcttactatattcttgtttcatgtttgcagtcatttttctcttattggtatctccagtgtcaatatctttgggtcttttctcctggtctgaccagattctccagagaaatccactcgaatctcctgccagaatggtagagtcctgactataaacatcctgaaactaagaaagaagagaaagaggctggggcatatgtaatccccatcttttcaaatactgtggtcatgccaggtatccccaggttgaggagcctctgttttgccatctctggggttattaagtctccagctcttgccaggatggggaaatgggtctgggtatctgactgctttttaacagctttcaatctccctttattttagttgccacctttgctcctacttcccatattgctagttcctgagcttctgggggatcctggggtggttgctggttctcctgttgctgctttgagcagtcagttttcttgggtttgttaagtcttttatcagtggttcttctgctttctacctaccaaggttttttgctgtggtctccttttgtgttctcattctcaagggtttataatttaaaaaccctcacatatgtatgcccctttagagtcacgttagtggatatgaagagtgtgatggcagatgtctttttcctaggggactgtacttgtagagtaggaggagggtcctccaacctcattttctacagatgaataactggaacaacatacacagaactcagaccaggagccctggctaatgcatgacagagctccaactaaactctgaatgagagatccttccagtatactgtattgtttttatttttttcacagaatattaaatccttttggatccatgctgattctatgaaaattaaaacatcctgttcaaattcactttgtaccctagaattctagaatcttcaactaagatatttttgaaaaagcactatgagcaggtttccaagaatcaaatggctaacacattgaatccttttatatatgcacacggctgcctactctgcgctgcctactctgcaagtactctggggcaaaattcaacgagaggcaacttgaaaattttaactgtgtcttaacaagggaaggaacagaatgctttctgtccttttcagtagtagctttcctgaaaaacactaagcctgcatttatagagaatagtagagactaatttatataaagacataaaccaggctgggtggggtggctcatgcctataatcccagcactttgggagactgaggcaagaggattgcctgagcccaggaggccaagaccagcccaggaaacatgctgagaacctgtctctacaaataattttaaaaattagccaggcctggtggtgcgcgcctgtggtcccagctactcgggaggctgaggcaggaggatcacctgagcctgggaggtcgaggttccggtgggcaatgatcacaccactgtactccagcctgggtgacagaatgagatcctatcttaaaaaaaaacaaaaacaaaaacatgaaccaagacagaaccttaaagataatatttacacagaaattctctgagctcagctcatacatgcaaacctggcctgggttgaatcttcttctgaaggtagtaactacttcaaaaatctatgtgaagaacccctcatcctaattattactcaggatgaatctaatagatgaaattattctcctttagaaaaaaattaaaagacctcacaagtaatagaaaatgtgcctgtgtttgtgatacgcccatgtgtggcaagagacgctggctggaaacatgtattggcacagtcaatacattcactagaaggcaatgaaattcccaaaagtattacactaagtatattttcataaacaaatcaacaaaaacgaagataataatcattctggtcaatgactgacccaagccctagagctagaacctaatcaggaaactagaatttaaaaaacatgaggcaagagacaagatatcactaactctaatgattctactatttggagtttctttgaagatagataaattcctttctacttccttcaaacaatgatacagtaagcctggtagcacctagcatgaaacaaaaaaaaagcatttatttttcttctgattactaaattaataatatgtcactgttttaagaatcctcaaatacgcaacaactctattgcaaaaatcttccagaaacttactctacatcttgggaggggtggcttaatttcctgatttcttgtttaaaaatttttaaataaaactttaattaaaataaagtctacttggaaggccaaggtggggtgctcacttgaggtcaggagttcgagatcagcctggccaatatggtgaaaccccatctctgctaaaaaaaaaaaaaaaaaaaaaaacacaaaaattagccgggcatggtggcaggtacttgtaatctcagctactcaggaggctgaggaaggagaatcgcttgaacccaggaggcagaggttacagtgagctgagatcacacggttgcactccagcctgggcaacaacagcaaaactccatcataaacaaacaaacaaacaaagtctgcttttcagtagcaatagaggccttttaaaatgaaagagacagaggaaattaattgctcacgacctggtaaaactatgtgcagttatcgtgaggagcccttgtttttctcccctgctagctgtccagcaacgggtggggttataccttatccccttggagttccaaatataacttcttactcttctaaagcatgtacctactgaatgaggaaaatgctgagagaaaaacaagcctgttgaatttctacagccacagttttactttttaatttaaatctaatctatttcaaacctggacatgttcttgaagggcaaagaaggcagctgcttttacatttagaaaatggaaaaacaagccgggcgcggtgatctctgcattttgggaggccaaggcggatggatcacccaaggtcaggagttccagaccagcctgaccaacatggtgaaactgtgtctcttactaaaaatacaaaaaattagccaggcacggtggcatgcgcctgtagctccggctactcaggaggctgaggcaggagaattgcttgaactcaaaaggtggaggctgcagtgagccgagatcccgccactgcactccagcccgggcaacagagcgagactttgtctcaaaaaagaaaatgggaaaacaggccaggcacagtggctcacatctgtaatcccagcactttgagaggccaaggcaggtggatcacctgagttcaggagtttgagaccagcctggccaacatagtgaaaccctatctctactaaaaatacaaaaattagccaggcatggtggtgggtacctgtaatcccagctactcaggaggctgaggtaggagaatcgcttgaacctgggaggcagaggttgcagcaagccaagatcgtgccactgcactccggcctgggcaacagagcgagactccgtctcaaaaaaaaaaaagaagatagatagatagaaaatgggaaaacaacagactcctacctacaggttcaaatggctactgatatcatgggcttgcagaccaacatttctgtccaacagcaactgcttattcagcattgcttcacaccagtggttcagcagccttggttgcacattggaatcatctaagaagctttcaaaaatcctaacaccaggccgggtgtggtggctcatgcctgtaatcccagcactttgggaggccgaggtgagcagatcacttgaagccaggagtttcagaccagcctgggcaacatgatgaaacctcatctctactaaaaatacaaaaattagccgggggtggtggcacccacctggtgtcccagctactcaggaggttgaggcaggagaatcacttgaatctaggaggcggaggttgcagtgagctgagatggtgccactgcagtccagcctgggtgacagagcaagactgtctcaaaacaaaaacaaacaaacaaaattctaacattcaggctatacctcaggccaattaaataagaatcgctagcagtcaggcacagacatcagtactttggaaacgtccttgggaattccaatgtatagctaagcttggtattgctaccctaatacctggaggaggtaaaaacctgccttctcccttgtgttaccaaatccagttgagaaggaatcgaaagtgctgaccaatggaccccagcaagaatcaccactttcccctcccatttgagaaaagaccaaacacttgcctctctgcttgaaaaaaatatggaaatttatatatactagaaagatgccactgggacaaatatctgtgaaatataaagaattagcattcttcaagagttagtccattaaaggatgactacctactgggagggtagccacatcgaagactacagactggacatctaaaaccaccgagaaagaggtgaagatgacccactccattaatagattacaaagcacaccagcatgactttactcactctgcagattcacaatctcacaaaccaatggctttcagtgacaacaggaagcttctcctggtcaccacttcaggtttatttccaggttcacagaccccatccccaaaagtctgttttcattcactaatcaccatgttgcttttaaacttaaagaaaaccagcatgacttaaatgtcaccctgggcttttgagctatgcttggcctaatgcagatgcctgaatgtgggtatgtgcctcagcattatttcagcagaggatggtgcataatccaggttaccaccattaagccaacagtgctccaggcagaagtggtcgggccagaggtgtcagtcatttggctgtctcagcagtgctgggcccagaataccctctctgactgtgctaggtagacaactgctttgaaatgaagaagaatgatgggttttcattaaatacactttcagtgaaatgctattttcttttcagtacaggttgagtatccccttatctgaaatgcttaggaccagaagtgtttcagatttctgattttttaggattttggaatatctgcattatacttaccagttgatcaaccccaatctaaaaatccgaaatctgcaatgctccattgagtatttttttcaagtgtcgtgttggcactcaaggtttcatcatgtgtggattctggagcagtctggagttggtattttctgattggggatgctcaacctgtacttactcgccaaagatgtgccagtgacacagcagctccacaagatggtgacctccttagaaacatgctacaacacttaagacgtgctttcttgttaaattcattccttcatgcatacaaaaataacttaccaagtgcttcctatgtgcgaggcagtgtataaggtactaaggatacaaagatgacaaaaggaatgaagccattactgcgattcagggcacaggccctggagtcagagaatcagcaaaccctaaccctgctgctgcatcaagttccatgacttccatgtgccttgttccttttatccctacaatggggacacagtagctaccttctgggttcttgtgagggactacatgaaatcatgtaagtcaagtatctaataaacagtaagagagtccctgatggcacagacttccaatctattagagaaataaacacgtttaacaaaaaatagattgttctaaccagagagatgcaaggaaaaggtatttgggtgtatgataatttgagaataaaagtacaccaagttcaataataacgggtcactggatacaccctccaagggtgaaactcacctctgtactcagttttcaaagacagcaactcaggaagtagcgcaatcctgtgttgccagaccggcagtggtgtggaaatggggtcctgctgcatgcccctctaacttctgagagaactgccagtactgccaaatgcccagagagacagatattccagcctcatctaacactgcagaagtatgacatctggactggataaatgtcatgaggacacaaatgttcccttactcagtgctatacaggggagagcgctctggaagggcagtcagtactgcctcgtttcttcacctaactagaagcaggattttggcagggtttagggaaagagtcacatgatcaagctgcgccatcttccccaagattatatgtactatgtgtgaaaaatgcaaacagcataaaattctgccttaactgacagagccacatgagtcgagtgagaatgtgtgtgcggattgtgcaaaacctaccaccacatgcaagacggaaactgcagggtttcctctcccaggtatggttcagagctcaggtaacttgacccagtgcgaccacaatttgtctaaaaagctctgaaatgtcattcacttgttctttgccaacaagaaagtatcaaaagtttatcagtttgctaactacagtcctctgttgctaaagtggacggcaaaggaaactgataaattaggatgtggtcaattcttttaaggagaggcaattcttttaagagaggcaatgttttctcttgattttctaagcgccacagaataattcgcatttgcaacatttgcaaagcaatttcacattcgacagtgaacttccaaaaatcttgtaacttattagagaagaagagaggactgatttagagggagaatttttttttaaatgtaagtattttaaaatattgggcttagacgaaatcattaagaagccataggaggctgggtatggtggctcatgcctataatcttagcacttcgggaggccaaggcaggtggatcgcttaagctcaggagtacaagaccagactgggcaacatggtgaaagccgtgtctacaaaaaatacaaaaattagccatgtctacaaacaatacaaaaaatgagccacggtggctcacacctttaatcctagcactttgggaggacgaggcaggagaatcacttgagcctgggaggtcaaggctgcagtgagccaagatcatgccattgcactccagcctgggagacaaacttagatgccatctcaagagaataaaaaaaaaagctcgggcacagtggttcatgtctgtaatcccaacactttgggaggccgaggcaggcggatcacctgaggtcaggagtttgagaccagcccggccaacatggcgaaaccccgtctctactaaaaatacaaaagttagccaggtatggtggcgcacacctgtaaccccagctactcgggaggctgaggcaggagaatcagttgaacccgggaggtggaggttacagtgagccgagattaacaccactgcactccagcctgggtgacaagagcaaaactccatctcaaaaaaacccaaacaaacccagaaagcacattagtcctcagttacagaaatgaggcgaatcatgaatccttagtaagatgaaatctcagaatctattttttaaataaaaaccatccctggctggactagagaggcctcaagagagtcccacttaatcatgtggaagtattacttccttcctgtattcagtttttgaaagagttgaaaagaaagagccctggcacagtggcttatgcctgtagtcccagcactttgggaggccgaggcaggcagatcacttgaggtcaggagttcaagaccaacatggccaacatggtgaaaccccatctctactaaaaatacaaaaattagccaggcatggtggcatgctcctgtaatcccagctactcaggaggctgaggcacgagtatcacttgaactggggaagtggaggttgcagtgagccgaaatcacccgttgcatgccagcctggatgacaggagcaaaactccgtctcaaaaaaaaaaaaaaaaaagaagtagtcatccagtcactcttaatgtattatgctatagtttaaatgtctgtcccctgcacacctcatgctgaaatgtaatccccaatgatggaggtggggcctacagcaggtgtttggttcacaggggcagatccctcacaaatggcttgctgctgttgcggtaggttctcctctattagctcccacaagagctggttgttaagaagagcctggccctgccctcctctcacctgccacattgcttcctctcaccatacacacaggcttccccttccccttccaccaagagtggaagcagcctgaggccctcaccagaagcagacgctggcatcacacttcttgaatagtttgcagaaccataagccaaataaatcctttttctttgtaaattatccaacctcaagtactcttttatagcaacacaaacagactgagtcatattgttaacaaaaatgaacgaggattcatttggcaagagcttttttagcagtaaagtaaaactcagccaaatccctcttttacaatgcgcttttcccattgaaaataattattgcaaccgaatttacctctcttgggaggagacattctaatcagaccacctctttactaaaaatatacctgagtcatttacactgctgttcctcttggcataagcactccgaagcacctgctcataaacctgagcaccgattgttctcacgttgtcccggatcagaatgccttgggcttgcatcatgaagaggtaggtgttcactgcagaaagcaaaaaggggaaaaagaggtggattcagaagcaatcatttaaaaaaacataccacatagctatggatttttttttctttttggacttttaaagcctcttttagttcttttaaaaccctacatgaccataactctattttccatacctttcaggacaccaacatcttttgggtagctagtagagcttagaggaatttctgtcaatatccaacagttctagaaaaagcatcaacttaaaaaaaaatatattccatctcttctccaaatacccaatctgtattctagcactctgatcatcagaagaaagacctttatgaattagttaaaactttttttttttaaaggtttctgctctctttaagttcaccttctcagaattagttcatggttcttcatagagaaaagaaaccactgactctctgactgctagaagcactgaagccatggtctgaagccacggtctggtcttggcaaccttttcaaagtggtagactgaggctccaatcacttacccttgggagatttggaaagaaaaaggagtaacgaaagactatttgcagtcctcactatccacccatcccagcccaaaagtccaaagcaatagggaaagagcacagtccaaggtcaattaaaacatgctcttaacaaatgagtgttcagattaacctgccaatcttgtcttctttggaaagtgatctccacttgcattttcctgaagtctctctatgatacaaaactagaagctcacaaacacgtcaaaatgtaatccctatattctacttgcaaactccactgctatgccatctattttcaagaaacagtgagattgtaaaacatagtttcttaaccagtcactctaattccctcaaattgcctttgtcattgtgaaagggggatgtgttacaggggtggaacatttacaaatctaaactttgtgggtgtctgggggtggattcatctaaccgcttggctaacctcgggaccaggccccagtgcctcctccacactcaatacatctggccttgggatgtggattccggctctttgacaaaacacttggctgacattaggtttcatcactattaaagcagtatcctgtacataatgcgcagcaaacaatgactgaatggaataatggacgaagcttagaagtcactgtatttcaagctagtgcttttggtgctttatactgggaatgacagaggtggggtgggttagcataatgtcaaaaaccccacgtggccaacattaaacagggacattgaaatctttcgaaagatttcaaatcatctcttaaggtatatcccaagccataaaataataagcaaaaaggaccagtgttcagaatgctttccgaaatgagggagcagtttcaaatgcggccttgcattgattgggagacagccctatgcttaacttctggcaccgtcggagaatagatcagatattgtgtttattctctagtagctaggaaagattttaaggaaaaaagacagcttccaattattaaaaaaaagtataactgtgtgaagtctctgaaagcaggagtaacacctcattctctatttccagcagataggacactgccagtcacagtaggggggcagtccacaaatacttgttaaacctaagacttaaacttcatctaatatcacatttctaattcagtcctgtgttgttgttgttgtttttaatcatttgggctgtgcagtatgttcccactgccctgaaatcttcctttcatcccaacatattactaaaccagttgtcttattgaaaattttgtgtaaagcttttattgtatttattgaaaatcttgtgtaaagcttatagtaaggtgccgccaagaactcactacctcctttcctctgcactgcaaaggacacagttgcttagcccctcctttaaacactctccctttcttagctttgcatcccaactggaggattcctctagggcagtcattctctaatgtttcccacccatcccccagagtgcttttaagaagcctgtttcctaggtcccactacccagactgatgcatctggtctgagtggggcccatgaatgtgcacttgtaacaagctcgcaggtgataaatggtgctggactaaggaccacacttctataaccactgctctagggaactctggccacataataaatataagcaacatttattgagtacttaattacataattccttactgcatttaatcctcataattatcctaagaggcaagtaatactatccaatttacaaacaacttctaggcttcagtttctccaagtatcttcacaaaggtcaactgagagcactagaatttgaaccaggtgtgtctgtgctcttaaccactaagcttttatacctcactcatccatgttctagccacaacctctctctgaaagatttcaagcacccacatggcttaaatgcttactcttaaggagatagctctcacatcttcatctcctgcacaaagctgccagatggatctttcttgacctttcttaattacagatttatccacactgttactgctcaaaagtcttttacgtctcttgcctttatccctgagctgctgctacagcaaggagtctattctttctgccgtgcaaatcccattaatccttcaaaccccagttcacagacctcttgaggaagctttcagtaccgtgtcagtctccccccttctccagtttctgtgatggtctattacagactatcaaaacttggatttgtttccatgttgacttaattcactaacaactgtctcgtgttagtctcgtcattcaactaataaattaacgtaaaccacatagtatttttttttctaattatcgaaaggaactagcacaatgctaaaaaaataaaaactgagggagtaaagattgccaaacaaaaggaaataatcacaaatccacaacttgggattggatggcattttaaggaacactcaccaatatcatcgaatgcttcccactactggggaactatgacctccaagaacacagagtcaacagggaaaatatggccatcagcaaagaaaacctactttggttgggtacaaaatgtttcccagtcacttgttttttctttttttcttttttttttttgagacagagtctcagtcttggctcactgcacctccacctcccgggttcaagtgattctcatacctcagcctcccaagtagctgggactactacaggtgcatgccaccatgcctggctaatttttgtatttttcatagagacggggtttcagcatgttggccaggctggcccagtcacttttgcccactggttctctctcaaccttccccagacaccctctcccactcaggccccttctatgtgtgcccctcccatatcacaacttcacacaacttcacatcttcatcatcacaacttcatcatcacaacctcactccccatccaggctgcgctctctgcatactggcccagttgtctacacttgacaaagagttgtgaccacactaacggagttgtccagatgcaataggatgagcctagaaacacacaaaccaccagcagccctgttccacctgttaccaaagatctgtaaaagcaagcccctttttggagattcacaatgcacaataactcaaggcccagaaattcccagaagagagatgtttagttatttagcctgccatttcccaaaccagaacatcaagtgagtctctgcagaacttactttgggaaattcagttttggatatttctatgaatagactttttaaacgtccattacatggttaggtaatcaatcaatcaatctttgctgaatgttgttggtaaacagcagtcacatcctattactaattcatatcaagcttgctagaagcaaaatccccttaatctttttagagatgctaaattgcccttctcctgtgcaatgctcatgtagttggttatacaaatcaaactgtaggacctttcaggtgtctctattaaaagtcttgttaccggttgggcgcagtggctcacatctgtaatcccagcactttgggagtcggaggcaagaggatcacttgaggccaggagttcaagaccagctgggcaatacagcaaaatcccgtctctacaaaaatagattttaaaaatactagccgagtgtggtagtgtgcgcctgtagtcccagccactcactcagatcaaggctgcagtgaaccatgatcgtgccactgcactccagcctgggcaacagtgagatgctgtttggttaacaacaacaaaaaaagcagtcttgttaataaacttaggccatggctctggcctaaagtaggaagtacatatgcatacacatgttgctttcaatctaaattatctcattcaaaattcacatctctgtgaagtagatatcatcttgagtgtttattttagattaggaagtcaagtcctccagggggtaatttgcccaaggtcatatggttagagaaatcaaaaccagagaggtgaactgagttgctgcatatattttgatgagctttactttgtttttttctttttgttttttggagatagagtctccctctgtcgcccaagctggagtgtagtggcgcgtctcggctcactgcaacctccatttcccaggttcaagcgattcttctgcctcagcctcctgagtagccgggattacaggcacctgccatcatgcccagctaattttttgtattttggtagagatggggtttcaccatgttggccagactggtcttgaactcctgacctcaggtgatctgcctgccttggcctcccaaagtgttgggattacagacgtgagccaccgcacccagctaactttgaaaattctgaaagcagtactttctaataatatggtcctgcgcaacagtggctgaatcacagttaaaaaaaacaattttaagttggtgtgcagtggttaaatcctccagtttcaacgagtctctactgagcacctccttcactgtgtgcttttcaggcaccgtacgagggcactggaggccaagtatgcataaggcaacgctgaatagatgagtaatgtatagacaaaattcaacaaattacaatgcagtgtggtaaatgcgacaacatttaacacaaattcacacttactaataatttgttttacactttcatgagacaatgtaattattatccagcctcatatctaggaggagggatctcttatatataaccataattcagttgagaaaaataagccccattcaggtctacacaattagaaatttccattcagatgccagtgttagcagccttgggccatggcttaactggacagcttccgggggcgaaggactgggtttcctgcccttcagccacctcttggccacacaatggtgcctttcttcctctctgcttctgattctaacaggaaaacctcctcctttctcactgaaccttaatgtgtatccttaatgtttgctgtggttggcttggtaagctaaaagagggttcagaaccagaaaagaaaccattcccttcctgaccactttttacaatctgtatctcacccccaacatatgcaaacatacaacacacacacactcacacccaaacaccaatcaccctcctctgctttggttttctacttaacatacaacatattttaaaatttatcttgtcccccataagaatgtgagctccattagggcaaggctgttgcctacttcctttaatgctgtacccccagtggctagaatggtgtgttgggaacacagaggatgcataataaatatctgaatttaaaaaataataataataagttgagacaatatagagttttctgaacttggctgtgctccaggaggcatggagatggatttcaagcccttctctttattttgcattagccccctcctcctttctgagaggaacccaaaatactgtaagttaaccagtttcactgcactaacctgttcctaagaaaagctcagtcattcctttccaccaattgagcagcactgccaaaaagattagctttccccccaaaatgttctgttactctcattcctcataaagcttttaaaaacatgttccatactataatgcacaagtttattcaaaatcttgtgcaataatatttgtagtagaaaaacactagggaaaaaagcctaaatgaccatccaaaggagactggttgaatacatttttatactcactcccatggatgagtaccatgagaccataaaaaagaatgagaaaacatttgttatagtccaaaactagaaagaactcagaagagattaaatatttgtagcctattccgattttggaatactatacagcaacaggaataaataaactagaactgcatgcacccacgtgaatgaatctctcacactttatgtgacacaaagaagccagacacaaaagaacacatgtggtatgattccatgtagataaaatacaaaaacaggcacagctaatctacaacataaaagtcaggagaatggctaccctggagtgcaggagagttgaaggtggcttctggtcatcttatttcttaacctggatgctggttattcagatatattcattttctaaacattcaccaagctttttgcttacatgtacacattttaatgttatatgtcaacaaaatttaccttccccaaaaataaggtgagcaaaacccatgaattgacttccaagacatattatgctacttaataaagggaaattgatatgcactcacatatttttacaaaaaaaaaaacataggaagagtaaaccagaaactaataaaaatgaaggggtaggactgaggcctgagtacaccttttatattttggacatttacgtattaaaaaaattatctagctgggcatggtggcacacacctatggtcccagctgcttgggaggctgaagtaggaggctggcttgagcccaggagtttaagtccagccagagcaacatagtgagaattcatctcaagaaaaaaaaaaaaaaaatatatacatatatatatatatatatatatatatatatgaaaaatgggcaaaccctaaaactaaatacaaacacaaacaaataattctaataatacattgtactgaaaacacaaccaacggaaaagtactccgatacattctttgagagatatactgtaaggacaaaaagaaccgtaaagaatctggaactctgtttagcaggtctgttgattacagtcatatttgggtcataatcatgacatggaaatcaatggatgctaaaaccctcaggtgaaagggttgttgaagaggatagtcaaaacacatattcaatgcaccaccccacaaattacatgttgatcacaactgacatttgtaattttgctgcataagaggaagatctagcaggtcatccctttaccaaatgtctcaactcagcaaccccaatattagaacaacctacagttccaggctcctaatgcaatgtaagatatttacttcctatataatattcttgctaatctactgaagagaaaacaagaagataaatctagaatatcccttaagagttgggatctcactctgtcacccaggttggagtgcagtggcatgaacatggctcactgaagcctccaactcctgggctcaagtgatcctcccaactcagcctcaggaggagctgggaccacagcggaatgcccccacacacagagctaacatttatatttttttagagatgaggtctccaaatacacacacacacacacacacacacacacacacacacacacacacacacactttagattcttcaggctgaaagaacataggatattctacaaaataactgatctggaccaaaaaaaagcaggggctattctagattagagacataactaaacgcaatacatgaactttgactaaattctgaatagaaaaatcagagtgctaaaatagatatttttgagacaagtgagaaaaattaaacatggaatgtatatcagatattactaaatgttaagcttaagtgtaatcatagtgctgtgattatgcataatgcgcttattctcaggagatgtatattgaagtatttagaggtttcgcatcatgatgtctacaactttactttcaaatgcttctgaaaaaaatgtgtgcatatgcacatatgcatgtatgagcttatgtatgcatataaaaagttaaagcaaatgtgacaaaatgctaccaactggtgaactcaggtgtagagcatatatttattgtactattttctcaatgtctctacagatttgcaatttttttccaaaagaaaaataaaaggttgttaattaatgtgttgcaactgccaggttaagtggcttactgttctgctggacttcaagctttctccaaaaggggaaaagtaaagtggccacttactctccaggagtggccaagttcccaactttatttaatgaagaaacagagctgggcacagtggctcatgcctgtaatcccagcagtttgggaggcctaagcaggaggatcacttgaggctaggagtttgagaacagcctgggctgttcctagtgaggctctgtctctacaaaaaaatttaaaaatcagctgggcatgatggcgtactcccaagctacttgggaggccaaggtagaagaatccttcgagctcaggagtttgagctgcagtgagttatgatcatgtcactgcactccagcctgggtaacacagcaagaccctgtctctcaaaaagggggggtgggggggtagtagtaataataataataataataataataataataataataataatgaagaaacatcaagtcctaaggactttttacacttctataaaacaccagctacaaagagatgatgaattcttttataaatgttacaaactgtaattcagacatacattcattcaacactcattatatacataagatgttccaggactgccctatactctaaagataaagagatacaagtaagacacagtccctgccatcaccttgcaatggaagaatagtcacgtttgttcaggggtacaggagagtggctactagatcatattgggagcaggggccaggaaaatactctcagaagaggtaattctagagtatggtcctgaaagaagagcactgaagcaggagagggagcagcataaatgaaaacaaagagccatccagggggaaatacatctgaggaatcaaagaagtttcatatggctggagcgaaggttgcatatggcaagaacatgagacgggaggctagaaaaatggggggagcaagagcgaaagggcttcacgcactatacttggggtctgaacttgattctgaaagccacgacattgcagaaacggtccaggattggatttccagtgggccaatgagtaggtatcaatcggaacaagtaaatttaccctactcaaaattcctggctccagattaaggactgaactttttagtatccacatctaaattcttagatgaactaaataagattctgtgtgtagaatcccccaggtgattaataaaagttgggagcctgaatcttagcaaagactgtactttctacatggagcaatgcagaggaacaccacatctccatggcatgtagagtggagggaaaatgtcaagatataaagctagacacaactgaccagagccagaaagaatgacactcagcaaaggtgctgcttggtgctcaggggggtctgttagactgggttttctttctctgaatttactcacatcatcatcccactataaaatgtgggatttataacagagtcaaataaattccagaaaaacactggagccaatctatggatcacaggttctacctctttagcatgtccatgcttttggcataaagaacagggaaaagggaagagaatctaaagagaagagaagcagaaaatgaataaatagaacaggaggctccctctcacgctcatgcttgctagtgctctctccttcccccatatacaaaatacacagataagacacaataaaaattaaggaaaaacaaaatgtgccaaaggaatgttgaagtttgatttctgccatgctagagtatctgcaaaacctgcattatctttttagaccaatattttgtggaaaaagcacaacctgaaaaataattcaaccttacccccaaacaagcagatgatcagtgttcactgctctgcacaacaggtaaagaaagaatctgcttattctgcttataaagagatggattcctatacaactaataatgcatttattgagtccttatgtgccagcacctttccaaatgcctgtgttttatctcatttcatcctcacaataactgagaggcaggttgttaccatcaatttagagatgaaaaaaactcaggtctgaatacgcaatctgaccatgtggagccaagatttcacagcaggctttgtctccagagtccagatttttaacaaacatgctctactgcctctcagatgctcaatcccctgaatccacagctactatgctgcccacactttgtttgattccttttacttggatctttttgaagtgtttttttttttttggcttgtgttgttgttgttttttttgagacggactctcgctgtcacccaggctggagtgcagtggcgcgatctcagctcactgcaggctgcgccccccaggggttcacgccattctcctgcctcagcctcccgagtagctgggactacaggtgcctgccacctcgcccggctaattttttttgtatttttagtagagacggggtttcactgtgtcagccaggatggtctcgatctcctgaccttgtgatccacccgccttggcctcccaaagtgctgggattacaggtgtgagccaccgcgcccggcctgttgttgtttttgacaggatcttgctctgtcactcaggctggagtgcagtggcacgatcatggctcactgcagtcttaacctccctggctcaagcagtcctcacactttggcctcccaaagtgctgggattataggtgtgagccaccccgcatggccaatattacctggatctttactgtcaacatgtcatatatttcaggcttccaatattccacttcaggagtgggtgccaatactcacgctataatgcatcccccaaattttataagtttgaagctctaatgtgaatcatgaatttttccattttaaatctgcttaaaatgctggatactcatactatgcattacatacattaacatacatttaagagagaaaatacagcttttttaagatacaaggaatttttggcagcaaaatttacacccattgtcttatctatttaaatattttggagcaaccgtgtgacaattttcatacaaaaagtgtttaaagagaactgggaggaggggggacacatacacacattaacaaagtaaataatacaaaaaaatattttgggggaaaaattgatttgaggaaacttttgctttcctaatccttctcatttgaggcagaaaaatcacaaagtcattcgtaggtttcatttttcaccctaattactattcctagctattaaaaaaatccaagtggtaaaaattaacagctatgaagtaccctataaacatttccactgacctattagtctaccatctgttaaattattaaactgtacataagattagacatgaaaatgctgtctaaacagatactagatggctgggtagcctatggtaagtactttactgatctaagcttcagctttgcttcccccaaaattcttaatagcatgaccagttatcaaccctcagaagtaccaatatccacatgcacagccacataacctcagtataagcttgggtgggagaaaactgtaaattaccttgctggttccattgaaactgaacacgtacacttatcaaaacaaccctgcggagaatgggtgggggtggggggggcgtcagggtatgacggatgttgctgatgggaatgtgctagaggcacaagaccagcactgccacactcctctgtggaactgaaaccagaacaaaggctctgctcccctcacctccgcaccccctcgtcctaatctctgtccgtcaccgcccccactccaccgaccaatccctgtccctgaattgccttgtggttccagcctcccacccccactgacacctcctctgtatgaacgtgcttttgtgacacccgctcatactaagctttttttttagacagtgtctcgtcctgtcacccaggctggattgcagtggcacaaacacagctcactgcaacctcaacttccttggctcaagcaatcctcctgcctcagcctcctgtgtagctgggaccacaggcgtacaccaccacatctggtgaatttttttatttttgtagaggtagaatctcactttgttgcccaggctggtctcaaactcctgggctcaagcaatcctcctgcctcagcctcccaaactgctgggattacatgtgagagccatcatgcccagccaatactaagctttaatgtccctttcctagcttttcctggtatcatcccacccccaagattagaactgcctacacctatctttgggctctttctcaactgatacaccaacttctatccatgacctctacaaatttgagcatgtctctctcttccaatagactgtaagctccttaagagtacagacagtcttattcttttcttcatcaacttctgataaatagtaggcatttagctatttattaaagaattacataggctgggcgtggttgctcacacctgtaatcccagcactttgggaggctgaggcaggtggatcacctgaggtcaggagttcgcaaccaacctgaccaacatggagaaacaccgtctctactaaaaatacaaaatcagccgagcatggtggtgcatgcctgtaatcccagttactcgggaggctgagaaaggagaatcacttgaacctgggaggcggatgttgcagtgagctaagatcgcgccattgcactccagcctgggcaacaagagcgaaactccacctcaaaaaaaaaaaaaaaaagaattatagcttggcacacagatgctgtgatagccggaggagttgccttgcttttttaaggtagaagtatactggtttttctgcaaccacaaaaaaaaaggctataagccagaaaaggtcatagtgaaactgatacttcaccaactgtgctggtgttcgtgcagactggtataaaccctttgggaaaactatttgcaaattcaacaatagccataaaaatgctcataccttctgagctagcaaagtatcctaaatatgaggctattctatgcacaaagtttttacttacattatttctaaaagcaaaatcttgggaaacaactcaaaatcaacaaccagcagctctcagtgctgctctgcctgtggagtagccagtttcttttcttctctaataaacttgctttcacttactaaaacaacagcacataaactgtgacacaaaacttgacggaatcttacacatctttaaaagtgaaaactatgcaaccttatcaccatacaccttatgtataatatttagcatagactatcacatttttaacaacatgaaaaaagttctgctatatcttgacaactattgctaaggaataagaacatgtatcaggctaaaacagacttgaggcaaatttaccaacctgctttgctgttagggagtaacagtgatgtgagatgaccttttttccttctgttttaccaatgttctttacaacagtaatgatttatttttttgagacagggtcttactatgttgcccaggctggtctcaaattcctgagctcaagagatcttcatgccttagctcccaagcagctgggactacaggcatgcatcatggtgtctgactgagtgagggtttaaaagaatgcaattctatagcaaaaagttgaatttcttcaacactgaactgctatctgcctacaactaagtttcttctaaccctttgcaaacatgtaacgtaaaattttaagttgacactacaaactgcttgtctaaatgagtcaaaagactgatacctgttctaccaaagcctcaccaacattcagaggctttggtggaacaggtatcccacaccttgttgatggaaacaaattgatataacctctagagaggttggcaatacagatcaaagtgaaatgttcatactctaacccagtagttcctactttcaggtattcatcctaaagaaataattggataaataacaaatgtgttcaatactgtttatctcagtgctacttataaaagcaaaactccaacctatctatgcaccaaaagggtctggaaaaaaaattatggcaaaatcagaccatgactaactcagctatcactgaaataatgattattgttttagaagtactcactatttaaaaatcataccgtgcaggccaggcacggtggctcatgcctataatcccagcactttgggaggccaaggtgggcggatcacctgaggtcaggagttcaagatcagcctggtcaacatggcgaaaccccatctctacaaaaaatacaaaaattaaccgggtgtggtggtgcatgcctgtaaccccagctactcaggaggctgaggtggatcacttgaacttgggaagcagaggttgtggtgagttgaaatcatgccactacactccagcctgagtgacagagtgagactctgtctcaaaaaataataattttctgagattatgtctgcatttgtgctaaataatttacgctaggagcagtaataaaagcagagatgaagctattgattcaagacggtatatacattgtatatatactacatacagtatatcacatttgtgttaaagacacaaaggaaaatataagcctagaacagttttagaaatcacttatcaagatgttcagtgttttttatctctgtgtggcagaattacaggtcatctgggttgtcttttctttgttacaatgcaacatttccatgaacatcagaaccctgtaagataaggaggttctctgttccactagtgaaaaactgcagtaaccaaatctgtttaaatcaactgacccaaaatttcaaagtttccaaagttactgagaaccccttttcacacagcatctactttatgagcaccctttaggaatgctgcctttgggcagggtctttttcttttcatttttttttaaaacaataatcaataaatttttgtatggggtcgggggaagcacaaaaacacaaccttctgccttagtaagagattcctcccctcttcattgctccagaccctaataattcccctaatctcaaactgttattctacccccaaattatcctaccccaaatgattcataatgatcctaaagctcttggtgcttctagctttaacttcatcaagcaagtttcctctatctagcctaccatccaaacatattcttccacatactgttctttggtctccctcctgattctcttttggaaagattattcttcatgtcctatggggataatatattttaatcacattattgttagcctggaagcttgtaacagactaatgggttatctactcgttgggaatttaagtgcttccaagaaggcagcattccaactggtattaacacccaaactgtcaaacataggaaatcagagccatgctttccataaaaaggcaaaagatgccagagaaagcacttgaaaatttctagcttctaaggcacacacacttagcaaaacaaagtctttccttaacaccttgtgggtaatgaaacccttcctctcctccagatggcttgtcttttgcatatatcaacttgtagtcctagaaacgggttctctgggccatgcagaatgctggattatttttctgtcatctattatgacagacagactctgtcacttgatcagacataaacttttctttctttagctaagtaatgttcacattttaaagcaattcaagacccaagtccacagaaacagaagggccaacctactctacaaaggcacgttggaagagcatgattgatggaaacttgtaaggagtcaggcaaggtggctcacacctataatccaagccctttgagaagccaaggtgggtggcttggcctcgacctccgcaaaggcttggatttaaaaaagaaaacaaaccagaaaaaaaacaaacaaaaaacaaatcttgtaaggctacactttggaaagaaaatcaaaaacaaattcttcccacagatcacataactgcaaagggggaaacgtgcatttacaatggagagatcagataggtaccacttaaccaagtgcccaaactgggttatcaccaactagaacaaactaagattaccttctgagtattcttgccaaaaacttttaatttaaatcgaatcaagctcttagacttatcttctggtttacaaaaatacagtggattggccaggcgcagtggctcacacctgtaatcccagcactttgggaagccgaggcaggcggatcacaaggtcaggagttcgagaccagcctggccaacatggtgaaaccccatctctactaaaaatacaaaaattagctgggcgtggtggtggatgcctgtaatcccagctactcaggaggctgagacaggagaatcgcttgaacccaggaggcagagattgcagcaagccgagatcgtgccactgcaccccagcctgggtgacaaagagagactccaactcaaaaaaaaaacaaccagaaaactagggaacacatcaaagtgacactaggcaattccagaatgtaggacatgcaataatactggcctgaactctttctcaaagagttactacaatgagcagtggatggggtgagaaagctactaaagactaacagacataaccaaatgtaatatgttattttggggatgggggcagctacaaataacattctgagcaccactggatgaggactggatattagaaagtattatgatcacttctcggccttctggctaagatcaagtattgaaaagattatgaaagtactgttaattttcttagatgcaataatagtactttgattaaacaggagaatgtcattttttaaagagatgtgtgctgaagtatttaaaggttaactgcctggataattatcaacaatttaacgtggctcagtggagaaagcagagccacagttcaaacaaaaaaagcaaaatagtggtaactgttgactccagatggaagataatgcttttattgtgttattcttgcaacttttctgtaagtttgaattttttcataataaaaagttctgggggccaggcatggtggttcacgcctgtaatcccaccactttgggaggccgaggtgggcggatcacgaggtcaggagatttagaccatcctggctaacacagtgaaatcccatctctattaaaaatacaaaaaaaaaaaaaaaaaaaaaaaaattagccaggtgtggtggcaggtgcctgtagtcccagctactcgggaggctgaggcagagcttgcagtgagccgagactgtgtcactgcactccagcctgggcgacagagcaagactccatctcaaaaaaaaaaaaaaaaaagatgtgggaaaagtttggtttgggatgtatctagattgccaactaaacctaaatcaaagtatactaatattaaaaatcctgtaaatgggccaggaattgttacagagggaataaagaccctagcaatgttcacataagaagttaaagcactgcggggtttttctatgcccgtaaagtattctttagtctttggaatcaagaactgcatttagggtcgggtgtggtggctcatgcctgtaatcccaacactttggaattacaaaatcccaggaattagtaactttttttagtgagtctgcaaatgttactgaataagccagccgcaggactgctcatggaaggggaagggaggcacaggagaccgaggtgggaggatcacttgagcccagtagttacagagaccagaccagcctgggaaacatagcgagaccccatccctattaaaaaaaaaaaagaagaagaagaagaaaaagaattgcatttagtctttacctataacgtcctataatgtcataggtgaactaaaagaaatgataaatatatcctcctgttgtctctcaatggctttccaccactttcaaggtccaaattcctcatgcttagtatgactcagaaaagtccataaaacctggctcctgcctctggaatttcagttcttgccactcccaactctacccacaatggacagttctctggaacctgctaagatctcagacaatgctgctcctactggctaggtgcaaagacacaaaaactaagatttcaaaagcaaaaaatcccgggaaaaataatctatcacaacaaaagcatgagctcaggaagaaaagggagtggaggggataagagcaggggagggggaccaaacccaactttgcctcccttccccttccacgagcagcctggtggctggcttgttccgtgtgttcagtaacatttgcaaggaccaaaaaaatcactaattcctaagattgctgttactctcaaacaaaagtcaattcccaagcccacacaccccacagtcaagctgagagttaaaactcagaaaactcaaaggccttaggatactgaccctatgctggcaaccacatagctcagaaatgcaacaaatattaaattatggtgtcctgtaatggatttacactttacttttaaatattaacaagacggccacagggagtaagtttatcaagggataagaatcctaacagtacctcctagttcactcagaggccaattaacatttcccaccacgcccaacaacaaggctcctgggggtgttcaaagttgcttatgaccctgtggagctatcagcaggtacctctgccccagaacctattatgagcaatgcactaggggctcggtgcacaaggaaacacctgaactacaactacccaagcaaatatcatatctttgtaggttgtcgggtttcttcagctgtctgaagatacaaaacctcatgtgactgtttgatttttagtctcttctcaccttggtcttcctttctcacagttatttttaaaatcagcaactggctaatatttgaaaactgtcagtagccaactgtccgtttcacaattagatcactgttcaaaaggagcagaattttcaactctagactttagttcaacaagctagcaaatcattacaggaatgagtgacttcatctttacagctgggtcgctgcactatgaggctacactaaaatatacctaattgttgaattccaacatgtctgtaggccctccccgcatcttcaaggttagagtttttattattgcatcctcccccaacccaacccccccagacaaagcttggcattttcggaatccctactcataaagtgactcagtccaccgatgggccaactgacaaatccttaagggattaagatattaccaggtaaaaagtgacttttaaaaatgtacataatacatatatatgtagagagagagagtgtgtgtgtgtgtgttacaggaaagctattaactatactatgaataaaacaaaatttcactgaaaataaaagtgatcaggtagcactgactacaaccttctaaattccccctaaatgaatccacagaaagactttcttgaagggtcttttgctaatttgcggttagaacacaacacactcaagaaaatgatgctcacagcaggacactaatactaagtaatttctgagattatgtctgcatttgtgctaaataatttatgctaggagcagaaataaaagcagagatgaagttaagctattgattgaagactgtgctaaccccattaaaaataaagagaggtatgaatgtgtgccttcacaactcagctcaggatatacttgccaactgagctcttccttccgtaagaaggcccattgctcttggctactgcgcaggggctatgaaggccccatggttctaggactagagcagatgcgtacaaactccctaaagtcacaggaaggaaggggaggcacaactggagagaagttggtgaactgcctctctggcccataggggcatgagggcggggggcacagaataaaaccataaagcaataattttcactatttaaaagaacaagtctaaatggcacacatcctctgtgtctaagatgactagcactgctgttttttgatgagtcatcaagggcagtcatgctgaaaagcagggatacttctgtattccacctatgtaatcattccaaaattatgggattggaacattacaatacctatgatgtatgtccttatatttgtatgtgtttgtgtgcttacccttaagtggtgttttttgttttgttttgtttttgctgacttctttgttctagggggtatttctgcagccttctcagaaaaacctcagggtattagagaaggtacaacttgctaatggcatctggtgagcatgggctggaaggggaaccaccgggaaacacagttgtcaataaccacacccgctatggtgcaaacatgacccacatacaaactgaagtacaagtacaacccctcccaaaagtctagccctaagataatagcacagaaactaagcctaacaaggtgcttggaacctcttcctacctgcaccaaccaccctctgcacaccatccccagcaagaccccctgcctccaactcccctaaagcagcatttccaggatagcactattctttaatccactgacaactttggcactggctaaggcttactatttttatcccctttcacaccattctctgagcagaaatgctaggtgcaaacatttgttggtaattatgttaaagtaagtcttcttaagaacaaatggtaaaatgaatacatgaaaactttgcaatctatttttgaagaattgtctgcaaaaagagtggaaattgagtttttcttacgcagctgaaaggataaaacaaaaattacatataatcagaacacaatataaaataaggatcgtactcccccaaaattacatctgtatttggctgtgagaggtgaaatatctttgattgattgattgattgattgatttttgggatggagtctcactctaacgccctggctggagtgcaatggtgcaatctcggctcactgccatctccgcctcccaagttgaagcaattctcctgcctcagcctcctgagtagctgggattacaggcatgtgccaccatgcccagctaatttttgtattttttagtagagacaggagtttcaccatgttggtcaggctggtctcgaacccctgacctcaggtgatctgcccgcctcagcctccccaagtgctggaattataggcgtgagtcatcacgcccagcctgaaatatcttttaaatcttgttagcatgtgctctgaaagatatgttccaccttaggacaaacagcaaacaaactttatttcttcagaacacagcaaatggcagggtagagaatcaaatgacactggaagtggggccttgatctcacccctcctgatatggcaagcacacagggcctagagtcctgggctaaactaaaagatgaaggtcaacttggttactaatttcgcagagcaagtccaaggcaatcaaaatagaaaagcaaaaccaaccctggaactcacaaaggactggacacatgtcatggaattatttatagtctaggacaggtgaacaataatttggctggacaagaatgcaggcccttttctgagttcactctcactgttccaagaatgaagatgtcttgctattctagctgcaagacaggcaccagccatgagtccctacgtggtggtgtgcatgctgcctctgaaggacaagcctcataattatctggccaagatatcttgaaagaagcctactaatgcataaaatacataatcactgagccctggaagccatccaggtaccctcgggcctttgggagttggacagacatgtagcaaggacacattctctcaaacttcctcctaacacaagccttaatcaatattaagggttaaaaggtttcatttaacttcgataaagtaggtattagtactctcatagaaaaacaagctgagactcaatcactgctttcatttggcttaacagctcactactaggcttgctactaagaccttgaagatccttggcttccatatccacttcaatataaacattgttagtgctgttactggtaatgggggctggggggaatccccagggttcctggagcacaaagcaaagttccctccattctcctaattacattaatttaatcccttgcccactacatgattacattaaaaggggctgggggtggggagggtaacataaagccaagacccaaagttaaccacaatacaaaaggagagaagaatggatactatgatcttccttttaaactttcattatagctgactgcagaactgctgggatgactcaatagattatgggaaatggcctaaaagtctactggaaaccagactgaactgtggccacatcttaaaaataacctcttgcctctaattttcttctcccccaatttttttgactaaaaagggttttttgctgtttcgttgttgttgtttcgcaatcaccagtcctaaaatgaagctaaaaatttattttcattttatccttggtcattctctagcaccacaatcaagaacattaatgagtctttcctacaataccgaaagttagttaaacaaataccttgtttcccagcactttgggaggccgagacaggcggatcatgaggtcagaagttcgagaccagcctggctaacagggtgaaaccccgtctctactaaaaaaaaaaaaatacaaaaaattagccaggcgtggtggcatgcacctgtagtcccagctactcaggaggctgaggcaggagaatcacttgaacccaggaggcggaggttgcagtgagccgagatcccaccactgcactccaacctgggcaacaaagtgagactacatcttcaaaaaaaacaaaaacaaaaaacaaaaaccttgtttcacacatcagctgaactttcagtggacctgactactgaaccccaaaggacagccaggttttcctttaacacatattgctgccataaaaactgctgttatcaggcaaagaatgaataggttatttaggaaatatggcaaatatttaataactgatttttttcagtatacctgccttgaagcaacagggaaatattacaggacttggcccctaagctcagcaatttgtcaaatgagtaagtggtaaaatcacgctctccaagatacctctcactaaatacatttatcacattccagaagaagaaaactattttgacttgattgctacctttaaactgtccctttttcaggttttctatctatttcaaatgagacaagcttatcctttgattaaaatgccatataataaaatccatcaaatcatattagccagagggtcaacaatccagctattcaatagcattatcattattttactagtagcacaaataagagggctgcatgggctgaagagccatttcaacaagctcttggagtgttctggacacagagaccatgagtgttttggaacataaggctgagctatggagacccttctgcagcaaagaattcctgtcagaaataagactcgatattagaggttgttttaaaaaataataataataaaagcactgatgtgcatcctaggatgtttagcaaaattaaaacttaaaaaatttaaacttaaaaagcagtgaaacatgctgtaacatagatgaaccttgaaaacatgctaagtgaactatgccagaacacaaaagtacaaatattatatgattccatttatctgaggtacccagaataggtaaattcacagacacggaaagtagaatggtgattattagaagttgcggagaaggggactaataataggtggactaataatagaggttgagaaggggactaatttttaataggtgcagagtttctgtttggaatgaagaaatcaagttctggaaacgaatagtagtaatggttgcgtaatattgagaatgtacttaacgccactaaattgtatacttcaaatgatttaaatggtacttttttttttccgtaaagtgaaagcaagtttattaagaaagtaaagaaataaaagaatggctactccataggcaggacaacctaaaatggcctattttatgttatgtatattttaccatatattttaccacaatttaaaaaaactgtacataaaaactagaattataatttaataagttccagcactttggggaggctgacgtgggagaactacctgaggccaggagtttgagaccagcctgggaaacagagttaaaccttatttctaccaaaaacaattagccaggcgtggtggcatgcatctgttgtcccagctactcaggaggctgaggctggaggtttgtttgagcccatgtgttttaggttatagtgagctatgatcacaccactggactccagcctgcgcaacagagcaagaccccatctctaaaaaaaaaaaaaaaaaaaaaaatagtaagaagaacataggtggtaaataataaacttagccggaaggacactgaggttctgtatttaaaattcacgttaagagtcagagcgctacatgcatccgtaatcagaatcaaagaatccacactcccaaagtgacaaaacagccccaaactaatttctctcattttaatgctgcagatccccaaggcccagaccctggacttctcgatctacactcactcccttggtgatctcatccagtctcatgatttcaaataccacctgtttgctggacactcccaaatccttatattgagccctgacttctgcactgagcaccaggattgtagaccaacagcctccctgccatctccactcagaagcctaacagttacctcaaatttgtccaaaaccagatcactgtccttcccgtccacaaacctgttctaccgcagtcttcccatcctggttaatggtaactctacccttttaccctcattccttgtcagttcattctcaattaggcaaccagtggcattccttacaacagcagtcaaattttctaattcctctatttgaaaacctccaagaaaggctgggcgtggtggctcacgcctgtaatcccagcactttggaaggctgaggtgggtgaagggcttgagctcaagagtttaagaccagtttgggcaacctggcaagaccccgtctctacaaaaaatacaaaaattagtccggcatggtggcttgcgcctgtagtcccaggtccttgggaggctaaagtgggaggagcatttgagcctttgaggttgaggttgtagtgagcttccattgcatcactgcactccagcctggacaaaggagccagaccctgtctcaaaaataaataaataaataaaaaccctccaatgaattctcatctcattcagagtacacatcaaactctggacaatggcttacactaaaccaggagtcagaagctgtggtgggtgaatcctgcccagtgcctgccagtgtgaataaagcactgctggacaccctgtgcccctctgtgcactgcctactactgcttcggcattgcaggcagagttgagttgttgctatggactgcagagtcgaaaacgtttacatctggcccttcgcagagcaagtctgtctacaccagctcttaaatgatttcccttatccctctgacctcatctctctagttctgcacctcactcactctgttccagccacacgggccttctcgctgtcctgtcctgaagatacccatgcaagctctcaccacaggccactgacccaaccactgtcttggcagcgctgcccagacaaccacatggcttgctcgcacacctcctgaatacctcacttcagtgagaccttccctcatcacaatatatttaaaattgcaaaatttcctctctctactccctgcaaagcatccactttcctctgcttctccaaagcactaattacctaaaaggacacacaagtttgcctaccacatagcagcagcccaataaatatttgttaaatgtagttaagagtattattagtgagcctaaggcaaaaattcaagattccaattctaggccggcgcagtggctcacatctgcaatcctaacacttcaggaggttaaggcaggaggatcacttgagcccaggagtttaagatcagcctgggcaacataggaaggccccttctctactgacataaaaaaatattagcccggcatggtggtgtgcacctgtagtcccagccagttgggaggctgaggtgggaagtctgcttgagcccaggagttcaaggctgcagtgaactgtgattgcaccactgcactccagcctggttaacagagtgggagaccctgtttctggggaggaaaaaaaaaaagtgacatagaaggacgacatatgcttatatacaacaaatacaaattctcaactaaaagttaaataataaaagttatcctagaaataaactgttttgatttcacaaataatgttctccttagaagttgcaaactatctgcacataaatgtgctctgtttagtctaacaggtattttctggttttccttttatctttaagctgaataaattgtcaggtaaatggtttaatggttgaaagtattaactctggaggagggctagacaggtttaaatttttttttttttttttttttttttggagatggagtctcactctgttgcccaggctggagtgcaatggtgcaatctcggctcactacaacctccgcctcctgggttcaagcgattctcatgtctcagcctcctgagtagctgagattacaggcacccaccatcatgcccggctaatttttgtatttttgtagagatgtcggttcaccatgttggccagcgtggtcttgaactcctgacctcagatgatctgccaacctcagatgatttgcccacctcggcctcccgaatgctgggattacaggcatgagccactgcgcccggcctagacaggtttaaattctagtcagctgaatgacctttggcaaattattcattctgtgtttcctcatccataaaacggggataataatatccctatctcatttgtattgaatgagttaatattggtaaaacatttaagaataaagactgcagccaggcacggtggctcacgcctgtaatcccagcactttgggaggccgaggtgggtggatcacttgaggtcagaagtttgagaccagcctggccaacatagtaaaaccctgtctctactaaaaatacaaaaattagccaggtgtggtggcacatgcttgtaatctcagctacttggaaggctgaggagggaggatcgcttgaacccaggaggtggaggctgcagtgagctgagatcacaccgctgctttccagcctgggcaacagagcaagattccatctcaaaaaaaaaagagcaaagtaatagtacctacctcactgggtcaggaagagaagcaacacatgcagagctctaagggagtcttgtatatggtgagcgctaatgtgttcattcagaatttactttaatttaaaaaaaaagttggctgggcgcggtggctcatgcctctaatcccagcactttgggaggctgaggcaggcggatcacaaggtcaggagatcgagaccatcctggctaacacagtgaaacccggtctctactaaagacacaaaaaaattagctgagcgtggcagtgtgcgcctgtagtcccagctgctggggaggctgagacagcagaatggtgtgaacccaggaggcagagcttgcagtgagccaaggttgcgccactgcactccagcctgggcgatagagcaagactcctcaagaagaaaaaaaagttggtccctgaactgaaagaggccacatatcaaggacataagcacgcaaaatcagcaagtgccatacagtaagtactgatctacaacagaaagaaatcaaggcatacctgcagacttaaacgacatactgaagagccacgtccttgttcaaataattccattccaattccccagagaacagaggtggcatgcggtaggattagagtttcactcagctaagacagaggtttgagtccctgctcggcttagctgtgtgatcttgagctcgtgaccaaacttcttacagtcttaggagagttagaaataacaaatgtagattccagagtgattgaaacagagtaggccttcaggaagtcacagttattatttgtataagcctttcagtttagagtaattttagaattatagaaaagttgtgaatatagtacacagagtttccatgctgttattttattttcaacaatattgttattctgattgtgaagagaggtaaacaatttctaaattacaccttaaaaatccatgacaacaaagaatactgtcactctaggaaacttctgatttatgcacttaaacacaccactccgcatcaggtgaactgatttcccaagtttgttaagatgtgttacacagtttaaaggcagacatgactaagaggctaacatgtgtatcacagacctaggaacactttctccatgttgccgtctctaaaaggaacttcagcaggtgcagtgggtgcctcctctcaactcataccacaaacccaggggcttcaaaaattactttccctctaccagggcccttcaaaacacagtatttcctaaccaacagaaaacgaaaaactctgtgacccagacagcccagcctttgaaagcagcaggggtagcaactgctgagcctcaaaagtcagcctctgagtagccacccagaatgcaatgggctggcaaacagtaggggagaaaaacgctggatccaagcctggatcccagtgctcaccggacaatcatttgtcccatttcctcaattatctgtttgtctcctatagctgtctatcataaaggcaatgtgaaaatattattttaaattttacagaatagaaattacggactcagaagaggcatatccagacaataggtagaaaagtagaaaaataacagctattgtcctagaaatcaaatacaatacacactaacatttagatctgcttttaagagctttcaaaaacctcacgttattagacatttttggatagttttaaaagtcttgttctttaacagtaagaaaaatgcatcccctgaattgaagctttagagtatttaaagtgaaaagcttgctaagagataaatgtgcaaaaaaaaaaaaaaagtagtatttgagcattgcagagggatttctcctttctcctgagctgctgctgtaacatctcctctgactcagcacctaagaggcatgatgggaagggagtactataaaaaagccatgcattattaacaagacatttggcatcaaagcagaatgatttggaaaaccggaaaatgtccgcagaataagagaaaggggagctaacagcttaaattatttttggtagtgtcatgccattcaaaattgtccattctaatcttctaagctgtctttttctcccttagttttagctctaattctgatctctttatgtctttcctaccttacattccaaatggttactacttacattctgagtggatttctctgtgttggtttgctcctgtcagttttaaagaactgctgtacacgcattagatccaatgaagacagactgcaacagaactgctctgcagaagcccaagagataccacacataggatgttaacacttactactgcctagaaatcaagagtctgtcttcttaaccctagaataagcaaccaagtgacctaagttcccaattcacagatggcaagccaatggttaaaaaaaaaatacatttactcttacaaccatttttaggaccctagaatttaccatcaaattgtcagtaaaaaatgaagctgggccaggtggagtggctcatgcctgtaacctcagcactttgggagaccgaggcaagaggacctcttgaggccaagggttcttgctatgttgcataggcaacatagcaagaccttgtctctgcccaaaaaaaaaaaaaaaaaaaaaaaagccaagtgtggtggtgcacacctacagccccagagacccacaaggctgaggtggaaggatcccttcagcccagaagttcgaggctgcaatgagctataattatgcctctatactccagcctgggtgacacagcgagaccccatctttaccaaagaaaaaaaaaagaatgaagctggcatatagtccaatggtcagagacaatgacttgagtaactcaaaatccaattctgcttttctggcattatatcaaattaggaaaactattcccttcctttaggccagtagttctcaattaggggtgcttttgcttcccaggggacatttggcagtatctgggggcatttttcgttgtcaccactgcgggagaaaggtgctactggcatctcttgggtaaaggccacagaggctgcaaaacatcctacaaggcacaggacagcctcaacaacaaagcagcatgtcaacagtgccaaggttgagaaactctgccttagacaaatcacttaacttctactgacttttaaattaaccactgacactgttagaaagtacagcagtaatgcataaacgttaagtttatatttgctggttcacatttattggattaataaacatgctgggcgcggtggctcatgcctgtaatcccagcactttgagaggctgaggtgggcggatcataaggtcagtagttcgagaccagcctggccaacatggtgaaaccctgtctctactaaaaatacaaaaattagccgggtgtggtggcaggcgcgtgtaatcccagctactcgggaggctgaggcaggagaattgcttgaactcgggaggcggaggttgcagtgagccaagattgcaccactgcactccagcctgggtaacagagcaagactctgtcctgggaaaaaataaaaaataaaataaaataaacagataatttattttcgattccctataaactgaatatttcttccttagtaaatggagcacagactagcatcaccttttctgcaacataagtaacaatgcacatgtgcaagatttgcataaagtagcctctgcttctggctatgactgagagcctgtggcagaccagagatccctcagagaaacaactccaacagccagagaaaattaaaaaaaaaaaaattttttttttcaaagtctgaagactttggagaactgtggaagctactatgacttgaagagacacaatccggaagggtaaaccctttaggagcaagccaatatgccacaactgctttgcccctcagggaatctgccaatgctaggtgccaggaaggaggctgaggaaacagaaaagcagcctgggaacatgaccagagccactattcacaggcagagaaaccagcagagctcatggtaatgtctcaggcctgaagaaagaaaaatagagacaagggcctaggattcctgtgaaaagaactgagtgttttaccctgaagacattttacaaaatcccaaagatgcacaggtcagaaggctgaaaccaagcagaaagcctctgaatagcacagcaggtttcttcaccaatcccatgtactaagaagacaaagattaaagttcaggacacaccgtgggggacaaagattaaagttcaggacacaccatgggggaagggccccagttcttagccagaactcctgcagggtacttccaaagagtagaggcaaaccaaaaagagatggagcctgaccaaaaccacgcccttgctgtggtcagctcagacaagataaatggaatcagcccccattctatttgcctagcaaatggtgtaagccatctagatattagaaaatcatctagggtcgctacaatttttttatatacaatgcccacttttcaataaaaattaacaggcatgccaaaagataggacaaaatgagtgtcaaggccgggtgcagtggctcacgcctgtaatcccaacactttgggaggccaagccaggcagatcacctaaggtcaggagttcgagaccagcctgaccaacgtggagaaaccccatctctactaaaattacaaaattgccaggcttggtggcgcgtgcctgtaatcccagctactcaggaggctgaggcaggagaattgcttaagtccgggaggcagaggtggcagtgagccgagatcgtgccattccacttcagcctgggtaacaagagtgaaactccatctcaaaaaaaaaaaaaaaaaacagggtgtaatattttaatattgggtaagacagagcaaaaaaagagaatgattgatccaaaagctatgccatcagaaaacatctagactgaaagctggaggagaaggaaggagaatagaaaaatacagatttgtattgagtgctagcctgagaaaatgtctcagcaaaacagtgtttaggtatccattggatgatacatgcagaaataaacacagatgtcacctctttgacaattatacaggatttatgttacttgatttccaagtaacaaagacagcaaaataatcagaaaaaaaatatttagactcaatgagaaagataagagagatccttaacatactgaggatgaagaacctgataattcttagctcactctcttatcaatctcaaagttaaaatgatcacgggagtggtgtgattcaatggatccgtttctgccccgtgggaactacaatttcacagatacaaatttgtaacatcttttttgatatctaatcaccgatgtgaaaatttttaacatttttaaaccgttttattatgaaaaatttcaaatatacagcaaagttgaaaggattttacagtgaactcccatatactcaccatcttgattccactattaacttgcttatcacaaatatatccattaatccatcttactttgtgacctatttccaagtaaactgcggagatcagtatacttcctgctaaacacttcaacatgcatgttaattaattagattttttttcccttcttggtgtaaaagttcatgcaatgaataggtgtgcatttgcggagtttgacaaatgcacatacctgtgtaatctaaatccctatcaagatatgaaacattacaatcactcctgaaaggtttcccaagcccctttccagtcaatccctacccttatttccctctctcagaataaatgtttttttgtttgtttggagacggggtctcgctacgttgcccaggctgtcctggaactcctggcctcaggttctgaggagctaggtctctaggcatacatagcacaagtgtttttgttgttgttatttgtttgtttgtttttgagacagtctccctctgtcacccaggctggagtgcagtggcatgatctcagctttctgcaacctctgcctcctggcctcaagcaattctcctgcctcaatctcccaagtagctgggattagaagcacacaccactacacctggctacttcttttgtatttttagtagagacagggtttcgccatgttggtcaggctggtctcgaactcctgacctcaagtgatctacctacttccgcctcccaaagtgcggggattacaggcatgagccatcatgcctggccacaagtgttatttttaacccacggcactttgaacaatcttcaagtctctggtgtgaagagacagtcttagaaaagtaatgtttaaaagggataaatagccaggcatggtggtgcatgcctgtaatcccagctactcgggaggctgaggcaggagaatcacttgaatctgggaggcggaggttgcagtaagccgagattgaaccattgcactccagcctgggcaacaacagtgaaactctaactcaaaaaaaaaaaggggggggtgacaattatattttaattataaaatagtaaatgaaaccatattcctgaagctaaatttaatacttacaaaaagttgcaaaaaagttatatctgttacatctttaaatgcatataagccatttaaatggtatcaatctaacagctaattttcaatgaaatgtttagtctcaaagaaggcataccgattgatatgttcaacacaagtattcttgtttcctaaaattctatttttatgaattcatggagacacaaaatatcctagagaagaatccttaccctgaaattgcaatttatctataatttatattccttgaatacctgggtttcccttctgcatataaccaaatggaatcctttcttggcaagaatggattgctgcctctactgtgaactgtagttacctggctctaactggcagacagataatttaacgtaaattagcagattatgcctgtgctctggtcctagaatattatttaagagatagcagataagagtggtaaatgatcaaccgggtgtttgctgaaacttcctggagggttaagtaatttattattaatttttgagactagctatagatgggaaaaatgagtcattctgattaaaatgacggtgcggggcaatcagccagctttagacactgctcctatatcaagtacatgccaggccaggagcaggggctcacgcctgtaatcccaacactttgggaggcagaggtggaaggactgcttgagcccaggagtttgagaccagcctgggcaacatagtgaggccctgtctctacaaaaaaaattttaaattagccaggcgtgatggtactacgtaactgtagtcccagctactcaggaggttaaggtgggaggatcgcttgatcctgggaggttcaaggctgcagtgagccatgattgccacactgcactccagcctgagtgacagagtctcacaaaacaaacaaaaaaaaacccacacgccaaaacatgttcttctgcagtatatggtagagtccacattttcttacaggactgaaaacctgacagtcactttgcctctagactacagttttaacatttttagttagtatataaatctgtacatataatgtaagctcaattacgtttttgaaaaattacacatactcccctaaaaaaagatccagaagaaaaagcaccaaaatgttaacagtgtgttatctttgggttatgaggttttagattgtctttattttccttatgcttcgctgtatttcccaaattttatacactgaatgtattatttttaaaatccaaaataaagataccggggaaaaaacaaaaccctaggcagtgactgacctgtaatgatcaccaaatgactgattttatcacactgtgattatgaagctacaatgaatgaatgccctttgtcctgatttatccttgctgccacccaaaggtacatataacctgattctcctggcaacaacacaccttggcatcccacttaccccatgtctgtaaagaggcctcagacagtaattcaaccatttaaaaactatgtcccctacaattatgctttctcactatcttcagagtattctcacctactgttttttttttaatgtattcactgtagtgtgccttataaaaacaataggtatgttgagtgtgctgtttctatttatacataagcctttcactcccatccaaaagaaaacatcccagcctgggcaacaaagtgagagcctgtctctacaaaagaaaaaaaaaaaagtagccaggcatggtggcgcgtgcctgtagtcccaactactcaggaggctgaggcaggaggatcacctgagcccaggaagtcaaggctgcagtgagctatgatcgcatcactgcattccagcctgggtgacagagcgagaccctgtctcaaaaaacaaaacaaaacaaaaacaatagaaaatatcttggtatcaccatatcatcatccaatgccaactttatgaaaattcctgatgtaaactggtgaaaatccttggaataacaactagaatgggactcagttgtagtgctggcattgcctaggaggctgagtatatcctttaaacctttccatgattctgttttcccacctgtaagatacaggggtaagcccaataattttgagtatcctttccactgaaaacctgtcacactgcctctagactacatttaacgtttttagttagtatataaaactgtacatataatgtaagttcaattatgtttttgaaaaattacacacaccaaaaaaaattatccaaaatgttgcgattcttcagatcctgttgtatcttacacagtcatgtgccgcataatgacgtttcagtcaacgactagctgcatatccaatggtgatcctctaagattataatactgtatttttactataccttttctgtttagatatatttagctacacatttacttacctacagtattcagtacagtaccatgctgtagagatttgtagcctacgaataataggctataccatacagccaaggggtgtaataggctataccatctaggttggtgtaagtacactccatgatgttgccacaatgacaaaatagcttaacaacgcatttctcaggatgtatccccatacttatgcaacatatgactgtgtttgtgaattcatcctgaaaacacatctgagattataatctcccaatagtcagaatatcaatcacggtagcaataacactgactgcatatgcttgccaccacagggactttgctaagttcttcactatcaggtagaaactaatatcaattccaatgaagaaactgaagttcgaacagaatggtccagtaactggcccaaagtcaccaaaccagtaagttgcagagcggggacaagagctaagaatcattaggctccacagctcattgcagtttctctctccaaggtgcaggctaattctccttgtcctaaacaacacaacacagtatctctaccttgctgtttctaaaggccctaaggtagatgactaatagggaagctctctacatctgatttctaggagtctaggaattctgagtataaacgtcttcactattcatggttacatatcatcaagaaacaagcttactttcgccaccactttttaagacattttccaaaagcctgctggcagcagtgtgcgcttatgctcaggtgactagctaggccccagaagtttagagaacagtgcaaatgaggttaaggtgccaggtggactccagggcaggtatgcagctttgcataaagaacaactctttgcataaggggtagcctcaggggaggttccccaatcccagaaagtgaccttacaaatgcctacccacaaacagttaatgaagggaacaaaggcacaacaaaattaatctctgcacctggaagataactcaaagtgacaggatggacacctcactttcgataattagccacctcattagatttacaaaaaaataacagaagtgagatgacctgatcaactaagctagcagaagtctaagccactcttccttgaaaagcagacagcttatgtaaacgtactttttattaacaccctaattttcacatttatttccagaaagaagttagaaaaagtatgttcctcatacttcaaagtgccctttctgtatagagaggcgatgtgcctagatgggaaaagaatgggtttacctaggcttcacacctacctaccaccgatttgcgcatctatttttcttttcccaactataacttttgaaagttatagttgggaaaactgtaacttcctcttcctaaatcaaaggcaaatcaaagtctgggcacggtggctcacacatgtaaccccagcactctgggagggcgaggtgggaaggtcacttgagcccaggaatttgagaccagcctaagcaacacagggagacctagtccctacaaaaaaattttttaaaaagtagctactggtcctagctacttgggagggtgaggtgggaggatcacttgggcccaggaggtaaaggctgcaatgaggtgtgatcacaccactgcactccagccttggtgacacagcaaggccctgctgagaagggaaagggaaagggaaaaggaaagggaaagggaaagggaaagggaaagggaaagggaaagggaaggcaagtttgctctaacacaactgataacacctgggaacaatatgcgcataacctgaactctgcctttgcatatgcacaatttcatccacgaggaaaacccagaaaactacacccagctggaaagacagacagatacacacacacacacacacacccctgaagcatctaccagctactcagttcaccaagtgggtgccacacacatctgatgttagaactctcaatgccatttcagagaaccctccttctaccacttcacaataactcaagctgcaaccctgctgatgctcacttctatgagcaaaccacagatttagattttcaaagtgccatatttacagtattccttaactgcttaacatgtgaacacctgcactgttttcattaggttctttttttttttttttggtgatgagtaactaatgcagtttttgcacacctaactccaatttttcataatctctatggcttttattgaacaatctggcatagtgcagtaattttttttttttttagacagacttttgctcatgttgcccaggctggagtggcacaacacacaaccccctacacaatccccagcccctttcagaatgtcttccacggaactggtccctggtgccaaaaaggttggagaccactgctttatatggattaactcattaaccacagggtgaagtgaacctatcatgacagtctgttgtggtttatttttttttttttttgaggtggagtcttgctctgtcgccaagctggagcgcaatggcgcaatctcggctcactgtaacctccacctcccgggttcaagcgattctcctgcctcagcctcccgagtagctgggattacaagcatatgccaccatgcccggctaattttgtatttttagtagagatggggtttcaccacattggccaggctggtcttgaactcccgacctcaggtgtttggcctcccaaagtgctaggattacaggtgtgagccaccgggcccggccagtgtggtcactgttagaaatgcttatgccatgttatagcagaactatttaatataatcacctttgtagaaaagaataaactgcatgacattaatgatattcccattctgtacatacagatacctttctaaagggtgggggtgggaaaagaaaacaacacattgagtttcaatctaatcatttccaacaactcagaagcaaagaaatatgctgagttttcattatgtctaatgcttccatgtgggatcttccaaagggctaagaaagcctggctcagcctagagaatgccacacaaattaactacagatttaactcctttaccgatgcaaaaggcacgctgtgtcacacagctgtgtatgaagaaacaatggaaataatcgcagtaaatgtatatagttaatgtgaccagggtagcccaactctttggtcctgctcaattgatttgacctatgtcataacagactctcaatcattcaaagtttactcactcttgacaaactagagaaaaaataacaatctagagaaaaataattactaagtccaaacaggtttctgagaagagctttattctactttgtggaatccaatcaaagaaagaaaaaaactaattagacatactgttgtaacatttaatgagatttgaaattcatctatttaaatttattaatagtaaaggaatgagattaaatagacttgacatcgaaggggctagaatttcccatgaagttttccacattatcggtaaagacagcaggtatgttttctttacagctttcaagaatcccttgccagaaataatcttatattaagacaggatgtttcgttatagtggggaaaacagaactggccaggaaaagatcttatagcaaagagattgtaaaagattattctagcacaaatacagatttaaattgctgccatcctttttctcccagcccagcaattcctgaggtgcaaaattttcaaatatctgtgtatacaatgacaaggacacaagtgaaaacacttgtgatgaaagggttatgaataaattactgcaatttccttttatcaaccaagttgatttaatggtttaaaaatattgttcaacagaacaaaggtggtaacatttgttagatcctaattaaacgtgattcattctggaatgtttctgatgacacagcttacataaataatctactgggaagtctactcaaaattcacaatgaagagtcggtttttcacacatataatacaacctgaaactatagcttcaatctatgcagatggttttactattttaattatacaactaattaataccaaaattagatcgatgttgtttaatttgtggctactgaggaatgttactattcacaaatcacaaaatctgtgccaaaataagtcttcaaagggatattgttgcctccttacccttctaagctttgcagtgggctttggtcaaagctgacataaacagctaaagaaattaacaacagagtctcagaagacaaggccaggggagccaaaaggacacaggtgctacacacccaggcagttgttgtctgctcccagagcacctgacttcagcagccacagcacctgctcctcaagcgcagcggcgcctttgagggagcacagcctggaaggtttacccttcgcagagacgcttgctcttggacttctggctgtacattctgagggttcaaatgaaggatgggacaatgggaaagcttaaatcctctggaaacgtcactgtgatcaatggcttcaaccctcctctacctcataccagttcactggagctgctaacactaagtttccttctttatccgcccatctctattccagtggagccccgtgattaagggatggcagaggaaggggacatgtccttttttttttttttttaacagaaaaacactcatttagatacctggtttagtaagacatctgaacaacatgaaacccaactatgtaaaagctttaaaaatccaggttatgaattagcctaaacctgtgcttatgttccattctgtttagaggaagggggatggaatccctttcacctttatatttttcatgacaagtccatggtcacatcaaaaattacttttgtctttaacacagttgaaattattaaatgttatctagacctaaccaaatcctatttccttaatgttatattcaggacagtgaaaaaaatactgttttcttttagcaaagtctgacttttaaggctcagtttttacctgattaaataaactgcccctgcttttgaggttagaaaaattacttttgttcatggggtccattatactgtactattaagtttacttttatatgtttggaaatttccagccgggcgcggtggctcatgcctataatcccagctactcgagaggcagaggcaggcagattacctgaagtcaggagttcaagaccagcctggccaacatggcgaaaccccatctctagtaaaaactacaaaaattagccgggcatggtggcacgcacctgtaatcccagatactcgggaggctgaggtgggagaattgcttgaacctggaaagtggaggttgcagtgagccgagacggtggcaccacactccggcctgggggacagagcaaaactccatctcaaaaaaataaaaaaagaaaaaagaaaatttccataataaaatgaaactcttaaggaaaaaactgctttgaacataaagccaacccaaaaagtagctcttacctaaagtgaattttccctagtgccaaatgaaattcaaataaatcccaatcttctaattcacacaaatcttaagatttctaatactttaaaccagaatgaaaaagtcaggtatgccaaattaacaatcgaagagaaaattaatcccacaccaaagccaaaacattgaacttcctcccactctcgcattcacacacacacacaagcatgaaccacacaatgaaggattccagttgccccatccagacaactggacgcacatcacacacctcctagtcatccagggaccatcttggcagcctgtttctcatcactacctgccaccctgtgcctgtgttgtggacgaggaaggcacgggtagtagcctagctttttatttttttaaatctcagcaatagaggcaaggttatttctaccttacatccaagagtatggagcacaagactagctgtttattaataacatgcttattttccacaccaaccacacggttttccaatttcacaaagtaaatacttcctcatccctctttagaaaagatgaaacaatttatcgtagcctaagcaaaaaccacctatcaaagcaaagactggcaagcagattcaagacataaaggtatagcttttactataaatttgaaaccaacaagaaagccattaacctaaatatttttctaatcaaaaatcagaaatgacgttaatagcaacatataagaattactgtatctaccacacttagaatgtactggggtagatgacaatgacaatcagtactgattgccttatgtttatcaactttttcatctacatttcaggtttcagtgcaagacaaaccattaatacattcatgactagccatttcaaagcattattgtatacatactgtacgacacaaagtgcttaattgtaacttaaaaggttaaaacccatcttgaatcctaaatgggcaaaaaaaaaaaaaaaaaaaaaaccccactagtcatttgcccacaaaccaggccccatataaccatcaagcatctgactgcatcggacatgattaatctgaaactgtgctatgaatcatacagcagtcctcccttatcttcaagggatacgttctgaaattccccagtgggtgcctgaaactgcaggtagtaccagatctaaatacattgctttttcctatacacacatacctatggtaaagtttaaattataaattaggcacagtaaaagatgaataacaatgtaaaaggaaaataaacttggggaccccaaacccactaagtcaaagagaaaagtcaaggtaggaacggcatcatgcaaacctacctccctcacaatctgcccaataggaaattccttgtggacctcaacatccttaccctacaaccactctgctgaatttcaccctgacaacgtaaattgacagcttatcttcacaggtataggacaaaggacagaacttaaagtcattcctctgcttacctgagacaaatgcataatctcatcacttcctctgcccggtaagtatattttgtcttatgtaaaaatgcagattcactgagctagatgaatgcataagggactattcctccgctgccccccacccttgcccgccacatgtgaatagctgatcaaagactcaaaagaatgtaaccatttgcctcctatctaccacgccttcctaaaatttctccccctttaaatactgaagccctcaaaatcatcttaggagaaaggcacagaccttgggcctgggtgcatgcccttaaccttggtaaaataaacttctaaataaattgagacctgtctcagatactttttggtttgcaacaaatataaaatggttttacaatttggtttacaacaacaacaacaacaataaaatggaacaattataacaataataaaagtaattaagtaaagttaatttttctgagagagtctcactctgttgcccaggctggagtgatcatggctcactgctgcctcaaactcccaggctcatgcgatcccaagtagctggggctacaggcatgtgccaccacacctggctaatttttatttgtatttttgtagaaacaagttttcccccaggttgcctaggctggtctcaaactcctgggcttaagcgatcctccagcctcggcctcccaaaatgctgggattacaggcatgagccaccacacctggccataagattaaaattcaaaagtattacaaataataaaattaaaataagggtcacttgaacacaagcactgtgacaccacgatgatgatgtgataatccagacgactactaaatgtgtatacagcgtgggtatgctggacaaaggaatgactcacatcccaggcaagacaaagggggacagagcaggatggtgaaagatttcatcacgccactcagaatggtgcacaatttaaaatttgtgaaatgtttatttctggaattttccatttaatattttcagaactcagtgaaaccacagaaagtgaaactctggataagggggtgactaccttattcactatcattcctggcaattaaagaatgttaactccaactgaacaccagatgaattggccctcaattaaacacatctgtccagaaatataaaatcacccaaaactaaaaatttactaaagtgaagcatgctccttagaagacttaaaaaataacagtgatacactgtctgctttgttcatcactgtatccttcaagtctagcacactgtaggggtgttacacagagattaatgaatttagctataagaaaatagcaaaatcaggcaaatgcaaagatgagtttgtaattttttctcttttatcacaggcaccagaacataaaagttttctaagtacccacccctgcctttaatcaccatttttatcactcacatttagataaatacatttgcagttcagctgatatcagaaaaaaaaatatgtatcaaattgtcaaattttactaagtcagagctgtgggagtccagcagcttttacacgttagatttttctatttcctcattcgtcagcatttgacatcattttctgatgttataaaggataacagaaaaaaaaaccctgtgcacacatcacgcccctcctagtcatctagggaccatcttggcagcctgtttctcttcaccacctgccaccctgtgcctgtgttgtggacgaggaaggcacggggaaacagaatattctggtgaataaagcattactaattttcaaagaattagaaggcaaaaacaaacaaaaaaaacacccacaataccaaactgaaagtcatgcctcagggtctttattgtaactacttaatactaaacaccaaaacataaatgatgctgattaatggagatttggggctaagaaaataccaaacaggctaggcgtggtggctcatgcctgtaatcccagcactttgggaagccaagacaggtggatcaggtgttcaagaccagcctgaccaaaatggtgaaaccccatctctaccaaaaataaaaaaattagctgggggtggtggcatgcgcctgtaaccccagctactcaggaggcggagacaggagaatcacttgaacctaggaggcagaggttgcagtgagttgagatcatgccattgcactacagcctgggtgacagtaagattccacctcaaaaaacaacaacaaaaaaaggaaataccaaacaaaatgtgcttttccctatcttcgaaatcatcatgtcttttcattcctgtatggcaaaaaataaatcccgtgtcgcctgccgaatccgaatctaaataaatgaataaagacagagaataataaagaaagaaaacagcttcaaacttaaacacgttagagcaagagaaacaaacaaacaaaaaaaaccatgactcctgctttctcaaaaatcacatcagtagcttataaagaccttcatgggcagaaaaagaatgggcacactgtagggagcaaaaggtaagtgataatatttacaaagtagtgtattttaaaagcataaacaaaaaattaggtaaattgggcctcattaaaaacttttttgtgcatcaaaggacactatcagaagtgaaaagacaacccacagaatagaaaatatttgtaaatcatgtatctgataaaggtttaatattattcagaatccgtaaagaactcctaacaggccgggcatggtggctcatgcctgtaatcccagcactctgggaggcgggggtgggaggatggcttcagtccacgagtttgagaccggcctgggcaacatagggcaatcccatctctacaaataatgtaaaaatcagccgggcttgctggcacgcactggtggtctcagctgcttgggaggctgaggtgagagaactacttgagcctgagaggttgaggctgcagtgagccgtgatagtgccactgcactccagcatgggcaacagagcgagagtccatctcaaaaaacaaaaaaaaaccctaaaaaatagtgattactggccaggcgcggtggctcacgcctgtaatgtcagcactttgggaggctgaggcgggcggatcatgaggtcaggagatcaagaccatcctggctgacacgatgaaaccccgtctctactaaaaatacaaaaaaattagccgggcgtggtggtgggtgcctgtagtcccagctactcgacagtctgaggcaggagaatggcacgaacccgggaggcggagcttgcagtgagaccagatggcgccactgcactccagcctgggcgagactccgtctcaaaaaaaaaaaaaaaaaaaagtgattactgcataacattatgaatgtaatttatgccactaaactgtacacttaattacttaaattactaaaatagatacatggcaaatttcatattttaccaccaaaagaagaaaaatgtacaaagtagatttggaaaaaattaattcagtcacttcaaaatcaggattaattaattcctttccccaaagtaaatgcagtccaacgaccaagaggctggtctgcccagacaatagtttcttctttcatttcattaaatatttaagtacatacaacgtgctgggcaccatcctaggcacaaggaaattacaatccagaaaacttccctctcatgactatatagattatgaggatatgggtcaaatgagcttttctaaaaaagttaaagcattaaatgcttttatttaaaacatacagattcagccgggcatggtggctcaagcctgtaatcccagcactttaggagcccaaggcaggtggatcacctgaggtcaggagttcgagaccagcctggctaacacggcaaagccgcatttctactaaaaaaaaaaaaaatagccaggggtcatggtgctcgcctgtaatcccagctactcaggaggctgaggcagcagtatcacacgaacccaggaagcaggggttgcagtgagccctgatcgcaccactgcactccagcctgggcaactgagtgagactccatctcaggaaaaaaaaaaaaatacagattcaaaataactatatcatgaatcctaaagtcagtctactatcatttttggtctatctggtttgacttccttaggttggcaattctgtcatttttctgaacaggaataaaacatttttttcctttttcaattacataagcaagacacaacacagtatttaggaaaacactattttatgaccttcaccagccaagtctaccaatcagcaaatacacacatcctgatcaggaatacaatttaggcttggttcctgaaagtagaacttaaaatgggataatgagcagctctgtgaggaaaaaataaccctgtctctccatcttcccaagcttatgattgttcaacacagtagaattaagaagaaggtttaaatgtcaattatccatacttttaggactacttgggagggggtggaaaaagttacctctttactgatatttaaatatcctacaactttttaataaaaataatatacagttgtgctcactagcataccctggatccactgacatgtaaaaacacaacattgcggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcaagactctgtctcaaaaaaaaaacaaaaaaaaacaaaaaaaaaccacaacattgctgtcttacaacctactctttccggtacccaatactccacaatatttttcatctttataattaggctactaaccacctaagagaactgttcataattgatgacagtaatgaaggtgcctcagaaacaatgaacaggttcgcttctgattgctgcaaagtacctgggtagctccgtcacctgcaaaggcagaggaacaatacccagggtctaataattgcttactcaaactaacaaaaggagaaaaaaaaaagaggaagtagagaaggggcagcactctaaattatttaatgtgattcccatgcttgggaaaacactgaattcatgcaaccagcaggagctggaatgctcctcagtataaaaggcaccatataaaaagaattactgaatccaaatgcaatattcattttcatttaacatccaactacctagaggattgaggtaatgagtctggggctctatttcacacttaaaagctgaagtgtgaagccagaggaaaggactggcttagcagatcaaaatgtaaaaggattagcccacaggacaaaaaaaatggtccaaaaaaaggaaaaaatggtcttaacatcccaaagatatttccaaaaattctttctgattttctttcctttgaccaagacagcacaattttccctcccttccttagtgacaatgatttcaaagacagatttccatgtagagacacgaagtctggagttcccaggctaatgtccgaaagcaatggcactgcacagtggggaccttgccattcaccccaaagactgaaactataaagtctgaagattacacacaagcatgtcaccattctcaccgcagcagtctggggaggagatgaagtcaacgggaaatcagaactttaaaagacagtgtctttacttgacaaaatgattccttctttacttcaaaggttcaattcacacatgctcagaatcatgaaacttcagatctgaaagggaccctagaatctgcacaatagtccagtctcctcagttcacagaaaacaggaaaaaaaattcatacctagttattggtaaagtcagacaggagcccaaacctaatctcagtttaatatgagcatgagaccaagagggcacctcctatggttataaataagaatcataaggccgggtgcagtggctcacacctgtaatcccagcactttggaaggccaaggaggacggatcacctgaggtctggagttagagaccagcctggctaacatggtgaaaccccatctctactaaaaatacaaaaaaaaaaaaaaaaattagctgggcatggttgcaggtgcctgtaatcccagctactcaggagggtgaagcagattgagaatcacttgaacccaggaggcggaggttgcagtgagccaagatcgcaccatagaactccagtctgggcaacaagagagcgaaactccatctcaaaaaaaaaaaaaaaatcataaacataaggacctttgtgtcaagctctgtgctaagcccttttatgtgcatattctacttaattctgacaagtagcctgagaaaggtagtatcctctatttgaaaacaaaatgaatctgcccactccaagctgatctgaacccagatctcttttcaaccacattgtatgtgcttcaggaatatcttaataattctcaactttgggcaagttaatgactcaacttgacttatatgatcatctataaattgacagatgtagtcaaaagtttagaattcaaagatctcccataactgataacatgacactcaaatgctgggtacctgggtagctccaggattttaagtggatcttaaaatcccattaatttttcctcacaattttctacaaaacataactcgtgtgcaaaggcaagcatacctttattggctactagaaagtgaagaacaactgcccttttccccacagtgcacataggcctgcctcttctcttcagcccacacccaacctgcttgcttacgattatctgtttgtcttagccagtggtaacctccctttttctctatttctctgacaggcctcagcagcattacattgctcacttcttacgtgctaaggtttttctttgccttatgtgattagatgtgccgaacatacttccaagatctaaaaagcagcaaaatttagggaagcaagaagtcaattgtattctggccttctgctgctttggaatttctgctctctcagagagctctaaagaggcatggcaacacagagcccctccttcctggtgattattatacaaggctcccactggcctgttcagctggggcggggggagttgatgctggaacagaatcatctgccggctaggtatcctggaacagtaattaatactgtttgaatggctgagactatccaaaaccaaccactttctttctactaaagaaaatttcaactccaaacccaagacctggcttccaatatagcaaaaactccacaaagagaacataaaacatcaccaaagtcctggtcaaaagtggtgctgtttacttttgtaacatcaacctgttctccaaacacggcttcctcctaagaagaagggacaacactatactcaaatatgtgcgcaagagtgcatgtggatttggagcaaaaaaaaaaggtgtccttcacgggataaggctctttaattctctgaagtgaagtaacccatatttccccatatgtatttcattctagaaagctcagaaactgagtgtgctgagggattcagagggctttttcatgtcaagaaaaaaaaaaggctattttcagactacacttgaatggggaaaatctgaaattttcatgtggttattaggaaaagttgtatttgattatataaaacatgtatcttctctaaaatcgttgtttggagacagggtctcactctgggtacccagacagagtgcagtggttcaatcatggctcattgcagcctcgacctcccaggctcaggtgatcttctgacctcagcctcccgagtagctgggattacaggcaggcaccacatccaactaatttttttgtatttttagtagagacgaggtttcactatgttgcccaggatcgtcttgaactcctggacacaaggaatccgcccatcttggcttcccagagtgccgggattaaaggcatgagccaccttgcccagccttttttttttttttttgtctaaaatcttaggaatggccgggcacggtggctcacacctctaatcccagcactttgggaggctttggtgggcgtatcatctgaggtcagaagtttgagaccagcctgcctggccaacatggtaaaaccccgtctctactaaaaatacaaaaaaaaaaaaaaaaatagctgggcatggtggcaggcgcctgtaatcccagctacttgggaagctgaggcaggaggatcacttgaacccaggaggcagaggttgcagtgagccaagatcataccactgcactccagcctgggtgacagagcgagagacttcatctcaaaaaatagtaagataaaaataaattaaaatcttaggaccaatgtttatgtagaatgtaaatgaattatcaacattctatatatgaaagcatctcactagctttattgaggtatgatttcttaaaaattctctaaaagattgactaagatgcagttctagtttttcaaagggctttgggattttttgaaagtatcagatcattgaaatcaagtcacttgctcaaggtcattcgatcaaatcaggtaagattagaattactggctcctgccttccaaaagccagccataaatcaaatttctcttggaactaagcaggccaaaaatgtcaaaatcattccccatctcttttcttcagtaatcaaggaaagagaaaaattagtttaaatgtagaacagaatttcaattaataaaatgtcatcggccaggcgcaatggctcatgtctgtaatcccagcactatgggaggccaaggtgggcagaccacgaggtcaggagttcaagaccagcctgaccaacatggtgaaaccccatcaaaaattagccgggtgtggtggcaggtgcccgtaatcccagcaactcaggaggctgaggcaggagaattgcttgaacccaggaggcggaggttgcagtgagctgagattgcgccactgcactctagcctgggcaacagagcgagactccatctcaaaaaaaaaaaaaaaaagtcatcaatgcataaacaattacccctaaccatgcacaggcacctctcttgaaaccgataactgtttcgacaatttgctaaggtcagtaacctctacacaaccttgccatatgatggtaccataaacttattaagattttaaatcagcacctcatatgtatatttataaatagctcgcttctgttatcttttaaaagacctgatcagactggagtacggaagtactctgagctctcggatttttttttaagttaacaggtcataaataagttcaaaagttttctgcagaaccctgaagggaatagggatatttcaacattgcaaataaaacaagtgattaaataaatgagaatcataaaggccagagggtagagggttgaagagaagggacatcacatttttatgcaacattattaccttgctccttatcaaatccaccactttctctctttcactctctcactttctgtcccaaccttctccttttaaattgctgatataaaacactacttccaaaattaacaatacaaacacaactcccggccaggcacggtggctcacgcctgtaatcctagcactttgggagactgaggtgggtggatcacttgaggtcgggagttcgagacgaacctggccaacatggtaaaaccccatctctactaaaaatacaaaaattagccagtggtggcaagcgcctataatcccagctattctggaggctgaagcaggagaatcctttgaacctggggggcagaggttgcagtgagctgagatcacaccatttcactccagcctgggcaaaagagcgaaactccgtctcaaaaaaaaaaaaaaaattccaacgaagtcgtatttttaaaacattaaatggatcaaatggtattattatagtagctgagggcattttatattttttgcaaacacactattaatagtcttatttagtaattttcctcatatccaattttctatgtgagatggtaccccatttcacggatgactctcaagtccaagaaaagtttcctttgctcttagaatacgggtcacccacattaagtggcattagagctcaaaaatactaagttaatggttaggctgaaattttggctgggttacagtatacatggacaattcataacatttatagctacatgatttttcttatttcaaattcaagtctactatttctgaatctcttggagtgatgatatctctagcccttgagcacaatgtagccacagggtatacaaagcaaatcaaaagcaagcactggaaaaagttaaacctagaaggaaatataagtccaataattccactgtgccagaaaacagaattgtcattgggaaatttattaaagtgaactacatgaaactgctgatatacaactgtttttgacctgcaaaaacagaaatttcatatggctcaacctaatgttattttctgttattttctctctcttttttttttttttgtgtgtgtgtgtgtgtatgagacagagtctcactctatcacccaggctggagtgcaatggcgcaatctcggctcacagcaacctctgcctcctgggttcaagtgattctcctgcctcagcctcctgagtagctgggattacaggcacctgccaccacgcccggctaatttttgtatttttagtactgacagggtttcaccatcttggataggctggacttgaactcctgacctcatgatccacccaccttagcctcccaaagtgctgggattacaggtgtgagccaccacacccagccaacctagtattattttctaagctcattttaataactattcaaataaggtcttcataacccaaggaacacaaaacaaccttctatttctccagattgccttaaccttgaaaaaatttgccgccccactgtccaaagctagacattctaaaaatttaagttcaacagagcctgtgcatcatagtgagatcctgtctctacaaaaaactgttttaaaagttagccaggcagggtggcatgtacctggagtcccagctactcaggaggctgagggaggaggatcccttgtgcccaggagatcaaggctgcagtaagctatgagcatcactgcacgacagcctgggcaacagagactctctatcaaaaaaaaaaaaaaaaaattagtaggaagggcaaacagctaaatgtaactactccacatcctttttttattgttcccctttctcacgaacaaaatttccatcctaagtagaattccccttcagaaggcttacattcaaggggatacagtactaatgaaaatgtaagtgctctgcctctttttcagctatcagtgatataggattctaggcatggcagtagcacatcgctttacacaggggttccactgacctaaaaatctactgttgaggaatcttaattaaattgataagttccatttctgttgaagaatctggcttctaacctttctatcaaaagggtgattaccatcccagtgggatatagttttccatttagatatagctgatttatggactcagaccagaagtacctgtcactttcacaaaaggagaaaaaaaggattatggctctaagactgcctctaggtccaaatcccatcttttcacacccatttttattagagtctaatagccaacatgctaatgaactcttttctcagttaattccactaattagttatctcttcttgttctgccagaatcccaacccttttacaatctactcatcaaatccatcaggccacatattatgccttcctagaggaacacttttcgtgatgacactttgtaaacaaggcaatctgatgctgcctgttctatcttcccagatctagttgatagttcaaaacatcaacattaaccacaagtaaaatatgcttaaaaaataatcaggagacgatctcctgctctatctggaaatttctctattcagctagttctgcgttgacaggtcaacagagaatggcactagttattgctacaatcctaaaaggcatttccctacagctaaaccatcaaccctttcctaaaatccatataatccaaaatttttctagcagaatttactctccctgcccctaccccagcagcatcttctgatcatttttcaccataaactgaggtttcctcatagtgatgccaagtcaggcaaacacattccttaagcgttccacctaactcccttcttcctggaagttacatgtaatagctgcctttatttacttatttttaaaactcttcaagcaccaggtacagtggtaagtgcttttaaagaacatgtatctacttccatccttaacactgtatgagattgggactcacattcccattttacagaggagaaatgcaaaggcttagtaacctgcccaaggtcatacagggcagagattggaatccaagtctgacctctgtgtcctccgctcttaaccttcatgctgtctttccttctgatctcttcctgtcctaactggtgccctgtggtcttataaaagactatgcttggggcaggcgggggaggggtgggagggtcagtttctccagagaccgcctttcctttaaaggataagactttgaaaagaaggagtacccattacatctttcctccatgctcccccttctcacctggtaccatttcccaaaggccccaatcatatccccttctctacggacaatttaaacttctcctttgtccgcagagcaggcactatccaatactgaagaaccacaccatctaccctcaaggctaggagagggcagaagtggaagaaagaacacagacagcaccccttccccaggtcttcagttgagaaagaagctgtggctgaaagtctggggggctgggggcaaaggtgacaaggatgtgcccttgtgggtacgcgaggtgggggggggggagatggggaagaggcatgggacgctcaggggattagcaggagattgaatgggggtggacctctgtaaggggaaggggggtgccaccggcaggcagagagatcaggccactgaagaggtgaacgtgagttagggaggaggacctggaggtggatgtaataggggaagtagaggaagaaaggggagggagggggctcacgggagcaggaaacgatggagtcatggggagtgggggaggatggatgggagctagaaggtggggcggcctgggacccgggcacatgggctcggcgaagagcgggcgcgccgcgggggactggggtgcggggaatgccgggaatgggggttcgaggagaccccggggaagggaaggggaagcgggagttctcgagcagaggagcgggaagtgggagttccagcgaggcaagagcgggaagggggttccggagcaaggggcgggcgtgaaggtacagtcgggttcgcgagggtggcgttaggaggggcggggtgggccggaggctggcgcgggagagggatcccgggcgcctgttggggtgcggagggcaggaatgtcctggcgtccccgagagccgggccaggactccggagtcttcggaggaccaggctcagggccgcctcccggccggggccccttagggaggggcggggattccccgggtccctcaaggccagagcggcagccgccgcggtcccaagcccccttcctacctatgccgggcgccacatagacgaagtacagcagcgaggacgagagagaaaagaagaagagcgcggcgagcagcgagcggcgcggcagccgcagcagcccccggcgggcgcgcatgctgcagccaggcggccgctagagagccaggccgggcctgctcccgcagctccccgtccgccgcctcctgggccgccgccgccaccgcctgggcctcggccaccgcctcccgggcctcgcgggccgccactcgccgccgccgccgcctcgccgctcccagccgccggccgtcgcgggccgggccacatgaagcgggcgggggccagagcggccccgagcgggcgcagcggcgggggcggaggcggggcgcacgcgcgggaggcggggccagtgccgccgggcaccgtcgcaaaagacccgcgcgcttgcgctcgccgccgaccctcgctcggcgcccacagcagcccgcatggagtaatcgccaaatggcgacagaccctctcccagtgcggccaccgcccaggctttcggggaatgtctcccaagtgctccgcgctagctcgtcccccatctcgggggccaaggggccatctacaaagtctgactcatctcgttgcccactgcagcagaagagtggggactgcaaggcttgggggttcggcctggtatacaccctcattcattcattcattcattcattcaattcaccatttatttattgaatgccagacacagttgttggcgctgggcatgctacagagaaaaaaaacgataaaaatctctgtctacttgaaacttacattatgtgagagataaaagaaacaaatcagctagtaatatcaggtactggtaacacatatgaatacgataaaacaggaggatgtattgcaggcaggctggagtggtcaaggaaggcctcactgagcagtgacacgaactgagatataaaagggtgagaaagcgccagcttttttgaataagctggggaaaaagcagtcataccagggggaacagcaggtgtaaaggccctgaggtaggaaaagggctgatctgcccccgagttgaatccaaggccaacatggataaaatccagtgaagtagggggggaaatagggatgagcttggagctgtagtcagggatcctactgtatcagaaatagcataatgataacaattgtcaatgtctctagacttctgctgagaaacatggacttcactcatgccatgaaattcccccaccagtcttgagatgtgtgctgttattattactatcatacaaatgaggaaactgaggtttctagatggaaaggcaattcacccaagccttgcagtaagggcttaaatcaaaactggcctgtctcccatgtcaggcccttgacctctaggttgtaactgtctcagcagtctgtatgacctctaattcttatcctgcaggcaaatcggtatcctatccccatcacctgggtatgggaccatatccaaaaaaatgctttcagatcagcatcagctcaaaggacctcagaaggcaatgaacagtcctagaaatttatggcaagaagcagtagcctcaaggagctggactgaggaggccagtgtccctgtgtagacatatctgaaactagggtactgtcttggaatgccagaagcagtggggaggggagaggactttgcagggattctgtgagaatcaacaataattctgatttatattcctaaagtgatttctactttttacagtgtttctttgatcctttaagtggggagtctagagccacactgcccaggttctctgactcccagcttttccattgttagctgtgtgacctcacgcaagttaaactctctgtgcctcggtaaaatggaggaggttattagcaacctcatcaggttgttgcgaggatttaagtaatacatgcaaagtgcacatagtaagagtgcttagctgtcacctaattcaatacccctggagaatggtatggtggaagagaagaggcttaaacgatcaaaaaggaaagcagagaattttgactcagatagatgtgagttcaaatctcggcttggcatctcctggctgtgtgactctgggaaagtcacttacctctctgagcttctctattcatcacctgtgaatcggacccagtgctgcccaccccacggggatgtgatgtggattcgatgaaatagtgcaggtaaggccctggaccagaaatcccagactagccggaatcatctaacttgcaaatagtttttgttggcccacacaatggcccctcccaaccctcgtatctatgaaacattttcaaacatacagaaaagttgaaagaatagtacaagaaacatctgtacactccccacctggatttgatcattgttatcatttttccacatgtatgtatctatattcatatgttgaaaatttttattttttgctaaatatttaaaggtaggctgggcgattacacctgtaatcccagcactttgggaggcaaaggcagatggatcgcttgagctcaggagtttgagatcagtctggccaacatggcaaaactccatttccacaaaaaatacaaaagaattagctgggcgtgatgacgtgtgcctatagtcccagctacttgggaggctgaggtgggaggatctcttaagcccaggaggtggaggttgcagtgagccaagatagcgccactgcactccagcctgggagacagagtgagaccctgactcaaaaaaacaataaaaaaaagtaagttgttgccttactagtacttcatgccttaatacttcagtagcaaatcctaaggaaaattacattatccttcaaaaccacagtaatactaagagaattaacaattataccataacattctgtaacatccagtctgttctggatagacagagaaagagaaaccttcctacatttaaactatgtaccaatgatcagtctctatttctgacctatctgaaataacaaggcatcaaaataaattggttatgttttaggccgggtacagtggctcacgcctgtaaccccaccactttgggaggccgaggcaggcagatcacttgaggtgaagagtttgagaccagcctggccaacaacatgaaaccccatctctactaaaacatacaaaaattagctgggcgtggtggcacgtgcctgtaatcccagctactcgggaggctgaggcaggaggattgcttgaacctgggaggcagaggcagaggttgcagtgagccaaaatcgtgccattgcactccagcctggacaacagagtgagactccacctcaaaaaaaaaatgcaaaatacaaaaattagccaggcacggtgtcaggcagcctgtaatcccagctatttgggaggctgaggcacaagaatcgcttgaactctggaggtggaggttgcaatgagctgagatcataccactgcactccagcctgggcgacagagcaagactccgtctcaaaaataaataaataaactggttatggtttttgtctgtttgtttgtttcagtggagtttcgctcttgttgcccaggctgcagtgcaatggcacattgtctgctcaccgcaaccttcgccttccaggttcaagagattctcctgcctcagcctcccaagtagctgggattacaggcatacgccaccatgcccggctaattttgcatttttagtagagacagggtttcaccatgttggtcagactggtctcgaactcctgacctcaggtaatctgcctgcctcgacctcccaaagtgctgggattacaggcatgagccaccgcctccggcagtttatgtttttaaatggaagaaaaagaagtatgtcaggagtatccagggatccctacctcaaactccttcctccacactactttttcatctccaagttaggtttccaactcactaaagcatgtattcattatatattcatttgactattcagctcctcagacaaactcactgtattctaatctctgctcaaatgttaccgtctcaaaaagacctttcctctaaagtagctttcttctccccatcccagcactctctatccatagccttcctcagcttgatttttctccatagcactttttatcccctgacattctactatacatatacgcgtttacttgttcattttcttctcccagatcagaatgtaaacttcacgagagcagggatttggtttcactctctgctgtatccttgcacctagcacagtgctcagcagccagtaggcgctgaataattgttgaaggacgacaggtgtgcagtgactgtgtgctgggcatggcagatgcaaagatgactaagacattcttgcagcctagtgacatatgagctacaggaaagtgactaactgagggacactgtcataagggcaggactcagcatggctggcagtaggaaaaggtgttctgtgagattctagatggtctttgaagggacattgagacaggtttgctcaaggggcagtgagaagaggcctgcctggttggagcagctagtcctgccaaggaaaagaaagaggtgaggggtgaggctggaggagtgaggcctgaccctgtggctcagcatgggccctggaattagatggatctggctgccagtcttccttcctccctgccctcactctgtcatcttggcaagtcacttcacctctcggaacctccatttccgcatctgtaaaatggagatcagacagttccttctttctaggattgtgcacagattacaaatagtatctctataaagggcctgatatgtaggaagtgctcaatccatgggagccatcactattcttaactttttcctctgagccatagagagcccttgaaggttttagcgcaggggagtggcctaaagaaagggaggtccttggtgaaatctcaggagagcacaggttgggcctcttgtgcttgtcaacacccaattgcaggctagctgaaatcacacacataaagaaaacaatccggcagggcatggtggctcatgcctgtaatcccagcactttggaaggctgagatgggcaggtcacctgaggtcaagagtttgagaccagcctggccaacatggtgaaaccccgtctctactaaaaatacaaaaattagccaggtgtggtggtgggcacctgtaatcccagctactcgggagactgagacaggagaatcacttgaacccaggaggcggaggttgtagtgagctgagatcgtgccactggactccagcctgggcaataaagaacaaaactccgtctcaagaaaaaaaataaaaataaaaaaagccggtgcatccttccctctacttttccttctatcaaataaccatcaatgttgttcagagcagccacccaccagctaagttccagaatgaggaggagatgctcccaactccattttgccaacaatgacacgtagcatgagcaataaataaagcctctgagatataggggctttttttttttgagacaagtcttgctctgttgcccaggctggagtgcagtggcatgatctcaactcattgcaacctctgcctcctgggttcaagtgattctcctgcctcagcctcccaagtagctgggactacaggcgtgcaccaccatgctcagctaattattgtatttttagtagagacagggtttcaccatcttggccatgctggtctccaactcctgacctcaagtgatctgcccgcctcggccgcccaaagtgctggaattataggcatgagccaccgcgccaggccaagggctatttttaatacagaaaacctggcctatccttacttatcataaatataccgttctgcaacttgctttctcctgacattatttttataagatatttccataatgatacatgtggctcaagtttattcattttcactgctgtgtaatattttatcatataacttggcctcaccttttaaaatcctttttcctaatgatgtctatttaagtttgttccaattttttcctcatactggtccataaatccttagctacaattcaaattccaggaaacctaaaaatggaaggctttttataatttatttagcagcaagatctgacctgatttgaacttctttagtggcaaaacctgacctgaatagacagaaagctatttataatcattatgccacttaatgtgaatattcatatgttccactgaggaaatatttagtgtttttttttttgttttgttttgttttgtttttttttttttttttgagacagggtctccctctgtcgcccaggctggagtgcagaggcgcaatcacagctcactgcagcatcaacctcctgggctcaatcgatcctcctgcctcagcctcctgaacagctggtactacaggcatgggccaccataccgagtttagatttttgcttacaggatgaaccagtcctctcaaggggtatgataggagatttcatgaatgcaccatattgtctttcaaaattctaagaatttctttttttttttcttttttgagacggagtttcactctttttgcccaggctggagtgcaatggcctgatctcggctcaccgcaacctccgcctcccagattcaagcaattctcctgcctcagcctcctaagtagctgggattacaggcatggaccaccatgcccggctaattttgcatttttagtagagacagggtttcaccatattggtcaggctggtctctaactcccaacctcaggtgatccacccacctcggcctcccaaagtgctgggattacaggcatgagccaccacgcccggcctcaaaattctaagaatttctaaaattcaaaacacgtttagccccaacggctttggataagggatggtggacaggcacaaacatgactgcgatgtatgcgtgtggcagaatgtattttccaaagatgccctcaacaatatttcctgtcctcatgctcttctagaactttctctaattcctcttcctgtgaatctgggtgggattgtgaatcatctataaccaataaaaagatgaaaatggccaggtatagtggctcatgtctgtcatcccagcactttgggaggctgaggcaggtggatcatctgaggtcaggagttcaagaccaacctggctggcatggtgaaaccccatctctactaaaaatacaaaaattagcccaagcgtggtggtgcatgcctgtaatcccagctacttaggaggctgaggtgagagaatagcttgaacctggcaggtggaggttgcagtgagccgagattctgagattgccctactgcactccagcctgggagacagagtaagtgagactctgtctcaaaaaaaaaaaaaaaaaaaaaaaaaaaaaagatggaaatgatgctgcacaatttgtgaggcaatgcagcttctgacttgatcactgggacactcacctttggagcctggaacccctatgctgtgaagaagcccaggccaagtggagaggccacatacagatgctctggtcagcagccctggcagaggttccagatgacagccagcatcagccaccaagcatgtcagagaacaaggctttagatgtcccaactcccagctgtcaagtcatcctcaccctttaaaccttcccatctaaagccccagacaagctgtcccactgtgccctttccaaaatgataaaatggttattgttttacacaactaaatttgggataatttgttatgctgcagcagtagtaactggagcaacacgcttttttttttttttttttttgagagggagtcttgcttttttacccaggctgaagtgcagtggtgcaatctcagctcactgcaacctttgcctcctggcttcaagtgattctcctgcctcagtctcccaagtagctgagattacaggtgcacgccaccacgcccagctaattttcgtatttttaatagagacagggtttcgtcgtgtcgtccaggcgggtctcgaactcctgacctcaagtgattccccgcagccccctgcctcggcctcccaaagtgttggaattacaggcatgagccactgcaactggctcaacacgcgtctgtatgtaatttgtgcatgtggcaaaaatgtctccaggtcacatggtttacaagagaggatttggtgaacaggtgaggtatgcatatcttctgctttactattttccaaattgttctcaaaaatgcttgtagcaatttatattcctagcagcagtgaaggagggcttcctttatttcctgcttcacccaccgttactgtaatcagaattttccagggtttggtccttctgccaccaatcccctctgaagagagagagtaaggtaaaagttagcaaaggcctccaagagctttgattctgtacaggactatgtctttgctgtcaaaaaaaactgacttatagccaggcgcggtagcatgagcctgtagtcccacctactcggggggctgagacaggaggatcacttgagtccaagagttctgtgttgtagtgtactatgtcatttgggtgtctgcactaagttcggcatcaatacagcaacctcccaggatggggggaccaccaggttgtctaaggagggatgaaccagcccaggttggaaatggagcaggtcaaaactccagtgttgattagttgtgggattgcgcctgtgaatagccaccgcactccagcctaggcaacattatgagaccctgcctctaaaataattaaaaaattaaaaataaaataaaataacccgggcatggtggctcacgcctgtaatcccagcactttgggaggccaaggcgggcagatcacctgaggccaggagttcaagaccagcttggccaatgtggtgaaaccccgtctctacgaaaaatacaaaaattagctgggcgtggtggccggcgcctgtaattccagctactcaggaggctgaggcagaggttgcaatgagctgagatcacaccatcacactctagcctcggcgacaacagtgaaactctgtttcaaaaaataataataataataaaaataaaaaataaaaactgacttatatcccttctctaaattctcctcagtctttcctatcctgtagaggaaggcctaaggcatgacaagattgctcctagtattgcctgatataactcattctctcattcaacagatattagtatttatcaagtactggccgggcatggtggctcacacctgtaatcccagcactttgggaggccaagacaggcagatcacttgaggtcaggagtttgagaccagcctggcctacatggtgaaatcccatctccactaaaaatacaaaaaaatatatatatatatataattagccaggtgtagcggcaggtgccggtaatcccaggtactcgggaggctgaggcatgggaatcgcttgaatctggaaggcagaggttgcagtgagccaaggtcgccccactgcactccagcctgggtgatagagtgagactctgtctcaaaaaaaagaaaaaataataatatttatcaagtaccaaactagatgccagacatttttctagatgctaagagaaaattatgatgataataatgatgatgccactgccatctagggaccaggtatttactgaattttttagtcacccagcatccattcacttgacttctgaaacagccagatttccttctctccttgttttcagtctatgtggttctctgaggttgttaactccatttccatctccagacatgatatgaactagcctggccagtcagaatattatattccttttgcaacagtgattggttcagggctgagcagaccagccagagccaatgatgctaaatgtccagctttctttgtgcctttggagaggccaactttctctttcatgctagacataaacatgacaggttgtgaggccacagcaatggcaactgttttatcaacatgtggaacctgagaatgaaatgagcatataaacagactgatacaaacagcaaagagaaattgagtcctaatgatatagtttgactcttgaattcacctagtcctaacctgcctttctttccttccccagttttgcatctgctgaggtttttacaagtgtgtttttttaattttaattgaatcatagcacacatacagaaaaatacacattgtaacaaaagtatagtttgctaaatttttacaaatggaattacccatttaaccaacattcacatcaagaaataaggacatgatatgatgtatacatgtacatcacatatgtataggtatgtatatgtatatgatatgtgtatgtatatgatgtacatggtctccaatttatgatagtttgacataccactttttgatttcatgatggtgagaaagtgatacatattcagtagaaactggacttcaagaaggccgggcgcagtggctcatgcctgtaatcccagcacttttgcaggccgaggcgggtggatcacttgaggtcaggagtttaagaccagcctggtcaacatggtgaagccccatctctactgaaaatacaaaaaattagccaggcatggtggtgcgcacctgtaatcctagctacttgggaggctgaggcaggagattagcttgaacccaggaggcgaggtagctatgagccgagactgccccactgcactccagcctgggtgagagaacaagacttcatctcacaaaaaaaaaaaaaaagaaagaaactggacttcaagtacctatacaaccactctgtttttcagtttcagtacagtgttcaataaatgatatgagatattcaacacttgattataaaataggcattgtgttaattttacccaactttaggctaatataagtgttccgagcacatttaaggtggactaggctaaactaagatgtttggtaggttaggtggattaatgcattttcaatttacggtattttcagctcacaatgggtttagcaagatgtagctcctctgtatgttgaggaggacctgtgctgttctgtctggctccgtttgctcaccatgtttgtgagattcatgcataccgatgagtgagattgtaaaaccattcattttaattgctgaatagtatcctgttgtgtgaatacaccatagtttactttccagtcaactgctgtcatctggcatttggatcgtttctagttagaggatactaggaataaagctgctataagctccctgggacagtggctctcaggcttgtgaaatactctcttgatgtagtgtattagtcaggcatagctggggggctcacatgatatcagcagccttagtttctctcaatatcttagttctgcttccctctgagttggtttcatcagattcatgtgttcctcctgaccagcttattctcagctgctccaggcttccattccccagcccagtcacttagccaaaaaaaagaaattttataataaagtctcattggtctggcttcattcatatgttcctccccgaaccgatccctgtgattaaagggatggagtgtgctgattggacagaagtggtcacatacccactccccaacctgcccccaccctggagccaggaagcaagatcagcttcctgtgaaccacaaggttgatgtagggaggggtggctccccgaggggaaatcaaagtgcaattattcaagtggaattgttgctgggcaggcaaaaacaacagatatttgtggaccacaccaacttttttttcaatgccttcatgcctttaggtgctctgtttctgctaccaggaaatactgtgttctctttctcctcatcctctaagatccagcttaaatatttttcccatcctaaaacctcccagaatttttggacttgattctggatggatgttctttttttctttctttcttttaagacggagtctcgctctgttgcccaagctggagtgcagtggcgctatctcggctcactgcaacctccgcctcccaggttcaagcaattctgctgcctcagcctcctgagtagctgggattacaggcgcatgccaccatgcctggctaattttttgtatttttactagatacaggatttcgccatgttggccaggctggtctcgaacttctgacctcaggtgatctgcccaccttggcctcccaaagtgctgggattagaaaggcctgagccaccccgcccggcctggatggatgttcttaacctccatttactctccttctgttgaaagaggctcaaaagcttaaaacagcattccacaggctctcttgcagctatgacagtgggaagttaaattctgtcagttagattcatttgcatgagatctggaggatgggagagagggagaggtcgtcttgctggagctgtgtcagctaagggagcggttctgcaggtgggaggagcatgtacagtggagtccactgtgcagtccccacttaggagggtgtgaggtagtaggatggaggccatggtggtggcagggaagcagcagtttggtaaccttgggaacaaggccttgctggaggaaccttgaaatcaaaagcctgaaatggcccctgacttctactcttccagacctcctaatgattttgtaagcacctatatccctgtattaaatcttttttatttattattattattatttaaattatagacacagagtcttatactgttgcccaggctggtctcaaactccgggcttcaagcaatcctcccacttgggcctcccaaaacactgggatcacaggtgtccagcctcaaaattcttttttgggccaggtgcggttgcttccacctgtaatcccagcactttgggaggctaaggtgggtagatcacttgaggccaggagttcgagaccagtctggccaatattgtgaaaccccatctctactaaaaatacaaaaattagccaggcatggtggcccatgcctgtaatcccagctactcgggaggctgaagaaggagaatcgcttgaaactgggaggcagaggtgcagtgagtcaagatcatgccgctgcactccagcctcggtgacagagagaaactgtgtctcaaaaaaatacaataaaataaaagattttttaaaaaagcacttgaatagcacttactctgtgtcaggcactagtctaagcactttattaaaaatttatggaccagacatggtggctcatgcctgtaatcccaactctttgggagggcaaagcaggcagatcacttgaggtcaggagttcaagaccagctcgaacaacatggtgaaaccccatctctactaaaaatacaaaaattagctgagcatggtggtgtgtgtctgaaatcccagctactcgggaggctgacgaaggagaatatcttgaacccgggaggtggaggttgcagtgagctgagatcgcaccactgcactctagcctgggcaacaagagtgaaactccatctcaaaaaaaaaaaaaaaatttacaaccaggcatggtggttcacacctgtaatcccagcactttggcaggccgaggcgggtggatcccctgaggtctggagttcaagaccagcttggcctacatggtgaaaccccacctctactaaaaataaaaaattagttggatgtggtggcacacacctgtattcccagctactccggaggctgaggcaggagaattgcttgaatccaggaggtggatgttgcagtgagccaagatcctgccactgcactctagactgggtgacagagtgagacttcgtctcaaaaaaaaagaaaaaaaaaatttacttaatgggctgggtgtggtggctcctgcctgtaatcccagcactttgggaggtcaaaggggacagatcacgtgaatccaggagttcaagaccagcctggccaacatagccagccaaatttcatctctactaaaaaatacaaaaaattagctgggccgtggtggcatgcgcctgtagtcccagctactcaggaggctgaagcaggagaatggcttgaacctgggaggcaggggttgcagtgagcccagatcgctccattgcactccatcctggtgacacagcgagaccctgtctcaaaacaaaacaatacaaaccactgaacaaacaaaacccttaatctttacaacaacattttgaggtaagtactactgccaccctcatttgcagatgaggaaataaaagtctagaaggattaagaaatttgcccaaggtcacacaactggtttcttataaattatgtaaggttatgggtagatttcataatgccatggggaatgctcttgatgggaacgactgtccttgaaggcaagcactgtctttttttcatatttgcaccgcagtgcctaaattagcaccctaagcacttgataggtgtttggtaaatattggttgaatgaattaatgaaactatttatgaattcagctgagtctgctgtgaaaagaaaaaaaaactaaatattaaaaggaattcagagtatattttcccactagagcacaggtgagcaaagttcttttataaagaggcagagagtaatttttttgtttgtttttttgagaaagagtctcactctgtcacccaggctggagtgcagtcacatgatcactgcagcctggacctcttgggctcaagtgatcctcccaccttagcctcccaagtaactgggacacagacttacaacactatgcctggcaaagattttttatttttttctatagaaacaaggtgtcactatattacccaggctggtctcaaactcctggcctcaagtgatcctcccaccttagcctcccaaagggctgggattagagatagtaaatttttttttttttcgagatggagtctcgctctgttgcccaggctgcagtgcagtggtttgatctcaactcactgtagtctccgcctccagggttcaagcaattctcctgcctcagcctcctgagtagctgggaccaccatgtgccatcacacccagctaatttttgtatttttggtagagatagggtttcaccattttggctagggtggtctccagctcctggcctcaaataatctgcctgtctcagcctccccaagtgctgagattataggcatgagccactgtgcccagccaagacagtaaatattttttattttactggctgtacaatctttggcacagtcaattaattctgctattctatcacaaaggcagccatagccactatgtaaacaaaggagtgtgtttctgttccaataaaactttatttacaaagacaagtagcagaccagatttggctcatggattgtactttgctgaccttgccctataagatgagttttaatatatcaaaagatttactgtagattactgtacttagtaaaatctttttttgctttgttttgaaaaaattattttattttattattttttttgagacagagtctcactctgtctcccaggttggagtgcagtggctcgatcttggctcactgcaatctcggcctgccaggttcaagcgattctcctgcctcagcctcctgagtagctgtgattacaggtgtgtgccaccacgcccggctaatttttgtatttttaggagagacaaggtttcgccatgttggccaggctgatctcgaactcctgacctcaggcgatctgcctgtctcagctttccaaagtgctggaattacaggtgtgagccaccatcccctgccctctccaacatgtaagtagggaatatagagctaacgtttcaatattgtatttcatttatttttatttttttgaaaaacaaatctttattgtctagaaatatatattttaaaaatcccccacaaaagatgctattctctaatttccccatcttctttttctttctttttttttaagacagagtcttcctctgtcacccaggctggagtgcagtagtgtgatctccactgcaaactctgcctcctgggttcaagcgattctcctgccttagcctcttgagtagctggaattacaggcatgtgccaccacacccggctaatttttgtatttttgtagagatggggtttcaccttgttggccaagctggtcttgaactcctgacctcaagtgattcacccgcctcagcctcccaatcatttctccatcttcttcctcttcttccacacctctgatataaaggacattattacaccttattaaaacttcacccagatgtccagacaatgctccatctatgtattcttctgtatttgcaagctgcatgttcatgtagccatctacagataccaggtagccctagtactccattccccgcttaagtttcaccatccttggctttcctgttactccactgaggaaagatctgggattgagacataaactcatcatcgtaaccacaggcaaatgctatgggcaaatgctgcaggccgctgaccaggctgaccaggctactgactacagcagctaccacaggtcctgagccactgagcatcaggagaaaactatgttcaagattttatagtaagaaatgtatttggtaacattccatgattttatgccatagaaggctcagccaacattccatgattccacatagaagggggtttagctaacattccttaagtctgtacagatgagggtgctctgtagacattccataacgataagcaaaaaggttctgcaaacattcaatgattttatacatggacagatgttctgcaaacggttcaaaattcatgctacaagaaaggattctagccaggcgcggtggctcacacccgtattcccagcactttgggaggctgaggcggtcagatcacctgaggtcaggagtttgcgaccagtctggccaacatggtgaaaccctgtcttcactaaaaatacaaaaaatagccggccatggtgatgggaacctgtaatcccagcgacttgggaggctgaggcatgataatcacttgaacccgggaggtggagattgcagtgaaccaagatcgcgccactgtactccagtgagggtgacagagcgagactccatctcaagaaaagaaaagaaaggactctgtaaacattccatgattctgtatacatgtgggtgttcctcaaaaacagttcataatttgattttttaattttattatttttatttatttttttgagatggagtctcactctgccagcccggctggagtgcagtggcacgatcttgactcactgcaacctctgcctctcaggttcaagcgattctcctgcctcaacctcccaagtagctgggattacaggcatgggccaccacgcctggctaatttttgtattttttgtagagaagaggtttcaccatgttggccaggctggtctcaaactcctgacctcacgtgatctgcccgccctggcctcccaaagttctgggattacaggcgtgagccactgctcccggccgacagttcataattccatatacaagaaggaaaacttatttgttctgacaccctgaaattctgtacacaggaagtgctctgtaaacatttatgatttcattgctatgaataggctttatagatattacataattctaatagatagaaatgggctatatagaacttcttgattttatgcttttgtacacagttggtgattctatagccgaagagcactcttcaaacaattaatgattctacctaaaggagggtacaggtttccctgaacctacctagaacaaagggtactctgtaaagattccataatactaaacataggcaactctgcctgctgttaatgacactacagatagaagggtattctgtaaatattccttgatttcatggcccagtgaggtggtttatgcctgtaatcccagccatttgggaggccgaggtgggtggatcgcctgagctcaggagtttgagaccagcctgggcaatatggtgaaaccccatctctactaaaaatacaaaaattagccaggtgtggtggtggtgaaaccccatctctactaaaaatacaaaaattagccaggtgggcgcctgtaatcccagctgcctgggatggtgagacagtagaatcgtttgaacctgggaggcaaaggttgcagcgagccgagaccgcgccattgcactccagcctgggagacaagagcgaaactcagtctcaaaaataaataaataaataaaaatacaaaaattagctgggcaggatggcacacacctgtaatcccagcttcaaaggagtctgaggcaagagaattgctggaacccaagaggaagagattgcagtgagctaagattgagccactgcactccagcctggtcgacagagtgagactgtctcaaaaaaaaaaaaaaaaaaggatgatgaagctgtctacataaggatgtagaaaagtctctaagatacagtgttaggttaaaaagtaattgtggggccggtcgcggtggctcacacctgtaatcccagcactttgggaggccaaggcaggtggatcacaaggtcaggagttcgagaccatcctgccgaacacggtgaaacttcatttctactaaaaatgcaaaaaaattacccgggcctggtggtgggcgcctgtagtcccagttacttgggaggctgaggcaggagaatggcgtgaacctgggaggcagagcttgcagtgagctgagattgcgccactgcactccagcctgggtgacagagtgagactccatctcaaaaaaaaaaaaaaaaaaaagtaattgtgtatctatataaaattgaatatatatatacatatacatatggagttggatcacaaggtcaggagattgagatcatcctgcccaacatggtgaaattctgtctctactaaaaacacaaaaattacccgcatgtggtggcgcatgcccatagtctcagctactcgggagactgaggcaggagaatcgcttgaacctgggaggcggaggctgcagtgagccgagattgcgccactgcactccagcctggtgacagagcgagactctgtctcaaaaaaagaaaataaataaaaacaaataaattaatttattaaattaaataaatgcagtgtcagggtctatataatttttttatttttttatttttttatttttgagacagtcttgctctgttgtcaggctggagtgcagtcacgggattttggcttactgcaacttctgcctcctgggttcaagtgattctcctgcctcagcctcccaagtagctgagactacaggtgtgtaccaccatgctcagaaaatttttgtatttttagtagggacggggtttcaccatgttggccaggctggtcttgaacttctagcctcaagagatccgcctgcctcggcctcccgaaatgctgggattacaggcatgagccacctttttttttttttggcttttaaataaaagcccgccaggcttttttttttttttttggcttttaaataaaaagagacaggatcccaatatgtcgcccaggctggagtgcagtggagaatccagttttaaagagagcattcaagcaagaagctgtgaatggccactcggaaacacagactccagagaagtggggtgagaactcaaaagttaaaagttagggtcttgcttaggtaggaagaaaacaaagaaatttaacaggattatgacttgttttttaaaagagatggggtctcactctgttgcccaggctggaatgtagtggtgtgatcaggactcactgcagcttcaaactcctgggctcaagccatcctcccatctcagcctcctaagtggctgggattacaggcatgaaccactgaacctgccttcattacattttctatacaaggctggtttatgagctacaacaatttaattagttatggtttgtttttatttcctttctagaaatacacttaaagagtgtatttgacattccatctcaagacagtatgatgatagtcatgaagtctttgtgtgagaaaggtaagagggaagttattatacaatgaagatgaacagtgaagaggaaaggggtcttctctggtgccctttagtcatttacaatattttctttctttcttttttttttttgaaacggagtctcgctgtgtcgccaggctggagtcagtggtacaatctcagctcactgcaacctctgcaggattctctgaggcaggagaatcgggttcaagcgattctcctgcctcagcctcctgagtagctgggactacaggcgcacgctaccacacccagctaatttttgtatttttagtagagacagggtttcaccatgttggccaggatggtctcatctcttgacctcgtgatccgcccgccttggcctcccagagtgctgggattacaggcgtgagccattgtgcccggccgtttacaatactttctaaaacaatgtaggtagagaagagggctaattataatcaaacaaacaaaggtaacgcctgcctaggttacagctgagtaggttcagaagacttgtgtcccacaatcacattcccttaaggcttgaaatattttaaagtctcaacagctcagattttgaaatacttattttcacacttccctgcttaaaagtttctcaaggaccactgcgcctggcccagatggttgtattcttttgagtttctgattggcctctccaaaggagccaaagagatatgcatttatctcagtgagcagaggggtgactttgaatagaatgggaggcaggttggccctaagcagttcccagcttgacttttccctttagcttagggatctgggggccctaagatttattttcctttcacagcatcatagccaaaagtggaaaaaagttactgggtgcagtggctcatacctgtaattccagcactttaggaggccgaggtgggtggatcacttgaggtcaggagatcgagaccagcctggccaacatggtgaaaccccgtctctactaaaaatacaaaaaaattagccaggggtggtggcaggcgcctgtaatcccagctacttgggaggctgaggcacaagaatcacttgaatccgggaggcggaggttgcagtgagctgagctgagatcctgtcactgcacttcagcctggatgacagcgagattccgtgtcaaaaaaaaaaaaaaaaaaaaaaaaagctggtggcggggagcggggagaggaaggtgagaacaatcgaaataccatcaactgatgaatggataaacaaaatatagtataggcatacaatggaaaattagccaaaaataaaataaaataaaataaaataaaagatgaggcggggcttggtggctcattcctgtaattctaccactttgggaagctgagacaggaggatcactcagcccaggagtttgagaccatccagggcaacatggtgagatatcatctctacaaaaaaattttttttaattagccaggtgtagtggtgtgcacctatggtctcagctactcaggaggctgaagtgggaggatcatttgagcaggggaggttgaggctgcagtgagcctcgattgcaccattgcactccagcctgggcaacagagtgagtccttgtctcaaaagaggaaaatgaagaatgatgtactgaaagaagtatgctacatgctacaatgtgcatgaacctttttttttttttgagacagggtcttactcttaggctcaagtgatcctcctccctcagccttctgagtagctggggttacaggcatctacctcggcataagcgggcattaatctttttactttatttttatttttgagacagggtctcactctgtcacccatgctggagtgaagtggcacaatcatggctcactgcagcctccaactgttagccccaagacatcttcctgcttctgtcccccacgtacctaggaccacaggtgcatgccactatgcccagctatttaaaaattgttttgtagagatgaggttttactatgttgcccaggctggtcttgaactcctgggctcaagtgatcctccccacttggcctcccaaaatgctgggattacaggcatgagtcactgtgactggccaggcatccatcttgaaaacattatgctaaataagagaagccagacacaaaaggccacatactgtatgattctatttctaggaaatgtacagaataggcaaatctattatagatgattagttgtctaagactgagagcatggggagagatggggaatgactgctaaatggtatggggcttcttaagggggtgatgaaaatgttctaaaattgattgtggtgtggttgcacaactctgtgaatatactaaaaaccattagattgaatatttatttatttatttagagacagagtctcgctctgttgccagactggagtgcagtggcacaatctcagctcaccgtcacctccgcctcccgggttcaagtgattctcctgactcagcctcctgagtagctgggattacaggtgtgcgccaccatgcctggctaatttttgtatttttagtagagatggagtttcaccatgttggccaggctggtcttgaactcctgacctccggtgatctgcccacctcagtctcccaaagtgctggggttacaggatgagccaccgcatccggcagattgaatactttaaatggaaaaatcgtatcgcatgtaaattatatttcaataaagctgttacatatacgtatattttttaatccaataaaaagtcttggcggggcgcggtggctggcctgtaatcccagcacttttggaggctgaggcgggcggatcacgaggtcaggggatcaagaccatcctgctgatttacacggtgaaaccccgtctctactaaaaatgcaaaaaattagccgggcgtggtggcgggcgcctgtagtcccagctactcgggaggctgaggcaggagtatggcgtgaacccgggaggcgcagcttgcagtgagccgagatcgcgccactgcactccagcctgggcgacagagtgagactccgtctcaaaaaaaaaaaaaaatctccttcccacttttgttctccattgaaccagttcccaacactagctgctccttgccatgcacacacacacacacacacacacacacacacacagagctaactactattgttagtttcttgtgtttctccagtttttatgtgcataaaatataaacatagattcttttcccccatgctcttacacaagaatagcataatactgttctgccctttcttttttcatttaatatttcagtgcgttacacttgccttattctttttatttaattaattaatttattttctgtagggacagggagtcttgctatgtggcccaggctggtctccaactcttggtctcaagagatcctcccgccttggcctcccaaagtgctgagactataggtgtgtaccattgtacccagcctgattctctctctctctctttttttttttcctgttcttttcttttgagagggggcagggtctcactttgttacccaggctggagtgcagtggcacaatctcggctcactgcaacctttgcctctcagattcaagtgattctcctgcctcacctaccctagtagctgagattacaggcgtgtgccaccacccctggctaatttttgtttttttggtagagaagcggttttgtcatgttgaccagcctcgtctcgaactcctagcctcaagtgattcacctgccttagcctctcaaaatgctggggttacaggtgtgagccactgtgcccactgattctttttaatagccacataatattcagttttatgaataaactataattagtttattcttctaacagaaatttggttgtttctaatctttctaccttaacacagtgttgcaatatatatacattattttgcacatgggcaggtgtgtctgtaggattaatgactagaaatggactttctgggtcaaaaggtatgtctttgtaatgatgatagagaccttgctcccaagggtgctgtaccagtttacatgctcaccagcaacatgggagggtgcttgatctttgccagcacaacagagtgagcgtcacatagtttcacttgcatttcttcttctgtgataattcaagcatcttttaatatatgtaagagccgtttgtatttttttggtcatttcctttgccattttccactgggtgtgtacttttctatttctagaaagaatatgctttatgtattaggaagatacagccctttctatatgagttgacatttttcctggcttgtcatttgtgttttgactttgtttgtggtactttttgtccctggactttaatcatttaaaaattttttcttatttatgtatttatttgaaacaggatctcattctgtcatccaggctggagtagagtggtgccatcatagcttgctgctgcctcaaacttctgggctcaagtgatcctcctgtctcagcctctggagtagctgggaccacaggtgcatcccaccatacccggctatgtccctggactttaagcttcttggctatctacgctccgtcttatctattcccttgaactccccctatctccatttcatctgctcactcattgtcttcatcttttcaggctgctatatcaaaataccataagctgggtggattttaaacaacagaggtttatttttcactgttctgaatgcagggaagtccaagatcaaagcactggcagattcagtgtctggtgacggcttgatttctggttcatggatgatatcttctcgctgtgtcctcacatggttgaggaggggaaggcagctctctggggcctcttttatatgtggcactaatcccatttttgtgggttccaccctcatgacctaaacccttcccaaggccgcacttcctaataccaccccattggtgattaagtttcaatatatgaatttggtaggggagacataaacattcagattttagcatttctcccctggctccccaaaagtcatgtccttcttgcatgcaaaatatattcattccatcccaatagcccccaaagtcttaaaccataatatcagcccacgcttgtaatcccagcagtttgggaggcaaaggtgggtgaatcatttgaggtcaggagttcaaggccagcctgaccaacatggtccaaccccgtctctataaaaatacaaaaaaattagctgggcatggtggcacaggcctgtaatctcagctactcaggaggctgaggtgaaaggatcgcttgaacccgggaggtagaggttgcagtgagccaagatcacgccactccactgcagcctggactacagagcgagactccatctcaaaacataaaataaaataaagataagatacaggtgagactcaagatacgattcatcctgaagcaaactgctctctagccgtgaacctgtgaactaccaaaatacatcaatgggatgggcataggacagacattcccattccgaaaaggagaagtaggaaggaggaaaggggtgacagatctgaagcaagtccaaaaccttacgtctcaggaacaatctttgactcaaggctctgccctccaggcccactgggggctgtgccctgacttccggacccactgggatggaggtcctgcctccacagtttggctgggcagcagtttgacccccaaggctctgagtgttctgttcccacggctttgctgagtgcagcctatgccacagttctcatggattggagtaatgtgcctgtggctgtcccagcctggcatcacgctctggtggtgcaaccagtctggagtctcagggtggccccacctctgcaggcaccccacccccatggctccactcggcactgcccttgtgggggctctccacagaggccctgctgctgccttgcttctctgcctaggccctgaggccttctgggggcatccttagaaacttaggtggaggcagccacgtccccacagctttgctgggcacagtacaccccaaaccagggcccactggagcggcatctgggatggccgaggaggtagaaatggagtgtggggagcagagtcgagaggcagtggtagccaaagtcccacaggccctggtggcccctcctttgaaattgctctgtcctctgggccctggcacaatgggcctatcacgggaggagcagctccagtcatctctgaaatgtctttggggtccttcttttttttttttctagatggagtctcgttctattgcccaggctggagtgcagtggcacaattgtggctcactgcaacctccacctcccaggttcaagagattctcctgcctcagcctccggagtagctgggattacaggcacgcaccaccacgcctggctaatttttgtatttttagtagagacggggtttcaccatgatggtcagactggtttcaaactcctgacctcaagtgatctgcccacctcagcctcctaaagtgctaggattacaggcgtgagccatggcacccggccttggggtccttctttcattctcttggacaacagatcctggtttctgttgagatggctgatccatactaatctccttatcaaatgtttccttggccacacctttgttctctcactctctttctctctctttctttttttttttgagagagggtcttgctgtgttgtccagactggagtgcagtggtgtgtttatggctctctacagccttgacttcccaagctcaagtgatcctcccacctcagcccctcaagtagctaggactataggcacatgccagcctgctatttttttttatttgttttagaaacagggtattgctatattgcccagacttgcctcaaactccctgccacaagctatcctccttccttggcctcccaaagtgtgggattatagccctgtgctgccacacccagctgttctgtcttatataggctttctgtttttttccaatatgggtaggctttgagttctacctttttgattaacaattccatttttttttttttttttttttggtgagatagaatctcgctctgttgcccaggctggagtgcagtggcacaatcttggctcactacaacctccgcctcccaggttcaagcaattctcctgcctcagtctcccaagtagctgggattacaggtgcctgccaccacgcccagctaatgttttgtatttttagtacagacagggttttgcaatattggccaggctggtttccaactcctgacctcaggtgatccacttgcctcagcctcccaaagtgctgggattacaggcgtgagccaccggtgcctggccaacaattccatctttaagtcatttctctctcacttcattttactataagtagtcaagagaacccaggctgcaccctcaactctttacttagaaatagcttcaggccaggcacggtggctcacgcctatagtcacttgaagtcaggagtttgagaccagcctggccaacatggcgaaatttcatctctactagaaatacaaaaattatttgggcacaatggcacacgcctgtaatcccagctacaagggaggctgaggcatgagaatagcttgaacccaggaggcaggggttgcagtgagcaaagattgtgcaactgcactccagcttgggtgacagagccagactccaacttgaaaaataaaataaaaagaaatggcttaagctacatgtctacttttgttgctcacaagttcttccacaaaatagtgggtcataaacacaattcaggcaagttctttgccactttataacaagaattgcctttcctcccgttttgagtaacatattcctcatttctctctgagacctcatcaaaatgacctttcttatccatattttcaccaacattctatttatgaccacttaggtcttctttgagaagatcggggttctcgctacagctcttttctccctccctccctcccatcctcctttccttccttccttccctccctccctctctccctctctccctgtctctctctctgtctctctttctctctttctttcttcagagtttcactctatcgcccaggctggagtgcagtggcatgatcttagctcactgcaaactctgcctcccacactcaaactatcctctcgcctcagcctcctgagtagctgggactgtgggtgcacaccaacacgcctggctaatttttgtattttttgtagtaacagagtttcaccatgttgcccaggctggtcctaaactcctgggctcaagtgatctgcctgccttggcctcccaaggtgctgggattacaggcatgagccaccactcccagccccatacatgttctttctttgttcaaaatccttccagccagacgtggtggctcacacctataatcccagctctttgagaggccgaggccagaggatcacttgaggctaggagttcgagaccagtgtgggtaatgtagcaagaccctgtctctacaaaaaattaaaaaaattaaaattaaaaaacataagaagcaaataaactcttccatagctccccattgccctcaggaaaaaatccaaaccgcctgacacgcctcccagcccctgcataaagcaggtctgcccacctctcccactcttcctctgccattttccgctcagtttctttcttacgaacaccaccacactggtttcctttgagtccctgaatgaggcacgcttgctcacgctgtgtgttacatctttccctcccctcaccttcccactctcttagactaactatacctacacacactcctgggatcagctcagacctcacctccagggagcttccctggaggaggccgcagctccagcaagggagcaaaggagcagggagggggccagcttggcaggagtgggatgagacagtggaaggatgagatcggagggcacggcagagcaagtgatcatggaaggccttgtcaatggatcacagtgagacttcggcttttcatgctgagtgaggtggaagccacaggaagattttcagcagagaaacagggtctgattcaggattcttctggcatctgagaagcggctgggaagaagcaggaagaccccaacactctcaatcagaattaatctccacttagtctgtgtacccagggcacatgaatatactgctttaaacaagcaaacgccttggtttcttctgtctaatgttttagtttcctgtacgcagcaggtgctgaagcatagtgattaagactgagggctatgcagcccagcctttctgaactccttccacaggtctgtcgcaaggattaaatgaattaatctgcataaagggtgcccagagcactgtcagtgctcaaggaatattagccattattaggaagtgtctgtctgcactgctataacatgacttttttttttttttgagacagagtttcactcttgttgcccaggctgttgctcaggagtgcaatggcacgatctcggctcactgcaacctccgcctcccgggttcaaacgattcttctgtctcagcctgccgagtaggtgggattacaggcatgtgccaccatgcccagctaattttgtatttttagtagagatggggtttctccacgttggttaggctggtctcgaactcctgacctcaggtgatccaccctcctcggcctcccaaagtgctgggattacagttgtgagccaccacgccccatgactttctaaggaatgctgtattgctttaagccaggttcacggaagcagccctcaggcagtttgctggagatcgaagcctctgctggctgcctaggtctcttcctcctgctccttcttctcctctttccctctggattgttggattcttgcaacaggttcctgcagaatcttgccattttaacacttccaaagaatgccaatgatccgtgggtttcctggacaggtagagaaactcacagaagcatccagccgcaggacgacagggctgatggccttggagcctttgtctaatgcatattgcagataaagaaacgggggcccagaaaggttaagccacttggcatcaggcacacaaggcaagagcagaactgggtaggaattcaggtttcctctctccagtcctggggtatgtttttttccttttatgtacttttttttctcttttttctttttctaaagacagtcttactctgttgcccaggctggagtgaggtggctccatctcagctcactgcaaccttcgcctcccaggttcaaataagtctcctgcctcagcctcctgagtagctgggaatacaggcatgtgccaccacaactggctaatttttatatttttagtagagacagagttttgccatgttggccaggctggtctcaaactcctgacctcaagtgatccctctgcctcagcctcccaaagtgctgggattataggcatgagccaccgcagctggcactccttttatatagttttaaaagtacataaggagtaaaagtatgcaaggtaaggagggccaggcgcagtggctcatgcctgtaatcccagtactttgggaggccaaggtgggtagatcacgagatcaggagttcgagaccatcctggccaatatggtgaaacctcatctctaccaaaaataaaaaacaaaattagccgggtgtggtggcacacgcctgtattcccagctattcaggcagctgaggcagaagaatcacttgaacctgggatcacaccctgggatcggcagtgagccgagatcgcaccactgcattccagcctgggtaacagagcaagactccgtctcaaaaaaagaaaaaaaaaaaaagtaaggaggtctcatctttaaaaaaaatgcacgtaagtgaaaaaaattgtctttaatgatcaccctgtgccatctgccaacattctctatccatatccgctgctctgtttttttttttttttttgccaaagcacttatttccacttgatatatcagccactggaatgggaacacccagaaggcatggatatatgcagagtgtggtctcagtgctaaggacagtgcctggcacagagtaaatgttcaataaatatgtgtttaaaagaataaataatacagccagtcatggtggctcatgcctgtaatcccagcactttgggaggctgaggtgggaggattgcttgagctgaagagtttgagaacagcctgggtaacatagcaagaccctgtctctatctcaaaaataaataaataaataaagccctgcaatccttgttcctcccctatgccaacataattgctgttatcaatttggctttgctattcttctagaccagtaccatccaatagaaggctctgcagcgatgcatagatcctatatctgcactgtttaatccacccaccactagctgcgctggaaatgggcctgatgccattgaggaactaaactttacattttatttagttgtaattcatttgcatttaaatgtaaacagccacacgtggctggtgacaagcatatcaactgttctagacattttttttctgggcatttgcatatgtatatgtcatcaggggctattttgcgtttttgttttacgtacattttcatgctccatgtagccttctgctacttacttttttgcattgagcaacactacattttggaaggcttttcatatcaggccatatagatctgcctcattctttttacttgctgcacagaagtgcatagtatagatgtgccataatttgtttagccattctctatcgggagacatttacttatttacttacttacttttctcttttttcgaaaaatagagatttgttgtgggggagggcggggttttgctatttttgcccaggctggtctcgaactcttggcctcaagtaattctcttgccttggcctcccaaagcggtgggattacagatgtgagccaccacaactggccaatattattattattattgatttttttttttttttagagatagagtctcgtggccgggcatggtagctcgcgcctgtaatcccagcactttgggaggccaaggtgggcagatcacttgaggtcaggagtttgagaccagcctggccaacatggcaaaactccgtctctactaaaaatacaaaaattagccaggtgtggtggcgcctgtaatctcagctactcgggaggctgaggcaggagaatcgcttgaatctgggaggcagaggttgcagtgagctgagatcgtgccattgcactctagcctaggcaacagaatgagactccatgtcaaaaaaagaaaaacaaaggctgggcgtggtggctcacgcctgtaatcccagcactttcagaggccgaggtgggcagatcacctgaggtcaggagtttgagaccagcctggctaacatggtgaaacgctgtttctactaaaaatacaaaaaattagctgggcgtggtggcacacgcctgtagtcccagctactcgagaggctaaggcaggagaatcgcttgaaccctggaggcggaggttgcagtgagccgagatcacaccattgcactccagcttgggcaacaagagcgaaattccatctcaaaaacaaaaaacaaaaacaagagacatagggtctcactctgtcacagactggagtacagtggcttgaaaatagctcactgtaatcttgaattcctggactcaagggatcctcccacctcagcctcctgagtaactaggactacaggtacacagcactgtgctggttgatttttaaattttttgtagagatggagtctcactatgttgcccaagctcgtcctgaacacctggcctcaagggtcatttagatggttttcaatttgtctctattaaaaatagacctgcaacaaatgttactgttcataccttcttgggcacgtgcatgaccttttctctctgatgagtacgaataacaatagttctttatttctttctttctctttctctctctctctctctcttttctttttttgacagagtctcattctgacacccagactggagtgcaatggcgcgatctcggctcactgcaacctccacttcccaagttcaagcaattctcctgcctcagcctcccaagtaaatgggatttcaggcgcctgccaccatacccagctaatttttttgtatttttagtagagacagggtttcgccacgttggccaagctggtttcaaactcttgaccttaggtaatccacctgcctcagcctcccaaagtgctgggattacaggcatgagccaccgtgcccgacttttttttttttttttttcagcatcttgctctgtcacccagatgggagttcagtggcgcgatctctgcccactgcaacctccttttcctgggttcaagcaattatcctgcctcaggcttccaagtagttgagattacgagcatacaccaccatactcagctaatatttgtatttttattagtgacggggtttcaccatgtttgtgaacaggctggtctcgaattcctgacctcaagtgatctgcttgccttggcctcccaaagtgctgggattacaggtgtgagccaccactcctggcccaataacaatagttcttattttagtaataataataattgcttctacttactgagcccttattgcctgagccgaagcattgctctaagccctttacttgtattaaatgatgtaattatttttacgagctgggcacaatggctcatgcctgtagtcccagctactagggaggctgaggtgggaagatttcttgagcccagaacttggaggctgcagtgagctataagctatgatcatgccaccatactccagcctgggcaacagaacaagaccttgtctctcttttatttttttctcttttgagacagggtctcactctgtcacccaaactggagtgcagtggggcgatcttggctcactgcaacctctgcctcctgggctcgagggatcctcccaccttagccttccaagtagctgggaccacaggcacacaccatcatgcccagctaatttttgtatttagccatgagcctccatgcccggcaagaccttgtctcttaaaaaaaatttattatgttgaataagagaggttttattattatttccatagtacagatgcagaatctgagcctcagttttagaaatttgcccaaaattacataaccagtaaatgacagagctgagatgtgaactcaaacatccacttcttgagtctgaatatccattttctgttttcctagctcttaccaagctagcctgctgagggactatgctagtgtccacacaggcatgggtccttcacccacagagccgcactgccaccccagggatcactttccaggtttgaggccctgggcccctggatctagggtaagacatgcatccctggagccttggaactgggcagagctgaagtttcggtccatcttggaagcactaaactacagacatgccctgtgtcttgtcccatccccctattattaagtcctgagtcttcctccctggctggtgatgtgctgagagtgataagaagataacagcaagacagacagagtgagagcgacaggctgacttacgtaacctggtggaaagtgatacaggcagattcgctgatgggaaacaaacagaaagggagtcaggcagagcttcctggaatccaggtctaggagctgccaaaaacaggcctcctctcttaggaacaattgaatgtcactgcagtaaccgaacactgctggccagagaggcctcctgcccacagcctcacagagcggcctgtgtgagccaggacaggctccagaggaaaaaagggcctggcaaggtgccctgtgaggctatctgaggagacattgcagttcctcaccctggatgggcctccaccagcacagggctgcgagttgaaggccagggaattcccagggcgagtcccaggcacagaggctgtgagctaggagggctctaacctggggttaagccctgaactcagaagccgggctcctaggctcttatcctagcttttttctgctgtgtgaccctgggcatggcataacctctctgagacctctctctctcagtcttctcattggtagaaagggaataaatatgtgatagtagataaaaataggactcgtagaaaggggataaaaatgttataagaatcaaataagccaggggcttgacaaaccttttaggtaaatagccatataatatagattttaggctttgtcggcagtacagtctctgccacaactattcaactctgctgttgtacagcacacaaaaacaacaacaacaaaaaaccaaatgactatgcccacgtgccaataaaactttatttctgggtactgaaacttgaattttacataattttcatgtgtcacaaaatattctttttttttttaaatttgtatttatttacttgtttttatttatttgtttatttgagatagagtctcgctctgttgcctaggctggagtgcagtggcacattcttggttcactgcaacctctgcttcctgggttcaagtgattcttctgcctcagcctccccagtagctgggattacaggtgtgcaccgccatgcccggctaatttttatatttttaatagagacagggtctcgctatgttagccaggcgggtctcgaactcctggtctcaagtgatctgctcacctcagcctcccagagggttgggattacaggtgtgagccactgcgcctggcctccagccatcatattttatctaatgttccattcggagacatgtagattgtctctagtttttctttctttcttttttttcttcttttttttttttttttttttttttttgagacggagtctccctctgtcgcccaggctggagtgcagtggcgccatctcagctcactgcaagctccacctcccgggttcacgccattctcctgcctcagcctcccgagtagctgggactacaggtgcccgccaccacacccagctaatttttttgtgtgtgtttttagtagagatggggtttcaccatgttagctaggatggtctcaatctcctgacctcgtgatccacctgcctcggcctcccaaagtgctgggattacaggcgtgagccactgcgcccggccctagttttgcatgctcagggctgtgaaacacatcctcagctattcttgtctgcttgtttcttaaacacctagacctggaatttgcagggggaaaagcataaacctggggcctccaatgcatgttacttaggcaggtggttgtgcattggattgctcttgttcctgggcaggacagatagtggctaaaagccaggctttgaagtcctgtagagcagagttcaaatcccagctcagtatttactggctgggtaatctttggcaggtcacttcaccagtttgagcctccatttcctcatttgtaaaatcctgccttcattggtcctcatctcacttctgactctaaaccaccatatcccaagatggggctgattagaatgacttcctcatggaagttacaattattgaaattgtaatcgcttgatgaatggaagttcccacttcttttatcccaggcagtttctcaaaagcaaaaggaaaaggaactaaggccaaaatctgggaacctacaaaatcactgggaatgaaacagaagtgtgggcattagaatggaggctcaatatcccagtccaagatctatggatctggtggaaaataacccactaaaactggctccaactataataaaagggggaggctgggctcggtggttcagcctgtgatcctagcactttgggaggccaaggcgtgcaggttgcttgagcccaggagtttgagaccagtctgggcaacatggcgaaaccctgtctctacaaaaatacaaaaaattagctgggtgtggtggtgagtgcctgtagtcctagctactgggaggctgaggtgggaggatcacctgagcccagggagtttgaggcttcagtgagccatgattgtgccactgttctctgttctccagcctgggtaacagaatgagaccctgtctcaaaaaaaaaaaaaaaaaaaaaaaaaaagaggaaaaaagaaagaaaaaaaaggggaaattcaccataagaagtatcagtcaggagtgtttctgctgttgcagaaacccaactaaatttggttgaagcatgaggagaatcaacttttatttttggtcacttaattgaaaacatcaggacaagtgccagcttccagcacagctggacccaagggccaacatgtggctccagggactctccctccgtttccagtgctgcactccagcttttgctgtgtccccactcctgggtcaagatggcctctcagcaaccgcagagccaggcaattctgtcttttcacggatgagaacagaaagtcccagaaggaagtctcactgggtctagcctggtcacatgcccatttctaaaccaatcgctgtgactgggccagcctagagctaggcagagctggcccccacggacagaaaggaggagacccgtagctcccgggagaatgcaggtgctgtttccagaaggggcatcaaggccagaaaggcaaagacaacaggtgtctattatgccacctggctgtactttttgtgagaaccgctgttatcacatgaaacacaagggcaggaagtgcagtggcctcacacatttcttaaatgagcacctgaaaggccaccaggaattgtggcagccaaatcctggtctctctatgactctgcccacaggtttcctcatctctgcttctctcttttccctctccctgtcttcttccctgagcccatgagcaaacccgactgccccatagcacctgacagcacaaccccttcctttaagcaacagcccacaagactcaccacattctcaagacagagaatctgatcacctcaaccagtcaggtgcccgtctttgtgcagtcaattctggctggagggcagggttgagtagcttgtacgcgtggtttcatggggtagttgcacctgtttcaaagagagatgggtcaccacaaactgggcagaaaccacacgatatgtccatgatgctctgcagctgaatgaagttatctacaaagaaactgaagccaaggccaggcagaagtcaggcctgaagctaagaatttgtttccccaagacaggaacattcctgcatctggaggctgaggctgcttggacagagaagtgcatccagctgccaaggtgaagctctgaaggggcctgtccatgagagcagggccaagaacgcctaagcccaccagtaagatgcaagaacacctgtgcgaaataataataatgatcatagctgggtgtggtgcctgacagctgtaatcccagcactcagggagacagaggcaggaggatcacttgagcccaggagtttgagaccagcctgggcaacctggcaaccccttccccacaccccttgtctccacaaaaacgacaaaaaatttttaaaatgataataatataaaatagcactaataataaatgttattcagtgctgctgaccaggtatcactctagacacttaaatgaacagcatttttgcttttttgtttctttgtttttgagacagagcctcactctgtcccccaggctggagtgcagtggcaccatcttggcttattgcaaactctgtctcctgggttcaagtgattttcatgtctcagcctccggagcagctgggattacaagcgtgtgccaccacgcccagctaattttttgtatttttagtggagacgggggtttcaccatgttggtcaggctggtctcaaacttctggcctcaaagtgatccacccgtctcagcctcccgaagtgctgggattacaggcgttagccactgtgcctgacctaaatgcgcagcatttttaagcctaatgatacagtcagatgggtatttattatcctcatttacagaacatatattgaatgagtgagcattaactgatctttcaccttattaattcacttagtcattcactcactcaatggataaacaattaatgaatgccaactatatgccaaataccatgtgtgctgggtgttgggacacaagcagtcctgtctttgtgaatgttacagtaaaatgttggaggctctgaagggtgagtggtcattaattagacggttagactaataagaggggaagggaaaggcattccaggtagaaggaactccatgtgctaaggcactgtgggggaagggcatgtgtggggtgggagcaatgcctgttgactgatggtgtgccagagaggcagagagccacgcagtttacacctgctggctcactgacccttaccacagtcctgtgagatagctactgctattaatatcattttgtagatgaggaaatcgaggcacagagaaggtaagtaactttcccaaggacacacagcaccattagcagtgaaagagcagcagttataacccaggcctgtgaccagaattctgaacatctctaatctttaagtaaaggaaggcaggagaaattggtccatttggggcaggtgtgttttctgggaaccttccagcactattttcacttgcagctgtagccacaggctacatagatgatttccagaatggaggggaagaagagtgcacccagcctttcctggccacaggcaggaatccttttagccagttattaatgctcagccacaggagatgccgcagtgagacacacagaggagccagaccagggagaggcagcaagaaagacagcattgatcctggaggtatacatttaggagagagaacctgtcagaacagaaagagcttggacttgggaccaggccaacctcagcccaaatggcagccctgctacccaccagctctgtgaccttaagtaagtttcctcttagtctccagttctttattcaagcagagtaaaagtatgcttcccgcctccctcccacctccatcctgtagccaacagtcccccctccccagaggcaggcactatgactagtttcatgcatcatcttccgggtaaattgtagagagatagatggatgaatagaagtatatatgtgtgtgtataatatagtacacacatatatgcaaatattgtaactattgggatgctttgactaagtacaaaaaaacctacagatgcaagatttacttattaagaactgtggagataataaatgcctaatttctgtgtccaactgctcattaatgtctagtaagaatctcaaatttaacatggttaagattaaacttttattgttattattattattttgagacagagcctcactccgctgccctggagtgcagtggtgcaatcttggcttactgcagcatcaacttcccaggctcaagcaatcctcccacctcagcctcctgggactgcaggtgcacaccaccacgcctgtctaataaaattaaactttatgattcctcaccctccaaacctgtttctcccttactaaatacctggttactcaagccaaaaatacactgaaataattctggatttttctctctttcactcactttttttggggggtgctggggtgcagtggcgccacctcagctcactgaaacctccacctcctgggttcaaggagattcttgcgcaccagccactggagtagctgattacaagtgtgtgccaccatgcccaggttttttttttttggttttttttttttttggtatttttagtagagacagggtttcgccatgttggccaggctggtctcgaactcctcacctgaagtcatccacttgccttggcctaccaaagtgctaggattacaggcatgagccaccacgcctggcctttcactcactttttacatctgattcatcacatagtcctgtccagcttttctgaaaatctagagatagatccaccattaagtgaatgaagcaaagctgagatcagggctcttcaattgcacagccccttccaaatctagcaatatgttcacacagtcatgtgtttctgcaacatctgcaaaggtaagtattttagctgcaactggttagacaaggtctctccagctccccaacgttgcctgcctgggaatgtgcatcgggtggcatttggggagctatgggcagggatcagctaaggggaagatgagttagggaatccattaaatttgggtttagtggatgtaatcttttttttgttttttaatagaggtgggggtctcactgtgttgcccaggctagacttgggctcctgggctcgagtgatcctcccacctcaggctcctgagtagctgggactacaggtgtgcaccactgcacgcagctttagcgggatgtagtcttgtagctcacgatcttttcggtgaataaggaaagtattgcttgttgtcctggcagagaaatggcttccaggatactccttctgcccatgctactgactcacccagtatcaagacacaaaagtctggcacggtggctcatacctgtaatttcagcactttgggaggccaaggcaggaagattgattgagcctaggagttccagactagtctgggcaacatagtgaaaccctatctcttcaaaaaaaaaaaaattgttttagctagcctggagtggtggtggtgtgttcctgtagtcccagctattagggaggctgaggtgggaggatcacttgagcccaggaggtcaagactacagtgagccatgattgcaccactgcactccatcctgggcaacagagaagccctgtctcaaattaaaaaataaaaataaaaaaacaggcacaaaagtgactgggcacagtggctcacgcctgtaatcccagcactttgggaggccgaggcgggcagatcacgaggtcaggagatcgagaccatcctggctaacatggtgaaaccctgtctctactaaaaatacaaaaaaattatctgggcgtggtggcgggtgcctgtagtcccagctactcgggaggctgaggcaggagaatgacgtgaacccgggaggcggagcttgcagtgagccgagatcgtgccactgcactccagcctgggcagcacagcaagactccatctcaaaaaaaaaaaaaaaaaaaagacacaaagttatagtactaaggatgccagagcaggaagagagaaggaatctgaatccttagtgatagcattgcttccctaaatgaaccaactgtgaaactgttctacatccagactcctcataggtaaattatacatttgcgggttgggtattgttttatatttgcagccaaaagcatcccaacagatacaacaatatatgcttccatgcctctaaagttaacctggaaggagatatacaagactggtaatgctgaatgcctctgtggagggggacaggtagcagaggggaatgggagggagacctatttaattcagatttttttgtgtgtgcttgaattttgtttctctggggccaactttcaccatttcaaaaagtagatagtaaaacttcaaagtatgtggaacacttgggaacttttttttttctttgggacagaatcttgctctgttgcccaggctggagtacagtggcacagtctcggctcactgcaatcttcttgtcccaggttcaagtgattcttgtgcctcagccttccaaatagctgagattacaggcatgcaccaccacgactgattaatttttcgtaattttagtagagatgtgatttcgccatgttgccaggcttgtctcaacctcttaagctctggtgatccatccgcctcagccttccaaagtgctgggattacaggtgtgagccacggtgcccagccaggtttttcatttcttttaagcgcatgaaagaagtacatttaatctggcaaggctggctcttgctgaagtggtctcggagaggccattggaacaacaaagaaagaaatgtcattggcaagttcagatactaaagggttggaaagtgatctggcactcagcatcctgcagcttgagggacatttggagttcttcctgcctgcttcccactgctgagcaattcccagcccagcctgatatttcaaatgatttccaggaaggggaacctggcaccagctgtacccccttgaagttcttgtgactgtcttcttcaaatgcatccgcctgcttcttcttcaaaagacaagagaaaatgctgctggcgagctaagagacttcaaagatggttttgtcatgtgttttttgagtcaagaggctaagtttctgagaggaggagagatttttttcaaggacacatacagttaattggtgacaggactccagtgtccacttagctaggctccttcttgctcctgttctgcccagggtccttagttcttccaggctgttccacccagtaggcctcccaggttctcaaagtgatagcacagggagatctcctggggaaaaaaatgaccttgacatccatggtctgtgagtctggggaaggctgcattctatagcagcctcctggagatttacagagcatgttggcagattaagggttctgcagagtcctgcataaagaaaactacttaaaaaaaaattcctggccaggcacggtggctcacgcctgtaatcccagcacgttgggaggctgaggcgggtggatcacttgagatcaggagttcaagaccagactggccaacatggtgaaaccccatctctactaaaaatacaaaaaattagccgggcgtggtgatgcgtgcctgtaatcccagtgactcgggaggctgaggcaggagaatcacttgaacccaggaggcagaagtggcagtgagccgagatcacacaactgcactccagcctggtcttgctgtgtcacaaaaacagagtcttgctctgtcccaaaaacaaaaacaaaaacaaattcctcccaggtcaggatatcaatagtactcacctcgtagtgttgtcatgaagattagtatcacgaggctacaaccatttatcggatatcagagtttcaaaatttacactaaatgggttcaataagattatgtataacctcaggacaggtcaggatttccttccaaatgagtgctggcatcagacttttgagaaacagttcatttcatagccttttttgttttgttttgtttttcagagatgtttctagttgtcattatgggctttttttttttttttctgatgcctgtcttcctcctgcagtatgatagccttttttgattttagaattgtggttaaaggaatgaggacttgtaatgaagataatagctaatatttattgagcatttttgtgaaacccggcaatgttccaagtgcctcacatcaatgaacttattgaatccacagagcaactgcacgtgacagatagtgtggtaaaccctgtcgggcaaatgagcaaactgaggcgtagggggactaagtaacgcactcaagcagcagagctgggagtaaatgagacaatatgtatgaattgtttatcacaatgcctagcacataatcaacaatccatataaacattagctattatcctcattaatgatgggagaatcatgactaatcttttttattttttgtttttcagacaggatcttgctctgtcaccaggctggagtacagtggtgcaatcatggctcactgcagcctcaatctcttgggctcaagcaatcctcctagctcagtccccaagcagctaggacaggtgtgtgccaccacactcagctaagtttaaaaatctttgtagagatgaggttttgccatgttgcccagactggtcttgaactcctaggttcaagcaatcctcccgcctcagcctcccaaagtattgggattacaggcgtgagccaccacgtctggccttgactaacttttatcttctttgcacccatgtagaatttctaattttactataataaaaatattctgggctgtgtgtggtaactcatgcctgtaatcccggcactttggaaggccaaggtgggcggatcacttgaggtcaggagttcaagaccaggctggccaacttagcaaaaccccatctctactaaaaatacaaaaattagccaggcatggtggcacatgcctgtagtcctagctacttgggaggctgaggcatggggaggcagaggttgcaatgagctgagatcatgccactgtactcctgtgatggagtgagactctgtctaaaaaaaaaaaaaaaaaaaaaaaattatatgtgggggaaaatgtttttcaaaagattagacaatttctgaattgagcctaatatctcaatatctctcagtctctcttctcactccatcaggtctgatgctggtctgggcagaaatggatttgtcacctcaaagatgacttccttgggcacaactaggccagacgctgggtaccttgtggtggccctggaggggtacagcttcaagaaagaacttgccgatcccctgcaaagaatgcagttagccaacagccttcggcctcagcacatttgagatctgccttaactttcaagccaaggctagctcttcctgagcaggctccagcgaagaacctgcatggagggactaggacccgaccagttctgcccaacatggggctcccctaacaaacagtctttgttctggagctcccaaactgagttgacaaagcctctgtcagccctgcattgccgtctgaggctcccctgctgagtgctgctttcacccacttttgtctttcacaggcatgacactcctccctctcgtcctactagctccactttaccatctgcttcccagaggactggaactgacatgctgcctttactaccccgcaaccattctcaccccacctccacatatgcctgcccaaataatcttgattttgggctcagctactagatcgaaatcccttcatctttggagagtgggttgctccccagccccagcagataaatcatgatctgtcttaagtagacccagtaagtcctttctgttctacaggaattggtccaggatgggtgcctggtccgccttttagccaatgagaggtcaggggaaatctggggcttcactttactaataacatagaccttcaggtagttaaagccttctgccctgccccttcccttccattttgatcagtgtcctgtgatcaaatgatgtgaggcactgcagcagctgttttgggcaatgagtttgaggacaaaagccaactgctgaagatgacagagcagaaagatgagaagagcctgagtcctgaagaacacccccgagcccctgcaatgactctggagctgctgacctccacatgttttgctataaaaaaaaagattgcatttcttctttgctcaagccaccatgaatcaggcatgctgtgactggccgctgaaaatatggtaacgcatgcagtcacattccccatgttctattctccagattaccttcaaacaactgaaggtacaggactcagagttcccgttgaggtatttgaactattttcctggaagggaaatattcaaaaagtcctctcagccccgggcacagtggcttacactgtggattacaaaaggacttttaaggactcataggattacaaaatcctgtaatcccagcactttggtgggcaggtcacctgagatcaggagttcaagaccagcctggccaaaatggtgaaatcccgtctgtactaaaattataaaaattaccgagtgtggaggtgcatgcctgtaattccagctactggggaggctgaggcaggagaatcacttgaacccgggaggccgaggttgcagtgagctgagatcacaccattgcactctagcctgggcaacagagtgagactgcatctaaaaaaaaaaaccaaaaaaattatctcatttccaacttgccaacacctgtgataatgtaaaccaaaaatgaaattctaagcccctcaactgactgaatgaatccccatcttcaccaaggtgatcccaaagaaaacctgaaaaactagttcaggccatgatgggaaggaaggtcagatatgcctcttcgcctcttcatactttcctccctttggagtttaggcacaactggtcagcattcatattaaaatacagatcatcatagggcgggcatggtggctcacgcctgtaatcccagcactttgggaggccgaggcaggcagatcacttgaagtcaggagtttgagaccagcctggccaacatggtgaaaccccgtctctaccaaaaatacaaaaattagccaggcatggtggcaggcgcctgtaatcccagctacttgggaggctgaggcaggagaattgcttgaacctgggaggtggaggttgcagtgagctgagttcgctccactgcaatccagcctgggtgacagagcgagactccatctcaaaaaacaaaacaaaacacaaaaaaccagatcatcagatggacaaaacagactctttgtgcaataagataccaaattccaacctgaccctgtatgtgatgtagagcataacagtgacagataacaggccctaaggaaagtcaaagtattttaccccaagatatatttatttgacatattttggagtgaccctgcaaagcccactctttgccttctgtagcgaatccccttcctgttccaggtcttttcctgatccaggagagaattaaactaagagtctaacaccttttgaggtctaataagagaaatctaccatctatcctgtctgaagctgggtgcttagaggcttcatctacataaacaagaaccttggcttccacaactctcttaccttaactcaagcatttctttttctttcttttttttttttttgagttgggttctcaccctgtcacctaggctggagtgcagtggtgtgatctcagctcactgaaacctctgcctcccaggttcaagccatcctcctgactccacctcctgatagctgggagcacaggtgcgtaccaccacgctgggctaatttttggtagagtcaggggtctctccatgttgcccagtctggcctgggactcctaggctcaagcgatccacccgtcttggcctcctaaagtgctgggattataggtgtgagccaccgcacctgacctcaaacatttctttatgctgacttcaactcctcaggcaatgcttcactctttcaatcaattgccaataaggaaatcttcgaatccacctatgccctggaagtccctctgcttccatctttgagatgtcctgccttttgaggctgaaccaatgtatacatttcatgtattgctttatgtctttgtttgtgacttccatctctctaaaatgtataaaaccaaactgcaacctgaccaccttgtgcatatgtcctcaggaccccctgaggctgtgtcacgggccatgatcactcatatttgggtcagaataaacttcttcaaatattttacggagtttggcttttttcctcaacaatacttacctctcccttgcttcaaaccctcccatggctccccagtactttttcagttttttttttgagacagagttttgctctttttgtccaggctggagtgtcgtggtgcgatctccgctcactgcaacctctgcctcctgggttcaagtgattctcctacctcagcctcctgagtagctgggattacaggcacccgccaccacatccggctaatttttgtatttttagtagagacggagtttcaccatgttggccaggctagtcttgaactcctgacctcaggtgatccacccgccttggcctcccaaagtgctgggattacaggcgtgagtcactgtgcccggccacccccccagtactcttaagacagagtttgaactcctcactgataaagacctgcaagatctggcacctcctggtcccctgccatcacccatgacccttcctacttcatacttgttccccagccagactgaactacttttaattgcctaatattattactagaaaggggtcctgatccagaccacaagaaagaattctctcacaagaaagaattcgggatgagtccacagagtaaagcaaaagcaagtttactaagaaagtaaaggaataaaggccgggcgcggtggctcatgcctgtaatcccagcactttgggaggttgaggcagggggatcacctgaggttaggagttcaagaccagcctggctaaaatggcgaaaccccatctctactaaaaatacaaaaaattagctgggcctggttgtgcgcccatgtcatcccagctactcaggaggctgaggtatcggaattgcctgaacccaggaggccgaggttgccatgagccaagatcgcaccactgcactccagcctgggcgacagagtgagactccatctcaaaaaaaaaaaaaaaaaagtaagtaaaagaataaaagaatggctattctgtaggcagagcagcagcatgggctgcttgactgagtgtatttatggatacttcctaattatgtgctaaacaaggggtgaatttttcatgagttttccagggcagggttggggagctcctggaagtgagggtttctcttctttttagatcatatagggtagcttctggacattgtcatgactctggtgggagtgtcttttcgcatgctaattagtgtataatgagcagtgaggacaaccagaggtcgattttgttatcatcttggtttggatggcttttgacctgcttctttactacctcttgttttgtcagcagggtctcaatgacctgtatcttgtgataggaatcctgctggcctcttatctcaacctgtgagaaagaatgcctaacctcctgggaatgaagcccgttgggtctcatccacattttacccagcccctattccagatggagtcgctctggttctaacacctctgacaatatcctatattacctccagacatttgcgtatgctaatttctctccctcctcccccatttcatgtggctgtctcctccttcgtcaggtctcaactcaaatgttttctcccccaagaggccttccttgatttcttttctttttttttttttgagatggagtctcgctctatcacccaggctggagtgtagtggtgcgatcttggctcactgcaacctccgtctcctggattcaaacgattcagcctcttgagtagctgagattacaggcacccacaaacatgcccagataatttttgtatttttagttgagacggggtttcaccatgttgtccagctggtctcaacctcctgagctcaagtgatctgcccgccttggcctcccattagtgctgggattacaggcatgagtcaccgcacccaaccaccttccttgatttctagactggattctgaaaccccttagggctcccattgcacctttgtgtttaccctgttgaaacagctatcaaactggattatggttgtctgttttcaggactgctctctgctctctcctatactacctctagctttttttctttttcagatgtagttttgctctgtcacccaggctggagcgcagtggcactatctcggctcactgcaacctccgcctcccagattcaagcaattctcttgcctcagcctcccaagtagctgggactacaggcgcacaccaccatgccggctaacttttgtatttttagtagagactgggtttcaacctgttggccaggctggtctcaaactcttgacctcaggtgacccaaccgcttcagcctcccaaagtgctgggattacaggcgtgagccgctgcgcctgacctctagctcttttttctaactgttggcctgctttccaaaagttggcttaggcccatgactaggttcttggctgtagactcacaaagaactgcttcccagagacctctccaccacctcccttttgcagttttactccagcagttggatgtgcttggtttctcaatctgactggtgactcttctctgatcctctaagtccttttttgagacagtcttgctctttcccctgcaaattccaggtctaggcgtttttctttttctttctttctttctttttttttttttgagaaggagtcttgctctgtcgcccaggctggagtgcagtggtgcggtctgactctctgaaggctccatctcctgggttcaagtgattctcctgcctcagcctctcgagtagctgggattacaggcatgtgccaccatacccagctaattttgtatttttagtcaagatggggtttctccacgttggttagtctggtctcgaactcccaacctcaggtgatccgctcgcctcggcctccgaaagtgctgggattacaggtgtgatccaccgtgcctggcggacttttgttccttttagaagaaaataaaaaaagaatctagaggattggtgaaaaataaaagatgacagtagaactctaggaagtgttttttttttttttttttgagacggagtctcgctctgtctcccaggctggagtgcagtggcgcgatctcggctcaccgcaagctccgcctcccgggttttacgccattctcctgcctcagcctcccaagtagctgggactacaggctaatttttctgtatttttagtagagatggggtttcaccatattagccaggatggtctcgaactcctgaccttgtgatccgcctgcctcggcctcccaaagtgctgggattataggcatgagccaccgcgcccagcagaaaggagttttaatcattacttaatccaacgcttttttgttgttgttgaagagggaaaactgaaacgggaatgtaatttgctcaggatcacatggccaagttgtagaatcaggctgcactctagcctgggtgacagagggggactccatctaaaaaaaaaaaaaaagaaaagaaagaaaaagaaattattaacaatgaaaattaaaacaaataaaaatgttagaggctagactccacagccagcccactctcaccctctgtgttgtaaatgcttgcatgaggcttcaggcaactttcaggctgacaaggaagtttacagcacccagtccatagtgggagtgtcctaatgaatgatgaatgcttatcgtgtgcaacagctttttcttcttcttcttttaaatgacctggtcagcaggaagtagcaagagcttcttaatagaacattgggggagccaactgggagaggctcaaccagcttttgaaccagaataatctccgagaagtcacagccttttttgtttggccctcttttcctgcaggtggattcattagagtactttgagttgcatgtaaggagactgggtcaagagggccttaagtgactagagtacttagtattatctcaggtaacaatacaccaataggtggactgtttcagggttggctatttcagcgtctcagttctggggtattggattagcttgttactggacaggggtcccaatccagaccacaagagagggttcttggatctcgcgcaagaataaattcagggtgagtccgcatagtaaagtgaaagcaagtttattaggaaaataaaggaataaagaatggctactccatagacagagcagtcctcagagtgcctggttgcccatttttatggttatttcttgatcatatgctaaacaaggggtggattattcatgcctctccttttagaccatatagggtaactttctgaggttgccatggcttttgtaaactgtcagggcactggtgggagtatagcagtgaggatgaccagaggtcactctcatcgccttcttggttttggtgggttttggcaggcttctttactgcaatctgttttatcagcaaggtctttatgacctgtatcttgtgctgacctcctgtctcatcctatgacttagaatgcctaagtgcctgagaacatatcccagtaggtctcagccttatttcatacagcccctactcaagacggagttgctctggttcaaatgcctctaagcttctcaaggattcctcatggtctcaaaatggctgctacaacttcaaatgtcacattctagcacagcaatgtccaaaggctggaagaatatgtgtgagagagaaaagaagttgggaggtgggaaagtttctctcttttaatagaaaggaacttccttcccagaaaccctcagcagacctccaccaatgcctcaactgccaggactgcttccaatgcttactccaagactgtcaacaggatttccatggctggctcagaccaatcagaattaatttcctgcacatgacatgttgtgttttgttccaacaaaattaggttctgttggcaggggagaaggggaatgaagtaatcaacagaatctcttttagggctttatttataggtcggtgcaaaagtagttgtggtttttaccacttcttttaaaaaatggcaaaaaacacagttacttttgtactaacctactatttatttattttctgagacagggtctcattctatcacccaggctagagtgcaggggcatgatcacagttcagtgcagcctcgacctcccaggctcaatcgatcctcccaccttagcctgccaagtagctggaactacaggtgccaccacacctggctaatactggtattttctgtagagatggggtttcgacatgttgctcagactggtcaattcctgggctcaagtgatcctccatccttggcctcccaaagtgctgggattacaggcatgagacaccacatgctgccatatggctttgataatttcctgagtgggcaccatggatctctttttgtgatccggaccaaaaagcaacttgaacttcccaggatgctcagatgcccaaagcacctaacatgaggggaagatttatggcctagactagactatactggacaccaatttctttgggaaacctcccctccctcgcttccactccctgcagttcaggtgaggctgtttataccccttggttccaccaagaagcatgtgaccaggcctggacaatcaaagcattgccttcttcaagtgacaatgattggttcagagatgaaccacaacttgagttcgtccaatcagagtgaatgctgcaacttcagcagcatttccaggaagtgacctcctttcccaccacactcatacctggcaggatgcaggcctggagctattggttgccagcttgctatcaagtagatactaagactggagccaactcactgaagagcaaagccaagagatggcgagagactatgtctggtaacctcatttgagttcctgaatccagccaggtctgaagccagtacttttcagttacttacttcagtccttttcagttacttaagccaataaattgctttttgcgtaaaaatcagtttcaaatggggcttctgtcatttacaaataaaagaatcctaggctgggcacagtggctcatgcctgttatcccagcactttgagaggccaaggtgggaggattgtttgagttcaggagtttgagaccagcaacatagcaggaccccatctctatctgaaaaagaaaaaaaagggccgggcgtggtggctcatgcctgtaatcccagcactttgggaggccgaggtgggtggatcacgaggtcacgagatcgagaccagcctgatcaacatggtgaaaccccgtctctactaaaaatagaaaaattagctgggcgtggtggcacatgcctgtaatcccagccactcggaaggctgaggcaggagaattgcttgaacctgggaagcggaggttgcagtgagccgagatcgcgccactgcactccagcctggtgacggagcgagactccatctcaaaaaaaaaaaaaaaaaagaaaaagaaaaaagaagtatacatacaaataaaagaatcccaagtttctcagtgtttggaggaacatgtttgaaagacaaattgaaaacatgtttgaaagacaaattcccaggtgaccgagacacctgtgctgggacctgaacctccacctttggaacaagctcctccgggacccctaatgtatgtagtcctgcctttatagtctgagactctctgacccagactttgggggaaggacggtctcttaattctgcatgggaaacaaaagacacccagtcctttccatcacaaagccccagctaccttcttggcaaagagtagggaaatgcctttcattctttcccaatggccctggaattgagaaaatgaaagacagttgatttcccaatcaggttattccaccacgttgaactttcggtaactgtccttgccccatcgtgttgcgaaagcattcaggttgaacagtgttcaggaagaatactcaagcaaaaactggtttgcagccaaatacagagactgcaaaccccagtggcttcaggggccaggcagggaaagtaaacatgtgaaacaatagggagtagtcctgcctgtggggaacaggggagttctcatgccccagcctaataaatgaaaaaattatttatacaccacagtggaaccggagatgcacctaaagccattgggatgtggtttctctttttcatctcactgctctgtctctgatgtggcttcattctcagaggattgtgggctcacaagccaacatcctgacagtttagaaaccacaggagaaatgtttctctttctcaatcgtttcaacataaatcctggatgaaactgttattggccttgtttgagttcaaatggtcatccctgaaccatccctgtacctaaaagaggtatggtggtgtcattggtcagacctgagtctgacccatcctagaatggggttcaggcccactttaaccatatagactgagactggggaatgggaaaggtttcatgcctttgtttgggctccctcagaagcagactctgagatgaggatttgaggtgcaagtggattatttgggagatgatcccagaaagcaccattaggggattgagggaatgagacagagaagagaagcctgcggaaacaggaagtattatccagcaagttactactgtggacaactggagcacaatcccatcagggaactctggcagccagtgtagagcattgttttagtctattttgtgctgttatgatagaataccacagactgggcaatttaaaacaatagaagtttatttggcccatggttatggaggctggggagtccaagggcatagtgctgtcatctggcaagggccttcatgctgcatcattcatggtggaaggtgaaaacgtaagagaaggtgagggtgaacaagagattgaactcgcagccgcaagccctttcacaactggcattaatccattctcatgagggctccattaggctccactccccagcacatttgaattgcggattaagtttccaatacatgcttttggggggacacattcaaaccatagcaaacatagacctcaatgttatcccatcttagtgctgagggagctggggtattcatctaccaacttctgtcagtcattgtctgacagttgctagcaggagagtttttgcccagaacttccagcatggaagagcatggtccctgctggtctgagaaagtcctcagacaaagagacgaagcttgggccagcgtgcattgaaggttaggacaatggccagggcacctatagcctttgcttcattgtctgaaggaaaattggggtgctatgatcagaagaaggcactgatgttgcacaggtcaaacaaacatgttcattcaaggagtgaatcggttggcccattcatcgtctgagtccattaaccaagcaatggcaaggaagggtatactctgttgctctaaggaactggcatggaagctgcacttggcacttttgttcacatctcataggccaggatgtgatcagatggccatatctacatgtggggaaatgtagcttttgactgtccagccaaatctcagggattatggctaggtgtggtggctcactcttgtaatcccagcactttgagaggctgaggtggaaggattacttgagcctagaggtttgagaccagcctgggcagcaaagtgagactcttgcctttacaaaaaaaaaaaaaaaaagtttaaagtagctgggcatgttggcacatgcctgtagtcccagctacttgagaggctgaggcaaggaaatgcttgggctcaagagttcaaggctgcagtgaactataatagtgccactgcactctggcctgggtgacggagtgagaccctgtctcgaaaaaaaaaaaaaaattacagagattctgctacttaaagaaggggaaggaagggccaaatgttttttcctggcaagactttgtgtctatatttcagaaggaatgccttcccagtggacttcagcctacatctcattttcctgaaccatgtctcactgcctccactggagaaccaagtatttagcttcctggtctctctaatagaagaaggcaaggggaaggggattgggagtgggcagtttgggcaggaagatcaaccatcctgatttgcctgggactaaagatattctggagacatgggattttcagtggtaaaaccaacctccaggatctgcagccacaccctatgtagcttgagaccttaactccagttggagaaatgttatcttctctgtcacctcctcctcctaacaaccttctctctctgttcatcacttcctcttcaactaaaaggtggccaggtcctctgctatgccctacatccacttacactctgtcctcatggttggacctccttggaccccaactctgccctgacttctgggaacttcagtggtgccagagcctctgtccagctctcagcatctcccttacctccaccatcttgtttccggccatcttgcgtccttggagtccagagtttgcaaaggtggaaatggagaagctggagagagaaagcgcttgctggtctcactgaaacagtcaggactcaaactctcagcccaaggctcttcgctctgcacccctcaaaacctttggtgcctgttattcaactagcttgacatttctccagctctgaggtgatacctctctccaagatgcctgcagtcagagggcagggggcgtggcacagagtggggcctcaagaaacactgcaaaatacctctagggcccctttctggctctcaaatgatctcggtacgacttgacctgaccaaacagaaagaattcaggctccctcctcaaacctgttcccctaccacctcctaagcggtaggggtggtttggaccccaataatgacatttttatataacttggagtttattattttttctttttcttttctttttttttttttttttttaagacaagagtctcgctctgtcacccaggctggagtgcagtggtgctatctcggctcaatgaaacctccacctcccaggttcaagcaattcttgtgcctcagcttcctgagtagctgggactacaggcatgcgccaccgggcccggctaatttttgtatttttagtagagacaggattttgccatataatttggagtttcacaacaccagcactatttagattttgggccaaataatccttgagtgggggtgggggtgggggctgtcctgttcactgtaggaggtttaggggcaggcctgacctccacccaccagatgcccagagaaccctcctccccagttatgtcagtgcctccagacattgctaaatgtcccctgggagacaaaaatcactcctgaaccactgatctagacggtcaatattttcttaatataaaaagtggggctgggcgaggtggctcatgcctgtaatcccagcactttgggaggccgaggcaggtggatcacgaggtcaggagatcgagactatcatggctaacacagtgaaaccccgtctctactaaaaatacaaaaaattagccaggcatggtggcgggcgcctgtacttccagctacttgggaggctgaggcaggaaaatggcgtgaaccagggaggcggaggttgcagtgagcagagattgtgccactgcactccagcctgggcgacagagggagactccgtctcaacaacaacaaaagggcggggggagcaacaagcaacttcagaaaacgaagtccctttcaatgagtacccaccttctgtggaaaaacctcaagctcactactcaaatgcagcttggaacaaaggctctggcaaccctgccatccagctggcttctctcagtgagtcacactcagagatttctggcgtcactgccactctccccaccccctctcatgcagaacaatgggtctcactctggctctgaccttcttcacacccagcactttactccattttcctggactgggaaagccctttatgttgtgggcaactttgtttgtgctaagtcaacagaaaatgcttcttggcctctaccctcctgagagcacatggtgcattaataagtttaacccagagtttcccaaccttggcgctactgacattttgggctggctcattctttgcttcgggggctgtcctgtgtgttgtctgatggttagcaacatccctggcctccattcacagatgccaggggcaacaccacacctggttgtaaccaaaactttctccagacattgtcaaatatcctctggggaaaaaaaaatcaccctcggttgagaaccgtcgtcaactcctactaggaaccactgaggttagtaatatttttattattattattattatttatttttttattttttgagacagtcttgctctggtacccaggctggagtgcagtggcactatcttggctcactgcaacttctgcctgccggattcaagcgattctcctgcctcatcctcccgagtagctggaattacagatgtctgccaccacgcccggctaattattttgtatttttagtagagacagggtttcaccatgttgcccaggctggtctcgaaattctgacctcaagtgatccacctgcctcggccttccaaagtgttaggattacaggtgtgagccactgtgtccagccatattattattattttagagatgaggaaatcaggattatggaagtgtgatgacttgttcaggtataaggggcaaagtcaggaattggaatttctcccaagccagtgattttcttttccttttttttttttttttttttttttgagatggagtttcactcttgttgcctaggctggagtgcagtggcatgatcttggctcactgcaacctcggcctcccgggttcaagcaattctcctgcctcagcctcccgagtagctggtattataggtgcctgccaccacacccagctaattttttgtatttttagtagagacggggtatcactgtgttgaccaggctgatctggaactcctgacctcaggtgatgcacctgcctcggcctctcaaagtgctgagattacagacatgagccaccgcgcccggcctaagacagtgattttcaaattcgctaactgataaacgtcactggggcccttgctaacagaggcctggccccatgccagacccactgcatcagaacctttaggaaaggggccaggagttctatattctctacaagattcctttcctgacaacctgcaaacatcaatatttaacagccaatattctctgtttttatagcttttctcacatgagcccccactgtttattttttaccttttgttgttgttgtcgttataaatgagacagagtctcattatgttgcccaggttggtctccaactcctgggctcaagtgatcctctcaccttggcctcccaaagtactgggattataggtgtgagccactatgcctggtcttttaaatttttttcgagttggggtgcactggctattcgtaggagtgatcatggcacactatagccttgaacccctggcctcagccccagaagctgggactacagacacacgctcagggtgtccagcttgccattcccacttcagagaagaaactgaagcacacagagattgtgacttgcccaaagccattcagaaagtgagaataggccgggtgcagtggctcaagactgtaatcccagcagtttgggaggccgaggtcggaggatcacttgagcccaggagttggagaccagcctgggcaacatggcaaaactccatctctacaaaaaatacaaaaattagtcgggtatggtggcactcacctgtagtcccagctacgtgggaggctgaggtgggaggattgcttgagcatgggaggtcatggctgcagtgagcaattattgcaccagtgcattccaacctaggtgacagagggagaccatctcaaaaaaaagaaaaaaaaaaatgaggctgggcacggtggcttaggcctgtaatcctagcactttaggaagctgaggcaggcgattgcccgaggtcaggagtttgagaccagcctggcaaacatggtaaaaccccgtctctactaaaaatacaaaaattagctgggcgcggtggcacatgcctgttaatcccagctactcggggggctgaggcaggagaatcacttgaacctgggaggcagaagttacaatgagccgacattggaccactgcactccagcttgggtgacagggcgagactctgtctccaaaataaaaaagtgagaagaaaaataaataaaatttaaaataacaaaaagtaagaaacagaaacatacacacacacaaaagcaaacaaaagaaaacaagaaaaggaaaaaatgaaacaaactagaaaaaacaaaatgagaagaatgtagactgtcatcatgtgccttggccatccctccaggaagatgtcttggagctgggattcgtggataaacaagataaacaagatgtatacattttcctgtgtgcttgcagctacacacacacacacacacacacttgtgcatgcatttggacacacaaacactggggccagagagaggcccagcctccccttagacacattgttgtccaatgtcccccacccccagttggggttctgtaagtaaaaaagaaggaacaggatgagtattcaacaggcaacctttaggttttccatggacctcacctcatttgatagacagaaaagtttctacagcaagttcattggcaggactaggccttgagcccactccctgggacagcggactccacaccacctgttacaactggagattgagtgtctgccggaagctgtttcctggggaactgcagccagctgctggccacacaggagctctttatcccccaccaactcacctccctgggatctacccaggacctgccttcttgagtaacaggatgtgaccctatgtcaccagggcacttgctgcccattgaaagtcctcatgagtcattctccaaggttccaagggaaaaaaaactcctagataggggcccatcccagaaagaaataaaacactggcccagggccgagactttcagagaaaccagctggcctgcttgtgagtgggaggttgcggggggtcaccttgaaccgaggtctctctggacagaactgttttcttattcaatcattcattcatcatctatttatagacatgacatttattcatggattcagctaatatttattaggaggggcaaaataactctcacttctaacctacacatttttgagttgtttacattcattattacacaagtatgtgctgctttcatttttttaagctttgcttttaattaattaattaatttatttatttagcaatcccaggatggagacagatttaattattttaaaataacaggccaggcgtggtggcacacacttgtaatcccagctactcaggaggctgaggcaggagaatcgcttgaacccaggaggtagaggttgcagtgagccgagatcacgccactgcactccagcctcagccacagcctgtctcaaaaattaaaaagagagagagagagagagagagatgctgctttctgatccagaggacatacatgccccactggcaagacagaagatccccaattcggacagctacctggagaagttgacctctaagctgaaaactcaaggatgaacgttgccaggtgacagggaggaaattaccagaaatggtgctctgggcaaagggaacagcatgtacaaaggtcaggagatcatgcttttttccgaaaatgcaagtgtttgagaccatactgtaggaagtgggagaggaagtgatgagctcagagaaaaagacagaaaggcagagagcccacttaaaggaatggctaattaaccacccccattccactcttcccgcccacctccccaccctcatcccactcctaggaccatgactcagtcatgaggttttcacactctctcactttaagctgggcagtttctgtttctcagccaatgtgtcattcatcagcagatcatgtcatcccccccaatccacagcatggttccagaatatcagctgatcctcgtgaattggaccgcaaatcttccagagttttttttttgtttttttttttttcttttttgagatgaggtcttgctcttgtcacccaggctggagtgcagtggcgcgatctcggctcactgcctccgcctcccgagttcaagcgattctgctgcctcagcctcctgagtagctgggattacaggtgcctgccacctacacccagctaatttttgtagttttagtagagatggggttttgccatgttggccaggctagtctcaaactcctgaccttttgatctgccctcctcagcctcccaaagtgctgggactatagacgtgagccgccacactcggccgcttccagggtcttacaaggcgaaaaaaatcttacattgaaaatcaagggagcattaataaatattatagcactgggtgcatcgcccacagataggcaggcaagttttgttcaactggaggcactttatgactaggtctaaagtcgccatttatctgagattgtcctgtctctagcagctgggtctcatttcatgctcagaggaaacttacgaggaaaatgcttttgctatccccacttcacagaagagaactgaagcctagaatgtaagacactcacctcaaatctcatatacctgatcactttttttgaaacagggtctcaagcagccaccccgactggagtgcagaggctggaacacagttcactgcagccttgacctccctgggatcaggtgatcctcccaccttagcctcccgattagctaggactacaggtatgcaccaccacacctagctaatttctgtattttttcttccaagacggagtcttactaagttgcccaggctgcagtgcagtggtgcaatctcagctcactgcatgagatcgtctgctgggttcaagtgattgtcttgcctcagcctcccaagtagctgggattacaggcatgtgccaccacacccgactaatttttgtatttttaggtatttttaggagagacggggtttcgccatgttgaccaggctggtgtcaaactcctgacttcaggtgatccacacactttggcctcccaaagtgctgggattacaggtgtgagccactgcatccggccgcctggctaatttttaaaaattatttgtagaaatgaggtcctgctatgttgtctaagctggtctctaactcctgggctcaagagatcctctcacctcggcctcccaaaatgctaggagtacaggcgtgagccactgtgcccagtcatggtctttgtttaatctttacaatagagcatccccatttacgatatgggaaaacagaggcccagagagctgaagcaacttgccagagacatagcaaaagtaagggagtgctcctacactgctgacaggaatgtaaagtggggcagccactttagaaaacagggtagtagttcctcaaaagactaaacaagctgggtgcagtgatccaagtgcttgtaatcccagcactttgggaaactgagacgggaggatcacttgaacttgggagttcgagaccagcctgggcaacctcgatagtgagaccccgtctctattgaaaaaagaaaaaaaagtgtaaacatagggttaccatatcatccagcaattttccccctaggtatatgtccaagcattgaaaacatatgtcctcacaaaatttgtacatgaaagttcactgcagtattattcattatagctaaaagtgaaaccaatccaaatgtccaacaactgatagatggatatatatattttagacagagtctccctctgtcactcaggctggagtgcagtggtgcaatctcggctcacggcagcctccacctcccgggttcaatcaattctcctgtctcagcttcccaagtagctggtattacaggtgcccaccaccacacccagctaatttttctatttttagtagagacggggtttcaccacgttgaccagaccagtcttgaactcttgacctcaggtgatccgcctgcctcagcttcccaaagtactgggattacaggtgtgcgccaccacgcccagcctataaatgagtaaataaatgtatgtatccatacaatggagtcttactgagcaataaaaagaaatagaggctgacacttactacaatacagattaactggaaaaacatgttaaacaaaagaactggccgggtgcggtggctcatgcctgtaatcccagcactttgggaggcagaggcgggcaagagttcaagaccagcatgggcgacacagtgaaaccccatctctactaaaatacaaaacattagctgggcgtggcagcgcgcacctgtagtcccaactacttgggaggctgaggcaggagaattgcttgaacctgggaggcggaggttgcagtgagctgagatcgcaccactgcactccagcctgggtgacagagcgagactccgtctccataaaacaaacaaaaaaacgagcaaaacacaaaaaacaaatgaacagcataaaggagcttatgttacatgatttcatttatgtgaaatgtccagtataggcaaatctgtagaggcagaaagtagattagtggttgccagggcagggggacttgggagaaaatggggattgactgctaacgtgtatggggtttcttttgggagtggtgaaaatgctctaaaattgattggggacttggttgctcaactccaaaggtatgaaaatgaaaacccatgaaatcatacactttaaataggtaaattatgtggtatctgaattatatctcagtaaagctcttacaggaaaatgttttaaaaagtaataataataggggccaggtgcactggctcacgcctgtaatcccagcactttgggaggccgaggtgggtggatcacctgaggtcaggagttcgagaccagcctgaccaacatggagaaaccccacctctactaaaagtgcaaaattagccggacatggtggcacacacctgtaatcccagctacttgggaggctgaggcatgagaatcgcttgaacccagaaggtggaggttgcagcaagccgagacagcaccactgcgctccagcctggaaaacaagaggaaaactttgtctcaaaataataataataataataataataataataataataataataggccccagcacaatggctcacgcctgtaatcccagcactttgggaggccaaggcaggtggatgacttgaggtcaggagttcgagaccagcctagccagcatggcgaaacctggtctccactaaaaatacaaaaattagcctggtgtggtggtgcatgcctgtggtcccagctacttgggaggctgagagagaagaatctcttgaacccgggaggtagaggccacagtgagccgagatcacaccactgcactccaggctgggtgacagggcaagactccatcttaataataataataataataataataataataatggggtaggctgtgatcatgacctaaaccatgatctatgtttgaacatctgcacttactatgtgctcaactagcctgagccaaaatgagcaaggaggggagcagaatacattagctcacacagttgaaaaatccaggagtatttcaggtatggctggatccaggagcttaagtaatgtcagtgggactttgtcttgctctatttctccagttcagatttgccctgtgctgccttccttttcaagtaggtgacaaaaatggccttggcagctctagactgctgagctcttactaccctgagggagtatctttttccttatagtgtttagtaaagatctgatggaaggttcacactgatctgactggggtcacttttgaattaatcgccatagccaggataattttctgctctggtgggctaagactgggtgatacaacccattctagagccaggtttgtggtcagcttcacccaaaccatatagattataggggtggggtagttccccaagggaaaattaggattctgggcaggctcaagtcacagatacccacagtattcggacagtgtggaccctgctgcccaggtttgacccttgctttttccacatgccagctatgtgaccttggcaaagttctttttttttttctttttttttttttttcctgagatggagtctcattctgtcacccaggctggagtgcagttgtgtgatcttggctcactgcgacctctgcctccggggttcaaacgattctcctgcctcaacctctcaagtagctggattacaggtgcctgccaccacacctggctaatttttgtattttttggtagagatggtgtttcaccatgttgggcaggctggtctcaaacccctgacctcaggtaatctgctcgcctcagcctcccaaagtgctggtattacaggtgtgagccactgtgcccagcctccccagattattattattattattattttttttttttgagatgtagtctcactgtgtcacccaggctagagtacagtggcgcaatcttggtttactgcaacctccgcctcccaggttcaagcgattctcctgcctcaggctcctgggtagccgggattacaggcgcaagccaccacgccaggctaatttttgtattttagttagagacgaggtttcaccatgttggccaggatggtcgcgatctcctgacctcgtgatccacctgcctcggcctcccaaagtgctgggattacaggtgtgagccaccgcacccggccccccagattattctttacaatggacaatccacagccacaaagctaagagccaggtgcttggtttttcaattttttttctttcttttctttctttcttttttttttttgagacggagtctcgctctgtcacccaggctggagtgcagtggcgcgatctcagctcactgcaagctccacctcccgggttcacaacattctcctgcctcagcctcccgagtagctgggactacaggcgcctgccaccacactcacctaattttttgtatttttagtagagacggggtttcaccgtgttagccaggatggtctcaatctcctgacctcatgatctgccctcctcggcctcccaaagtgctgggattacaggcgtgagccaccgcgcccagcctgttattttttctttaaacagtgaagagggtttcaaggaatctctccttaaaggcaaagaccctgcccaactgagtgttgaggcctttgtagtggactgacctgggttaatttctggctctgggttctgccttgggcaaatcactttctttctctaagcctcagtttcctcctccatgcaatgggcagagtagaggggaataaatgagaatcatctcaagtattgactggctcagcacagtgcctagaatctgtgtctaataagtgaacttttattttcccttttttttacttgtttatttgactacatgaataccttcaaaaagtacagagtgaaagtaaagagtgaaaaatgggtgggtctcccttcctccctgttcctttacccacccacttccctttcagagatataatcaggattacaggtttcaaaacggttttgaatttataggactataacaagaataattcagagaattccatataccctttacccagaatcacctgtctttactattttgccatgtttgttttattatcttttctttcttcatgtgactatgtttattattattatttttctgaactattatagttttcatacatcatgccgcatttacctcttaatatttccgcatatgtttactaggaacacgatattatttgctgtaaccacagcactgttaccaaattcagaaaatttaccttgatgccccatttacctcataatatttcagcatgtatttcctaagaacaagatattatttgctataggctgggtgcagtggctcactcctgtgatcccagcactttgggaggctgaggcgggtggatcacctgaggtcaggagtttgagaccagcctgaccaacatggcgaaaccctgtctctactaaaaatacaaaactagccgggtgtggtggtgcacacctgtaaccccagctacttgggaggctgaggcaagagaatcgcttgaactcaggaggtagaggttgcagtgagctgagactgcaccactgcactccagcctgggcaacagagtgagactctgtctcaaaaataacataaaagaaaatagatattattttctgtaatcacagcagtgttactaaaaaatttaccttgattaccatccatacgccaattttgtcagttgtggtaaaaaaaaaaaaaaaaaaaaaaagaatcccttacagctttttcccgcctagtgcaggatccacttcaggaccatgttttgtctgtcttttttattttttttttcttgagacggagtcttgctccgtcacccaggctggagtgcagtggcacaatcctggctcactgcaacctccacctcctgggttcaagcaattctcctgtcgcagcctcccgagtagctaggactgcaggcgcctgccaccacgccctgctaatttttgtatttttagtagagatgggatttcgccttgttgatcaggctggtcacaaactcctgacctcaagtgatccacccacctcagcctcccaaagtgctgggattacaggcttgagtcaccgcgcctggcctaattgtctctcatctgaaatgatgcctctgcttttctttgtcttttatgaccttgacattttttgaagaatacaggccagttatttcatagaatgttcctcatttggggtttgtttaacagagtaccccaaatttctgtaggataggaattcaggaagggcatagtggggaaaaattctatctgctctaaggctcactcctgtaatgccagcactgaggcctcagctggaaaactcaaaggctagaagcgagagttacctgaagtctcactgtctggcagctaatgcaggctgctggctggggcttggctgaggccccacacacagcctctctacgtatcctgagcttctttccaactatggcagctgggatggaagggcaagcatccaaatggagaaagccatactgtcttttttattttttatttttattttttgagacggagcctcgctctatcgcccaggctggagtgcagtggtgagatctcagctcactgcaaactctgccctcagggttcaagtgattcacgtgtctcagcctcccaagtagctgggattacagacgcccgtcatcatgaccagctaatttttttggagacaagagttttgctcagtctcccaggctggagtgcagtggcatcatctcagctcactgcaacctccaccttctgagttcaagtgattctcctgccttagcctcccgagtagctgggattacaggtatgtgccaccacgcccagctaatttttgtattattactagagatggggtttcaccatgttggccaggctggtctcgatctcctgatctcaggtgatccacctgcctcagcctcccaaagtgctgggattacaggtgtgagccaccgcacccagccactaatttttatatttttagtagaaatgggattttgacatgttggccaggctgggtttgaactcctgacctcaagtgatctgcccatctcggcctccgaagtgttggcattacaggcgtgagccgccacacctggcctgtcaatattgttttaatgatggttgctccttctcaggctttcctcacatactgttttttttttttttagacaggttctggttctgtcacctaagcctcctgagtagctgacattacaggtgtgtgccacgagcttggctaatttatttatttattatattaaatatatatatatttatatataatattaaataatatatgtatatatatttatatataatatatatattaaataatgaaatatattaaataataaataaataaataatttatttattgttttgtagagatgggagtctcactatattgcccaggctcatctcaaactcctggcctcaagcattccttccacctcagcctcccaaacggctaggattacaggtgtgagccaccacacccagccctccctcatacattcaaatggccaactcccttggcttcctcaagtctttgcttaaatgccatcttctcaggaagtcattttctgaacactctattaaaaattgcaacctgcccccaaacacgtcttgcactcactgtccgtgtctctgcttaaattttctccgtagcactcataccatctaacatactgtgcatttacttgtttatttttatttttttgagacagggtctcactctgttgcccaggctggagtgcagtagtgtgatcatggttcattgtaacctctgtctcctggactcaagcaatcctctcaccttagcctcccaagtagctggtaccacaagtgcacatcatcacacctggctaatttttgtattttttgtacagaaggggtttcgccatgctgaccaggctcatctcaaactcctgggttccagcgatccacccgcctcagcctcccaaagtgctgggattataagtgaaccatcatgctgggcaatttatttatttattttccgtttccctctactaatgaatcagctccaggagtgcagggaccttgtctgttttctacacagatgcgttcccagcacctagcacagtgcctagcaggtatgtgaatgaatgaatgaatgaatccatgcatgcatgaatgaagtatccttgtacaaaccatgaaccatgtacatgttaggtgtctacaacttgtcgtttgaattaatgaataaaagaacaggcaaggcgcggtggctcacacctgcaatcccagcactttgggaggccgaggtgggcggatcatctgaggttgggagttcaagaccagcctgactaacatggaggaaccctgtctctactgaaaatagaaaattatccaggcgtggtggcgcatgcctgtaatcccagcttgggaagctgagacaggagaatcgcttgaactcgggaggcagatgttgcggtgagccaagatcgtgccattgcgctccagcctgggcaacaagagtgaaactctgtctcaaaaaaaaaaaaaagaaagaacagacagcaccaaccctccttgtaagttcaatatgaggttgatctgaagctgccacccaaggctactgatcaaaatatccttctaaacaagtctgtcccacagtcctggcgtctgataatatggacagtcaggctggctggcaccagactggacccagatgaaggaatggaatcaggccacattacaggggcaagaggagccttgtggccagaggttctagaggtcagcagcaagtcatgcatctgaagaggaagttgattgctgtacctcaagctgaaacagaaactgcggtggctagcaaggaagggtccccacctgtgcgcctcagccccttggccattgccagcttccaacagaccacagagacttttgggggaaaacttttttattgaagtgtaacagacatacagaaaagtgcacaaataaggaaagtgcacaggggagcgatggctcgatacattttcacaaaggcagacagcggggtaaccagcccccagctcaaggaacagaacattccccgccccggagaagctcccttcaagtctttcccatcctaagcgataaccgttatcctgattccaacagcagtgatgatttttgccgttttttgaacttgatgaaatggcagcacataacacgtattcttttgtgtaagacttacttactacaaactttgtatgtttgtagcaacagccttttgaccctgtctcttcctccatgccctcaaagagaaaaaggaacctaataataacacaaaataaagcgaaagcatacttgcttgactggtttaaatgtgccatctggccgggcattttggaggccgaggcgggtggatcacttgaagtcaggatttcgagactagcctggccaacatggtgaaaccccatctctactaaaagtacaaaaattagctgggcatggtggtgggcacttgtaatcccagctacttgggaggctgaggaaggagaatcgcttgaacctgggaggcaggggttgcagtgagcagagatcgtgccactgcactccagcctggatgacagagggtgactccatctctcaaaaaataaaataaaataaaataaaataaaataaaatataaaataaaatgtgccatccattctttcatgcttcagccacccagtgggctggaactgttactgcttccatttcaaatattgggaggctgaggcacagagaggttaaataatttgctcagccaggaagtgaaggtctgtatttaaagccaggtctctctgatctccaagctcatgttctaacccagcatacactccttatcaataaaatgaccatgtattgaacaccctctttggactgaatactatacttcaactttatgtccattgtcttatttgattttcccagccgttgatgagtaatataccattatccttgcttagcaaatgatgaaagcagggttcagagaggttaaggaactttcctaacgtcatacagcccaggaaggcatgaaataaaaatttaaactctattttgttgattccaaagtccagtgcagaacgatatcagtacccagcatttatgcgcatctttcaaatataccttctgaggccctgcagggtggctcatgactgtaatcccagcactgtgggaggccgaggtgggtggatcagttgaggtcaggagttcaagactagcctggccaatatggtgaaaccccgtttctattaaaactacaaaaattagccgggtgtggtggcacacgcctgtaatcccagttacttgggaggctgaaacaggagaattgcttaaaccccggaggcagaggttgcagtgagccgagattgcaccactgtactccagcctgggtgacagagcaagattctgtctcaacagaaacaaacaaacaaaaacaaatataccttctgagtttttcaaaaaagagacaacaatagcagttaccttttatggatcatctcagagtcagttgttttggtcaaagattgcaaatgatcccttaatttgtgttcttgtcttctctctcctagtaagagtatacctgatttttagcttggcacatggcttcccatggctttactacctatctcagccttccttgcagctaggggtagccacatgactaacttatagccagtgaagaactgttccccgacatgcccacatggctcatgtcaaccccagcattacatcatttgtttaaactctcagtttctctgtcttgaaaatagggatttaaatatttatttaagccaggtgtggctgaggtgagaggatcacttgaggccaggagttcgagaccagcctgggccacacaatgagacccctgcctttacaaaacaattttttaaaaaaattagctgggcatggtggcgtgtgcctgtagccccagctactcaggaggctgaggtgggaggattacttaagcctgagaggttgaggctgcagtgagccttgattgcgccattgtgctgcagcctggatgacagagcaagaccccatctcaacatatgtgtatacatctatctatctatctatctatctatctatctatctatctatagctatatctgtctcatctctctctctctctgtctatatatatatatatatatatatatataaataaatatgttcttttttttttaatttaacaaaagcaggaagtagacagacacagtgggtggttcatgccagtaatcccagcactttgggaggccaaggcgggaggattgattgaagccaggagtttgagaccagcctgggcaatatagtgagacccctaactctacagaaagtttaaaaaaaaaaatcagctgggtgtggtggtatatgcctgtagtcccagcttcttcacatcactgcactccagcctgggcaatagagcataaccctgtctcttaaaaacaaaaaacaggaatatatgtagtagagtcaccttgagtgtggattgggagaagaagctaggacaggaaggacactaatgtgtttgtgttgggtaaacaaaccctgtttattgggagaccacctgctccagaagaaaagacaccaggtgaagacaggaagctgggtgctgctaactgaatgagctgggacaaggcccttcccttacctagggatagataataaaaaatattttattgtatatttttaaggtagtagttccttgtctgcagagtggggatttagattacatctatccttttggttttgtctactcactatgaattcccctatcataacagcatcctaatttctctgggagcccccttctttactccctgtccatgtgaaaggcatgcagcactaactttatccttggttccaggaaggccaatgctccatgctggccaatcagcacccctcatttctctgcccatagggattggctcagaaatgggcacctgccccaagtggaccagtgagttatccctcaggtttttgctgggattgttttgcttctgctgcgctaggctggtatgaagagggtctgaagctcaaaggtagccaccattgtgagagtgaaagactgagccctgataacttatgaacccctgaatccagctgtacctgaaggcagccacatattcctgaacatgttattctccatgagtcaatatggttcctctttgttgtttttttgttttttgtttttgaaatggagtctcgctgtcacccaggctagagtgcagtggcaccatctcagctcactgcaacctccacctcccgggttcaagcaattctcctgcttcagcctcctgagtagctgggactatgggcacgtatcaccacgcccagctaacttttttgaatttttagtagaaacaggattttgtcatgttggccgggctggtcttgaactcctgacctcaagtgatccacctgtcttggtctcccaaagtgctgggattacaggcatgagccaccgcgcccatcctcaatatggttcctctttggacttaagtcactgtagcagatgacgtggcttctgtgtccatatccccttggcattcatccttttgacccacagtgagtggatggcttcaaatttccacgcctatctttgcagcctgagggctttgctctcatatacgctctgcatacacagtctgagaatgctgggggcttcaccctcccctacaagcagcccttaaccaatgagtgacaggggctggtggataaatgtccccactcccttgcccttcacctggataattctgaggtgtattgcactctgtgtcccacagttccccagcagggttgagccccagctgcccagagtgataacctgctcagtaacttaccttctattggtttctttcccttccctgtcctacttccctccccgaccagagcttcctgggatcatttctcaagtaaacgatttaatatctgcacacaaatccttgtctcagatctgcttctgcaggaaaccaacctaaacgtttcgtaagattggttttctgtcacgcacagctaaagctgctctggcagacgcatggttcaagaattcttttaaaatatttgcctcataactgtatttttccagcctgcttttcagctcaaaggaagtatatgcactgagttgacttatcagtgtgcatagcagaaagggacccagtaagagaaagccccctgagaggccctgggacagctgagtgatccaccctggctgcctcctctccacctcattctcacacactaacctttcccaacccttttcattccaaggctcctagccagcgccccccacctgccttaggagataaccccagttccttcctcggattctttcatctgcaaggcctcagtgttcttgtccggccagtgataaggacattcaacgtcattttcctgtccctgacctttgaaagaaccctacccatctggggcctgtgatgtagactcagactgagatgttccatcttggggatataatcagtgggaaagagagagattcctgagaggtcatcattcattcattcattcattcaagaaatatttatggagtgcttgggcaaggaattctaaattgcagagtcaactagagccagcttaagcagaaaaggaattttttttttttttttctaagatggagtcttgttgcccaggctggactgcagtggcacaatctcggctcactgcaacctccgtctccagggctcaagtgattctcctgcctcagcctcccaagtagctgggattacaggtatgcaccaccacgcctggctaattttttgtatttttagtagagatggggtttcaccatgttagccaggctggtctcaaactcctggcctcaagtgatccacctgcctcggccttccaaagtgctggaattacaggcataagccaccgtgcctggcccacaaagggatttatgaaaggtaggaagtactctagatgttaaatagccacaaacggtgcagccaggagcatcgatgccaggagcaacactcaccttcactgttgaactgttctaatcaaaatatcactgctgctgctgcccccctctccccaaactcaggacctaggtagctagagacaggctgctagaattgccccatgcttccccagaaggaccagataccgctcccactgtgcttgccagaagactccaccacttggcatccttctgcttgcttctgtctccaaggcttactaggggaacccagatcacataaggcactcttgctgcaaagaaatctcagaatgtagtttttctctgtctggcctttacagtacaggaggtcacactacaggggaatgggataggtgagtgagccaatctgtagtatctgccgtaggctcacaacaatgataaagtcagggctgggcacagtggctcatgcctgtaatcttagcactttgggagaccaatgtgggaggctcccttgaggccaggagtttgagaccagcctaggtaacagtgggagaccactccatctctaccaaaaaaaaaaaaattaagtggtggtgtgtgcctgtagtcccaggctgaggagggaggaatgcttaagcccaggagttcgaggctacagtgagctacgatcgcaccactgtactcccgcctgagcgacagagcaagaccctgctctaaaaaagaaaaattaaaataaaaaaattttaatgataaaatcagaagagtcccctgctttccaggagctcaccattgacaggaggatatcaacaccaagcaattccaggagggagagcattccaaaagggaaattatagacagttacacacacatagaccaagaaaactcaacctattctaacaggacctcctgaaacaggtgccgttgtacatgatgtgtgaaggtgtttagaggctaaccaggcaaaagaagggcaagagggaatagcacttcaggcaagggaaaatctcatatgcaaaggtccagtggcagggaaggtgaggggtgcaggaggaagtgagagaagcccacttctctctgactggagaacagagaacaaggggaacagagggaaggaagaggggcggtaagggaatagaccatgaccttgtggtccatgatgtggaattcaaactgtctcctaaggccagtggtgaccactgaatgcttatgagtaaggcagtgacataatagcaactgctaatatttatttatttattattttgagatggagtttcactcttgctacccaggctggagtgcaatggtgtgatcttggctcactacaacctctgcctcccagttcaagcgattctcctgcctcagcctcccaagtagctaggattacaggagcctgccaccacgcccagctaattttttgtatttttagtagagatggggtttcgccatgttggccaatctggccttgaactcctgacctcaggtaatccccccaccgtggcctcccaaagtgctgggattacaggtgtgagccaccgtgccctgcctgctgatatttattgaccacttattcagtgccagacttttttctaagctgctaacatgtatcatttagtatgtatttgcaacaaccctgtaattaaggttctccagaccacgagcaaattactcagccattctgtgcctcagtttcctcatatgcacaatgggagtaatcatagaacctaccacaaagagttagtatgagggttacaatgagtgcttggcacatgggaaatgctgtgtatgtattagcttttgctactattattcccattttatagatgaaaaagctgaagcccagagagatgaatcagtttgtctgaggtcacacagctaatgctaataaggcatagaatgaacaggacaggtgtggcgaaggtagaagtgctggtgggcgtggagaagccacatcttcatcctaggagtgatggaagtgtggaccacccattgggacccatgtggccagcctctgttctgactggtcagtgcctaggtcatgccggttcttaaatatttcattatcaccctgttattactacatatatgacattgttttgtggatttaatatttacacaaacggtatcatactaaatgttaacttctgcaagtcccttttctcactcaacattactgtatgtttaagatctgtttagatctagttcattcattttattttcttttttagagatggggtgtcactatgttggccagtctggtcttgaaatcctgggcttaagtgatcctcccaccttggcttcccaaaatgttgggatgacaggcgtgagacaccgtgcccagccattcattcattgtttttttttttttttttttttttttgagacagagtctcgctctgtcacccaggctggagtgcagtggctcactgcaacctctgcctcctgggttcaagcgattctgcctcagccttctgagtagctgggactacaggcacatggcaccacacctggctaattttgtatttttaatagagacggggttttgccacgttggccaggctagtctcaaactcctgacctctcaggtgatccacctgccttggcctcccaaagtgttgggattacaggcgcgagccacaccattcattgattttaattgctcactagtattcctttacaggaacatgtcatggtctccttgcccactatcccatggatgcctatttagtccactgcactttggacccattgtaggcaaagctgccacacccaactttgcatatgttgaagcttctctagggtgaataccaggaagtgggatcactggtctcagagttcatacgtttcaactgccaagcagcagtacatgaagagttcttgtttctgcacttccttaccgatgaaaataataccactaccccacatgacacttactatgtgccaggcatctttctaaacatctaacatgaaataactcatttaacctctcaaaaaactttgaggtgaggtactatcatcatctccactagatagatggagaatgaagacacagagagggcaaataactagcccaaggtcactcagctaggaatagtagagcatggcatgaacccagagaggctggttccagagcctgggctgttcatcactcctgtaggccttggaattttctggttttcaagttgctgccagtttatgactgtgaaatgtctctaagtgctttaagttgcattgcctgcttagaagggaccttgaggacctttccatccattttttggccaatcaagcatcctcttcagaaaaatgcctctttctagccttggctgtccctgagtttctgatcttttctgcaagtatgcctggaggccaggacttggggcggggcctggcacagtgagcgcacttggtaaaaatgtaccagactcaccaggcatggtggctcatgcctgtaatctcagcattttggaaggctgaagcaggcagactgcttgagcccaggagttcaaaaccagactggtcagtgtagtgagaccctatctctacaaaataaaaattaaaaattagctgggcgtggtggcacatgcttgtagtcccagctactcaagaggcctctgagatgggaggatggcttcagcccaagaggtcgaggctgctgtgagctacgattgcaccacagcactccagcctgagtgacagggcaagaccttgtctttgggaaaaaaaaaaaagtgttcactttggcagcgcatatactaaaattggaacaatacagagattagcatggcccctgtgcaagaatgacataaaaaattgtgaggtgttcgatatacaaaagaaaaaagaaaaaaaagtgccagactgactggtggtgtctttcacgtctctcaccctctcttcctcctgggaggccaatgctgatgaataaagcttctgcttaagtcactggcccacgtctgtgctgtgctgggcacgcacagtggccctcttgcctcaagctcatttcctcttctgttatctgaccctaatctagttcatgatctgatctcatctccttcgactctccttgtctcttgtttctcatgaaccccactggctgtcctcctgtctcttcagtggccaagttcatttctacctcaggacttttgcatgtgctgcttcctctgcctggaacactcttcccgtagtggctccaactcatccttcaggcctcaactcaaatgccacctcctcagagagactttcctgatcactctgtttagaagaaacagaggcatgaagagattgagcataattgtcaaaaattgtacagctggcttattgatgagatttttgaattatgttatcttattatgtgcctatatttctaaattttttctacagtggtgatgtgttccctgtgtgaattttttaaacctcaaattcaggctggacattgaggctcatgactataatcccagcacttagggaggctgaggcgataggatcgcttgagctcaggagttcaagaccagcctgggcaacatagtgagaccccatctctacaaacaattttaaaattagccaggaatggtggcatgcacctgtagtcccaggtactggggaagaagaggtgggaggatgtcttgaggctaagagttggaggctggagtgagctatgatcacaccactgcactccggccaggataacagagcaagactgactcttaaaaaaaaaaaaaacaggccgggcgtggtggctcacgcctgtaatcccagcactttgggaggctgaggtgggcagatcacgaggtcaggagatcgagaccaacttggctaacacggtgaaaccccgtctctactaaaaatatttaaaaattagccaggtgtggtggcgggcacctgtagtcccagctgctcaggaggctgaggcaggagaatggtgtgaacccaggaggtcgagcttgcagtgagctgagatcgcgccactgcactccaccctgggcaacagagcgagattccatctcaaaacaaaaacaaaacaaaacaaacaaaaaaagcaaaaaagaaagacctcaattgttgttgttgttgttgttgttgttgttgttgttttgagatggagtcttgctctgttgcctaggctggagtgcagtggcacgatcttggtttactgcaacctccgcctcccaggttcaagcaattctcctgcctccgcctcgagagtagctgggattacaggtgcccgccaccatgcctggctaatttttgtgtttttagtagaaacagggtttctccctgttggccaggctggtctccaactcctgacctcgggtgatctgcccaccttggcctcgcaaaattctgggattacaggtgtgagccaccacacccagccaagacctcaaatttaaaatgaattaagagccaatcctgagagaatacgaatgagtgtctggggctctgtttttcaagcctcctgggtcagaataagatcatagcattcttcatcctccatgatttccttactgcccactttcccacgcctttccatctgacgatcgtccctcttggctctgaatcagaaggctaaaagcaaagtgtaggtccacaatcctctctgataatcagcctccccttccctacagatgtttctcattgcaaaatgggaataatgccaggtgcggtagctcacacctgtaatcccaacagtttgggaggccgaggagggaggatcacttgaggtcaggacttcaagaccagcctggccaacatggtggagccccatctctactaaaaatacaaaaattagttaggtgtggtggcatgcacctataatcccagctacttgggaggctgagacaggagaatcacttgaatctgggaggtggaggttgcagtgagctgagattgtgctactgcactccagcctgggtgacagagagagactccatctcagaaacaaaagggataataaaagacctacttcacagggattcagcatgatggggctgaaagacatttggcggaaggaagactattgctgtgtgggaaccgtactgtgtggtgagtttggagtcagataaactctggatcaaaggccagctcactgtgtgatctcaggcaactcaatctctgagcctcactctctctgtaaaataaggacaataaaaatacctactgagttctttagaatgcccttcactagaaagaagtgggtaacaaaactcaagcgtgctttactggaacaggctcccctggctccccacacaggacatttctaggacgggggagcaggagatccagcagcctagtgatctcatcctggagccaggctttttccatgtctccgtccacagtgttggtttcatcctcaggctggtcctcctcgtgatcgcaggatgactgccaggagctatcagggccacgggcatcctctttcatgtctggtaggaaaatagattcacttccaggccatcttcctggaagagtgaggaagaactttcccagaagcgtctggcaaacttctctccacttctcattagcctgaggtaggtcagaggcccattccggaaccaaactctggcaaaaagatgcaagtctcatgattggcttagactcattggttccagtgcctgtggctgggctgggatggatgtcgaggagtcagtcaacaacattgtcctctctacctgcctcgaacagttactgggagaagaaaatgagatcatgcttgcaaagcttagcatacagtaggtgctcaactaataatagctcttattactattacaggctgagtatccctcatccgaaatgcttgggaccagaagtgtgtcagaattcagattgttttggattttggaatatttgcattatatttaccagttgagcattcctaatctgaaaatctgaaacccaaaatgctccagtgagcatttctgttgagcattacgtcagtgctcaaaaagtttgggattttggcgcatttcagatttcagattttcagattagggatactcaactgtattattattattttcttttttgagacagggtcttgctctgtctcccaggctgagtacagcagtgcgatcttggttcactacagcctcaacttcccaggctgaagtgatcctcctgcctcagcctcccgagtagctacctgggaccgcaggtgccaccacaccaggctaattttgtttagtttttgtagagaggaagtctcactatgtttgccaggctggtcttgaactcctggactgaagcgatcctcctgcctgggcctcccaaagtgctgggattacagacatgagccaccgcacccagccttcaacagtattctgattattatcaacatcaccatcatcctttgggggctttgatgtcaggcaggctctgatcaaatcccagtttctccacttcttagctgtgtggcctcatgcaagttgctgagcttcagttccaccctgcaaaatgggaatgataagtgctcctatctcttgtcattactgtatgaaaatagttaatgctccgtatgtgccgataatgcagtcctttggccttcccattaggaatttgggtggccttttcctgccctcagtagatgtgattcaggtgagggagactctcccttctattccagaagtgggcacattctcctcacttgaatttctgaatccctcaggtcgatatgattggttcagggagccagagaaagagagtctgtctatcctctagaattgctggctggaaaagtggaagctaggagctgcgggaaaccatcttggggagagctggcttgaagtggagccaacaagagaggaagcagagatgagagatggagagaggcagaggactgttgactctgttgagctcctggatccagccatgcctgaatcggatttaccactggacttttcattatgtgagccaataaattccctttttttttttgtagaagaagccagtttgaggcgggggttctgtcacttgcagtgatgtgtgtggagtctagtccagaccaggcaggatggggaattagaaaaggagatagtcctctgagggcagaattatgcctacctaaatcagcttggtattccaagagttttgcccaggccaatgcatagaatggaactccagaagtattaggagttaaaagcataaataggctgggcctatttgtgccctataatcccagtactttgggaggcctaggtgggaggttcgcttgagtccaggagttcaagagcaacgacaacagcctgaacaacacagtgagaccccatctctgcaaaaacaaaaataaaaaattagctgcgaatggtggtgtgcacctgtagtcccagctactggggaggctgaggtaggaggatcgcttgagcccaggagtttgaggttgcagtgagccactgcactctagtcggggtgaccgggcaaaacctcatctctaaaagtaaaaaaaataaaaataagaacacaaatagagtctagtgagtatccctccagacttcttctctgtgcttataataaatagtcatatacaaacacagaagaatatttttacaaaaatggaagcacactctacattttcagttcaaacactccctccccagtgaccaccccatctgaagtggctccgtctccatcatgctttcttgcatgctagcgtttttcactccctaaattaacttattcagagcagacatttttctctgtttgccactgctgtgtcatcagtacctttcacaactggccaagtatccaacacacatttgttgagtaagtatcactctgtagtttgtgtgtttcttttaacttgtagcgaagtagacatggatctgctttgacctttgagacgaatgcatggagatctattgatcggatgggccacgtttgtttcccacacttcgttgaaaaattgggggtgaaaaaaactgggagtgaaaaaatggccaaaccaaaagaagggtgagtcattccctcctaccccaaaatacagaggagagggtgaagaaggaggaccgcccctcctcgctccagtaaagcctttaacaggcccatcctgatttacagggagcggacttggtttcctgttcaagaatttccaaggcaaaaacaatcctcaaacacatgaagatgaggttgggcaaataactcatggatggtctcaacgctggagggcaaagttgtttattaagctcccgaccctcaaagggaattacttaaatttttttcttgattataaaagtagtattccagcctgggcaacaagagcgagactccatctcaaaaaaaaaaaaaaaaaaaaaaagtattggctcatcactatgaaaaagcattttcagagaatacagaaaagtgtgaggaatagaataaaaaacagtcataattttggagcattttgtaagttagcccatagattttttaaatgcatacacatgtacttaattctaaagtgaacctgtgctatctttttatttaacagtaatcctaagatttattgagtatgtacaatgcatatgctagttgctctctgtgtattaatccattttatatttacagtagtcctgtgtgataagcactattattaattcaattttatagatggggaaactgaggcagagagcagttaagtgatttacccaagatcacacaaggtggccaagctggaattcagaaacaagtaatctggcttcaaggcccatgacgttaaccactatactacattgctaaggcagagcagagacccctcccaagttaatacccatagatatgagtcatcctttttagtgcctgcacttattcttctattactagataattgggctttttctagtttccccctactaggaaatagagagaaacttcccttttgggctttaaattagacaagaaaatatgcggttagatgtcaccacaacttgtacttcttttttttttttttttttttgagacagggctcgctctgtcacccaggctggagtgcagtggtgcgatcacagctcactgcagctttgacctcccaggctcaatctattctcccgcctcaatctattctcccacttcagccttctgagtagttgggactacaagtgcacaccaccgtgcctgactatttatttctcttttctgtagacatggggtctcactgtgttgcccaggctaacaactggtatttctaacccaggagaagcaacgaagggctcagccctactttgaagcaatcgccccattatgcacatatatattgactgggggaggttattttatttaagaaacatccatgaagtacttatgtgccagacagacatggcttcaagaacttctgaataggctgggcacggtggctcacgcctgtaatcccaacactttgggaggccgaggcgggcggatcacgaggtcaggaattcgagaccagcctggccaacatggtgaaaccccgtctctactaaaaatacaaaaacttagctgggcgtggtggtgggcgcctgtaattccagctacttgggaggctgaggcaggagaattgcttgaacccaggaggcagaggttgcagtgcagtgatccgaggtcacgccattgcactccagcctgggcaacaagagtgaaactctgtcttaaaaaaagaaaaaaagaaaaaagaacttctgaatattagctcacttcacccaaaaataatactctgaaatacataccagggaaactgaggcacaagggggttaacttgcccaacatgacagaggcagtaagtggcagtgctgagatctgaaccccggaagcttggctccagtgtctgggttcttaactcccaatcagcctctctgtctaccccttggcccaagagagctggcccgccctggggtactcaaagcaaacccactttcagctgaggactgacggcagcaaggtgaatatatctatttttccttttaagtgatactcatgtattagctcacagttctgtaggtcctaagctcatgcaggctctgctgtgttatacgttcagggcatcacatggctgaagcagagatgtcagctcactggagtcctcatctggaggctatgggaggaattggactcttttcagattgttggcagaattcagttccttgcagctgtagaactgaagcccccatttccttacttgcgattctctctgcaactagaagcttcctgcattccttgtcctgtggccccttcttttttttgagacagagtctcgctctgttgcccaggctggagtgcagtggcgtgatctcggctcactgcaagctccgcctcccgggttcatgccattctcctgcctcagcctcccgagtagctgggactacaggcgcccgccaccatgcccagctaatttttttttttttgtagtagagacggggtttcaccatgttagccagaatggtcttgatctcctgaccgcgtgagccacccatctcggcctcccaaagtgctgggattacaggcatgagccaccgcgcccagcctatatctttttatttatggcaaatattttaactgtcccacagatttgtcttgaataagaagcaaagagacgggaaaaccccttagaaacaggtgtgtaatgggacttttcttttgtttcagttttggttaagggcttcgtgctgaggtactgtggctctctctagagacagctgaatgtctgctgagttagaaaaggggagacttccccaaaccgtctatgaacccttagcccatcacctgtgttgagggtgtaccgggaagacttgaggattactgaggggaaaatagaggttatggagaaagtttccccttcattgaaaatgcctgggcagggtgcggtggctcacgcctgtaatcccagaactttgggagaccgaggcgggtggatcacctgagattaggagttcgtgaccagcctggccaacgtggtgaaaccccatctctactaaaaatacaaaaaattagctgggcgtggtggtaggcgcatgtaatgccagccacttgggaggctgaggcaaggagaacccaggaggcagagattgcggtgagccaagatcgcgccattgcactccagcctgggcaacaagagtgaaactccatctcaaaaaaaaaaaaaagtttgcaaaaataaaaaaataaaaaataaataaagggccggggacagtggctcactcctataatctcagcactttgggagacacgggctggcagatcccgtgagccaaagagttcaagaccagcctgaacaacatggcgaaaacccgcctctacaaaaaaatacaaaaattagccaggcacagtggttgtgcctgtagtctcagctacttgggaggctgaggtggaggatcacctgagcccaggaggttgaggccaaagtgagcagtgattgtgccactgtatgccagcctgggtaacagagtgagaccctgtctcaaaaataaaataaaataaataaaaattagaagaagaaataattgaaaattctgaaaaacataaaataaaaaaggcagtttccttggagttttctgtgctactgtggacatagcacatagtaggtgcttaatccatacttaatgatttatgtcaggtgctagtctaggtactagaccccctgtgagcctaatggggatgacaggtcacaaggaagtaaatttgaaaaagaaacaacattgtgctaagtgaaagaagccagtcataaaatgccacagattttattccacttacatgaaatgttcagaatccgtaaatccatagagacagaaaataaagtaatgactgccaggggatggggcagcagggagtgactgctgataggtgcagaggttcttgttggggtgccagaaatgtttgggaatcagacagttgtgatggttgcataacatagtgaatacactaaaacccactgaattgcacatgttaaaatgaagtttttgttatatgagttgtatttcaatatttatttaatttaatttaattaattaatttattttttgagacagtcttactctgtcacccagactggaatgcggtggtacgatctcggctcattgcaatctccacctcccaagttcaagtgattctcgtgcttcagcctcccaagcagctgggattacaggtgtgcaccaatacgcccggctaatttttgtatttgtagtagagatggggttttgccatgttggccaggttggtctcgaactcctgacctcaaatgatccgcctgctttggcctctcaaagtgttgggatcacaggcatgagccatggtgcctgggccatatttcaataataatttcaaatatgtttttttaaaaaggacaaaacagagtaacttcacataataggtaccacgaggacaagagagtgaaatgctggaagatgcagtggctggctggggcaggtgggagacggcctcagtcagggtgcttccattgtatgggatctgaattatgactaggaggcagctctatgtatatctagaaggtgatagacaaaggaacagcaagtgcaaaggtcctgagctggggaggagcatggcatgttcaaggagcagataagtgagttgggatgcaggggaaaagggacaagagaccccttcagggaaagggagctgaccaaacagggccttgcagactgccaagaggagtttgggttttgtttgcagtaaaatggggagccgtgggatgattttgagcagaagagtaacatgatctgatacatacttcaaaaagactgcttgggccaggcaccatggctcatgtctataatcccagcactttgggaggctgaggtgggagaatcacttgattgagcccaggagttcaagatcagcctaggcaacatagcaagaccccgtttctacaaaaaataaaataaaacaaaaaattagccaggaacggtggcacgtgcctgtaatcccagttacttgggaggctgaggtaggaggatggcttgagccagagaggttgaggctccagggagctgtgatcccacaactgcactgtagcctggggacagaatgagaccctgtctctcaaaaaaaaaaaaaaaaaaaaaaaaaagactgcttgcactgtcattgtaaggtaaatacagctacagacatacagatattttggtcaaagatagaccacaaatacaatggtggtgtcatgaggttataatatggtacttttactgtgccttttttgtgtttagatatgtttagacacacaaaaacttgccattgtgttaccattgcctgcagtacccagtacagtaacatgccgtacgggtgtgtagcctacgagcaataggccataccataaaagcctgggtgtgtcataggcaacaccatctgggtttgaagaagtctgctctaggatgttcgcacatcaagatcgcctgaccacacgtttctcacaatggattcctgtccttaggtgatgcatgactgtggtaggcaggtaggagtagaagcagaaaatgtaagtaaatccgtttgacactgtgcttgtgacctgcaacactcagtaactgccagtcatctttcataaactagaaacaagccagcttgtcatatttatttcaatacagaaagtcaaggccgtgggtattttgatctttctgtcttgatgctgcctcacctccctgttctgagtcaccagccctgtggattcttcctcctccaccctcacccgctttgtgtcctccacactgtccccaccctaagacctgatgaccgatagaaacacttgcatccttggcttaccttttttctttccccctttaaaaaatatcatagttttggctgggtgcagtggctcacgcctgtcattccagcactctgggaggccgaggcaggaggatcacttgcacccagaagtctgaggccagcctgggcaacatagtgagatcctgtctctatttttattttgtatttatttatttatttatttatttttgagacggagtctcactgtattgccaggctggagtgcagtggcatgatctcggctcattgcaacctctgcctcccggattcaaacaattctcctgcctcagcctcccgagtagctgggactacaggtgcacaccaccatgcccggctaatttttgtatttttagtggagacggggtttcaacatgttggccaggatggtctcaatctcttgacctcatgatgcacctgctgcagcctcccaaagtgctgggattacaggcgtgagccaccgcacctcgcctattttaattttttaaaaaaaatcatattttagtacctgtagtcccagctacttgggaggctgaggcaggagaattgcttgaatctgggaggcagaggtttcagtgagccaagatcacgccactgcactccagcctggcaatagagcgagactccatctcaaaaataaataaataaatacaaaataaaaatagagacagtgtgtcactatgttgcccaggctggcctcagactcctgggtgcaagtgatcctcctgcctcggcctcccaaagtgctggaatgacaggcgtgagccactgcacccagccaaaactatgatattttttaaagggggaaagaaaaaaggtaagccaaggatgcaagtgtttctatcggtcatcaggtcttagggtggggacagtgtggaggacacaaagcgggtgagggtggaggaggaagaatccatagggctggtgactcagaacagggaggtgaggcagcatcaagacagaaagatcaaaatacccacggccttgactttctgtattgaaataaatatgacaagctggtctgtttctagtttatgaaagatgactggcagtcactgagtgttgcaggtcacaagcacagtgtcaaagggatttacttacatttcaaatgacgtgtcatttgcagaaaaaaaatattaaaaatacaaataagcaaaaggaaaaacaatatccatgacccacaattgagaaataaccattatcgaaacaatatttcaatatgttactcctgtccttttttgtttcttggtttaaattttatttgtattgaggtcatacatgcacataagttgaagagtcaaattttctaaaaataggaatccccacttcactctctcctctcatttctgcctccccaaagataatcactttgagctgattttttgggtatttaactccatgtcttggaataacatgcttctatcgccacttcttagtttttctgttttcagtaaaatctgctttcccactctgggcaataagggttctgccctctttccctctcctcacctgcccagcccatgcagagacccttcccatcctttattctctcaatatagttatatggttattcttgtgagattgacatttacagtatacattattgtgactatgtaaatgccattcacagctgagctccgtggtaaactatgatgacctttacttttctccttttctgcaacttttcatttttcttttccttttttttttcttttgagatggagtcgccctctgtcgcccaggctggagtgcagtggtgcgatctaggctcaaggcaacctccacctcccaggttcaagtgattcttctgcctcagcctcccaagtagttgagattacaggtgtgtgccaccacgcccggccaaaactatgatttttttttaaagggagaaagaaaaaaagtaagccaaggaagcaagtgtttctatcggtcaccaagtcttagggtggggacagtggggaggacacaaggcaggtgagggtgaagaaggttttgaactcctgacctcgggtgatctacccacctcggcctcccaaagtgctgggattacagctgtgagtcaccatgcatggcctggaatctggatttttttcacaaactttctcagagaattacacctgactccactgaattctacaagcccagattttctatttttgcttagtaattctagtgcctgttacgtgctaagtggccagggccagattaaaatgttagcatccaaaggtattaaagaaattatgccccactcgttcccatgtataaatcaatatgaaatgataataaatagcaaaaatacatgaagagggctgggtgtggtggctcacgcctgtagtcccagcactacgggaggccaaggcgagcagatcacctgaggtcgggagttcgagaccagcctgaccaatgtggagaaaccccatctgtactaaaaatacaaaattagccgggtgtggtggcacatgcctgtaatcccagctactcgggaggctgaggcaggagaatcacttgaacccaggaggtggaggttgcagtgagccgagattgtgccattgcactccagcctgggcaacaagagtgaaactccgtctcaaaaaaagaaaaaaaaaaatacatgaggagaagtccaacagatcttatttttcctatggcgtggtgggtaggataatggccctccaaagatggccacgtgctaattgctggtccctgtgaatatgttacagggcaaggacgaattaagattgcagatggaaatagggtgctaatcagctgactttgagacgggcagattattctgattatgtaggtgggtccaatgtagtcagaagggtcctaataagagaaagaggggctgggcacagtggctcatgcctgtaatccaagcactttgggaggccaaggtgggtggatcacctgaggtcaggagttcaagaccagcctggccaacatggtgaaaccccatctctactaaaactacaaaaatgagctggtgtggtggcgggcacctgtaaccccatctacttgggaggctgagatgggaatcgcttgaaccccggaggcggaggttgtagtgagccgagatcatgccactgcacttgagcatgggcgacagagcaagactcagtctcaaaaaaaaaaaaaaggggggggtggaggggaagaggaagaggaagacaagagagtcagaatcagaagcagagcatggggtgaggcagtccttggctttaaaaatagcgagtggaccatgagacatgggatgcaagcagactctaggagctggaaaaggcaagaaagtttattctcccgtagggcctccagaatgaatgtgaccctgccaacaccttgattttagcccagtgaaaatctttatcttctaacctacagaactataagataattcatttgtgttgttttaagccaattccttgccataaagctcttaaaatatatccccttttggttctgcttctctgattgaatcctgactgatatacatggtaaccaatttgattccctgtttaataaaagcattaaagatcaaattcttagccaggcacagtggctcatgcctgttatcccagcactttgggaggctgaggcaggtggatcacttgaggtcaggagtttgagaccagcctggccaatatggcgaaaccccgtctctactaaaaatacaaaaattagctgggcatggtggcacacgcctgtaattccagctacttgggaggctgaagcaggaatcgcttgaacccaggaggcagaggttgcagtaagccgagatcgtgccactgcactccagcctgagtgacagagtgagactccatcttaaaatacaacaacaggccaggcctggtggctcatgcctgtaatcccagcacttggggaggccaaggcaggcggatcacgagatcaagagattgagaccatgctggccaacatggtgaaaccctatctccactaaaaatacaaaaattagcagggcatggtggcacatacctgtagtctcagctacttgggaggctgaggcaggagaattgcttgaacctgggaggtgcaggttgtaatgagccgagatcgtgccattgcactccagcctgggtgacagacactccatctcaaaaaaaaaaaaaaaaaaaaatccaaagaagaatggtatttcatgacatgtgaaagtaatgcaaaattcaaatttcagtatccataaagttttgttggaacacagctatgcctatttatattatttatgctgcatgcaaactacagagttgatttgttgctacagagatagtaaggcccacaaagccttcagtatttactgtctgactctttacagagactggtcagggagggcttccctgaggaggggacatttaagctgagacatgaataacaagaagactggagatagcgggcagagctgtctaggcagagacaatggagagcaaaggcagttttctctctaatcttgtaacagtcttctaaagagaagcgttattaaagaaaaaaagaaaaaaaaattgagggggccctgaggctctgagggtgctgtagcctctcagggtcacggagactgtaggtcctgaggaggggttgggaaccagcactgtctggcaccagaatttgtggtgccttatgctgcctccttctcggcctgacacagcattggagcccagaaactgcatgttgaatggctttattcaccttcctcggggaaggaccagggattttagattcattctcaggaataggtgagaagagccaaagactcacccatgggcatgagagaatgttctctgcagcctcatggttagtggtaggcccagaggaggccaagggcagtaggcaagacaacggatagagaagagtagtgaattccagctatgtggagtttccagcttggcgaattccagccatgtggggtttattggtgctggtagaaaatggtagcctcaagccctcagttgacaagtgtggccagagagaaccccactctcaatcctttgtagaccaggtcattcccgccaggctctgtgctaacggaggagagtaggttattagtcccatttaagagccagagaaattaaggcagtggagagtagcagggctactggtttaaaaacactggctctgtgcctgaatcccagccttgtcatttgctagctgtgggaccgcaggcaagtgccttgatttctctatgtctgtggataatgatggtatctacctcaaagctatgtaaagaattaaggaaacaatagcccaacaccacacctgcaggaaggaagcaagtttattattactcaataaacattggtggatcctgatgacattctctcagtcagctttagcagtcttaagagactgcagaggatggagaacccaaggttagagccagatttcttctctacccagttcctcggggccaaaaccctgacaccatgcttaactcctcttttatacgccatagtccgtcagcaaaccttgtcttcagtatgcgtccaggagtccaaccattcctgccacctccaccgtattactttcatccagactgccatcagctgtcacctagattattgcaaaagcctccttgctggctttggggcttccatcctctctctctcgccaatccccagtcaactcccaacaggcagcaaagcttaggttacttctcagttcaaaacccttctaggtgtgctagaattaactgatttatttactcaatgattatttattattgagtgtctactatgtgccaggtactgttgtaggcattgcagataaaatggagaacaaaacagacaaaaatttctgcattcatgaagcttccgttctcatggagggagatggttaacaaacaagtgtatgagtaaaacatatggtaggttaggtgtcatgtggaaaaatagtttagggaaggcggggggccttggattttaagtagggtggtcaaggaggtctaacacacaagataagggttaaataaaaggccaaacgtaggagaggtgggagccaaagagctacccagaagaagagcattctagataaaggctcagtaagtgcaacggtggaagtattcctggtgagtctgggacaatagtggaaagtcaaagtgtgtgggaggggagatatagagccccatgcccccctcccacacacttcagaggggaaaagggggcaggattgagtcctgtacattccccacgttttttttttctctggagattggaagccattggagggtctaagcagaggagtgatgagttaagctgctgtgtggaagtccgtaaggaacaggggtgagtcagagaccctgaatggagccgttgcaattatccagatgagatagagtgccttggatcaggaagggaggtagcaacagaagcggccaataaagttcaaagtcctcagccccagtcctcccgatgggggtctcacctacccctctcacctcaccttgttcctccctgcatccccaccccaccggtcactgctaggcacatagaagcatctactaagcatgtggtgaatcaatgaaccccttaatgaatggtccacccctagatcatcagcatcctttttaacgctaggcatatagtctgaactcaacacatgtttacagatggaatgctgcacagtcctgccaagtccaggcggttattcctctccacagccgaaggaaactaaggctcgggtggggaagtgtccccctggggtctctccgcttaggctgcaggctgggcatcctttttcaaactcttttagcacagcgaagtcgagggcactgggtggagggtgcttgcttgccctcagggtgagtcacagtgacctcagaggagtttccccaaaacgtccccgccctgtgatggggaaaagccggaatctctcggtcccaggtggtcatgtggcccaggccggacaagcgtcccgaaagccccgggagagactaagaagcaatcctcccacgcgctttctcccaccctcgggccactgagacggagggacagagggccgccctcgcgcggccgaggccccgcctcccgctcgcccgcccgcgcctccagcggaagccggaagcaaaagcgggtcctgctagccccgcggctccgaactcggtggtcctggaagctccgcaggatgggggagaagatggcggaagaggagtgagtgggctttttcccgggcggcggaggcggcggggctgggccccggcgggtgacagcgagcgcctcaggccgccctccggccccggaaggcggagcttcttttgctggttggccaggactgaccaagccggtgcctacgaggagggcgggatgggcgggcctgggcccaggtgggccttgctttcccctggagatcggtccctcgagctgggaatctactgcccagcgcaggcccggagagctgtcttgcggaaaatacaaaccatatttactttcccagttttcggtaatctcatggttactgagccctcttccgcctcctccaggaagtcgtccgggttctccacacccacctcctacgtagccagtcgcctcctgtataacgatcagttttcatgtctttctccttcactaagtttcatttagtcattaactgttagccatctactcaattccaggccctgggcaggtggtaggaaaggaggccgaccaggagccgctctctgggagcttccattctagtgggaaaagaagaccataattagtcaaggtggtttcagatcgtgattaattaacgttatttgtgcctagtgttccattattggaacgctaagcatgtgggagttatttatatcctactgctcaaggtcatcgccaaggtctgatttttctcacgtctgcagttctaaaaattgcaacctctggcatgaatgggttaagtgttctgaaggaagcaaaatagagttaaggttggggagtccactcaggaaaaagtgacattcagcagaaacttgaatgaccagaatgagggataggagaaataacatcaggttcaaaaggcctggctcaagaaagagtttagtgcttttgagtgacaggcagcatggctggtgtgtagagaggaagggggttagctggacaaggggagatggggaaggacgggctgtgtcctccaggtacttttgggcaagtccaaaagtcatctccatacctgcagggcagagtctgttgcagattgtagatgccctatcactgtttgtggaatgagtatgtgaagatgaataaggaaccccttcattgatactggagtccttcacctgataacttttcaaatatatttcttggccatgtgggggtcatttcatgtaatcagttatttattgagcagctgctccatcccagacactaaacagcctcagcagcacaaaataaaagaggcaatatagcccagcgatttcaagtttgggttttcagcttgattctgccactaactgagatgttggtgaagttttgcaacctccctgagccttagttatgcatgagtaaaaaacggaaagtaatcatacccaatcagacatgttatacctattaaatgagaggtagtgtgttacctagttcctggaataaagcagtgctcagaaaataataacttttgtagtcacagtaacagttattatagcaatattgtactagttcacaatcccagcacagtgtgaaagagctgtgggaacatacgcagtggagtgggtaaattcgggtgtggtaagatggggtaataggaggtgacatttgagccgtttgaaatctgagagggattttgtaaagtagggtagggcatgcccagatcaacaactgggcaaattgaggtggcttcttcaacttgcagaaataatgccaggaaaataatgtaaattggagaaacaaaggtgctaagtaaacagtgttggaccttggaaagtgatgagactccagtttgcctccctttaaatcccccagtatttgccaaagagcaggcagcatttcatttctatactagctctgattccctaccgttcttgtcctctaagtggctgtattcaaaagcaccagaggccactggtacccttgtgctgtgcaggcagggattttcttagtaagtttctctcgaaggcctgcctgttaaagacttctgaatcccataaagttcttggacagcttctctttctggtgtgaggtgtgtgaattgatgttttgggacccttttccattatctaattatgctttctatgtcctccaggaggttccccaatacaactcatgagggtttcaatgtcaccctccacaccaccctggttgtcacgacgaaactggtgctcccgacccctggcaagcccatcctccccgtgcagacaggggagcaggcccagcaagaggagcagtccagcggcatgaccattttcttcagcctccttgtcctaggtgaatatggacactgtcatccccatcatctgccatcccgtgtctgtgtgctcggtctgtgtgtttaaccctgtcactcctcttgactgtcaagtcttcctcccatttggttttcatatcaaacactgagggaacatgatcagtttataacatcattaacaggaaactctcttctttataaaatcatggtgcttagcaagttctgaagagctgttgatgtaatatcttggcctttgaaagaaggattaaaaaaattttggcctagaaagaatcttgaggcctggcgcggtggctcaagcctgacatctcagcactttgggagacttgggtggatcacttgaggttaggagttcaagaccagcctggccaacatggtgaaactctgtcttcactaaaaatacaaaaattagctaggcgtagtggtgtatgcctgtaatcacagctactcaggaggctgaggcacgagaatcacttgaacctgagaggcagaggttgcagtgagccgagatcacgccgctgcactccagcctggatgacagagtaagactgtctggaaaaaaaaaaaagaatcttgaacatctagtttaatggatttcaagttctactcaaaggagtatgcacctgtgcaggggatgaaggagcagggggtggggtggcaggaggtgggaggagtcagatgggagaatatctgaccccctgctcctggcttcaatcagagcagcattttgtgttcatatttatttgacttccatgtgaattttatttaatggttttgctgctgattgaaagagcagaaacccttgccccagcaccctgttttccttaacctctgtcattctcattaaccatggtcatgacttttgccatatctatgtaccacctgtattgttaatttagttatgtactatttttgattaaatgcattcactctctgaaaacctcattttgggccgagtttggtggctcatgctggtaataccaacactttgggaggccaaggcagatggatcacttgaggtcaggagttccagaccagcctggccaacatggtgaaaccctgtctctactgaaattacaaaaattagctgggcgtggtggtatgtgcctgtaatccccgctactcaggaggctgaggcaggagaattgcttgaacctgggaggcggaggctgcggtgagccaagatcgtgccactgtactgtagcctgggcgacagagtgagacactgtcttaaaaaaaaaaaacaaaaaaaaccaaaaaactaattttgttcaaccttctcttttagtgtgtgaggaaatttcagcatagagaagtcaggtggttgtcataccaggctgatataagactagagactgataaccaggttaccagataccagtcgagaggtttagataaaagacaaaaacttaaatgcctcccagtgtgcctccatctcaaaaaacaaacaaacaaacagacaaaaaagaaatccagttgaaactacacaaccacttttgattagctaaggaataaatagctttgagtttgacccaagttcaaattcttttttttttcttgagatggagtcttgctctgtcgcccaggctggagtgcagtggcattatctcggctcactgcaagctctgcctcccgggttcacgccgttctcctgcctcagcctcccaagtagctgggactacaggtgcctgccaccatgcccagctaattttttgtatttttagtagagttggcatttcattctgttggccaggatggtctcaatctcctgacctcgtgatccacctgcctcggcctcccaaagtgctgggattacaggcgtgagccaccacgcccagccaagtccaaattcttgtttggccgggcgccgtggctcacacctataatcccagcactttcgcgtggatcatctaaggtcaggagttcgagaccagcctggccaacacgatgactccatctctactaaaaatacaaaaaattttagccagacgtggtggcgggcacctgtaatctcagctactcgggaggctgaagcaggagaatcacttgaacccgggaggcagaggttgcagtaagccgagatcgcgccactgcactccagcctgagtgacaagagggaaactccataccccacccccccaaaaaaacaaaaacaaattcttgtttgaaagtgaaacaagcatttcatttgctgcttttctttaatgataccaaagtcatactcctaatgagattaggtcttttcagaaagttaaaaggtgcaactgtttttttttttttttttatttctctgatgtgtattaggactgtttattaaggaaaagtataacttctcttacatttatattctgtctctggtgagtggacaaagaattttaataatacacttgaggccagcgatttgagaccagcctgggcaacatagtgagactctgtctccacaaaaaataaaagattttaataatacggtctttttatttgaaatcctaggactcatccttgtctgtcatagttttagaaacttataaaccgatactgaaaaagtacacagaccagaagtatacaatgtctcatatagatttaatacaccctggtaattttttaccctgtaaatgtagttgaattctatttctaggggattacttcaacaatgaaggactctcttttgttttattttctttttcttttgtgatagtagtcgaagacaaagaagaaaagcatttcttttcttgattaagaaatctttagtagctgaagtcttccttcaggattaaggagtattattaatctatttacactgctgtcaatttgatatgttagacaatataaaaggcgggcctggaaaaaaaaaacttttgtaatcactttttttttaagggaaattgaaaagtataatatgacttttaaagtaacttccagggcgtggagcatttaagattagctgaacaaaagaccacaaaacaggtttctataatgtactttttaaaccaggcaaaatcctgcccagtgttaatacatctttggggccagaaaggctgaacttgctgtatatttctcttggattgccctctccaaacagattataaacctagactctagagtcacaccaatgttagatggctttcattttcacctaatcagattcttgatagtttatgagttagtgtctctgcttatgtggaggttagcatgtattaccaaaacagaatgatgctttctttttaagtaaatttaaggcattgtttgcctgttgcatgttattttatttctgattagatatccaaacattgaatttttttttttttttttttttttccccctgagatggaatcttgttctgttgcccaggctggagtgcagtggcatgatctcacctcactgcaacttctgcctcccgggttcaagtgattctcctgcctcagcctcccaagtagctggggttacaggtgcctgccaccacacccagctaatttttgtatttttagtagagatggggtttcgccatgttggccaggctagtcttgaactcttgacctcagatgatccacctgcctcagcctcccaaagtgctgggattataggcatgagccaccacacccagttcaaacaatgtaaatctgatggtgttttaaaaattgctgttattaggtaacttgctaattcatgaataaatgaactcaagtgaattaagggaaattagcccatagtttattctagacctcagaactcctgacctggaattcatttgccactttttgttactcttttagttaattcaaatgaaatggtaacttttgtgtcctgtaagcacatgacaggattacagtgtgttcctctttgttgagaagggatgacaaaactctgtagttacttttgatttttagaagcttgaaatcagttgacttgcatttaaccgttgttgatctttgactccacaagaaaaaatggggaatcattgttatttacttacactagattaacaattaacattatttgacacatacattttatgggccttgaaacttaatggagttattatgattgatatgtgttttatatattttccatagtcattactccaggcatgaaaaattgaaagcacaccctccataccacacagaagtgtttgccctttcttgctcggtttttttccaagtgtacttgaaaacgtgcttgtttttgcatatacagatgtatattcgtaagtacatgcagaaacacaaataatacatgtttggagttgcaaatttgttttgacataaatggggtcccataacttgccttttcatctcacagaatgtcttggagatcattgtattggtgttttttctgtctacctcattcttttttttttgtagtaaatacataacatacatttacaattttaaccactttaaaatgtacagttcagcagcatctagtacattcacaatgttgtgcagctatcactactatctagtttcagaacattttcatcaccccaaaagaaaaccattaaaagcagtcattccccatccctcccttttctagtccttggcaaccactattctgctttctgtctctaggaatttgcctatttagaatatttcatataaatgaaaccatataatacgtggccttttgtgtctggtttctattacttagcataatgttctcaagattcatgttatagcatatgttagaattgcattcctttttatggctgagtaatattccactgtatggatatgccacatgatgtttattcattcatcagtgaacatttggattgtttctaccttttggctgttgtgaatactgctgctgtgaacatttgtgtataggcttttgtgtggataaatgtttttatttcttttggatatatacctgcaagtggaattgccgagtcaaacggttactgtatgtttaactttctcagaaactgacaaatgttttccacaggggctgcaccattttacaagggttccggtttctccatgttcttgcgaacacttgttttctggttttaaaaaaatgatagactgggcgtggtggctcatacctgcaatctcagcactttgggaggctgaggcgggaagatcacttgaggccaggagttcgagaccagcctggcaatatggcgaaaccctgtctctcctaaaaatacaaaaaaattagctgggtgtgggcgtggtggcatacacctataatcccagctattcgggaggctgaggcactagaatcatttgaacctgggaggtggaggtttcagtgagctgagattgcaccactgcactccagcctgggtgacagagtgagactctgtctcggggaaaaaaaaaattatagctatcctagtggatatgaaattgtatttttgttttgttttgttttttttgagatggaatcttgctctgtctcccaggctagagtgcagtggcatgatcttggctcactgcaacctctacctcctgggttcaagtgattctcctgtctcagcctcccatatagctgggattcaggtgcgcaccaccacaccctgctaatttttgtatttttagtagagacggcgtttcaccatgttggccaggctggtcttgaactccgacctcaggtgatctgcttgcctcagcctcccaaagtgctgggattccaggtgtgagccaccgcaccaggccctcactgtattttttaaaaaatcttacatgtccttccagtgaatcattgtattttgattttagtttcccttgtgactattgatgttgaacatcttttgtctattcatgtcctatgcccgtttaaaagctgtggtgtttgtctcttggctgttgagtttaagagttctttatatattgtggatagtacacctttatcagatatatgatttgcaaatattttctccccttctatggattgtcttttctgactttattctttttaatggctgaaggctgttacctggcattgatgagccttatattaactctttctgttaatagtttccccttttgctcttaaagccgcaaagagttgtttgatctatttatgagaataacttaaatttttaaaaatctagcttggtacaaaggaagagcagaaactggttcaactctcttggtctattttctgtccacttatgtgcttatttgccgttttttgttttgtctagacattgggcatgttcattagtcacatgttatgtttatgcactggaacttttttcttgccattagtatttaatgtaggatttctaactaggttaaatatttatataaaaataacaccacagattgatagtttaaagcacagaatgaaaagaggacaaaatgtctacatttacaacactctggccacctggtgttttttggtgggattaaagaaacctaatttgtcagtgcagcctctgagggtgaccagttaacaggcatgtggattgtttaaacatttccttgaaaaaaataacaaaattaatgttagtcctgttaatactgtggttgatgagctggtataccatctaggtgcccagtaaaagaaagacatgcacgctaacatttggattaggaaattacattcaggaataatttttgtgaagtacccattttttttgccggggggttggtgggggcagaaatatccctttcaaatcgttttattttacatcttcttattttctttcataacaacacctctgtgaggaaagttagacattattctgttttggagattgaggaatgaaggcatccagccaagtgggaggtggtggggtatgctgtggttaagagcacagatttggaatctgactcaatactgcagcacctaccagtggtgtgacaggggctgtgatgtctagaagcctcagttttctgatttgtaatcagagaagatagtggtaatgacagctaattccgagggaagttggaggattaaatgagagagtatttggggtgttcagcctagttcatggctcatgggaagtcctcagccgatgggaatggcaggacacagctgcacccagctggggagcaggagtgttccatattcagatctctgatgttcttgtcaccaaaccatttactttttcctgtttgtaaaacccttacttccctctatgttaagagccagtcacatgatggcaaaataatttgtgtcaatgcaatctgttgcagttacatttatgtaaaagtgattgatttcattgacttcctcttcaccatatagtgttccagttgataatcacttccaaaaagttgaagaccatttctcagaatcagaaaaatttgaataattttaaataattttataaggtttaacagcttatataaaaaaataggtttctggctgatcaccgtggctcacgcctgtaatcccagcactttgggaggccaaggtgagtggattgcttgagcccaagagttggagaccagcctgtgcaatgtggcgaaaccccatctctactaaaaatacaaaaaaattagttgggtgtggtgtcatgtgtctctagtcccagctacttgggaggctgagatgggagaatcacctgagcctgggaagttgagactgcagtgaccctagatcataccactgcactctagcctggatgacacagtgagaccctgtctcaaaaaagttagatttctgttcctcttccaataactactgggaaacaaactagttcaggcagacaaagaagtatagagaaaatataataaacattgtaaatgtacctccagtttaagaaatgagacacgaaaaacaccgctgaagttcactgtgttattccaattgtccatttctgtgaggacccccccagaaataaccactgacttgaacttggtgtttatcattcagaattgagtgttttttttaaaacattgtattatttttttttccacagctatctgcatcatattggtgcatttactgatccgatacagattacatttcttgccagagagtgttgctgttgtttctttaggtaagtgtgtattggtgattccataataaaagcagtaacaataactaccattttttgagtgcctctttagtgccaggaaccacaagagatgcatcacatccctgatctcatttgatcctcactgcaacctgccctaagggtgctatgatcccattttacagatgaggacactggggctcaagaagggtagtgacctcctaaaggtcatgtagaagcccaaaggccatacagctctgtacagctcaaaggccctttcttagccttttgcttctggtagaactacccttggggaacattgacctctactgctaggctaggctgacatccaactcaactaaggtaagtaatgacacttcatagaatcactcaattttatagacagaagggactctgactttacagtttaggaggaagaaatggctcacttaatgccagagtcaggtctaaagtcttcagagagcattgtgctctaccccacttacatttctgttttgtttcctgtgccaattaactgttgagatctagttgcagtgaatgaacccgtgtaataacaggtgtgaatgcacacacaagttcattgaagtggttagtgaaggaagaagtggggaatttccgtaagtgtaagttcaaggctaaaatgtgggtggagacatgtaaggcacagtaaataaagtcttactaaggtcagccaaagctttttatcagtttattatattgcagtcacttttactagtttctacttgcctactgatggtatttaatttttcctgatcactgctgatgtttagaaattaactttcattgcctggtagatctttagtggagtagtaattctttcacaagatagttattgtttagattagctttggaaatgattgtttagactctgttcactagcctccccctcctcccatcaccccagcagtcctactaccttggttcagactctcctgtattttccctggacttcagtactaagtgccagatcctggcttgtgaggcttcacattgtcatctatctcatttatgccttatgacctccaggtgatgccgtattttaaggaatgggcaccactggatagtgttgacctcgagtacaggtttcaaaaccagttttactcaaaaagttcttgttctgtttttagcatgttttttagcaatatatcttggtagattctaacaaccttagctagtaagatagtcatagagctctaagaataggagccttgctcattaacattcctttctgctattaggcatattgaaaagaacctatgtgactaatacccataattctgggacattcggtaaaggctctaagaactactccaaggaatttacagttgtgtggtcagttttatagcttcttacataaatttgttatcaaaattatagttggtgtgtatttagatattatacacatgaaaattaaaatgataattcttataatttcatttggaatttcaagctcctcatgtttcttgaatgtctgggtaactgcagcttgctgaacaccagtgcttctattaggacttagagcagacattgttggtggcttaccaaagagtcatttcccccttcttccttgaaaatagaaccccaaatttgatcaggtatcttgccacagtgtgctcaaggaagatgggcccctccaagtcaagattggtctttgccatcatgttaatttcactcttctctgccaatgattagttcagaggggtaggggcggcaaggcagtgtgaaacccagttctggccagtgacaccaaggggaagcgtgatgaggtagtgggtcctggaaaatgttttcctctcagatagtaatgagacatttccccttcatttctttgatgctgctgaatgagagtgtgatgcctagtggactggtagccatcttgcaactactgtggctcaaagacaaaagccagaatgctaaggattgccgaggggacagatgggaatcccagattattgatagcattgttgctttgttgagttgatagccctgaaacttcctatcttagtgctaccttttatatgagataataaacatctattagctgttgttgacttggaataaagaaaaaaaaccaaaaccaacatctattgtttaagccatttttagtctaggttcttttacttgcaactaaaagcatcttaactaacatagaactctttccattcaagggacaaaacccaattcaaaagaaaataaattggccaggcgcggtggcttatgcctgtaattctagcactttgggaggctgaggtgggtggatcgcctcaggccaggagttcaagaccagcctggccaacatggtgaaacccctgtctctactaaaaatagaaaaattagctgggcatggtggcaggtgcttgtaatcccagctactctggaggctgaagcaatagaaccacttgagtccaggaggcggaagttgcattgagctccagtcaacgccagggcactccagcctgggtgacagagcaagactctgtctcaaaacaaacaaacaaaaaaaattggtgggggtaggggcgctcacctcttgactcatgtaactggcaaaactacaggtagtattagcttgagacttagctgaatcaggtctcctggacccagttcttctccatgcctcagcagtgaatcccttttccccggcttcgctgtcaggcaggctctctccctgtggtactctgatccgttctcagacaggctcttggtgtggtaagcccttaaagcagtaactgcagtgggagagagaacctcctcttctttctggcaccaaaagttgcaggatgaactctgaccacctggcgacctcaactgggagtggggtggaatggtgttgggagtcagccagagctctccatctacaaggttcatttcttcactgatgttgcagaaataattgtagcctgaatagctaggtcttgggagaagtgatggaaaggcagtcttgctttcaatgcttacttgctaactcaggtgactggaaacccaagagcacttccagggagagtgctgaggtccagaaagtactttttaaaaattatgttagaggacatttggttagaatttgtaaatgctgacatagctatcaaagtaattctgtatttcataaagctaaagaaatggaaggaaaacgtttttctccagctggagcaaagtgtaacaaaatattgagatatctaccatttcaagaatttccaactttgtgccaaaaaagaatctagaagaagttgccagagaaagtatggttttcgttctttcagggataaattttcctctcctgccagaagttgctttgtagcttgcagtcatttcgagacattactggtcttttgctttatagttaggtgttcagcattcctaagaaattctcagtatagaaaaggaccatctgcactccaaaagcacatgtcccctccttctaccttactgtatttttaaatgagtgtctgtctggccacttttcattctttataaaaatatagtatcaacctgaagttctaaagagttccttggcccctgttcgaagctttcaggatactttccatactttatggaattctgtagtttgggccttttaaaaactaatttcttttgcacagttaaacaactactatatatagaaaaaagaaaaatcttgtttattgacaattatttttatcttgtttcattctcttccagtccatgtgtagacatgtccgtatgtattagatgcctttgtatagtttaatttgagtttatatcattttttctgttctttccatgtattagttgagttcacatatttatttatttatcttttttttttcagacagagtctccttctttcacccaggctggagtgcaatcacgatcttggcgcactgcaacctccgccccctgggttcaagcgattctcctgcctcagcctcctgagtagctgggattacaggcacataccaccatgcctggctaatttttgtatttttagtggagacagggtttcaccatgtcggccaggctggtctcgaactcctgaccgcaagtgatctgcctgcctcggcttcccaaagtgctgggattacaggcatgaaccactgtgcccggcccatatttatttttttactggctgtgtaatgctgattcatgtatatattttaggctaaaatttgtaaggaatgaaaatgaggctgggtgcagtggctcatgcctgtaatcccagcactttgggaggccgaggcgggcagatcacctgaggtcaagagttcgagaacaacctggccaacatggcgaaaccccatctctactaaaaataacaaaaattagtcaggcatggtggtgcacgcctatagtcccagctattcaggaggatggggcaggagaatcacttgaacttgggaggcagaggttgcagtgagctgagatcgtgccactgcattccagcctgggcaacagatagagactgcatctcgaaaaaaaaaaaaaaagaaaaagaaaatgaaatacttgtaagcgtatggccagcatcctctgttgaataataccaaagacaggagtttcccccaaccccaaaaatcatgctttattttagagtgagaaaaggccagattagggttataagtggagggctgaaagtttgactttcagttgccaaagtttagccttaatactgctgatgattagaaaaactgtgatctaacttacaaactagatttgattgaatcattgggtaaatagaatatacaaaagtgctcccctgtcataactttttaaaccatatttgtgctatttaattctattccttcttgttttctactaaaagattttaatttttttgttttttaaggatagtacttttggccagttacagctcttttagaatttgtcgagcaggctttccagtttttgttggaaagcccccgtacccccaccaaaaaaaaattttttttttttttttttttttttgagatagagtttcacttttgccgcccaggctggagtgcaatggcacgatctcggctcactgcaacctccgtctcccgggttcaagtgattctcctgcctcagcctcccgagtagctgggattataggtgcctgccaccacgcccagctaattttttgtatttttagtagaaacagggtttcaccatgttagccaggctggtcttgaactcctgacatcaggtaatccgcctgcctcggcctcccaaaatgctgggattacaggcgtgagctaatgcaccccgcctaattttatatatatattttttagtagagacggggtttcttcatgttggtcaggctggtcttgaactcccgacctcaggtgatccaccaccttggtctcccaaagtgttggaattacagccgtgagccactgtgcctggccaaaaaattgtttttaattaaaaaaaaaaaaaagggcctggcacagtggctcatgcctgtaatcccagcactttgggaggccgaggtggccggatcaccttgaggtcaggagtttgaaaccagcctggccaacatggcaaaacctcatctctattaaaaatacaaaaattacccaagcatggtggcatatatctgtaatcccagctactcaggaggctgaggcaggagaatcactttactccggtagacggaggttgcagtgagccaagattgtgccactgcactccagcctgggtgacagagtgagactctgtctcaaataaatagtaataataataataataataatgtattaatatattttacacattagcacagtgcatggcacacagtatagatgtgtgtgtgtgtgtatgtatgcatttatttctttttaacacagtgcaaatacataggtgtgtgtgtatgtgtgtatatatagatttttttttttttttgagagagagagaacttgtgctgggattctacactttgtaacctgattattaatacatttgaggatgttttcggtggcccatgcgtcggggatggttggatagtaagatgggggctgtgagttcgctgctcagcaacttgatgtgggggaaactcggctggtatcctccttcaccaggaaagatcgttaatccaccgaaggacttgaagaaacctcatggggctgggcgcggtggctcacgcctgtgatcacagcactttgggaggccaaggtgggcggatcacgaggtcaggagattgagaccatcctggctaacatggtgaaatcccgtctatactaaaaatacaaaaaaaaaaaattagccaggcgtggtggcgggcgtctagtcctagctcctcaggaggctgaggcaggagaatagcatgaacccgggaggtggagcttgcagtgagccgagatcgcaccactgcactccaacctgggcaacagagtgagactccatctcaaaaaaaaaaaagaacctcatggaaagaaatgcttctttgtgaaatttttttggaacataagatcatgcctggattaaagtgaaacagctgaagccatatcatgctcataaagaggaaatgataaagattcacaagggtaaactattccagcaagcggtggatgccgccaaagagtttctcaggagagcccaaagggaaagatcagacgtcatcccacaattctgctgatgacaagaatcggcttaattccagtgaggagagaagcaggccaaactcaggtgatgagaagtgcaaacagcctgtctgaaggaaaagtgaagaagatcatgggagatggaaagaagggggtgtcttcgggctcttcagagacaggctccaaatcccctctgaaaagaatccaagagcaaagtccccagaagcggggtcagcccccaaagaatgagaagaatgtcaccatcgtggagtccggtaccttgaagtggatgatggccggaccagtggctgcatttaaatggcagccgaccagaagcgagcctgttaaagatgcagatcctcatttccatcatttcctgctaagccaaacaagccatctctgtctgttaccaggcaatcacaaagaagttgaaaatatgtgaagaggaaactggttccacctccatccgggcagctgacagcacggccgtgaatggcagcatcacagacaaaaagatgggatttgggggccttggtctcatgagaagtggaatcgtctctaacttgctaaaaatgggtcacacagtgactgtctggaaccgcactgccaagaaacgtgatttgttcatctaggagggggcccgcctgggaagaacccctgctgaagtcctctcaacctgtgacatcactttcgcccgtgtgttggatcccaaggcggccaaggacctggtgctgggccccagtggtatgctgcaagggatctgccctggaaagtgctacgtggacatgtcaacggtggacgctgacatagtcacttagctggcctgggtgattgcgtccaggtcggggggtcgctttccagaagctcccatctcagggaatcagcagctttctaatcacagaatgttggtgatcttagcagctggagacaggggcctataggaggactgcagcagctgcttccaggcgatagggaagacctcctccttcctaggtgaagttggcaacgcagccaagatgatgctgattgtaaacatagtccaagggagcttcatagccatgatcactgaggtgctgaccctggcctaggtgacagatcaggcccagcagacactcttggacatcctcaatcagggacagttggccagcatcttcctagaccagaagtgccaaaataccctgcaaggaaactttaagcctgatttctactgaaatacatgcagaaggatctctgcttagccattgcgctgggcaatgcggtcaactctctgactcccatggcagctgcagccaaccaggtgtacaaaagagccaaggcactggaccagtccaacaatatgtccgctgtgtcctgagcctgcatacactaagccgtcggaccccccacccccagccctctaatctctccgctaactccctcttcctcacatggggtcaggggcctgggactttgctctggaccagcccacctgtctccatttccttttacacagactttgagacttgccatcagcacagcacacagcagcacccttcctttgaggctggtatggaggggatgagtgtcagcaggattggctcatgggaaagctcttgagctgggcactggcctccacacgaggaggtggctgtgtgtgcacgcacacacacgaggaggtggctgtgtacacacacaaacacacacacactctctctctctctctctctctctctctctgtctctctctctctcaccccaggatagaaactgcccagaaacagctgcctggctttttttcttcttccaagcttgtcttatctcaaaccccttccagtcaaggaactagaatcagcaatgagagttggaagccttcccacagcttccccaagagcgaagaggctatagtcatgtccacgtcccccgctgaattctctgcagggagaggacttgggcccagatgagccagaccagactccagacagagggtcccgtggggcccccaaactcaggtgatgagctgagaaagagaaagatgttcatgtctaagtgtccagtgtgcacctagcactccttagacgcctttgtgaactgaaaagagactggcagagtcctgcgaaaatgaggccctggctttccagggagtatggtgagcatctggccttcgctgcctggaagtgacaccccagacaccactgccacagtgggcgcttgccccgccctgggctgttctagtatttggatttgcattccagtccttgggagggggtcctcagggtcattagtgaggagccaagaggagtggggttgggggacactccttcctgtttctgttaggccacagactcttcacctgcctctgaagagctgctctgaccttggtctcctccccgcagtcccacattctccagcctgccctgccaagccccttgcatgcccactgctctctgtcctcccttctccccaccttcctctcatggagacagtatttctttctgtctgtctgtcccttctttggcccagacccagcctgaccaacgataagcatttcttaggctcagctcttgatatggaaatgagtgtcttcactccagccagcatcatggtcttcggtgcttccaggcctggggtctgtcgggggtgaaaagaactggcctgacctacctgaactgactgaccctctggggtgggtctgggacatcctcgaggccctagcatttctccttggataggggaccagagggcgcttgggatgttgcataagaacaggaagtcacccaagggatgtcaatttcttatccctctacatgggttggattttccaaaatcataatttgcagaagaccagcacttatggtggaatgtatattataaggcagccacactggggcagggtccttcccctctccccactcacggctttggccctttcacagattagaacctgagttagaggattgcagaagacgaggtgggagggcagggaagatgcctgtcaggtttttagcacagtttatttcactgggattttgaaacatttctgtttgaacacaaagcctgttctagtcttggcaggacacattctgggggtgggggtggaggaagatgtggtaatgtaaccggttagtcagtgttgtcttaatattgttgacaattctgtaaagttcctttttataaatatttgttaagctgtttcacctttgttttgaaatcctttcctttttttttttggagacagagtctcactctatcacccaggctggagtgcaatggcatggtctcagctcactgcaaccttcccctcccgggtccaagcgattctcccacctcagcctcccaagtagctgggactacaggcacgtgccaccacactccgctaatttttgtatttttagcggagacggggtttcactatgttggccaggctggtctcgaactcctgacctcgtgatccgcccaccttggcctctgaaagtgctgggattacaggtgtgagccgccatgcctagcgtgtccttcccttttaagcagaaaatgtgacacttgtgaaaaagcttgtaagacagcacttccctttttttccctttaaacctttaaatggcaaatctaggtaattaaagttgtgaatttttatttttgctttgtttttaatgaacacttgtctttcagaataggattgtgtgataatgtctaaatggcaaaaacaaaacgtgattttgcacaattaacaaaactactgcaagaaaaataaaacatttcttggtaacaaaaaaaattaatacatttgaaacatttttcatgtaaccttactgaccaggaatacttatattttacagtcataatggtagccctgcagtgcactctgggagtgagcgagcgagcattggcagttcattgtagtagtgtaggcagcctgcagtagtgcagtctcctgtgtctttagcatgatgagatggtaggatgcacccgagccaacgggccagcatccttactggccctaagctctcagaaaagcttcttaaactctctgagcttccctacagtgttcttttgaggattagaagtaattgaaagtgacaaatcctgaaagaagcagctcaacaaataatcattaattgctcctgatcctctgaatgaattgaggggtgtccttaattaggtgtatgcacaaagatcaactaggagcaaaggaaaatgttagaacttgtgtttctatttatttttaacctcactcttttacaatttctatttttttgtgaatatttttaaatataagctgggcgcagtggctcacgcctgtaatcccagcactttgggaggctgagacaggcggatcacctgaggttgggagttcaagaccagcttggccaacatggtgaaactctgtctctgctaaaaatacaaaaattagccgggcgtggtggtgcacgcttgtaatattagcttgtctctctctctctctctctctctctctctctctctctctctctctctatatatatatatatatatatatatatatacacacacacactatgtatatacacacactgtatatacgcactatatgcactatatatacacacagtatatgtatatacacacactatatatacagtgtgtatatatatatatactgtgtatatatatatatactgtatatatatatatactgtgtatatatatatatactgtgtatatatatatactgtgtatatatatatactgtatatatatactgtatatatatatatatactgtatatatatatactgtgtatatatatatatactgtatatatacacacacacactatatatatgccatatataatatctggtggccagttgtgtgaaatacattcattttctctgttgggtagattgatttgacctaactatgagcctcaatctcaagaggtaaagtggtagtttgccaatttaatgctgcacaaaggattatttaagtaataataacaataatatcacattgtattttacagcgcttcctagtacatcataaataataaaaagacgcaggcttgggcaatagaataattactgattttcaaatgtaactgcttcatgtgtgattataaacgaggtaatcatggcattaaggtttggtatacatttagaagggaaaaagaaagttgaggttttagtaaagcagaaaaacactaagctttaaaaatgaagcctgaaaccatggaaagaggtttaacttccctagtaatcaggatgattgctgaatgcaaattgaatcaaatacaaattgaaacattaaagtacaatttcttgcccactatgttggcagaaatgttaacatctgatgattatccagcgcgactgaggatgtgggacgctttcttgtggaagtgtaagtcggtacaaccactttggaggataatttggcaatattttcagagttaaaaatgcttatgctttgtaaacctgccatttgtagtctctggatctgccctagggagatagtctgggtttgtttttttttttgtgaatgtcttccacagggagatactcttaacacagagtggcatgtacaagcatgttcaatgcagcaccactgttaatagcaaacagctggaggcaaccatcagtggggcaatggttcaaaaggttgtgattttaaaaaaaaggtacaatataattcacatatcataaatttcaccatcttaaagtgcacaattcagagttttttagtatattcacagagttgtactaccatcacctctacctaattccagaacattttcattaccccaaaaagaaactcatacccattagcagtcactccccatttccacatttctcccttctcccatcccctggaaaccaccaatctactttctgtctgtgaatttgcctgtcctggacatttcgtataaagaaatagaatcatacaatcggtggtactttttatttggcaacagctttattgagatgtactttgtatgccacacaattcacttttttttttttttttttttttttgagatggagtcttgctctatcacccaggctggagtgcagtgctacaatctcagcttactgcaacctccgcctcctgggttcaagcgattttcctgcctcagcctccccagtagctgtaattacaggtgcccgccatcacgcccaactgctttttttgtatttttagtagagacggggtttcactatgttgaccaggctggtcttgaactcctgacctcagcctcccaaagtgctgggattacaggcatgagccaccatgcccagccaattcacccattttaaatgtacaacaatttttagtatgttcagagtcgtgcagccatcaccacagtcaattttaggacatttttatcacctcaaaaagaaaccacatgccctttagctctcctccctgtccctgggcaaccattactgtccctgtagatttgtctattgtggacatttcatataaatggaatggtaaaatatatggtcttttgtgtctggcttctttcacttggtgtattttcaagattcttccatgttctggcaggtaccagtacttcattccttttcattgctgaataatattacattgtatggatataccacattttgtttactcactcattagttgatagacatttgggttcttcccactttttttttgaaatggagtctaactttgtcacccaggccggagtgcagtggcgcaatctcggcctactgcaaccgccgcctcccaggttccagcgattctcctgcctctcccaagtagctgggactgcaggtgcataccaccatgcgcagataatttttgtatttttagtagagacggggtttcaccatgttgttcaggctggtcttgaactgacctcaagcagtccacccacctgcgcctcccaaagtgctgggattacaggtgtgagccaccacacctggcctctttccaccctgtgactgtttgaaatactgctgttaggaatatctgtgtacaggtttttacatgaacatgttttcagtttctttgagtagaattgctgggtcataaggtaacttttgaggaattgccaaactgttttccatggtggttgccccattttacattcccatcagcaatgagtgcgtgttccaatttctctatatccttgccaacacttatttctcatctttaaaattataactgtgaaaggaagacaaatcttgggaccctaaaatcactaagctaaagggaaaggtcaatctgggagctgcttaggacaaacctgcctcccattctatttctaaaaagatagctactaagataaaaaagttaacatacctccctctcaatttgtacacaagaaaattccttgtggacaaaggacagaactcaaagtcacccctctctttgttgagataaatgcatatctgattgcttcctttggaaaggctaatcagaaactcaaaagaatgaaactgtttgtctcttatttatctgtgacctggaagccccctccctgcttctagttgtcccacctttccagaccaaaccaatgtacatcttacattgttgatagatgtctcatgtctccctaaaatgtataaaacgaagctgtgccccgaccaccttgggcacatgtcgtcaggacctcctgaggctgtgtcaagggtggtcatccttaatgttggcaaaataaacttcctaacttgactgagacttgtctcagatactctggtttacataaccatcctagtaggtatggagtggtatctcattgtagtttttatttgcatttccctaatgatttatgatgttgaacatcttttcatgtgtttctcagccatttgtatatcttcttttccaaaatatctattcaattttttttattatttttattttcattttattttatataatattttgagttggagtctcactctgtccaccaggctggagtgcagtggcatgatctcagctcactgcaacctctgcctcctgggttcaagtgattctcctgcctcagcctcctgaatagctaggattagaggcgcccgccatgcccggctaatttttgtatttttttagtagagactgtatttcactgtgttggccaggctggtctcgaactcctgacctcaggtcatctgcccgcttcagcctcctaacgtgctgggattacaggcatgagccaccacgcctggtcggttctgtgtggcatttttatactatcctgcccagctgttaaaaggaatgaagcaaatctatacataataatccctgactagatctctaagacttaatgttgaacaaaatagcaagtagtaggatgatacattatactaccataaattttatataaataaatacactcaggtgtgccatgcatacacttacacacacacacacaaacactcacaccctggtactgttgagttaaatatatgtaagaggatagagaagggcctgatataatatttcccaaactttccaagatagttggttaccttgggctaggaagagagagaacgaagatgggggtggaagtggggtatgatctaaaggggcttttgtcttatttatgacattttacatagtatccgcatactatttggccaataaaacatgtaaaagctccttaaaatgtaattacaacctgaaaaaataagaacatgggagctgttggggaactgtagcaggagatgggttcaaatccatgctccatgccctctggcaagggaatgtgtattcattgactccttttatagctcagctttattttgtcttgggtccttcctctttttcaaaatagttttattattttttaatactatataacaattcaaatagcatggaggtttataaagtgaaaatgaacttatctcccctcttcacctgaaactacccaccctgaggtagttttagtgcacgtccttttcctgctcagcttctgtgttctggtattgtctcctgcccacccagtaagctgtgcttccatcttctcgttgatggcgaaagctccttcctccatgggaaagtgaagtcttcgttttgaagcatccatggaatggcctgcaggcttgctttgtgtcacctcctacccgagattgtgattgtgtcacctcctaccgagactgtgaactcctaccctacaatgagtaggtctggagttctacttgggcgtctttattttataaaaagttcccatggtgattctggtgaaccaacagagggttaagagtcgtttatctagggagtaacagagcaatcataaattgtgcccatgctgcttctttgagaattatttttggtggccactttataagagtgatgagcctgtcagctttatggaaacatgcctgaacttagatggtctgttttcttccaggaatttcacagaacttttactttaggttattttcagcatttgtgtttttctagctaaatattcaacatggaactgctatttgagtctgagaaagtgatcatggattcttttttgaaaatgatggaaataaacagtacacggcaaacttagcttgtaaactctgcatttcacattgaaaatgggtggatatggtaaaaatgataggcggtaaatcttcaccaggcagagtgtccttgggtcttgctttaaaatacttttcctcccccacagcctgacttttgtatttcattttagtgtgtttgcctgagatgtgagtgagaaattcatgtgatagatgtctcacgtctccctaaaatgtacaaaacgaagctgtgccccaaccaccttgggcacatgtcgtcaggacctcctgaggctgtgtcatgtcttaaatttgagtaatctttctcatatcttaaatttatgttaaagtttacattttctcttgtaggtattctcatgggagcagttataaaaattatagagtttaaaaaactggcgaattggaaggtaggtttgccctttggttgttcttaattttagtaacattgatcattatgctggcttttttgtaattacttggctatcagtggagttatttatattattatgttatatatcccattactttttaatttttttattagatacaggttgatgcctttacatctgagtttttgcaaaagcataagtctcatgctgtttcaagtgaacatgggcgccaatgtcatttttttttgttattatacttgcatttttgtaatcctagactaacctacttttttaggcaggaaaattctctaattagcattaaacattaaatactgtttattgctcccaattccattttgacaactgaggataataaaacatacttgtccagtactgtgagacacagtactttatatattgtagctcatgttattctcatgacagtcatgtgaggtggattgtctgggtattgtaatatcatcacctcgtttttacagatgaaaaaagtgacactcagggagattgggatgtattcagtgtcacagagctagaaagaaagtggccgagtggagtcttgtgtccaaaccctctggcctgaatatgcagtgttttctccaccataccaccccgtcctcagtttgctgatatatatacccttgtgttaaagaggttattagaatatgaacatcatcctggggtgcaagtactcattgaaactggaatttcaacataaacttgagcatccatgttgagtagggcgagattaacaagtatgctacaaaattgattttgtggagggaaataagattcatttcaaaatataaagaattatatggctaaaattgatcacatttaagcccttcctactttgatgaagctcctaggtgctaggattaattgacctgtgaaactgtagagtgtaaaattagcaagacaaaccttatagactaacgtaaaacacaatttgaagctgttataaatagtagtaatgaaatattttatatattaaataaattttgaaaatgtatattgagctctggagagtgataagacacacttctgctggggaggccccactggagcgcattgcatgtgggatctctgccttcctgctacttggttacatttaaccacccaagagtgggtcatgactgaagagcctttttctactcctaggctggatatagcctgatgtgtagattttgcccactaacccattttgtttgatctgatttaaaaatcatttgatcaaggctgggcgttggcggctcatgcctgtaatcccagcattttgagaggccaaggtgggtggatcacctgagctcaggagctcgagaccagcctgggcaacatggtgaaactccgtctctaaaaaaatacaaaaaaaaaaaaagatcaaaatttgaattgactttaaaacaattaaaaattgttagattttgggcgggtgcggtggctcatgcctgtaatcccagaattttgagaggctgagtcacgtggatcatctgaggtcaggagtttgagaccagcctggccaacatggtgaaacctcatctcttctaaaaatacgaaaaagtagctggacgtggtggcacgcacctgtagtcccagctacttgggaggctgaggcaggaggatcgcttgagcccaggaggatcgcttgaggctgcagtgagttataattgcaccactgcagtccagcctgggcaacagagcaagaccctgtctctaaaaaaaaaaaaaaaaaagttggggcaggcttcctggaggagactgcatttgtggagagtcagagtgagaagtaggattcctgcctggaaaccagatgtgcagggagcagtgggaagtcagaaaaacaagaggagctggtggtttctttccctgaagttctgattccaaactgacctgctgggtctgcccaggtagcaacctgtattatcatgtgcttaatatttttctatcaacttgctttttaattatatgtatatatatataaattatttatttatttcttattttctttttttgagacagagtctctcttggttgtccgggctagagtgcagtggcacgatctcggctcactgcaacctctgcctcccgggttcaagtgattctcctgtctcagcctcctgagtagctgggcaggagaacaggcatgtgccaccatgcccagctaatttttgtatttttagtagagacagggtctcaccatgttagccaggctggtctcgaactcctgacctcaagtaatccacccaccttgtcctcccaaagtgctgggagtacaggtgtgagccactgcgcctgggtgtggctaatttttaaaaaaattttttgtagagacacgatgtcactatgctacccaggctgttctcgagctcctgggctcaagtgatcctcccaccttggccttccaaagtgttaggattacaggattgagccacgtggcctatatatttattttattttattttatttttttttttttgctggggagtggtggggagcagagtctcactatgttatccaggctggagtgcaatggcgtggtctcagctcactgcaacctccgcctcccaggttcaagcagttctcctgcctcaacctcctgagtagctagaattacaggtgcctgccaccacgcccggctaatttttgtatttttagtagagatggggtttcaccaaattggccaggctggtctcgagctcctgacctcatgatccatccaccttggcctcccaaagtgctgggattacaggcatgagccaccacgcctggccatgtttattttcaaggcaacattacagtactatttcaattcagaaactaatattgttttgtaaacatgataaaaatgaagtagtacagatgcctgctgaagcatcagaggtcaagtctgctctctgtcaagggagatcagcacgttggagagagcccttagaagcggtattgccatcctaaggtgtcttggatttatttgggcctgaagaaataatcaaaaggggctgactctctcaatccatgaggtcagtggtatttgacacacactgctcaagtgccacctaaaatcacctcagaacattttgggggagccattgccaaaaggaactgtaacactatttccctgaaaggcagtgtgttcataagggctgcagtaacaaattatcacaaactaagtggcctaaaacaacagagatttgttttctcacaattctggaggccagaagtgagaagtcaaggtatcaacaggaccaggttccctcccaaagactctagaaaagaattcttcattgcatcttccagcttctggtggccccggttttccttggcttgtggccgcatcactcctgtctttgtctctgtgctcacatggcattcttctccacgtgtctatgtgccttgttctgtctcttacaagtcgatgtttgctgcctttggccttcccttatccagtgtaaggtcatctagatccttaccttcattagatcttcagagaccctatttccaaataaggtcacactctgaggttcctggtggccatgaattgtgattggggttgggggacactatataaccccactataggtagattctcctttttcctggggtggggggggctagtttttatacctccaaaaggctgtatatagtggtcctgctgcacagatcctgagaataggttgccccgtaaaacacagagctcggctcattttttttcacacagtcccagtctgaatcatgagcttgagcttgttgtacatgctgctattttaagacttaataaggcatttcagaagtcatcatttgcttctattttgagcgttttttgactttcttttagtctttatggtaacagctgtacatttgtaagaatacatttaggcattctttggaataggcattttgacaaaaaatcagactgtcaaaattgtgacatgggaaaatattcatatgaaaaagggcctgattttgcatttttaaatagactgtgtattacacataaccattttgggcttgaggaccaatatatatttccccaaaattctaccaacaactagagagatatattaataatatagaaaatgaaattgttattgtttcacccctccaaagatggctatattctagaaacacctttcgtagtggcacttaataatcaaatctggaagcatggtgctatggtttgggcatttgtctccccaaacctcatgctgaaatttgattccagtgttggaagtgtttgggtcatgggggtggaccctcatggatagactgatgcccttgctgggggagggaggtgaatgagttgttgctctgttcgttccctatacagctggttgttaaaaacagcctggtcccatccccgccccccctttcttcctctcttgccatggatctctgcacactctggctccccttctcttcccccatgagtggaagcagcctaaggttcttatcagatacccagtcttgaacttttccggacagcagaatcatgagccaaataaatgtttttcctttgtaaattacccagcctcaggtattcttttatagcaagacacatggtaaggggctgtctttgtatcaaagtctcaagtcgaaagagcatccagtgtggactgttttatcacatcagactttggaaaatggcagagttgtctgtgataagcagaaagaaggcagagctattttaaccatatataggatttactgttcctctgagtggattgttttagggcttgccattacctttttcctggaggattccaatttgtggagttgtttttgaaagtctgcaaccagaattgaaattttctgtattcagattaattttctttctgtactaaggaataaaaaacatactactgtgttgtgctgtttcttttcactgatcacctttaaaatccttgtcttggccacgcatggtggctcatgcctgtaatcccagcatttggggaagctgaggtgggaggattgcttgaggctaggagtttgagaccagcctgggcaacatagcgggaccctgtatcttaaaaaaaaaaaaaaaaaaaaaaaaaaaaaaattagcccggcatggtagcacgcacatgtagtcccagctactcaggaggctgaagtgagaggatcacttgagcccaggaggttgaggctacagggagctgtgattgcaccactgcacttcagcctggacaacagagcaagaaagactctgtctcaaaataataataataataataatgataaaaataataaaatacagtttcatttttttttttggtgggggaatctctcattctgcttgattttattatcaggtagttatttaaacattatatgtttccactaggccaggccctgagagaataattattttggctctttattgattaatttatttcttaattacacaaattccatgcccttaagatactcattttctatttacaggaagaagaaatgtttcgtccaaacatgtttttcctcctcctgcttccccctattatctttgagtctggatattcattacacaaggtgagactcaggcacacattggtgctttggtctggacagtttctcatgtttgtaaggcaagttccttaaaagcttgggtataatttagcagcagcagcagcagcagctctgctccttcctggttgtgctcagtggaagctggactgcagtgcctgacttctggagaggagcagacatgatgaattggctgctttaatggtttcaggcagtatggctcactgagccagtgtttgccataaatgggtgctttgcccaggaagatggctgaagtgatgttaagtggctcacagatgatgcattgactcgtcttcctggacacagactgatagatgtaaagaggatagactgtgtcctgggacgacggggacatgtgccccaggacttttgtttctttcagctcccccactggggcctttctaaccttctcaggcccatccatccttccatgtctccctctcggtgccctcccctggcctcagaccccagcttgatattccccttcatccctcaacctctatcgctcctcgcccactccctggtccagcttctccttcccaggctggagccccatccttccctgcctagtcccacagttgcctgcccattctttcctccctgccttggtgagcagtggcactggcccctacccacttctctgctttggcttggccttgacggccattgccttgcaactcccagtgtgagatgtttttttttttgttttgttttttttgagatggagtctcactctgtcacccaggctggagtcctgtggcatgatctcggctcactgcaacctccaccttgtgggttcaagtgattcttctgcctcagcctcctgagtagctgggattacaggcacacgccaccttgcccggctaatttttgtcgttttagtagagacggacggggttttaccatgttggccaggctggtctcgaactcctgacctcaagtgatccacccaccttggcttcccaaagtgctggggttacaggcatgagccaccacactcgtcccctagtgtgagtctttctgcctgagcaggagcttctcacttttaagcctgcttgtgtgcgtgcatggttttttccttgtctgtgagttttctttaaacataaatgtatttaagttttaaaataaagtgattcaacttaaaatactagtattaataatacagcagctattttgtgaatgtgatttttaaaaaaactgtgaagattggaaagtttaggccagtccttggagagaggaaagccagagacacaacacagatctaatcatgcgctgccccctacaggtttctttttggtaaagtagaaaccaaaaaccccaaaaccctacctcccagggtgctttgagagtcacactagatgaaagaacgtaggcaaagcaccacccaccacactaaataaatgaagtgctgctgcttgttattaatgataaaaatgtcatttattattaataacaatattaccaccagtagtaataataatttattaagcttaatatggtcgggcccagtggctcatgcctataatcccagcactttgagaggccgaggtgggtggatcacttgaggccaggagttcaagaccagtctggccaacatggtgaaaccccatctctactaaacatacaaaaattagctggtcgtggtggtgcgtgcctgtaatcccagctactctggaggctgaagcatgagaatcatgagaatagcttgaactcgggaggtggagcttgcagtgagctgagatcacgccactgcactccagcctgagtgatagagggagactttgtctcaaaaataaataaataaaaataaacttaatttgttgttgacatggtataaaataaataaatacataattttaaaaaatgagttagatttgtctagaaatgtttggtaaaaacatagaaattaagtctttaattttcctgtactaaaacaaaagcatattaagatgttcagcccagatttttttttaagttattattttattgtgcatctatccaaagaaaaagtgaaaaggaaatttaatgtaaaaaatattcacaagtcttacaaactgttagtgacatcagataatttttaacaaggaaacataagttgaaggtcaccatgtctttcctttcactttgtaaacaaatcttaactgtaagcagatatgaaaatatttcaaaacatgctgaggaaattgacttgattttgacttaaaaacatgacattttgaatattagagcatgtaaagtttttcttttcttttttttttttttttttagaggggagagaaacttgttcaaaatttgaggaaagtaatagttttttagagaaacattttgttgaagatgactttccagcaggaaatgtgacaatttatatgaaagggactgataggattatgaaatgctacttctgaaacttctatccactttctaccctcgcccaaagatgataggaagtaaagtttgaatattttattttaatattatgatatctgctaatgtaaatttggatttagaatacagattacagtaagattatcatcagttgatatgcattagctaggcagcaactggttctttgaattgcaaatattacacaaatcacaggatgttaattatgtcagagagaaacagataaatttgctttatgtagcagagggaagttcttgtattatggtaactttaacttgggtaaatgttcaggatccagattaatattaaccaaatatataaattatatcaacattagatctctgcaaacaggtcaaaactgattaatctgtttttttttttttttttttgagatggagttttgctcttgttgcccaggctggagtgcaatggcacgaactcggctcactgcgaactcggctcactgcaacctcggccccctgggttcaagcgattctcctgcctcagcctcccgagtagctgggattacaggcgtctataaccacaccagctaattttgtatttttagcagagatggggtttctccatgttggtcaggttggtctcgaactcctgaccttagatgatccacccgccttggcctcccaaagtgctgggattacaggtttgagccaccgagcccagtctaatctgtttttaaataacaaaagaaaacagcgatttgcaaagagcaactcatagattgaaagccctttgttttgaaaaaccaaatcattgtgttttaaaattctttgtgcagtaaagattgatatgccaaacaaaggaattgaatgtcagatgataggcagccaagtcaaaattgcagcttctaggaggtgggcttagtggggcagtcagtgttcagctgaggacactctttcacaagtgggctttaaaatagcaggtcttgatgtccatggtttggtgatttctgagctaaaaacaagattcttgttcacaaccacaatcgggggtgatcaaagactcttggtagctcctaagtggagttcatagggttataataaatagcttaatttccttaattttatggaaatttgaaagatgctaccatgctgcttgaacttgaatattttatcttaaacgctgtgaagtatagatagaaacattttatctgacatagttaatgatgatactaatagagtgaagtaaaattgtttaaaagacctggccaggaaaaaggaatatctgatagtgtatcttggtatcctaatagtgtggactttggatgtgaaacacagttaattccttcagtgcctgtctgttgggcatcttccatctgacgggcattatgtcagggaccgtgttgtgcgaaagcaggtggggtcattgcccagaatgagcctgcagcctcatgggaaagtaagacatcagtacataaataagtgcaaaattgcagtcttgtcaaccgctacaagagagggtgactgtgcactgagagcacagactaggatctgggaagagttgaaatgtcctgagatcttgggatgatgaaagcttaacaagcaaagagggagcacaacctgctcgaagccaccagtgggactggaacccagagaacaaaggcgagcatggtgccagatgagcccagaggcctccccaggagtcgaatcattcagggtgggggctagctgcattttaagtggaaataggggtccaggtgaaggcagcacaatcagatttgtcttttgggaagatcattctggaaagacgggagagtggagggaaaggggccctggggggttgaggagacttgtgcgaagctatgcagtgtttcagatgaaagatggtgtgagtgacgggacactgcagtaagtgcgggggtgcaggaagactcccgggctcccagcttgccacacaggttgggcagtggtgccttttacagagaatcaagtctgcacggagggccaggtgtgcaggccgtgccttcactgacaggaatggcttttctaatcatttccctgatttctgctctttcaaacagggtaacttctttcaaaatattggttccatcaccctgtttgctgtttttgggacggcaatctccgcttttgtagtaggtggaggaatttattttctgggtcaggtaagaaaatcatctttgaaacactttgaaagtcttacattcttagagctagtgcagggaggtgggaaggtgaaatggggccactttgtggggcctgggtttcacccttaaggtaaattccttctggaaggaaatcctagcttcatatgaggcacagtagaggcgtgctaaattgtttcaaagtgtcctccaagacctttggtatctggaattgagtaaaacttttccataatcccccccaaagtatttgagtttatttgcaaaccaatactgtcttaaattagaatacctaaaaatgaagccaaatatatgccatcaagaacttcaaactgtgttgtcaagtagactgaattggggttgaatgctgttttttgataaaaatttgtatttaaaaaatcaaagatgtgcttttctgctggcattggagaaataataaaatcaaaggtgatgctgaatctcttcactcaattctaagctgtctacctgtagaattatatactctggattttccacaattgctaaaccacttcccagtggcaccagttgggtggtctctactttagacttcaaattaatttagaccaaacatccctaggaaggtagtatctgtagttttgtattatgcatgtccatgcatgtcacattcttttcctttattgtcagttgcagaaagtttgcctgtctcagttctgaaaattaagttgagggtcaggtatctgagtgacgggcagatttctttaacacatcagctgctttcttctctcaatagccaaagcccattccattggattttcacctatattgcagctttgatggcaccagaataaatctgtctgtcatgcagctttcttcattgctcagcttctagtattaagtaagaataaacttaaggaaactacagttaattgggcttgaagaatgtagcattcttttccatactctcgttgcatgccgatggaatgcatgtttcaactaaggcttaggagcttttatttttcaagtggtttgggaactgaagattaatgtccttattagttttaataaagcactaatggacatttaaatcttggctgttctccagggttttttttttgtgtgtgtctgtgtgtttgtgtgttttattttacaggctgatgtaatctctaaactcaacatgacagacaggtaaatccttcatactgtaacacccatgcgactgcttttcagacaggggaaatgtttctccacattgcttcctgggtgtggtactgttctattctctctctgtgtatttatttttggtaaggatttctgccatagaatcttactctgagttaatttgtatctctgaaatgaatcaaaagtatcctaaagacttttgaagatccctagtggggcattgctgattggaatgatttagtttaagcttgggagggagtaactctgctcagctaactgccctgcctgtgtgcacgcgtacactgtaccattgtcttcttatttacaagacttttcagtcgccgtaacaaaaagtcttcttgacagattagagatggagagggggagtgacggagaaactttcctctgggattcccacgaagcctgtggtgggggaagcagggccaagacctctattgtggttattgtagaaagcccctccatctgaagccactcccgtgagcacttcccatgagccccatccaggatttcccagaattgcatagtgagaagcaacctcactaggttgaggcagttgtctctcagaaggtaccagatctagtgctgaaaaagtgcccatgctgagcatagtctgggttcccccctctgagagcagacagccttgctcagtgtgtctgcatttggtcttgtgacatggctggggagctgggcagcagggtcacatgttcgtccccagatccttgccatggggccagtcagagctttcaggatttagcagcagtttagcaacttgggactagaatctgggaacccttttcatgggaactgtgtctctgataacaaatccaattctatttctacctccactcaccacccaccccagcccaggacaattttggagcttttgttgtaagacagttttgatacataaacaagtagtcctattccatgagagctggaaataaagcagaactgatgtcctgtgtttggtaggtattttgcaaataaaaagaaatgcccagtaaaggaaggtatcacagtattcaaaccttccacttgttttgggggcaactggttagagatacagacaatgctggataacttcctgtgaagttgaattgaatcagtggttgggatgttcaggtggaggacaggaaaggaattgccctgtagacacactgacttagagccgggtagtgttttcctctccgtgtgcagaagtttcctttgctgttagaaagtgacgatccctcagatggggactgctctggggtcgcaaacccacacagccgcagggcctggcagagcacttaacagagggaagctggccagctgtgagtctagacatggggcagcggccagtgggagaacacaccctgtatgaagggacagccacttctcagcgccaactcatgattaccatgtggaaatctgggcccagaattggtggctattttaaatacttttttttcaaaaagatgctgggtttctagatttttatagggaattttccagtttttcaatgttgacaacttgctcaatttttcacaaataccatgcagaccaaacatgagaggggaccacagactttttgcaacctctgcactgtagaaaacataaaaataacttcgttgcacacgttttgttttgttctagtgatatcttgttggagagagatttcactcttagagatcctgaattatttcgctgccttagttcatttctttttcattttgttaatgttgctatcttttggggctatgggataaagaaaatacatttttaagttgaacttctggcgtttaaaaggcgaggtcttaaagatgtgaagtggaacagctgacagccaggtgaaataaccgtctttccatacagacctctcaatgattcagcagtttgtatttcagacttctcatcttcactgtcagaaatactctgcctcaatttagattcccaagcaaactgtgtaacatgatttatacaaagcatttcccccagccttttgtttgttttgtttttttcagttaatttagaaagtttattttgccaaggttgagcatgcgcacccgtgacagcctcaggaggtcctgacgacatgtacccaagatgatcagagcacagtttggttttatacattttagggacacatgagacatcagtcaacttatgtaagatggacgttgccccaaccttttattatgaaaaattttaaacatacagaaaaggtgaagcattgtgaagtgaatacccataaacaaatttttaaaatataaaaggtgtatcctgcaggggtaggagaggcacaggacagggaacttgggagcctgtggtgggcctgcgcttcactgaggctggagtatagtggcatgatcacagctcgctgtagcctcaaactcctgagctcaagctgtcctcctgcctcagcctcctgagtagctcggactacaggtatgcggcaccacttccggctaatttttgtgtgtgtagagatagggttctctctatattgcccaggctggtcctgaactcctgagctcaagccatcctcccacctcagcctcctaaagtgttgggattacaggcgtgagccactgtgcccggcccaggatacactttttagacatcatcctccttccttcacggcctctggtgatggggctgtggttgatgagagtgaaaataaaagagcgaccagaagctctgtctgggttgtggtgcaagggcctggggaccagccaccaataaaataggatctcccagatgggcagttgtttagtggagttaccttccctttcttccttccctttcttcttcccacctgcctgcctgcttgccttctgcaagtgtctctgggccatgcccagtacagaccctgggaattcacccatgacgaaaattcagcatccactcccttggagctcacaggcctgtgatgacctctgtgaggacaggcgaagtctgggaactgaatcctcagcctgggatccggaggcactctgggttaatgcgcatgagtcacattcacaggcagctaccatggaaaccagaggccagatgattgacttctgaagagaactgtacctggcaaggcagccaggcatttcctcagtcagctctcctctccctgaccctgcagccaaaagatcacccattgaaggctgctcagccgagcatccttttccccctagacccaggcttggtgagggtgggaagctcagggcagtcgtctctggctgatgactgacacaggctggccattgggtctccatgttttggctggtgttgtggaagggggcagacccaccattctgctgccctggaaagaaagttgcaacaggcatggcacagaggcttgtgggaaaatcaccaaagggcagggagagtgaattgtccaggctcatgtggcacatgaggccccttgagggagctggtcctgcctccctcgccagcctcttatggctcctgccactcaccccacccccaccaccacatgcaccttccttctgttcctcaggcagcaggcttgctcccaccgcaggagtcgcttgctgtcacctcagcctgcagctcttggcctggccagctgcttcttaacatgtaggttcttgcttacatgtgtcatcccttcacagaggcctctccagaccgccccatctaagtggctcccacacccacacccccaccccaccttcccacgtcacctcaattgatttcctgggtcacatgtggtattgtctgaatttgccttcatctctgggtattgctgtatctactgttgggggtaggagtaccgactctgggcagatagcctggctctgctacttgttagctgagtgaccttggacaagttacttcatcatcccgttgtccctcggttttctcctctgtcattggggcagtagtagcagtctcatacagtcactgtctggattgttgagtcaccgtatgtgaagtgcttagaacagtgccggccatggtagcctccattcctgaaacatgttagacaatcagcacatatctgctgggggtgataagatcttcacggggactgtcagtgaggtcactggcccagttgggagatggcctcagtgtttctctcggctgtctacgccactcacccccaaagcacactggggttgctgctgctttttgacactttcttagatcttgcaaatctgagtgcaggctggggtcggtcacggacagcattccaaggggctggtggcgaggggcagagcagaggtcagatgcaggagctcatgggccatttggctctagctgctctgacccgtggaactgggcggtgtatgataaatatatctaagcaaaagtctcccttccatcattggtcaaagtcaagtctccgtgctgacactagaaaaccaggccattcctaacaactcagtttagagtgggcctttcatactccacccacaaaacagcagataagtggggaaaaaatacgctaccttctgtaattaattcagctctagcgtgtagtattgctttctgttaaatatggcctttgactttaatgctttaatatgtggaccaagtgacacacattacagaatctccccttccctctgtctcttacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaagtaagtacgggggcagagaacagacttttttcatgtgacagaactaaaggtccttgtaacaaaggggcagatatttccacacagcatgtgtacagttgcttgtcctctgggtgatcagttcacccactctctttctctgtatttctgtcctgacaagccttgatgtgctgcaagaatatggtcaggttccaggggtggttaaaagaggagagtccacctttttttttgagacagggtctcgctctgtcacccaagctggagtgcagtggctccatcacagctcactgcagcttcaacctcctgggttcaactgatctcccacctcagcctcccgagtagctgggacttacaggcacgtgccatcacgcccagctaattttttaagaagtttttgtagagatggggttcgccatgttgcccaggcttgtcttgaacccctgggctcaagcagtttgcccacctcagcctcccaaagtgctgggattacaggtgtaagccattgctcctggctttgcccacctttttcgacctgccttttagtagtggtttctgagcccagcttgtcaacatcactgagggtgcttattaagtgtgacattcctaggccccaccctcagagcttctgattcatttggtctggggtgagtcccaagaccatgggtttttaataagttccccagatatgatgaagcggcctgttcaggggtcagtgtttgggcaatattattggcaacaaaagcaatagacagaggccccactagctgatgcatgtcaccttccttttcacagctttaaaataaggtaggaatgctgataggtgccctgccttaagatgctattgtgtaaactctactttggacactacaatttgttttcaaatatttgttggtattactaccctaattgatgggatctgagaagttaaagatgaataataaaatgtcaagaagtcattgggggccaggcgcagtggctcagtcctgtaatcccagcactttggaaggccaaggcgggtggatcacctgaggtcaggagttcaagaccagcctggccaacatggtgaaaccctgtctctactgaaaatacaaaaattagctgggcttggtggcgggtgcctgtaatcccagctactccggaggctgaggcaggagaatcacttgaacctgggaggcggaggttgcagtgagccgagatcacaccactggattccagcctggtgacagagcgagactccgtctcaaaaaaaaaaaaaaaaaattttagctgggtgtcatatcacgtgcctgtattcctagctactagggatgcagtgagctgtgatggagccattgcactccaacctgggcaacagagcaagaccctgtctcaaaaacaaaacaaaacaaaatcactgggaaaagtaaatgcatttcagataatctcaaatatatttttctgatgcagggatatttccttgaactctgcattttatggtggtcattaacaggcaggcaacaaacccaaagatttttgccaaaacacagatgtttgagaccagtctggacaacatagcaagaccccattctcccaccttcccgcaaaaaactccaaagcacgtggagaaaagagccccggataatgtatcaaaaatgagctaagagaatcttagaggccagtgtgtgttctgttagataatagaatttccatttacctgaatactgacttactgcctttgctaaagcataaccactctgtggtagctggcattttcttagaagtttttttatagactatattcagaattcttatgttggaataaaatgcctcagcctaggactagatttgaggactgaatagttaaataaggtactacagggctgggcgcggtggctcacgcctgtaatcccatcactttgggaggctgaggcggatggatcacttgaggccaggagttcaagaccagcctggccaacatggtgaaaccccatatctactaaaaatacaaagattagccaggtgtggtggcgcacgcctgtaatcccagctactcgagaggctgaggcaggagaatcgcttgaacctgggagacagaggttgaagtgagccaaactcacatcactgcattccagcccgggcgtcagagtgagactctgttttaaaaaaaacaaacaaacaaaagggtactatgagaaaagcatccagcattgggtaatgtgacatcctttccttttctttccctgcccctagttgttgttttcaccacatttgcccagtttttgccctgtttttgcccttcctttgcaggaggagcttaccaaatactgcctgatggcaagaggtgctcaacaggccttaaaaaacaaccaaacttataagtatttttgttattctaaatgtagtacatatattcttaccaaatttaggaaatacacaagcaaaaaagagagaagtatcacacacattgctactacctagagataattatggttgataatttggtgtaaatatatatacattttatttcaataggcttataccccaaatattgtactctattttccattgaacacaattgataaaacagtcttctggaaaataattttactggttacggtgtattcctttttctgggtttactatgatctacttaaccagtttcctactattggctttttcatgtttctcttggcagaaatttctatagctttattaggatattatccaacatcatgccacaagacctttaaaaaatccaatggcagtattttttcttatttaagatctactctgaaagctgcctagcattctggtttttacttttatctcgtatcctggctacacatattgaacatttgtgacaaggaattttgcctaacttggaggtgacatcatgagttatttttatgcattgggagctaaactcaattgctttgtctcttgatttttttaaagaaaaataatttttcagaggtaggatcttttctgagcttttccagttgtctctattataaaagccaaagataggagactttttctatttaagatgggaaatgatggagtcatcgttggtagccagaggttcttactggaaaagtgctttggaaacccaagatggggccaggcatggtggctcatgcctgtaatcccagcactttggaaggccaaggcaggtggatcacctgaggtcaggagtttgagaccagccttgccaacgtggtgaaaccctgtatctactaaaaatacaaaaattagcccggcatggtggtaggtccctgtaatcccatctacttgggaggctgaggcaggaggattgcttgaacctgggaggcggaggttgtagtgagccgagatcgcaccactgcactccagccagagcgacagagcaagactgtctcaaaaaaaaaaaaaagaaagaaaagaaaccaagatcgtctgtggtaacagttcccacagttggatctgtggagcatgcatgtatagtttccagtctcctcgtccaccagcagcagtgctactgctgaggccacggttggatctgtggagcatgcatatatagtttccagcctcttcctctaccagcagcactgccactgctgagacccaagctggcttgagaatcagcctcacaaactctccagccacggctggtcatctgccatcagcatttggtgagggacctctgtgtgccagacactgctgagagccaggtggatttgacagtcggtccatgatgggcaaaagatgcccgtagagaagtgaacatggtgccttaagcatgagggggctcaatgaccagaccatgaaggatatgaggaaggcttctcagaaggaacgtcttgtgagccaggcctgggaggcttattttcagacagaagatacagaaaaggggcatgtcagacttacccccgcctccccctccacctttttttttttttttagtacagaagaaaaatatgctcctgggagctgttgtcacctttccttggttatcagaatcatacctggttttgaagaggtatacttcataaacgatcatctccaaagtgagctgacacatttatctttgcaactgaatatgtaaatgagttaccccctttttgatgttgttaccttcatgaatgccagaaagcaaatgtcttctgtttcttcggtaacttgaattcattttcagctttgatttgttgctatgatagtgtgttcttaaagtcactgctgtagaggaaaccttttgttttctccagctacagcttaagctcatgaaatggaccctgaagcaatactcccttttattctttaaggtatgagaaacatgaccttaagaaacaaaatgtagaaaattaccaggccagaaagagtccaaattctactttcattacctggagttcagaaaccattgccccagccctggatctgctgttaaccctttgtgtgaccttacccagtgactcactctctttgggcctcaggctactctgtataaaaagcagtgaaaccagcctgggtacctgctgtggtagtgatgtgggctgaggctgggcactgtatgtgtgtgacctgcagatccatttttgggaactatgggtgatcatggccttcaaaagcacttttccaatatgagcccttgttggctgccacattcctcaaggtgggatgttaacctgtgatctgctagaaagaagggggattggggagattgtttgttcagatgagtctgcaaagctttcacgtgaagaaagttagatttcttttttgcaagacttctcagacctttattatgttattttgggctgtgaatttcctcgaaaggctttctgagtttatttgaccaagctaccttttcatcttattctgctttaaaatgataccaatcctggggcctggcatggtggttcatgtctgtaatcccagcactttgggaggccaaggcaggtggatcacttgagggtaagagttccataccagcctggctaacatggtgaaaccccgtctctactaaaaatacaaaaaaaaattagctgggcacggtggtgcgcatctgtagtcccagctacttgggaggctgacgcaggagaattgcttgaaccctggagacagaggttgcagtgagctgagatcgcaccactgcactccagcctgagcaacagagcgagactccatctcaaaaataataataataataaaatgatatcgattcatgacatggtgattgatgaagctgaatattactgttgactattctttgtttcatttactgagtcaacaaaaaggtattgactgtcttttgtgtgggaggctctgctttaagccccggacataaggcagcgaacaagatggacacaggcttcatcctcatggaatgaggcacgacagtttcccatgctgtgaaggagaagtcaagcaccatgacaacctttaaatgggcaggcctgcgtgaagggatcagggcaggtgtgcctgagggagtggcactgaccctgggttctgagggatgaataagggagttagctggggcaaggaaaagtgaatggtgaccacctgggaggtgccagtgacagtgtggcccagatgtttagatttggggagaggaggtaaggtcagagaggtatggcaggcaggagccaagtcaaactaagactgggcttcctgataacgtcgggaaactgtgagttctgaacaggctggtaacctgatcaggtgtgcctttgaaaaggatcagttagggcctgtatttctagcactttgggatgttgaggcaggcgaatcacttgagcccaggagttcgagaccagcctgggcaatatggtgaaatcccatctctacagaaaatacaaaaactaactgggtgtggtgatgtatgcttgtggtctcagctactctggggctgaggtgggaggatcacatgagcctgggaagcagaggttgcagtgagctgagatcatgccactgcacttctgcctgggtgacagagtgagaccctgtctcaaaaacaaaaagagggggatcatctaggccactgagtggacaacggggttggtctgtaggaaggcaaggatgtctagaaggagatcagtgagacttatccctgggagtaaagggcagtaggggagggaagaagggaatggatttgagagacacgaggaggatatttaatgagaataactcgatgttcatggtgtaatggttttatctttaaggacaaaaccaacaattgaatttaataacatctgacattttactttgttctgttacagtaaaaggaaagttctttctttcatttcttcctccttaatgtctcctaaatcctccctctcagcctgaaacctcggacatttcttctttgggtagctccattctaatctgacttgccatagcctcaatttcaggttttatcacaggatttctgtactgaaatccttcctatcgactccccaggccttcaagctgaaataccagcacctttcctgggctctttcctgtccctctgccactcttctcaccttgcctcctgccactgtcccacccccaccccaccgctgcgttttagctgcactaatcttggtacttgaaagttcctacaatgggttgcatatgcatgggctctcttcctttgcacatgctgttccctcactgggtgccttcccccatttcttcacctgggcaagtcgtctttatcccaaatctaaacccagcccccggccttttttattttttatttttttgagacagagtcttgctctgttgcccaggctggagtgtagttgtgcgatcttggcccactgcaacctctgcctcctgggttcaagcgattctcctgcctcagcctcccgagtagctgggattacaggcgtgcaccaccacacccagatagttttcgtatttttagtagagacggggtttcaccatgttggccaggctggtctgaactcctgccctcaagtgatctgctcacctcggcctcccaaagtgctgggattacaggtgtgagccaccacgcccggcatcagcccacattttctcaagcaccttccttgagcccggccagtctgagttagttacctacccaccctgcttttctacagccctctacccctcccgcggattgtcattagtgttcatcttgtttttctccctcattagcctgaggggaggagctccttaagggcagcagctttgctctcatctctgaaccccagaaaataacagtacctgggacaaagtaggtgaacaataaacgtttggctgactgaatgaatgatggtatgaatgaatgaatgaatgagcgaataagcaagaaatgttttaagttaatttctaagaactttgtgtatataacattttaatttatttctgttttctttcatttcctagcacagctgaaggtttaacaagaaaaaatatgtcagatgtcagtgggtggcaaacatttttacaagcccttgactacttcctcaaaatgttctttggctctgcagcgctcggcactctcactggcttaatttctgcattaatatccttttaatgtgatgaacatgcagggttaaaattattcctgataacttctgtctctagccagtttctcctgttttttaagggggccaattttagatgaagattttgcttaaaggaggatttttttgcttagtttttgtttgagaaacactctaactcaaggattttttaatctaacgtgaaatttaggatgtcacttttcaaagtttaaaaaacatgtacactgttggatatcagatgtgattttggggacctctcagttcccagagtatgataaccacactccgatgattttcgttttctgccatcttacttttcacatttggaaaactggaaattaattttctttgaaaatgtcaaatagaccaggtgcagtggctcatgcctgtaatcccagcactttgagaggctaaggccagaggattgctttcgcccaggagttcaagaccagccttagcaatggaatatagtgagacctcatctctaaaaaatacataaataaaaataaaatgccaaatagagaaaatttttatcccactgaaagtgtttatccagaaggattgcaaaaggggctttcaaagtgtgttccattgagttatttgcactgattttgttgtttgacaaccaataagcttttccagctggagatggaaagaggcttgttaaggccaatgtcacctttattgctgtagaaatttcattatgtttaaaatagtaacaggcagtagaccacttcggtgcgcacctaagcctacgtctcagggagatggccacctggcccgcctccacgagcagtttgtgtcacagatggccggaagagactcttttgcctggttacaggcatgtttttctgccatcctgttgaattttcccatcaactcctttgtccagaagtctaagggctctattgagttggctgacagcttctcatattgtaccaataaacagaatggaaaagaaaattttttccagttcagtattttcctctatatttatctttttctttaaaaaaaaaaagtatctatcaaaatgaagtggagcaaatgggtactgtgagctccagtataggcattgtgaatgatgtttcaatatatagaaggctctctcctttcacaggggcatgagtttggaaatctccaggaataggaaatactgtgcttcaacagggcctcgaacctcagtttgaacagcgattctcactagttgtctttgactcaaaactgatggggaaagcaagatgggtagcattagtgatctcatccgatgttgttggaggagtgggggtgatgccggccctgggaggaacctggccaagtgagctgtccttggtgtgtctgcagccccagctttgcgccatggcccggcacatccccagccctctaagtcagcgtttttaaatgagttgacttaggttgattttcatcttccaccaccatttatctccggaatttacatttcttagtgttttgtcagattccctttcttatagcaacagtctccctacaaaggaaaaaatccataatgacaaatttccatttgtaaccttgggacattctaaaatctatatctgttgtttacttcatatatttggaaagcagcagttttgtgacttctccacatctcccatcaactctccctcgattctccttccttgacagttgtcatttacgtgctgaagcatattgacttgaggaaaacgccttccttggagtttggcatgatgatcatttttgcttatctgccttatgggcttgcagaaggaatctcactctcaggtaagtgacagagagcctgaaagtgctgtggtgatggcatcttgtcctgcctggggaaagaggctttgtcagttgggtcacttttagtcacaagagacagtcacaactcagaagagcttaagtaataaaggaaatctattggttccctagaaacacatctggatttaggcctgcctggatccaggggctcaaacagtcacattggtgtcacggtcacattttctcttaacccgccttctctcatttagcccatcagtcctgtgaggctccctcagaggagggtagccttgtaggagggaggtactgtgaaggtccctgttttactgatgagaaaactgaggttgagtgagattaagtaaattactcaaggtcacagctgggattggtggaacaacgattcaaactagttgtcttggagtcaagaactagtgcttagaaccctctaatacaactccctccaaaacagatcatcatgaaaccatgtactcagtgctacatagagggacaagcaaagtgtggtggtggcgtaatgttgggcgtttattggacacactttaccagtattcagtttttttatgctgataccagccctgtgaagtaggtactaagaggttgtcattagcccaaagctgcactgcacaagcagtggtggtagtgagattgacagtggaggcccagagccttttccctgcaccccattggaggagggcacacagctctcagcagcagagacgactctgatgcggccctagaagatgatgctcaccagctggaggaggggtggccagtcacagcgtaatgatcttggagccgtcacctggtaatcactcagcagcccaatcaggcttggcttagttgggctttctgcctacaagtggcagtcaagcttgcgtccacagcttgttacgttgtaaggatgttgacctgaaaatggagcgtgactcacccctgttcctgtgtgagggggcagccagttgggaagggctctgccctggaagtctgatcccatcctttgagtgaaggcccttcagaggccttgttctggaaaggaggcactattgcagggatgttttgatctgtgccacaagatggcagagattttcttttttattaacttcgttgaggtataatttacacacaatacatggacccgttctaagtatatagttccatgaatttttgcaaatgtggacagtcataactacccccacagtcgaggtgtggcatattcttatcgcccagtgtggctcccctgtgcccttctgcagtcagtccacctgcctgtcctgagccctggcacccactgatcctgcactgtcattgtagtttaaatgaaatcatgtggtacgtagtcttttgtgtctcctctctttcagttacgtttttgagagacatccgtgtttttgcgtgtggcagtagtttatcgttcttattgcaccacagtttgtctgttcatcatttgaagggcatttggggttttccagatttgggctaagaacagtgtgcatgtgttttcatttatcttgggtaaatacctaggattaaggctgctaggtcatatggtaagtacatttttacttttttagaaactgcctagtgtttttcgaagtgactgtatcattttacattcctcagaatgtatgagagagtgccagttgcttcatattgccaccacacttattttaatttaaaaaagtttagctgtcctgataggtgtgtagcaactgcatttagatgtgctttggtgtggttatttttatattcgccttgggttcattgagttttttgggtttatagtttatatgagtttatagctttcatcaaatttggtaagcttttgcccatttctttatcaatatttttttgttccgccttcctcttccccttgagacttcagtttactccagttatgagaggtagcatgctattggcccacaatatgctttgcctttttttctttttttccctatgtgcttaattttggttatttcctgttgccgtatcttcaaagtcactgatcttctgccatgtggaatctcctgctaatcctacccagcgtatttctcatttacatattttataattcatctacagcagatccctttaggttattttcatttcttccatttctctcttcatcatgttcatgttttcttctatattctggagcatatgaaacatagaaatttctgatagctgttttaatgtccttgtttgctaattccgtcatctctgtcaactgtaggtctgttttgttgttgatttttcttgtgcttataggtcacattttcttgctctttgcttgttattaagttttgattggatgtcagtcattgtgaagttttatgttgttgagcacaagattttattgtattcctttacggagttctggacttttcttttaaaaacaattttttttgtgtgtgtgtgttatttctggacttttcttctggcacgtatctaagtctcttgacatcagtttaatccttcttgaggcttacatttaaacttttttagggctggtgcagagtagcagggccctaactaaggtgtctcaggtaccgtgagctcactccactctggctggtgggaacgcaaactattcccacccatgtcagcttctggaattgttcagcctacttctttttaatggttctttccccagcttcttgtttcatccgacatatttactgatcagtatcagtcaaagactcaaggggactttacagtagatgtccaagagctctctttctgtgcagcttccccgactcaacaggacagccctcttaaagcctcagcctcaggcagtcagctcagcagggggcctagggaaagagtggccacctttgtctcccttccggcaggaatcacagtcctaccctatcttttgtcccatgtcagaaaatagttttgtttcatatcttgtatcaggttttctagttatgtagagcaggacagtgttctgtgtagcagtaatttcttcagacgcaaagctgaaggcccagtggtctctagtgactcagttgacagaacttttctacccagtcgctatccggagtcacacttgggtgctgcatgagcagcacaaggaggaagcagagtggactcaccattttcagggttttgtttttcatcgcagaccagttcaccagggtaattccatcctggtgtctgccatgaggttccctttctttactgaatgttggcacttacaaaaacgttacctgtgagtcattcggctctagcctagctatttttacatctgtttttctaaattgttcctctacccccttgagaagatcattgagtacctgttggcaaagatgtgtttcatgcatctgtttggaatctgtgattaaaataagggagtgtttttcttaccttcttttcagactggcagtgtttcctgttgagaggggtttcatttccttagggaccttgctccacacacagcagtgcaagccaggaacaccagatctgcctctgggtgagggaacctgctctgtccgcactttgccttttgggtatttgtcacgcagggttttcagagaggggcaggatggccctgtgtggtgtgtggacgccccacattgcactgtgaaagcacagatggaaagggtggtttctgctgtcttcaccttcctttgtgtgctccccttttcctgactatcacaaaggactgatctcaagtggttcccaagaccatggagcaggacattctcttcctaggaagtgggaattatttacctaaatccacatgtagggaacacagttgctaaggactggggctggataacagacagacttggatttgaatcccagctccacctcttattggctgtgtaacctcagattacagacttaaccaccccatgctctacttcctcattataaaatagacaaaagggccagcctgacgcctttgctgaggagtggggagcgatgcaagtgagagtcctgatggggcatctgtgccactgctggggtggccagaagtcctggtttgccctctgtctcaatatgatgaattaataatatccccgtttattctaaaaaatgtcctggtatccacagcaaatcaaacagtctccctaattataactcagcaagcgttagctattctcagaatatttgttctgactgtatccatgttaactatttttattgttcagtcaagccagttttgagggccactttggcctctgacactaaagattcaaagatgaatagaccccacttaggcagagcagttagcgaacactgggcttgcaggggatgggagagagtgacactctgtcaaggtgagtcacagaggaggggactttgggcttgaaggatgagtttgcaagattaatcatgagataacactttctttctttctttctttctttttgaggcagagtttcgctctgtagcccagtctggagtgcagtggtgccatctcggctcactgcgacctctgcctcccaggttcaagcaattctctgcctcagccttccgagtagctgggattacaggtgcccaccaccacgcccgactaattttttttttgtatttttagtagagacagggtttcaccatcttggccaggctgatcttgaactcctgacctcgtgatctgtccgcctcggcctcccaaagtgctgggattacaggcgtgagccaccgcgcccggccaacataacactttcttaagatgttggcatgggccaggcgcagtggctcacacctataatcccagcactttgggaggccaaggcaggtggatcacgaggtcaagagatcaaaaccattctggctaatatggtgaaaccccatctctactaaaaatacaaaatattatctgggcatggtggcacgtgctggtagtcccagctactcggcaggctgaggcaggagaattgcttgaaccagggaagcagaggttgcagtgagccgagatcctgccactgcactctagcctggcgacagagcaagactccatctcaaaaaaaaaaataaaataaaaataaaaagatactggcatgaagttggccaaagatagaatgtatggtgcagtgctcttctgcacagatatctaaggaattccattgcagcactgcttgggagagaaaaactggaaggaactatatgttcatcagtaatggaaaagatcaaattccagtccatttgcactatggaatcctgtgcagctacttaaaaaatgaacttgacctgtctgtactgccatggaaagaatttgacatattgttaaattttttaaaagtaagttgaaaaatcaaactctcgcccattcaagaaatacttattaaatgtccaccctatgctgagaactatccttgctgttggggctacatttataaacaacacaagatcagtttccttttcttgcagaagaaagccagaatttaagcaaacccatacaacaattccaggtggcaagaaatgacaagaagagaaattaaagccatgtgacagagagtggcatgtggtagagaatggatgggatctcaggcagtcagggaggtctcccctggaggtggcactggagcccagacctgtgtggcgagaggagccagcccagggacgctctagggaaggagggttttggcagcaggaactgcaggagccaggggtctgaagatagatgtgcgggagtgtggcatgctccaggaagagaaggaagaccagtgtggccaggacgctgcctcacaggttctgcaggcctgagaaggagctgggtttctagtatatgcaccacgacaagagagttggaagcccttgaaaaaaaatcactctgctggtaataggcaccatatatgtgataggatcctgtttattactttagttttattttattttaattttattttttgagacaggatcatgctctgttacccaggctggagtgcagtggcacaatcacgtctcactgcagccttgacctccccaggtttaggtgatccttccacctcagcctcctgagtagctgggactataggcacgtgctaccacacccaactagttttgtattttttgtagagccagtctcactctgttgttcaggctggtctcaaactcctgggctcaagcaatccacccactttggcctcccaaagtcctgggattacaagtgtgagccaccatgccaagcctattactttaaagataaactttataatcacatggtaaaagaactggcagtctgcatattgaagtgttaatagtagttaagagtagttacgtctgagcgggcagtatgaatagattgtcttttactctgtacctcagtgagtctgaatgttttatggcaaaatatgtttattattgagtaattaacacagcgtactcattacggtttcactcagccctcaagaagtatgttatattttacatacagtaaggcacggtacagtgtaaattgtaccatgataccttttcactgccttttggacttgaatcccatactgtcttcctttattacatctagaacagtggatgtaaccataaacagaagtggatttcctctctccctttcttttctgccattcttccttcaggaggctgaacgcttttgctgcatttgctttcttaaacgattttgcctaattcttaaaggaaattcttccttaagcgtattttttcaaataccatgccttttacctcacttaaaaaagttatcctggtttgcaccaacccccgcttttgtgtttctgtagcctgctccactggccgcagatgagggtgatgtgggtggtggagagtcccctttgcttctggagggcatatgaggcagatacttgagccatccctctggcttttgtgcctgctgctgaccctctttcctttcgcctagaactcaaggtgccctgaccccacactagcccagggtaaagccctctgggattgtccagatggcccagtgccaacagtgggtcaggtgcacaggtggcagctgtggtccagtctcagcccccagacagggcttacttatccatatagaaaaatccaaaatgtttgaatttgttgccatccttaaagatggagatttcctgtaaggaaaaccagaaggaagactggtccatgttagatcctcagtcccacagggctactgtcagcctttgtagacaggctgagccgagactgcgcctctaatcccagctgcttgggaggttgagacaggagaatcgcttgaacctgggaggcggaggttgcattgagctgagatggcaccattgcactccagcctgggtgacaagagtgaaactccatctcaaaggaaaacaacaacaaaaacactcttgagcttcaaagagccctaaaggagcaggtaaagaagtctcctaccctctcattttccttcgcccaccatgtcaggtgtgtcttacaggaagcatggctggaatctccctgtaggggaaactgaagagcaaaggcatttgctgtttcctaagagggttaggagatcaaatgtccagctcctgctgtcactcagccagcccatacctgctggggcaatacaaaaaagtaggtttcctatattttgtagggtattgtgttacagtaagcttagcagttgacaagtctgtaatacagtgctgtgattttcacccttttttttttttttacagttttttgtttgtttgtttgtttgtttttgagacagagtcttgctctgtcacccaggctggagtgcagtgccgcaatctcggctcactgcatcctccacccctccaggtttaagcagttctctgcctcagcctccagagtagctgggattacaggcgtgtgccaccatgcccagctaattttttgtatttttagtagagacggggtttcaccatcttgaccaggctggtcttgaattcctgacctcgtgattcacccgcctcggcctcccaaagtgctgggattacaggcatgagccaccgcgcccggccgattttcacccttttatacgtggaaagtttgccagatagtcactgtttccacaaaatggcagaagtgaattaaaactttgcttttaaagtttgacttggaattagtatatcttggcagcttatttgatgattttttaagacaatctcagcttccttacatgaaatagagacccctttcctgctccctatgcagggagatgctgagaagagacctgtgagttcctcaggagtgactgagggcagcggacgaatgtcgaggctcaaatcctgtgtaagcacagaaggttgtacacaccctcgtgcagggctctgaagaaaagatgcattacctttttaaataacagtagttcatgattatgggaaaattcaaagttaaggaaaagtattttaaaagtccatcaaaatccacacatttagctgggtgcagtggctcacacttataatcccagcactttgggaggccgaggcaggttggattgcttgagctcaggggtttgagaccagcctgggcaacatagtgaaaccccatctctacaaaaatacaaaaattagctgggcgtggtggtatgtgcctgtggtcccagctacttgggaggctgaggtgggaggattgcttgagcccaggagatggaggttgcagtgagctgataccacgccattgcactccagcctgggcgacaacgcgaaaccctgtctccaaaaaaaaaaaaaaaaaaagaggccgggcatgttggcttacgcctgtaatcccagcacattggcacaatcctgaagtcaggagttcgagaccagcctgactaacatggagaaacctcgtctctaccaaaaatacaaaaatgagctgggcatggtggtgaacacttgtaatcccagctacttgggaggccgaagcaggagaattgcttgaacccaggagggggaggttgcagtgagtcgatttcacgctattgcactccagcctgggcaaaaagactgaaactccgtctcaaaaaaaaaaaaaaaaaaaaaaaagaatccacacattctccatacacagattcttaggctcctttctgccccccagagtggtttgcttgccacccttatatagtcatccctcagcatctgtggaggatcagctgtaggactccccacgtatagaaaattcataggtgctcaagttccttatacaaacggtgcagttggccaggtgcagtggctcacacctgtaatcccagcactttgggaggccgaggtgggcagatcacccgaggtcaggagtttgagaccagcctggccaacatggtgaaacctcttctctactaaaaatacaaaaaattagccaggcatggtgatgcgtgcctgtagtagtcccagctactcaggaggccgaggcaggaggatcacataaacctgggaggcagaggttgcagtgagccaagatcgcacgcactattgcactccagcctgggtgacaagagcaaaactctgtcccccccccaaaaaaaagggtgggggggtagtgcagtgggccctcaatagccacaggttccacatctgccaaccctatccctggatgtcagtgatggtccacacctttttatctttggtgctgtgaaggggactttacatggcttattttcactcaccctcctaacagttctgtgagtggctactattagtcccactgtacagaagcggaaactgaggctctgatgggggatgtaatgtggctcaaggtcacccagctagtaatgaggctgccagagcgaagggacccatagtattttttctgaagcctctgggaggcttcaggaattcatttattttcctttttcttaaaccctctaatgctctaggccccagggccttgcaggcattgtgagatctgagttggggatcacacggcagtgctttctgttctgttctctccctctctaggcatcatggccatccttttctcaggcatcgtgatgtcccactacacgcaccataacctctccccagtcacccagatcctcatgcagcagaccctccgcaccgtggccttcttatgtggtgagttctgcttctgtgtggccgtgagcaggcccacccagagctgatcttgcttccttatcctgtttgagaagtcagttgagactttccctggcagcagggcagcagctcctcagagccagatccctcactcccttatcttttgtttgttcctctggctttgaaatttcataaagtaaaccaaacacctaataaatgaacatctggcgcctacaatttaaagaccaaaaatagtgagaaccaattatgaacatttgatacatgcatttttaatgtattaatgtgacatttccaaaaatgtattccttggaaataaaatattaatgatggtttggtgaaaatggctccatagtcaagcaaggcatggggctcacacctgtaatcccagctgcttgggagactgagaggatcacttgagcccaggagttcaaggctgcagtgggctatgatcttaaaaaaaaaaaaaaaaagaaagaaagaaaaacaaagcttttgtagtcaaacaagagtttaggaaatcctggttaaataaagtttaacatttatgaattgccagacttttcagcaaataatggattgtcaaatccttaacgggggatatagttatagaattttccaaacttgtccacagaatcctttattcacaagagcagcctgagggacatcactcggggacagttcgcagtagaggtgtcatttgttgggctgggataaaccacgatggctttgtctttaagcagtttgttcaagttcttgttcccccacgctccgacatacccatgtatctccccaccaactttatacttggaagtggttggagtcggggaacagctctcaccatgtccctttaagctggcccccaagtgactttgccctagctgtcatcaaaatcacccctggcattttgagggacttgtctctttttttttttgagatggagtcttgctgtgtcgcccaggctggggtgcagtggcgtgatctcagctcactgcaagctccgcctcccgggttcatgccattctcctacctcagcctccggagtagctgggactataggtgcccgccaccatgcctgactaattttgttttttgtatttttagtagagacagggtttcaccgtgttagccaggatggtctcgatctcctgaccttgtgatccacctgcctcggcctcccaaagtgctgggattacaggcatgagccaccgcacccggccacttgtctcatttttaattgctacttccacactgttagcgtgctaggaggcaaaggcaacccaggcagaaacttcagcagataaggaggctcaggtgaggagtagtcacatgacttgcccatggtctcatggccaagaagtgggtatgcaggccaggtctctttattcctgggccagagggtattatttgtacagcacctctctcagaaagccaggctacagattctgaccctgagcctcccagttaaagacacataaagcaaatcgtccatccaaaaagattctattttgtacccagcagtttggcaaatgttaagtttgataatacccacttctggccttggcgtgtggaaaacaggcctactggaatcttttctggagagtcatttgccacgtctgtctgaatttaaaaggcacgtgctctttggcccaacagtccaaccctgtggaatttagcccatactggggtgtttgttgaacctctcagaaataaaaacagtctaaatatccatccatagaggattgggcattagaaaaattgtcgaattttgacaatttgtcaaatgtgacagaaaaactgtcaaatttctctgcaaataaacattatcccgccaagggaagatgataaacacaattctgcctgtttactgaacaccttcattagcaagggtcccaactgtggcaaagtggcagaaattcagagcaaatggataccgtgatgtatccagatcctggagttgatgctgccagggaaaagcatccactagatctgaatgtcttctaaatgtgctcatttggaaagatcacacaaatattagataagaaaaaaatttcagagagagaagggggggtaaattctccagcttgtggacttgttttaaacttgggtaccattcaaaggaaaaacattgttagaatgtaaaacagccttgctgtttgtgatcaactattttaaaatacagttttaggccaggcgcggtggcttatgcttgtaatcccagcactttgaggggggccaaggtgtgcggatcacaaggtcaggagtttgagaccagcctggccaacacagtgaaaccctgtctctactgaaaaaaaaaaaaaaaaaaatagctgggcgtggtggcgagcgcctgtaatcccagctgcttgggaggctgaggcaggagaattgcttgaacccaggaggcggaggttgcagtgagccgagatcgtgccactacattccagcttgggagacagagtgagactctgtctctaaaaaaatatatatacagttttaatctctttagtcattatgctgttctgagggccatcacagtttaagcagagagcctagtgttagaaatttataaggtgctttttcttaatatatacaagtttgtgtgacagagagtaaatattgggctctttttggctcgcagagtggagccaggagttagcaatgagtctcactctgcaaatcctgctgggtgtgagctgtgttctaaaccttgtggcagtgttaaatatattaagctaatcatgtggaagttaaccagaggccccttcacatttgtcatgtggcgtctgcagtcatttgctctgaatttttgccactttgccgcagttggggcccttgctaatgacagtgttcagcagattgacagattcttgtgtttatcatcttccctgggtgggatcgtgtttatttgcagaagtatttgacagttgactcattacattaagagatttctgaataccagggacatgtagcttatgtaatagaaaagaatgagagaatttaagcacaagtttgaccaagatattggctgcaggattttcaagaaaataaggaaagtgttgtattggattctgactgtgaatgtttgcttgcttaatagtttagtaccatattggaatgaaatcattggggttgaataatccattctttggtttgtttcagaaacatgtgtgtttgcatttcttggcctgtccatttttagttttcctcacaagtttgaaatttcctttgtcatctggtgcatagtaagtattttcctttttttttttaaatttaattacttatttgtagatcaataaacacatgttccggattcatttatgtaactgttaactgttcaaagtcaacagctacatagacactcttttgtttaaagtttcttttgttaaaaaaaaaaaatcacaaacatacagtaagggggcaggggtagaattaagtgaataaatatccccagaaaggacttttgcttgttttttaagatttttaatggccttgaatattatggtctttaaataaaagtacaggtttgtaagtttttgtgtgaggaggtaaaagcagatttcaaaattgaatatgtaattgatcataaccatgtaaaaatattatgcacagaaaaaagaaaatatgtaaagaaaatatagccacatgttcacagtggtcatagagttgggatttctttctcttttctgctttttctggataatttattatgtacttcttactgcagttttcttcaaatttgtctatttatatttgtctatttgtctgtttataagatattgttcctgcaacctgggtacttccatctctcagtcagcaagagctcattgctcttggtcactgttatttgtcctccaaactcaggtttcagggcaagagagaagcagcaaaagtcctttacagaaagtataatagcctaggctgggcgcggtggctcacacctgtaatctcagcactttgggaggccgaggctggcggatcatgaggtcaggagtttgagaccagcctggcaaacatggtgaaaccccatctctactaaaaatacaaaattagccgggcgtggtgatatgcgcctgtaattccagctactcaggaggctgaggcaggagaatcgcttgaacccgggaggcggaggttgcagtgcagtgagctgagatcatgccatttgcaccccagcctgggcaaaaagagcgaaagtccatctcaaaaaaaaaaagtataatagcctttagtgtggccactggggaaaagggacacatttgatcaaacctgaaacaagtgtaggcatggaagattggatttcagtgggtgaaacagggaggtgactatttcagccacaggttgggaggaaaatgaaaggatgccctggggtgacaactcagttttctctaagcagttaggcccaggctggccctgcagctagtggagatggcctattcaggtgggttacagttcctgccctgtaaactcaatttagtggtcaagagcatgggctttggggtctgaaccagatttgagacttggatccattacttcctgccttgtcaacttggaccaattacttcatctctctatacctcagtttccttgtctataaactggagacaacaatacctactttgtaagacctttgcaaggatttaaatttagcaggataatgcatgtaaaatgattagcatgttgtctggcatagaaatgtttgatgattggaaacatttactcttggccaggcatggtggctcacgcctataatcccagcactttgggaggctgaggcgggtggatcacttgaggtcagcagtttgagaccagcctggccaacttggcgaaaccccgtctctactaaaaatacaaaaattagccgggcatggtagcacacgcctgtaatcccagctactagggaggctgaggcaggacaattgcttgaacccgggaggcagaggttgcagtgagccaagatcacgccacagcactccatctcaaaaaaaaaaaaaactctcaaattcatgcttgttaaaggaataaacttaaagcctaaagaatgtactgtacatgtctatatcatccttttcaagtagttatggtgagaaccaagatgaagaaaatgaaagtaaagtaataaatgtcctaagaatccacttagataagatttaaactttaggctgggtgcagtggctcacacctgtaatcctagcactttgggaggcaaaggcaggaggattgcttgagaccaggagtttgagaccagcctgggcaacatagcaagacctcatctttaactaaaaaattttaaaaagtagccaggcatggtggtgcatacctgtagttctagctacttgggaggttaaggtgggaggatcactggagcccaggaggttgaggttgcattgagccacaatcacaccactgcactccagcatgcgagacagagtgagactttgtctcaaaaaaaaaaaaaaaagatgtaaactttacataaagctgtactttgccaagactaacatgcctttggagatggagaggaaccaaaagccacagcaagcagctggcaggctaagccggggcatgtggcctcctgatagtccctacctctgcgttcctcttgctcagagagcagtgtttccatgcatgggaggtccttcatagctgccctcctttccctgagggagaggcagaaacaccttgtctgtccccctagtcctggtatgatcaatgcagccctgtcccaaggaggggcaccttgggagtcaggttgcccttaaactaatctgtgaatacttctgtacagcctcttggcattcagttttgttctgctgtcattactaaagcccttcctgatacctcgtccgtcctctcttttctggctactaagaaaggtaacgtacaaagctttatcctttcctagatgcatagaatcccgcagctgtggcagcacgcccatgctgggtctctgacgagcatggtgttgctcgtgtcttttgtggctgaggggaatactgcatttgtactggatgtgttacacagtctgcattagcttcatccaagaagcttcagcttgaagagccagatgttttcacctaagacttagtttgttgctatcaacaggtgcttgtactatttggcagagcggtaaacattttccctctttcctacctcctgaatttcttccgggatcataaaatcacaccgaagatgatgttcatcatgtggtttagtggtaagtcaaatcttggataaatggggtggggaagtacctgttaaaagcacgccccatacagggagagctgtggttctctgctagcgcccttggcaaaaccacaagtaatcaatactcccgtttaatggcacccactgcaatcaagatggtgcccctcaccatggtgctatgaagtgggtgaggcttggttggaagagggcaaacaacatgcccagggtcacgtgaccactggaggcagagccgggatttctgccactctcttctgaacaccatagtgcagtccgggatgcagctgggcgtgcttcagcgcctccctgggggtcttctaggctgaagtaataatggtctcaaggtagaaaaggtgaaagttgaaactgtttcataccttatgttagttttggatatttttccttttagtcacaaagttctagtagtttaatttgaatgtttcagttgctatttaatcactttttaaaggacggaaatgatttcatacatctttgcttctaaagaactggatccataggcatccttaaatttatttttgagcaatacatactgttctttatgctttcttgcttaaatattataatcaaagtattttccgtgtgggttgggttatagcaacacactataatgttctctatccaaaggcatatctgcaagtttgtctcagatttctcttctttcaaaaggccatgtttaaaaatgtatatgtttcatatatatgtacgtatgtgtatatatacatatacatttatatgtggtgagaaaaactcatttttttcctaatctcttttgccagtgaggcaaactactttgtaaatggttgcagaagtgtgtcagaggtttttgaagtgatgtgggctatttgggaaggggggcatgaggataagagagcgttatggggaaggttggagtgtatttgaaatggcgggggctgtcggctcctgttctctcccaggctccccgggctcttgctctgtgggtttccatccaggctttcctggatcctcaacgaggggcactgaacaagcctctgctaccggcccctcccatcatcatttaagcaatcagagcttctcctccttcccacaaaacaccagcaacttcagccagagttcctcctcatgtcccccgcagctgtgtccgcacctcttttgccatggccagacccttgcgagtgagccgtgctcgctcattttctccacttcttcaccgcctgtccacggggctggaattggccttggcaggtcaccagtgacctcccgcagccagacctggaggggaggcgtccgcccccgtcctagcctacctccttcccactgcccctaccttctggcgaggaccacttcactctcttccccggcctctgggccatgctcctcctttctctcctttgacgtctccttgggctcgtcccccttcgctgacccctcaaatagtggcttcttcaggacttggccccagccccacttctgttcacgtgttctgcacttcactgagtgcgctcacccgtccactggccttcacttccacctagtcccaaagctgttcccgcgaacccagacctccctctgggatccgtactcctgtttccagctgcctgtttggatgccgtggggatgctgtcatccctatgcctttgcatcccccttgcccaagaaatcctactttgaattgcccggtggcctggctagccggtactaagcacttgctgggtacacaccctgttaaagcacattacatgtcccgtgtcactgaatcctctggcccgtgacaggtttagagaggctgagagtcccttgtcctcaccatgtctctgtattatgtgccctttgctcttgccctgccgtctccccatctgggtctggcctgcagcagcctggctgccctaccccatggtgatgtgagcctccccgctttcctgtctggggaaggtcctggtgctgtctgcaccatgcccccccccaccccccacccccctccccccaccatctcttccaggtagcatttcacaccccttatttgctgtgcctcctcccagctgctctaggagctccccaagggtggggctaggactgcctgtcccctccgtatggcaccaaggaagccaggaaacttctaacagaggaatgtgctgttttccagctcagtccatgcccctcagttgtgccctagtagcgtcacagaggaccagccagcctgtcattaccacctaagcagcccacagccccatcagtgccaccaggggcctccacagggacagcatctcgagataggaggggtactggacacattgcatcttgtgctgttgtgggtattagttgagtggccctgggcgggccatgctgctcttggcctccatccctcatctgtgtgttgtggacaagagtagcgctgctcggtgaggattcctgtgaagatccagtgatgctctgcacactgagcacctgcccaggcctggcgcacacacagggagggctcagcccacagcagctgtcctgcagtttccaagacacgagcatcaggcttgctaagtcctcccgcacccgcatctggggctctgtagctggggcaggccatctcatttgatctgccaatgttggaatggaggtgagtctgtggtcccatctctgccacctgctctttacaccccaaagcctcacagggtgagcacacactcttcagcagggccattagaatagtcagctggtcgtggtgctgggccggctggatttccagggaagccagcccatgaagctgctgcctcttcactgtgtcctctcacactgtttgctgtcacccaggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatggttagtaccatgcgcctgtgggggtggggcagggggctggcctgctacgcagctggtggtccccactgtcaggaaatggggagatgagccttgctttcttgctttgaggatgcccagcacctccacacacacgacacacacacacacacacacacacacacacacacacacacacgacacacacacacacacgacacacacacacacgacacacacacacacgacacacacacacacacacacacacacacacacacacacacacacacaccccccggtcatcccccctgagaaggaggtgacggaacttgagttctgaagcatggctcttggggtgggggtgtctggtggccttgtgacctgccgcagccatgggggctgtggacgaccccatctgctccctctctgaagctccatggggcaccacaggagtctggacctgtgccacaaccacagcagtgcctctgccctgccagcagctgagacacctgtcagggcccaggtttgagggtttcaaaatcctgtcattccccagtatggttttactaaaaaccacctgttgggggcctgaggaggggaggatgtcttgcggtggctgtgagggccgtgagaggggtactcccccaaggacagacatggtgtggggctggaggtacccaggccccagctgtagggagagctgaggttctgcagcctgcccacctcttcttcctacaagccaccgcccctgccaccaggctgccttcccgccctgtcttcaccctcaggacccctgtgcaaagctaggccctctgaccgaagcagaggctgctgtaggctccagcccagagcatcccctgctgatcaccatgcatttctggacatgcatctctttctagttcccgtattctaggcctcagtaactttaatcagtcatcagaggcccaggagtcctcacgtggccatccacggctaacactggagtcagggctggcaagaccatggcctccaatctccatgctcagctgggcccctcacccagtgcagtgctgctgggaggaaacttccagatggctgtgaggcctggctctgcagaacttccaccacactaagaggccctttgcccccaccccctatctaccaacttttttgtttttcacaaaagctctagcttaggcctttctgggtatcagaatcggtggggggcttgctacacacaggctgctgggtctcacaccagcatctcataggtatggtatggggtccgaaagaatttgtgtttcttcttatttatttttgagacagggtctcactctattgcacaggctgaagtgcagtggcgtgatcgtggcccactgcagcccagacctcttgggctcaagcgatcctcccacctcagcctctggagtagttgggactccagacaggcgtgaccccacccagttaattttttcttatttttagtagagatggggtctcaccatgtggtccaggctaagaatttgcgtttctaacaagttgccaggtggtgctgctgcagctgatcctgtgaacacgcttggcgaagcacagcactagcagaaacaggacagctcctctgaggatgaaccgctgagtttctggaatgttttctgtggcagtcagtgtgcttgcgttttccttggatgatctcagattgtccccatagcctgccagaaactggcgctttcattatacccactttgcagatgagaatgccgaggcaccaagagaatcagacagctgtgggcacagactcccgagcctgtcctctttactaccacgctgatcagcagtcctcaaaatgggctccccagactagcagcatcactggaaacctgttagatctgcagattcccaagcccattcagacctactgaattagcacctctgcaggtggctgcggtgggctcagtattttgtggtttcacaggccccccaggtagattctaatacagaccagtgtttgacaaccactgcttcacagcatctaaatgccctcccctccccggccatcctctgccctccctgcacctgccccgtccccctccccaccacctgcagtgaagctgcagagcacacttcactgtggccccactgagactcctccagcagagcaggcgctgcactcagagcctgtctgctttgctcctacctatgacccgagtcccgcctctttacctccgtctctcccctccacatggggtccttttcttcgtccctccccaattcctacaggatgtgttcctctcccctctcctctcttgacttgattggcaaaagcctgtccacggtggagtcctagctaatagagccacaggcaaagagacaaaaagcctccctgtgcgatttgctgctaatgaaaagcccagaacagcagttctggtcctggttgcatgatagaatcacccaaaagcttgaaaagcttaaagaccaagccccagcctggcccagtccttctgttttagctgtcctaggtggggtcctgggcatccattgtgccctgatggacgttcctgcctccctgcaggctcccaggaggccgtctgctgcccgtcaccctgcattgatggtcaagtggagttagggttggggacactggcggcctgggtggtgtgggggcttccaggaggtgccccccgatggtgccagctggtggccgtcgggccgcctttcctccctgctcagggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggtgggataccggccaggccacactttctgggggtcccttgcctgcctccttcaggacctgcggtggcccagggtggggtggaggaagagtggggaggcaggaaagctcacgtgggcccgccaggccgccgcctcccgatctggaggctggacgtgcttgtggaactcggcatctgctgtttttccttcgctgccacatttagtgcgaggttaataatagatttgttaacacagtttggttttcctggatgatagactcggggtattgatcagctactgaatcggagctgaggaatttcagacataccagggcctcaagctgtggcccaagtctgcccccagctcagggctctggttctgtccctcggggcactgctggcctctctttagttggaggccttgggtaggggtggggctcttcctgctgctgcccgctttgtttccgagcaggcccattttccactctccggcaggcctgagagctgccggtgtgtgcgctcttccaggagccaggcagctccagtgactgtgaccacgaccgcttccttctccagcatcctgtgcagtggatgcagctgtgtccctgacagctgaggagatggaggcctaagggggtgcagtaaccccgcaaggtcacagccaatatgggcataactgggagcagagctaactgtgtctgactccagagaccacatgttcagcctcaagccatgctccctcctcctttctgaatgacacctcccgtgacctccacccccacaaagaacaatcccagctcagtttgttcaactgaaactgaagttgcctgtggccatcaccctgcctcccacctcctccctagacaccccacacaaaacacccagtagcatcccctcccttccatggccctgcccctgacgccctgacggcttggttgtgtctctcgacccaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccctgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggagcgctggaggaaaccagccctttagccagcagcccctccaccacaggcactgctgtgtggaacgagttcttggaatgaatcccatgctttctgcagcctgtagttgttatgacccctcggaacaaccaccccgtggcttgtgtggggtctcgcagggaaaagggctggcttctaggtccccgagataagtgtgcagggggatgggccagggccaggctaagggtggctcagttccatcatctggaggtcagacacactgtccagaggcagaactgaagccctctcggcccctaccctaagccagccacccctcttcacagtgggtgagctgggctgggctggctggcatgaggccaaggggtaggcctgagcgccagagtcgcccaggttagcccacaggattcctttgtgtgccatggaatgctgaaagatgggtgactggggacccttcttaaaacctttggcaaaggtgccatcggcagggcttggcctcatgaagtctcaggtccgtgttcccgcagggcgcacatgcttggagagtcctcagcagggtagccgaggccaggccacttctgctgaggatggggcaggctggggtgtgggtgtggcctggggtggctcagggctggaactgctgcctgattcctgtgtggggagaagctcagtggccgtttgctgccactgacaaggatttcacatgcagaagagaaaaggcccccctccaccccccgcattccctgccgagtgagagccagtgtttgctgcccttgctgggggcgggtaggaaaccctgagcttcctgatgcggagtcatgaagcagagtcctcgggaaggcatctccacagccccgggtcctctgtctaacgccctccatttcacgccctccatctcacagtcaagataaaggcctcgagaataaagagccagcccccttccatttagtctcctgccgtttcccaaacagttgtccaacagttagacattgaggggcttcactgttaccaggcatgtaacagaaggaggaagactaacacacaccccctgccccatcccatccccctctcccgagctattttcttgctgtggcctctggtgcccttgagttggtctccccggctgctctgcgggggcttcactggcttcggagtgagcgcgaagtgctggtgagcagtgggcctgtgattggatgggaagatgtgcatccgtggtcaaaagtcagctgccagccctgcggaaccagagcctcaggctgggatggggaggcctccctgcttccacctgcatggtgggcatggcctggcttacaccaaaggctttgacggtttctccaagtaaggatctgcaaatcttgaatcgtcctcaaaatgacgaagcttgaattgtcctcaagatggatgtgaatcttacattccttttcatcatttcctttgtaaaaatgacgagtgctgggtttttgttttaagaagcattatgaaggccagacttactcatttttctcccccaagtgagctgcaagaggcccctgttaggcccctgtttcctgagcagtgatgtgctgctcttcttggtggggctttgggctgggaggggaaggcgggtcagagatgggggacctgtggctgccatgcaggagcccctgcgtcatctcgttggactctttaagggagtcaggaatagatgtatgaacagtcgtgtcactggatgcctatttagaaataaagtgtatgctgctgaattggagccagtgtctgtgttcatgttcaggtggctttgcagatgcacaggtcacacctcctagactgggctctgtggcacacagctacccagcccctgggccggtggcagccatgtcaccaggaagtacagtgcttaggagcagggctgggtcaggctggcctgcgtctggttcctacctttggccctcagtgaggagcatgtgaagctcagcccccagccaggctcagcttctcctcacgatgctgggagcccttcctccctgggttcgctggctgttcgcccaggctgcagggccgcctgacctcctgctcggggcttacagatcagtcccccacaggcctttgcctgatggtgaaatggggaaattctgtcactgaacctgccctgccgcaggagcgggggcatccatagcctctgatcagaagtggtggcatgtggggcaagaagggtcgtgagttcatctatacccccacgtacttccaaaggcatccaagctgctgaaggtaacaggcacgaaccaaaaatgcatgtgatgtaaaatgaaaccagtcaggagaagctgtcctggccccagccagggggcaagagctgagtttcctggttccttcccacactgtgcttcagcccaccccaggggagactcccgaggccacagtgggctccccgtggcccgcttttggtggaaacccagattcagagaaatatttctccaccataataaaaactgcaagtgtgatgagaagtggtagctgacacttggcctcagtgtcagggaggcaccacgagagtgataaggactctggctaacagcagaattttccaggccagccctgcctgcgagggcggctgggaagtggagctgcgctgtgctgagcagagtgtcagctgggacggaacggagtgctggcagcaaaggtggggggtggtcctgagtgggcacctcgttcccacggaacagggtatgtttcatttgtatttcaaccttctcaactcctaaaaaaagctctcagggtagaggggagcaatcgaggcaagaaatattttccttagaggctagaaagctggcggggggttggagggtcacacacaaagttgagggtcctgtaacccccgcttattattccacagggcactaggggaatgaagctggcctggagcggggccccactgcctcttggaggcaacccccccaccccaagcaagggacaacacagccctctggctctagccagagaagatgtgagacatgaagggcagtgggggtcaggggccaggggccagtacagtcatctcaaggccctgggtgacagtaagtgccccgtaaatgagggtcctctttgtgaatatttatggacctgcaggagagcaggcaggcatcagccacactccccctgcctggggaggccgcctggcagacctggggggtcttagcatcagttgggaccagtctggtgctggggacagaaggaacctctgcgcatacaggcagctgccagctaataccctgatgtaaatggggaagaaaataagtctttgcttacagaaaaaaaagggcacaaaaatgtagttggttcattttgtggcgaagatgagccatacgctcctatctgctggtgggagggcagctggctcacactctccagaggacactgtggtgacagctctccaaagcctgaaaacggcccagcagttccactcatggggcaaaaggaaagtgcatgaaaaccgcactccaagaatggtcatcccggcaatatctgaatgaggataaatggaaaacaacttccttgtccatgaatgagggactggtgagataaatgatgatagaatatttaccaacagctcaagattctaaggatgtggaaaaatgtttagaatgttatcagaccagcattttaccacctttagggagagagaaacatttcaccctctccttaaatgctgtttgagattttaaaatgactaaaaacgaaagtagaaattttagtacatccttttatacaaatacacatactggcactccagcgcgcacccattcatccctaatatggaagacctggtggttcctttcaaccaccacttcttccccgagccctgttgtctttgctaagagaacccatgtggttcgtgtaatgggtgactgtatgcttcaaggggaaacagagccagttctcggttcaggttgttcctggtcattccctctacttgtctgagattggctgaggaatgggtctgtgaccttatttggcaggagaatgaagcgattaaaaaaaacaaaacaaaacaaaacaaaacaaaaaaaaacgaagtctcgctctgtcgcccaggctggagtgcagtggcaccatctcagctcacggccactgcaatcttcgcctcgtgggttcaagcgattctcctgtctcagcctcctgagtagctgggattacaggtgcccgtcaccatgcccagctaatttttgtatttttagtagtgatggggttttgccctgttggccaggctggtctcgaactcctgaccccaggtgatccgcccacctcggcctcccaaagtgctgggattacaggtgtgagccaccgcgcctggcctgaagcaatcttttgaggaatttctaaaactttccttactctcaaaaagacactcaaggaagggacatgttctcttcccattgtctgacctttgcctcccattacttgaggatgtaatgcctccacctgctgcagccatttggagaccaggagggaacaccttgccaccatgctgaggatggcagagcagaaagacagaaggcttgtatgttgtcaaggacactgctggagcagttaattaaccagtcctggaactgacctccctctggatctcatgacatggggcaatacatgttctgtatctgccatttctggttgggtattttgttacaacagaaataatgctgttataacttcatgaactgagaaaagcagatttcagaaccatatcaatagatgtggctctataaattaaattagcagtatgtgtatacaggaaaaaaatcttaaaggatagacatagagttttaacttaactttggttctctccaagtggaaggattataggtaaatttttttttttttttgagatggagttttgctcttgttgcccaggctagagtgcagtggcacgatcttcgctcactgcaacctccatctcccaggttcaagagattctcctgcctcagcctcccaagtagctgggactacaggcccctgccaccacgcctggctaattttgtattttcagtagagacggggtttcaccatgttgttcaggctggtcttaaactcctgacctcaagtgatccacctacctcagcctcctaaagtgctgggattataagcatgagccaccgcatctggccgattataggtaacttttaaaatcttgctgtttgcatatactttctatttctctcataaagaatatttattaagtcaataataaggaacacacatgttctttgaccagaactagaggagcagtgcattagatggagtgacttgaaggcccctagggaaacaggtgagggtccaaactgatgcagtcaccacggagaggcctgtggcccttccacccacgattcctcttctagccctggggcaaagattggcaaattactgcctgtggcccaaatccagcccgcctcctgtgtctgtactacctaagagctaaaaatggttttaacattttttaaaggttggggaaaaaaacagaagagtaaggccaggtgtggtggctcacacctgtaatcccaacactttggaaggccaaggtgggaagactgcttgagcccaggagtttgagaccagcctgggcaacatagggagaccctgtctctctatatataattaaaaaaaactagccagcatgttggtgtacacctgtggtcccagttactcagaaggctgaacccaggaggtcaaggctaaagtgagctgtgatcgtgccactgcactgtagcctgggtgatagaatgagaccctgtctcaagaaaaaaaaatcacagattcacaagaagttgcaaaaaagatagtacagaaaggtcccatgtacccttccccccgttaccctcagtggtaacatcttgcacaactacagaatagtttcacaaccaagaaactggcattgccacagtccacagatcttgttccaacttcattagttttacaggcactcgtgtgtgtgtgtgtttagttctacgcaattttatatcgtgtagattcgcataaccaccatcacagggaagttgccttttatagaagtattccagctgccaaacaaagaagaaatcattgaattggaatatctctattttgtaacttccagtgaaataatggatctaagtgggaagtaacagccttaatagctgctaattccccaaagggagagaactcgacataatatgcctcctgatgagagaatacgcatcaagtattcttaccacagagatcagacccaaatccaagcaaaccccaacagccagctaccatgcaatacatgcacacattcaacaccctttcacgatcaaaacactcaaccacctaggaatagagggaaactactgcaacacaatacaggccatctaggataacagctgacagcatactcaatggtgaatgactggaagcttatcctctaagatcaggaacaaggcaaggatacctacattcaccacttcaattcgacgtagtactggaagttctagccagagcaattaagcaagaaaaccaaagaaaagataccctggttggtaagaaagaagctaaaattatctcatggatgacatgatcttatatgtagataaccctgaagattccacaagaaaaaaactgttcaaactaataaataaattcagcaaagttgcaggatacaaagtcaacacacaaaagtcagctgcatttccataaacagtggacaatcagaaaaggaaattaagaaaaaaatcccatttataatagcatcaaaaagaattaaataggaataaatttaaccaagcagcaagaaagacttgtacactgaacactataaaacatgctgaaagaaattttaaaagacacaaatagggccaggcatggtgtctgacgcctgtaatcccagcactttgggaggccaagacctcccaaatcacttgaggccagaattcaagaccagcctgggcaacacagtgaaaccctgtttcaacaaaaaaaaattaagaattagccatgcgtggcacatgcctgtggtgccagttacttgggaggttgaggtgggaggatctcttgaaccaagagttcaaggctgcaatgagccatgactgcaccactgcactccagcctgggtgacagagcgagaccctgtctcaaaaaaacaacaacaaaacgatctatactgcccaaagtggatctacagattcaatgcaatccctataaatggcattttttacagaaatagagaaataaaaccatcctaaaattcatatgggatctcaagggaccctgaatagccaaaacaatctttaaaaagaacaaaggtggaggcgttacacttcatgatttcaaagtatattacagagctacagtaatcaaactagtgtggtactggcatgaaaacaggtatacactcatagaccaatggaatggaatagagagcccaaaaataaaccctcacatatatggtcaaatgatgttcgacaggagtaccaaaaccactcaatggggaaaggactgtctcttcaccagatagtgttgggaaaactggacattcataaggaaaggaatgaagttagacccctaccttattctgtatacaaaaattacctcaaaatagataaaagacctaaatgtatgacccaaaactataaagacaacttaaggggaaacttcatgacattggatttggcaatgatttcttagatattataccaaaagcataggcagtaaaagcgaaaatagacaaatgggattacatcaaacttttttttttttttttttttttgagacagagtcttgctctgttatccaggctggagtgcagtggcgcaatcttggctcactgcaatctttgcctcctgggttcaagcgattctcctgcctcagcctcctgagtagctgggattacaggcatgcgccaccacacccagctaatttttgtatttttagtagagatggggtttcaccatgttggccaggctggcctcaaactcctgacctcaggtgatctgcccacctcagcctccgaaagtgctaagattacaggtgtgagccatcacgcccagccgactacatcaaacttttaaatttttgcacatcaaaagaaataacagtatgaaaaagataacctatggaatgggagaaaatatttgcaaatcatgtatctgataagggatcaatatccagactatataaagaactgcaaataaaaaacaaaaaatttacccaattaaaaagtgggcaaagggctgggcacagtggctcatgcctgtagtcccagcactttaggaggccgagataggagataatttgagcccaggagtttgagacaagcctgggcaacatagagagatcccgtctctatttttaaaataacaaaaattaaaagtgagcaaaggacttgaatagacatttctccaaagaagatatataaatggccgaaaagcatatgaaaagatgctcaacatcactaatcattagagaaatatgaatcaaaacaataagatatcatctcaccccattaggaaggctgctataaaaacaaacaaaccccagaaaataacaagcgttagcaaagaggtggagaaatggggactcctgtgctgcaggtgggaatataaaatggtaccgctggccgggtgtggtggctcatgcctgtaatctcagcactttgggaggctgaggcaggtggatcgcttgagtccaggagtttgagaccagcttgtgcaatatgatgaaaccccgtctctactaaaaatacaaaaaaattagccaggcatggtggcgtgcctctgtcatcccagctactccggcgactgaggtgggaggatcacctgagcctgggaggtcgaggctgcagtgagctaagatcatgccaactgtattttagcctgggtaatcggagtcagactctatctcaaaaaaataaaatatattaagttcaggtgtacaataagaaaattaattaaaatataaataaaaatgataaaatgggtacagctgctatggaaacagtatggagactcctcaaaacattaaaaatagaacgccgtatagtcctgcagttccacttgaaccgcctcctcctcctcacataggacctgaaatatgttaccagtggagattcgcatgtctgaaaacctggacctactcccatcccttaagctcacccctgccttaagtgatttcctctcatctctcatttatgaagctgcagccttgaatcattcccataagaagtatttatttttctacttttgcacaatatgtgcaaataaacagtaggaaattggaggtaaacagagagaacaactactcccagtgctaaaacaacaagcaggctgaagtaaacatttaggctctggcaaactctaaaggacaaataatccagtttcctcaacaaacacgtcgcaagaaaaaagttagatgtgaaggtaatactgtctcagcctgttcaggctgcaaaataccacagactgggtagcttttatacaacaaaaatttatttatcttagttctggaggctgagaagtccaagattaaggcactggtagattcagtgtctggcaagggcccaattcctggttcacagacggtcagctcgctgggtcttcctgtgctgggagaactccattctcttcagccccttgtaagggcacccatcccattcgtgaaggccccacccacatgacctaatcagctcccaaagtgccctcctaatacaagcacactggggggattagatttcaacgtttgttttttcttggggggacatatgcagtccgtagcaggtatcatgttttaaaagccctcgtctcttagataaacactgaaaaattcacaaatgagacagacatctagaatttgcttcagaagagttcaggagtaggaaagtggatggcaagggtagagacaaaaccagattggccacaagttggtaactaactgttcaattgctgaagctgggattcattatactagtatcacttttttgctttttttttttttttttttttgagacagggtctcactctgctgcccacgctggactgcactggtgccatcacagctcagtgaagcctggaacttctggcctcaagtgatcctcccacctcagcctcccaagtagctggggaccaaaggcatgtgccaccatcccagctaatttttttttaatggggtctcactatgttgcccagattaggcttcatgtcttttgtaaacaaaaaggttttaaaaacagacaaattaggccgggcgtggtggctcacgcctgtaatcccagcgctttgggaggccgaggcgggtggatcacgaggtaaggagatcgagaccatcctggctaacatggtgaaaccccgtctctactaaaaatacaaaaaattagccgggcgtggtggcaggtgcctgtagtcccagctactcaggaggctgaggcaggagaatggtgtgaacccgggaggcagagcttgcagtgagccgagattgcgccactgcattccagcctgggtgacagagcgagactccgtctcaaagaaaaaaaaaaatagacaaattggggcttaagtgagataacagtttatttttcatataacagacctagaggcaggcagcacgggcaggccatgggggcagcttccagagcatcagggccagctgctgtagctgctgcccaccccttcctcgcttggccccctcagcttcatagagcagctccatctccagccatcacagccattccagccaggaagaagggctgggtgggaagggcaagctcccttccttgaaggccatgcccagacaccacacaaagcacctctccatccagggaccagacagtcatctgaccacacgtggctgcaggaaaggctagggaaggcaatctttactataggtggccacagatttgaaaaccggggcttctactaccaagggggaggggatggagactggggtacgatttggtgtctgccacagctctcatccctgagattggtaatctagcatcctaggtgccacagatcggccagcagagctaatgctgtccagctggtgggcccaatgaggtttaaatatgtttgtcatttacatgtacatgtaatgtacatgaagcaatctgctctgaagtctctgttcccttttggatgcggagcaagcacctggcttccttagctctcccagggtaggtgtgcgtctccaggaaactgctacccccgacagccagggtggcaatgccgtttcctatgctatagctcaaagcaatccagcacctgagcctggctttggcccaaggcctgggtatttgttcagccagcaaatgaaatggagaaacctgttcagtgtctgccctgacagctgagctgcctggtgggagcccacacagcagcgtggtcagtgggtgggcacaggcctgctgctgctgccttaagatttctgccatgtattttgcttttaagtcaatcctcacttaagaaaaaaacaccttttttgttttgttttgtttttccaagatggagtttcactcctgtcaacccaggccggagtgcaatggcacaatcttggctcattataacctccgtctctcgggttcaggcgattctcctgcctcagcttcctaagtagctgggattacaggcacccgccaccatgcccagctaatttttgtatttttagtagagacggggtttcaccatgttggccaggctagtcaacctcctaacctcaggtgatcctcctgcctcggcctcccaaagtgctgggattacaggcgtgagccaccgcacccggcccttaaattgatttttaaagcaaacctatcactgttacaatggaaaagtagtatggcctgccctagaaggtaacaaaacctggctaagagcctgccacacgctgtgtctgatgccaggtttctctgttaaagacaaggtagcatcgaactgactccctcctcaagacagttaaatggatggaaaaaaattcaaatggaattaacttttaaaaaacatcttccaatgttattaatgcctctttgtctctactaacaagcatttctcctggatgatgcagtcccctctttgggaaacatctgaactctgtgtaccgccatttccccatatgtaagatggagatggtaacagtgcctatttaataggatgactgaagctagtaagtaagatcatgcacatagtctcaggatacaaatgcctggcgggaggatcactcgagcctaggagattgagaccagcctgggcaatatagtgagaccccacctctacaaaaaattaaaattagccagacatagtggtgcccacctgtagctacttgggaggctgaggtgggaggatcactcaagtccaagaggtccaggctacagctagccatgatcacacaaccgtactccagactgggaagtaacagagcccgtcttaaactaaaaaaaaaaaacatggccgggcgtagtggatcacacctataatcccagcactttgggaggccgaggcaggcagatcacgaggacaggagatcgagaccatcctggctaatacagtgaaatcccgtctctactaaaaataacgaaaaattagccaggtgtggtagtcccagctacttgggaggctgaggcaggagaatggcgtgaacccaagaggcggaacttgcagtgagctgacatagcgccactgtgctccagcctgggcgacagagcaagactccgtctcgaaaaaaaaaaaaattttttttacaaaaaattaaaaaaataaaaagtgccaggctcgcagtatagcactcaaatgctatttgtcagtttcatggaagagaaaatttaagtcttgtcattaaaaaactaaatacagcttaaggaaaaataaactcccaagtaaccaaacttcaaagcagggccaggggacataaaaccccaaacacttcatttaacaatggaagacactttattattattatttttaatcatctctcaacatttcaactcttggtagaaatcaaatgtaaaacatctgcatttttaaattagcatgtatttaactatctcaatcacagcaacctcatccagtaagatgcacacctgggagcagggctgtagtatttcgtattccagtctgtgaccacagtgcgtccgtgatgacaggtacactggactttccctcctaggatgtgttagtcattcctgcttttgtccatagggtaagttacgtggcatcacggttggttagaaagagttagttactgtaatgctggcgcaatctggaaatggaaaactagaaaactagagctctcaggagtgggccaggcattgccgattctgaaatgtgaaaaggaagaacatcaaagatgaatgccctgctaggctggtcttagtaataaagttggttgaaattcagcttaatatacacactgtacatctacatgtgatctaccagatagatatatatatatatatatatatatatatatatatatatatatatatatattaaaaagagagccatagaagatttggaaaaccttaaaatcactcaactgagttggaagaacatcagcaaattcacagtggcctcaggattcagccagacttaaacttgctcaagagctgaataactttctcccagaaaagcccactgcatataaatcccttaacattgtgtacatcacaaacagttatggctaaaatatagttagttcacaaggaagcggctttattttcaaactcttgccccactcctgctcttgtacccccacaaggaaaatccaggggttggtaattcacatgagaagctgaaggggccttcaggcttggaagcgcttaggcttagctgagcatctgaggagccgtctctctgatgggcacatgccgactcctgcccacttttagtgcaaaaagattgcaaatgttgcagatgagtcctggaaactggtgaagagaagaggattgagatggaggggcagtaggaatcccaaatgattttccttctgaaacgagactcaagaagtgtgaagtgcaaggttcctgctcagcaagctataggtccgacaggtgaggtccctgaattgtcataggttagcagtctgcagacacacagacctcgacacccgcgctcaccccctaagtgcacactggaggtaggtgtatagatagttactgcagggaagacagtggctctccaccagctcaagaaaaggaggcttcatgtctgttcctccctgccccaaactctcctctcccctcgggccatagtgagtggaggatacaacacgaatgggcgcgaggccctcccttggaagactaaagaacccagggcatttaataaatagctacataattcatttttttaaccacgttgaaacacacagcaagttgaatatttatttaaaaataaatctcaaaaatatctattgacagtacagtaagaggggcatgtgcaaacaacagaaagggggaagtcagtcctgctgtgggaagcccacacatcagtgtgttggagcaaagttcacgaaggccatgggctgactgagctgtggtgtacgaaatgacattcagctaatactggactcggttcacctttgacacctggagaggtggggaagccagggggtggggagtccagctggggatccttgtgtttaggaagggggcggccaagggatgagcctttgggagaggccccgtgtggcaggagggctcatttcacaagccaacaggcctctagctcgccgctccaggtggatgtttggtgacctgaagggcccttcccagtccaagttggctttgcaatgggaggggtaggtgcagcgagggtcccagagacagaaatcctctttaaaggaaaaaacaaaacaacaaaacaaaacaaaacaaaaccccaaaaaaagaaccaactgaacagggagtggagagattagcaaaatgaatctgaacggaagtgccaccttctcccttgtcagacaacaaagcagccattggttgagatatctgagtcgctaagtgaactcccacgtggacacagccagcccacgatctctgccacctacatggtcaagtgcaggcctccgcctctgagatcaatgcgttagtacttcttcaccgtgaaacccgaaaggtcggttgatgtagcccttggagctggaaggggcgaggccggtctatctgtacacgagatgggagagctgggtggacttgtagttcagctggttgttgggcatgaacttgtgcagctcactctttttgtagcaggggtcataatggtaagcgctgaggcaggcgtcacatgagacttttgaacactgggtgcaggtgttggtggcgcctgggcggttgcagaagccacagcgggaagtgggcgtggtggagggcttggatttggagtgaaggtgcgggaggcggtcgaggccctgagtctggcctgggtacttctcccgcagagatgccccgtgggccaggctgtcatgagtcgaggccttgctggggaaggcgctgggcttggaagctggaggacaggtgagcaggctgtcacagcgctggcagagggaggagctgcaggacagcccgcagctttggcacttggagagggcggactctttggcagggggcgagcgcttgtggtagagggagtgggcatcgtttctgagcagccacacatccggccgcagagcatcctgccgacggtaggtggccctgggttcagagtctgtgtacagatccacgtcatcctgagtggagaagtaggtaccgcgcagcagggccgggccgttgctgggggaggcgggtggaagcacatccgggctgccgtggggggagctggccatggtcagcagcgaaggggatgggcggatgatctcatccttgaggtcgtcccccacatccgttgccacaggctccttccgaagactcaatgaggccttcaggggtggcttccggctctcccagtagctgtcataggcatccactgacctcgagggcttggtcacgcggggcttgtagtagtccttggccgcccgctcgctggccgacttctggagtgccactcgtgacatggaggccgtcaggtgctcccggccctctgcccgccgccgcagggcgtccgagcagccgcgcacatcctctgcactgctcttgcgctcgctcacaatgtccagctcggagtagcccttgtccttcacttgtgagtggatttctagcatctgctcacactcgactttggccagaaagagctcaaaggagaccatcttcacctggagggtctccacgagctctctgagcttgtatgcagtgcccagctcaggtgtgtagcccatgcagctcaggatggctcggatgtcctcttccagtaatgtcgacttgacataataaacaaaagggcccgtgtaggtctagaagggagggagtagaaaagaaaggtggggttttctgtcagagacacaagacagagactatgtcaaagcaaaggatgtccagctctgaagtggggcggcggggagagggcagggcagggaaggatctcgacagcctcaccctgcgggaggcagaagacgcaggagctggggcttgctaagcactcaggaattgtgcaaggaaatgacccagcagctcctttcttttgtttgagacggagtctcgctcttttgcccagggtggagtgcggtggtgcgatcttggctcactgcaacctccgcctcctgggttcaagcgattctcctgcctcagcctcctgaatagctgggattacaggcgcccgccaacacgcccagctaatttttctgtttttagtagagatggggtttcaccgtgctggtcaagctggtctcaaactcctgacctcgtgatccacccgcctcggcctcccaatgtgctgggattacaggtgtgagccaccgcgcctggcagcagctactttgttaaacacaggaagcaaaacctctcgcttcctagtggggcacgaagactctactccatatgaagagagagcctgggcaaacatggctgaataaaggggccagattacaggcagaacgcggtgacaatcagaacgttcctctctggtatttccatgaggggctgagtaacacggcagactgaagggcctggctaggtgacagctctcctgtgccatcccctctcttgattaccactcctcccatggcagaatgaagaagcctggctaggtgacagctctcctgtgccatcccccgcgtggtctgattcaggatccctctctcaattccccctcctcctctactgttcccacttagtacagaacacccctcagcttgctgggaccgctgagaagcttcctaactgctctccccatccctcccacctccccccacccctctacagcctacttcccataccacagccagaatgaccctcttcagatgcaagccagatcccacactgcctccttccccgcctactcagaacaaatccaagccttgccctgggccacaagaccctgcataacctggctgcccctgccttcccagcttctctgcttaaggtgtggcagccgggccagaaacggttcagaggtgatgctggagagacggggaaggttcggagcccggaaggatctgagagcacaggatggatgggatcagactggcatagcctctcaggagggactgccaggggcaggaagagagaaggagggcctgtatggaggctgctccaggacctcaccttgatgcttctgaattccttcttccacgggtagaggaagaggttgatgcccaccgtctccagcatgctgaaggcgccgtgcagagcccgcaggctagaggagctgagcgagcgcaaggagctctccaccacctcatagaactggatcagccggaatcgataaaagggatccaccttgtgcaggctgagcagggttgaggctgccacccgcaggcactcatcgctgccaggccgctgcctgctggtggtggtatccactttgctctcatggaactgcacgtacttccgaaataagtcatccttgaatttagtatccattgaactgggcttccccatccgatcgaggggggctaccttatctcctccatggcttctggattagaggcagggacatcactaaaagcatggacatgttgccgcctggaccagcggagtgctctggaaggaggggaacaagaagcatgtcattcctcgatacggtcgcgcttcggcttcaggtcgctgaggcaaaatgaacagcagaactggcctgggctacactggaccccagcagcacactacagagcatgtactacaagcagggttacaacagaggccagagagagatggaccttgactttgttgtgctcacaaatgaaaaatacgattaatattcctgaaagagaaattcgggtgagtacagcaggagctcctgtcctggtttcgttggggaagggcgagtttaggaaagccctcttgagacagcaacagacctgaaggatgaggagtctgccaggccaagaggccggggaaggagtcgcagtagaggaaggccctgagctaatagtaccagaggctccagacacgtgacgagcttcacacacactaactcgcttactttttttttgagatggatccttgctctgtagcccaggctggagtgcagtggcgtgatctcagctcactgcaacctccgcctcccgggttcaagcgattctcctgcctcagcctcccaagtagctgggattacaggcacctgccaccacgcctggttaatttttgtatttttagtcaagatggggtttcaccatgttggccaggctggtctcgaactcctgacctcaagtgatccaccagccttggcctcccaaagtgccaggattacaggtgtgagcccccatacccagcctcactttttcttcttaaacaatcctaggagagagacgctacaggcagccccagtggaccatgtgcaaactgagacacagacattagaaactgctcaaggtaggccaggcacagtggctcacacctgtaattcctgaactttgggaggctgacgggggaggatggcttgagtccaggagctcgagaccagcctgggaaacacggtgaaaccacgtctctacaaaaatacaaaaaaatttttaagaaaaagaaactgtccaaggttatagaactctcaggaggcagagaagctgagctcagaacccaggcaatctggctccaaagtccatgcccttacccaccacaccctgctttcctgaggcaggaagcctggaacagtaacagaactgcagccagtgaggccgaggccacgagggcaggggcatgaggagaggcagatgccagcatcagcgggaccctcagccccaaggccgcaagagcacattcagaattcgatattttatacaaagagccacgtgaagccactgaagagtttacagcgaggggagagagatacggtcttatttacaattttcaaaagaggccaccgtggctaccggcccctggagtgctgttaccggcctttgacagcctgcggcccctttatcaccagagcgcttgacagccccctgttgggagaggatagaatgttctgagctgggacacaggctttacacaatcttgtcatctgcttagccacttgttagtagaacaggcacagatccagcaatattcttgtcaccacaacgctgggagcgaatccggattaatggagggacactgccagggccaggggagacaacacgcgcagggtcacggacacggggtccaaggccaggcacctgcgagtgaggccagggctgcttctccaggttacttgggcaaattgctccacctccctgggtgtcggttttctcctataaaacggggttaataatagcgcctctgtccagagctggcgagaggattatgcatgatggaatatgaagctgctcagagagccggctccgggaagtccttgatggccattgctgttgtctgaaggtgctgtacccctaagtggacaggccttctctgagtggggcaaatacctctgactgggtggtagatgtgcattttcacatgctctggtcctgctgctcctgcccagaagctccgtgggtgcaggcctgtgaccatcttgctcagtaaggtgacctgtgtgcttcatgtctgctgagtgtgggagacagcaaggggctgagagaagctgcagcaggactgggcctggcatgtgggggactcctttagcagacctgtgttcagctaggaaggtcctacgagcccagcaactatcaggaggtcaacaaaatcatcctcatctcaaagagccagtagtctggctcctccacagattttgtccccaggaggagactcctgggagtactaatggtgcggtgagaggtgggatgtgtagcaaaactagggacacagagaggccactgtctccaacacactgcactgctgagggagcccagtgctacagtgacaaataaggctgaggagtacaggaggcaaacacatccatttaggggccaggtgcgggggctcacgcctgtaatccctaaactttggaaggccaaggcaggaggattgctcaaggccaggagttcgagaccagcctgggcaacatagcaataccctgtctttacaaaagaaaacaaaatccacttgggataaaattctgcttcaggaagattctcatcattcaggcctcagctcaaacatcagcctctagaggtaccaccctatctcaccttcccagttccacactgtcacattctcctacgataaccacaatctgaaactatcaacttcattcattcattagcttcctctctttgtccacccctcaccctccctggtaagctggtaagctcgtggtaagctccataaaggcaaggaccatgtctgtgttgttcaccacgatgcctaacacagagcctgcctgtgcttgataaagtaggtgaaatggatgctgcagccaggcacggtggctcacgcctgtaatcttagcactttgggaggccgaggcaggtggattgcctgagctcaggagttcgagaccagcctgggcaacacggtgaaaccccgtctctaccaaaatttaaaaaaaaattagacgggtgtggcagcatgcgcctgtaatcacagctactcgggaggctgaggcaggagaattgctagaacccaggaggcggaggctgcagtgagccgagatcgccccattgcactccagcctgggcaacagagcgagactccgtctctaaaaaaaaaaaaagaaaaagaaaaagaaaagagaaaaagagaaatggatgctgcaaaggatgtctgcattcacgatgccatcactttagtttctcattggtacctcccaagaatcctgggagatcagctggagagcaaagaaacgggctcagaaagatggcatgaggtacgacaagtagctcaaggttagcagatgatggacccgataatccaagcctggccttctgacttggaacctgtattcctctcaccaccccacgattcccatgtccagcaagcatttctgcagcccccaccctctgcctgagctggacccagtcggggaatggggatgggtgggacaggtagaggacagcaataaaggagacacatcctgcctgcagctctagctggaagagcataccacctagtatcaaagtaggtatgtgctctaacttcatactgttctgtccataaaaaaataaacaatttaaaatgtatattctcttaaaaaataaaaatgcaggccaggcgcggtggctcacgcctgtaatcctacaactctgggaggccaaggtgggtggatcgcctgagattgggagtttgagactagcctggccaacatagcgaaaccccgcctctactaaaaatacaaaaattagctggacgaacacctgtaatcccagctactcaggaggctgaggcaggagaatggcgtgaacccaggagggagaggttgcagtgagctgagatcgtgccattgcactccagcctgggcaacagagcaaaaactccatctctacataaataaatgtattgcaccactggagaggatagtcacacatgcatttaccattcttgacttatctaagagaagctgccatcacgcctctggccccagggtctgttttttggtagtctgagaaccattcaaacacagagacattaagcttccgaatactgctgtaatttttctccaaggaagtcagccttgaactcaaagagactgattttttacaaagtcagccagtctcaagctcggctcagcgtctgctgctctataatcgcaccacagtccacacccttgtttgttgctgaaaaacaataaataaaggaaagggatccaaacagcccagctgatgttcaaaatactcacaataaggacaggaagcctatctaaaacaaatctcaaaccaacctgggtaggtgagggaaaaggcggaagaaagtaaaagctaaaagataattaagggcaagacaagcctggacaacatagttagactccgtctctacaaaaaaaaaaaaaaaaaaaattaggtgggtgtggtgacacccacctgtagtcttagctacttgggagtctgaggtggggggatccactgagcccaggagtttgaggctgcagtgagctatgatggcaccactgcactccggcctgggtgacagagcaagaccttgtctcaatcagtcaataaggaaaggaaagaaagagactaacaattactgaggttctactatgtgctaagcattgggcttcccactttacctacatcatcccatttaatcctcacaactctataaggaaaacaggctcttcccattaaaacaacctgcccaacagagtttgaaagggtcagagctggaatctgaactcttgctgggaggcccttgatgcctgggctttctccaatttacctcactcatttattgttacatcagtaccatttaccaagggattactgtgtggcatccctctgctaactgctctgtgaaaaccaatgaaatccacaggatagatccaaggttaaagaggaaactgaggctcggagaggccaactcacttaccctaagtcgtaaggctaggaagaagtggatctgagctctgaacctaggtctaacgccaaaactccgactcttgcaaagccatcctgctgcatctgctggacagctctactcgaaagtgtttggctaagttagaatgccttatggcggcgcgagcagagttgagttacaaaaattcctgtagtagcaaaattcccatcttcccacaccgaatggggctaggagagctaatctctatatgatgtaagctcaagggccaaggaaagaggctggtcagagacatcggccagtgatgaagcagctgacatcatccctgctgaaaacattttctgagaatacaagatgccttgtagctggtcatagctggtgttttttctgagcacagagccagcaattcattcccagcactctgcaagaacaacaaaatacgctctctgcaaaaacatcgtggttacaggagaccgagacagcccagcgacagaagctgctaatttctccaagcaacccaaggattggaacgccaagccgtgccagtctggtggaaaaaaaaaaaaaaaaaaacccaaaaaacaaaaaaacagcactgtgaatatcctgaacacagagacaggcaggtgcccagagtcaacggctccagtcagcacctcctgcacccacaatctaggtaccttcttgaaaagcaagtcaatggaaaaagagatattgcacagtcagggagccagtggcttctttagttattttttgaacatctaagaggaaagctgtatctgtttagagtcccactgcatggaagtgaagtgattccgagtagctaagcattagcttggctttacctcagctggcccattcaagcagaaatgttccccaagcagcatttgaaggcgccccctctctgcacaggcagacctattttggtctgtgcactgcccctgtccacaggtttacacatccctggtctagctccatcagcctccaaacaggagacggggaagtcagttcaaccccctccacctccccacccacaccaatgcactcgttccaagcaagaggctccgagaaacatccaaggcaccttccactggctgtgaaacaccagaaggtccccacactcctactagattccaaagaaattcacacagagtccttccaaacctctgaaaataacctcagcggtgctgaaagaagcttccctagtggcagctgcctctctcggagaagctctgaaggaagctgtttccctccctgcaggggacagaagctggcggctgctaagtcccagctcggtcattcctacagcctcggggggccacgtcagttgtgaaaaacagcccagtctcaaattctggccccccctacggcttcgtgaattgaatgaagtaacaggaactatcacttattggacgcctgctgtatgccagaggccctgcatgatctcattccatctccactccagccctagcaaccaggttcaatcacttaaataggcaactgaggctcttaagatgaagtgacttatccaaggtcacacagtgagtacaaacccaggtgtgccgccagagcctgaactgggaacccctgcgcggtaactgcctcgtggcgaaatcggggtgtccttctgtttggccagtcgccgaagaggggtgttcctcttgggcggccctgagccaccctcggcgggtcccaggagcctgcgaggcagctcccgggagaatgggggtcctgaggataggctgggggtcccgggagcgccgaaacagcgggcccacctgtagtcctgcctgccgtgagggtaccccgctcccgggccagccgagccctgccgctgtctggcgccccctccgcctggggaagccccgaaggcagtttccgcccgcggccgcccgtcactcaccctgacactgccgccgaggacggcccggccgagggaagcaagcgagaggcgcggctgccgccggagccgggccccgtcgggctctagcctctccggccggctgcaggggtactgagaccagtacccgggggccagcagcgacccggaaacactcggcccggaaatgatgtcaccatgaggcgggcccgaagagagggtggaccacggctgcgcgctggctccgggaagcggtcgatgcccgcggccgacggagactacaacccagaggcggaggacaaagcggaaggccgaagagcgaggacgaaaccggcggaaccgcactttggagcctaacgagccatcgctgcgtctgagactgggacccggaagtaaacaggccggacgtgacgcaagccgctcggcctagggatggtggctggccgggttgtcatggaaaccgctcaggagcagggagctgggagctatgagtgctgactgcgtgaactcggcctccacttcccggacctgccacttatcatgatccacgagctgtactcatgactccgcacaagcaagcaggggctgacggtcggatccctcgcccccattttacggacagaagtaccgaggctcaaagagagccagtgagatgctgaaatcacgcgtgattggaatccagccttgctagggctgcgggtgttacgggccgtgggcggcggttaagagcgtgggttctatttttagttttgccacttactagctgtgtgaccttggacaagttacctaacctctctgagcctcagctttctaacctgtaatattaaataataaagccaggcgtggtggcacgcgactgtagtcccagctagtcgggaggctgaggcgagaggatggcttgctcccaggtgttcgagaccaacctgggcaacataacgaggccacgtctcttaaaaaaaaaaaaaaaaaaaaaaaaaaaaaaaagccgggcacggcggctcacgcctgtaatcccagcactttcggataaactatatatatatataatctgacatccccaccagaccctgagcttcttattcatctatttccccccgagctctgcacatgtctgatgaggaggcacacaacagatgttcattgattgtaggattctcactctgagtcttggtgaccccagctaaaaccggtggggcttgtgtgatgagtcagtgacacaatactgggaaacgtttggagaaccagcaatctgctgctgtccaaacagtagcattactgtgtttacctgtcgttgcctgagcaccgctcaaagtccctgtgttctttatcagctcatgtttaagctcctctcttaattatctgcaatgtgatgatgttcacaggaattccatctgagacaaactgtcccaccttaagtctgcctcttacagcaactcagcactctggtttggtagctcttacaatattgcattttcacgtggggctgcttaaaaaagtcccctccagctctgtgggtctatgacaggcaaaagagaaacaaagattttgaagaagggctttaccagtaggaaaccctggtcatcatctactatcagaaaagacccaaagtctccaaagacagtcacatttctcagttttttttttttttttttttttttttgagacggagtctcgctctgtcacccaggctggagtgcagtggcacaatctcagctcactgcaagctccgcctcctgggttcacgccattttcctgcctcagcctccggagtagctgggactaccggcacgcgccaacacgcctggctaattttttgtatttttagtagagatggggtttcaccaaggtggtcaggatggtctccatctcttgacctcgtgatccgcccacctcggcctcccaaagtgctgggattacaggcctgagccactgtgtccggccatgtttctcatcttttaaacacagttgaaggcttgtgatttctctacttggtgatgtagaaatgacaggagcgtcctttcccgactttattatataatgattaccagattatgtaagggtcacgtgacaatgattaggcacttctacttccgaagagccaacaacacgaacaatctacctacctctttctattttttagtttttttttccatcaccaaagtaatacatgattccaacaatacagaggagtatagaacaaaaagcaaaacagaaaagctaccccatgacccagcaattggatttctcaaaatctgctagagaaacatacactgtgcccaaagagacctcttgcatcattgtttctaatgcaaaagcaataataggaaatatttaaatctccatcactggggtaatggtatatccatactaacaaatactgtggatcacttaaaaagggtgatgcatggccaggcgcggtggctcacgcctgtaatcccagcactttgggaggccgaggtgggcaaatcacgaggtcaagaggccgagaccatcctggctaacacagtgaaaccctgtctctactaaaaatacaaaaattagccgggtgtggtagcaggcgcagtagcgggtgcctgtagtcccagctactcgggaggctgaggcaggagaatggcatgaacctgggaggcagaggttgcagtgaaccgagatggcaccactgcactccagcctgggctacagagtgagactctgtctcaaaaaaacaaaacaaaaaaagtcaactggggacaggaacacagatacagatatctgtctttcattccacaaacacacatttatgtgatctgtattaatatctttctcccccagaagtcagtgaactccatgaggacaaaactatgtctgttttgttcacaattatattactactacctgacatatatgcactacctagcatgcaataggttgttcaacataatttgtttctgaccagaattttcactgaatacctaccatgtgccaagtttgatgtcagattttttttttttaattgagacagggtctctcactctgtcaccctgtctggagtgtagtggcatgatcatagctcactgcagcctcaacctcctaggctcaagcgatcctcccaccttagcctcctgagtggcggggaccacagttgcacaccaccacatctggctaattttgttaactgttttgtagagggagggtctcgcaattttgccaaggctgctctcaaactcctgggctcaagtgatcctcccaccttggcttcccaaggtgctgggattacaggcatgagtcaccatgcccaccctgatgttaggtttaaagggcataactgtgagtgagacagacacagttcctgccctcacagagcatccagtctccttaaccgaaagagaatattcataacataggagtaggattaataaaaccctagaattcaggatagaagatggtaaatgatatgagaggggtatagagcttagagcatggagaagtgacctctgacagggtaaatgaaggatagcctccaggaggaagtagcatttgagctgggctttgagtgacctggacatgtgaggctgtccagctttccttccagctggagtaaagggagcaatcaaaggcaaggacctgagatcaaaaactcggctacctgtggctgggctcagtggcacaagcctgtaatcccagcaatttgggaggccgaggcaggcggatctcctgaggcccagagtttgagaccagcctgaccgatacagtgaaaccccatctgtactaaaaccacaaaaattagccagcctgtagtagtgcccacctgtggtcccagctactcaggaggctgaggctggagaatcgcttaaatctgggaggtggaggtggcagtgagccaagatcacgctactgcactctagcctgggacacagagggagaccctgtctcaaaaaagcaaaaacaaaaacaaaaaacaaaaacacaaactcagctacctgcaagcacataatgtgggcaaatacgaggtactagagtactatagcctcacactgcgtaggaccagaaatgagtaatgtaatctaacatggtacccggctcacagtaggcatccaataagtacttcagtgagaaaacaaatattgttgaattccttccatgcttcagctgacttgtggccaagatccccactcaccaggaatgaccagatactctgatttttggagaggagttagagatccagattgtttgtttatttatttatttaaagataaggtcttgatctgtcatccagactggagtacagtggcatgatcatggctcactgcaacctcaaacttctggactcaagggatcctcccaccccagcctcccacacagctgggactacaggctcatgccatcatgcccagttaattattttctgaagacgtgggatcttgctgtgttgcccagggtggtctcaaactcctagcctcaggtgatcctcccactttgacccaccaaagtgctgggattacaggcaccagccactgcgtccagcctggaatccagatttttaaataaaatttcttaattataaacaatatttgtaaatatacctcctgtttctacctgttgagagggcctagaagaaatggcacacctgtagcaacaagcacgtagactaagactaaccagatcttagtccatggaaccagggcttcctggagaaatggctgattcccaggggtaggtcagggaaattacaacatgaggttggaacatgttattgagccagaaagtaggaagtgcccaaagaatgatgggacatgttgaaagcacacaaaagccaggatggagggtccctattggccagatatgggcaatgtgagtatcaaaataaataataataacagattataaaacttaattgtggggagagaagttatgagcccatactaatgctaaacataaaatatcatgcttcatccaggcatggtggctcatgcctgtaatcccagcactttgggaggccgaggcaggtagatcatctgaggtcaggagcctggtcaacatggtgaaaccccatctctagaaaaatacaaaacaaaattagctgggcatgatggtgggtgcttgtaatcccagctacttgggaggctgaggcaggagaattacttgaacccagaaggtggaggttgcagggagctgagattgcaccattgcactccagcctgggtgacagagcgagactctgtctcaaaaaaaacaacaacaaccatgttttattttttattttttaggctagtcaagtgaagcaatgggaatggagaagaaacaaatctataactggttgtgatgaattagtcgtaagcaccactgcaattggaccagtcaataccatggttatcacaggagtgtggctgaggctgtgtttggccctgggtgccaggtctgcaccctgcactaaggatgggtgaggaacgacaggcagtcgagctggttggtgctacaggtaacgatagtacctaccaaaatacaggttaaatgagatagtccttgtgacatgataacatgttaattactcaattagcattagctatcatgaatcaatccttttatatgttttaaagcctagagaagcactttatccatagtggctgcttattacatttattacatttctcttgattgaatgaaatgatacagttttgctaactactagctcttacttcccatactgttttcttttcaggatcctcactctgatctaagagcataatttaattgtgttgtcagacagcttatcttcagggttatgacatggagtcagactgcctgggacatcatatttatttatttatttatttatttatttatttatttatttattgagacagggtctctgtcacccaggctagagtgcagtggtgccatcttggctcactgcaacctccacctcccaggcttaagcaatcctcctacctcagcctcccaagtaactgggactacaggcatgcgccaccatgcccttgtattttttgtggagacaggatttattcatgttgcccaggctggtctcaaactcctgagttcgccctctccctctccctccccctccccctccccctccccctccccctctccctctccccacggtctccctctctctctctttccacggtctccctctgatgccgagccgaagctggacggtactgctgccatctcggctcactgcaacctccctgcctgattctcctgcctcagcccgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgcagggattgcagacggagtctcgttcactcagtgctcaatggtgcccaggctggagtgcagtggcgtgatctcggctcgctacaacctccacctcccagcagcctgccttggcctcccaaagtgccgagattgcagcctctgcccggccgccaccccgtctgggaagtgaggagcatctccgcctggccgcccatcgtctgggatgtgaggagcccctctgcctggctgcccagtctggaaagtgaggagcgtctctgcccggccgccatcccatctaggaagtgaggagcgcctcttcccagccgccatcacatctgggaagtgaggagcgtctctgcccggccgcccatcgtctgagatgtggggagcacctctgccctgccgccccgtccgggatgtgaggagcgtctctgcccggccgccccgtctgagaagtgaggagaccctctgcctggcaaccgccccgtctgagaagtgaagagcccctccgcccggcagccgccccgtctgagaagtgaggagcccctccgcccagcagccaccccgtctgggaagtgaggagcatctccgcccggcagccacctcgtccgggagggaggtgggggggtcagccccccgcccggccagccgcccggtccgggaggtgaggggcgcctctgcccggccgcccctactgggaagtgaggagcccctctgcccggccagccgccccgtccgggagggatgtgggggggtcagccccccgcccggccagccgccctgtccgggagggaggtggggggggtcagccccccgcctggccagctgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaattggatggttgctgtgtctgtgtagaaagaggtagacatgggagacttttcattttgttctgtactaagaaaaattcttctgccttgggatcctgttgatctgtgaccttacccccaaccctgtgctctctgaaacatgtgctgtatccactcagggttgaatggattaagagcggtgcaagatgtgctttgttaaacagatgcttgaaggcagcatgctccttaagagtcatcaccactccctaatctcaagtacccagggacacaaacactgcgcaaggccgcagggtcctctgcctaggaaaaccagagacctttgttcacttgtttatctgctgaccttccctccactattgtcctgtgaccctgccaaatccccctctgcgagaaacacccaagaatgatcaataaaaacaaacaaacaaacaaacaaacaaacaaactcctgagttcaagcaatccacccgccttggcctcccaaagtgctgggattacaggcgtgagccactgcgcccagcctcatcatctttctaagcctcagtttccccacctgtaaaatggagctgatcatagtatcttcttcataaggttattttgcatattgaatgggataacatgtgcaaagaagttcccccagtgcctggaaggcagtgatcctgcagcaaatgttatccacgattaggattcttgttgtcccacatgaatttgctgggtgctacagattctgtctggctcccaaagctcagaattcattctggcctcccacgggtggaggcagggtttgggggaggtttgtaactctaaagatggcacgtcttgaactgaaagctggcgctgtcaagcttcttcacaatcagtaagaacggctttcttcccccttttccctaaatataaacccaactgccaatcgctttaaagtcttcatgtctgcagcaggagcaacccacgagtccaaaggtgaggcagctggcagagggctgttgttagtgggatccacccagcccagcccagctccaaggagacacacttcatgggactggatgtgggcaactcagcatttcttccttatgattcttaattgctcctgaaaacagtaaccccaaagttacgagccccagtgtgtactataacagtctcttaaagtactgggtttcagggctgggcacagtggctcacttgtgtaatcccagcactttgggaggccaaggcaggaggatcacttgaggtcaggagttccagaccagcctggccaacatagtgaaacaccatctctagtaaaaatactaaaattagccgggcatggtggcgcatgcctgtaatcccagctacttgggaggctgaggcaggagaattgcttgaaccaggaggcggaggttgtagtgagccgagattgcaccactgcactccagcctgggcaacagagcgagactccatcgcaaaaaaaaaaaaaaaaaaaaaaaagtattgggttttagaagacggcttgctggaagcaaacatctttgtccttccctctcccttgaagcaagcaaaggaaagccacacacaggttgtccttattacatagcaacattatccctaggccagaagtcgaagtaggctctggagccgaaaggcttaagttcagatcctagccctgccgctttccatctgtgtgaccttggacaagctatctaacctctctgggactgcctctatttccttatcagtaaaatgggattaatagtacccctgaggattattgagagattaaatgagctaataatatacgatgccaagtgcagagtgagcattcaacacaagctagatatgactgactcagtcacagggcttgccaggctggggtgtagagtcagcctcagaccaatggggaacataatgggacttatgccattatggtcaggccttgacaccttgcatttatgctgctcaaaagaggaggattttggctaggggccatggctcacgcatgtaatcccaatgctttgagagggcgaaactggaggattgcttgaggccagaagttggagaccagtctaggctacatagtaaagccccatctctccaaaaaattttaaaaattaggtagacacgtagcatgagcccatagtcctagctactggggaggctgaggtgggagaatctcttgagcccaagagtttgaggttacagtgaactgtgatggcaccactgcactccagcctcagcaacagagtgagaccctgtctctaaaaaaaaaaataagttaaaaaaagtgtagaattgtataatatccagaatatatgaagaatttctataacgcaacaacaaatagacaacccaatttaaaaatgggcaaaggtggctgggcatggtggctcacacctgtaatcccagcactttcggaagccaaggggggtagatcatttgagctcaagagttcaagaccagcctggccatcatggcaaaatcccatctctactaaaaatgcaaaagttggccgggcacagtggctcacacctgtaatcccagcactttgggaggccgaggcgggaggatcacctgaggtcgggagttcaagaccagcctggccaacatggtgaaactccatctctactaaaaatacaccaggagcagtggatcatgcctgtaatcccagcactttgggaagccaaggtgtgtggatcacctgagtttgggagttcgagaccagtctggccaacatagtgaaaccccatctctactaaaaatacaaaaattagccaggcatggtggcatgtgcctgtaatcccagctacttgggaggctgaggcaggagaatcgcttgaacccaggaggcggaggctgcagtgagtcgagattttgccattgcactccagcctgggtgacaacagtgaaactctgtctcaaaaaaaaataataaaaaaatttttttaaaaatacaaaaattagctgggtgtagtggcaggcccctgtaatcccagctacttgggaggctgaggtgagagaatcatgtgaacctaggaggtggaggttgcagtgagccaagatctcaccattgcactccagtctgggcaacagagtgagattctatctcaaaataaataaataaataaaattaaaaatgggcaaaggacttgaatagacatttctccaaagaagatacacagatggccaataagcatgtgaaaagatgtgtgtcatcactaatctttagggaaatgtaaatcaaaaccacagtgagattccacttcaaaccctctagggtggctataataaaatgtttttgaaaaggaaaataacaaatgttggcaatgatgtaaagaatggaatactcgtacttgctggtgggaatgtaaaatggtgcagccactgtaaagaacagtctggcagttcctcaaaaagttaaatacagaatgaccatatgactcagcaattctgctcctaggcatatgcctgaaagaattgaaaataaggactcaaaacagacacttgtacatcaatgttcattgcagtattattcacattagccaaaaggtagaaacgacccaagtgtttgctgacagatgaatgaataaacaaaatgtggtacatccatgcaatggaatattattcagccttaaaaagtgaggaaattccaatgctacatcatggataaaccttaaaaatattatgttaagtgaaagaagccagtcacaaaaggacaaatattgtgtgattccactagatgagatgtctgtaataggcaaattcatagagacagaaaaaggattagaggttaccagtggctggagagggaggaatggggagctatttcttatagatggagtttctgtttaggttgctgaaaaaattttggaaacagaggcgatgtttgcacaacattgtgaatgtaattactgccactaaagtatatgctttatggtggttaaaatggcaatttttatgttatgtatgttatcacaataaaaaaattttggggggggccaggccagtggctcacacctgtaatcccagcactttgggaggctgaggtgggtggatcacttgaggtcaggagttcgagaccagcctggccaacatggtgaaaccctgtctctactaaaaatacaaaaaaaaaaatagctggatctcatgacacccacctgaaatctcaggtactcgggaggctgaggcaggagaattgcttgaacccaggaggtggaggttgcagtgagccacgatcacaccattggaatccgtgcactccagactgggcaacagagcaagaccctgtctcaaaaaaaaaaaatggtgtggctgggcacagtggctcatgcctgtaattccagcactttgggaagccaatctgggtggatcatttgatgtaaggagttcgagaccagcctggccaacatggtgaaaccctgtctctactaaaaatacaaaaaaattagctggacgtggtggcacacacttgaaatcccagctactagggaggctgagggagaagaattacttgaaccgggaggcaaaggttgcagtgagccgagatggtaccactgcactccagcctgggaacaaagtgagactccatctcaaaaaaaaaaataaataaataaataacagaagatctggacagacacttcacagaggtaaaacatacaaaatggccaataaacaaatgaaaaggtactcaacgtcattaatcattatgaaatctaaaattgcacagtaccactacacactcactagaatggctaaaagtgtctgacaaccaaatgttggtgaggacgtgaagcaactcataccttgttagtggtcatgggaaatagttggaaaatggcttggtttggcagtttctaataaaattaaacacacattggccgggcacggtggctcacgcctgtaatcccagcactttggaaggccaaggcgggcagatcacctgagatcaggagttcaagaccagcctggccaacatggtgaaaccccatctctacaaaaatacaaaaattagccgggcatgatggcaggtgtttgtaatcccagctactcaggaggctggggtggaagaatcgcttgaacccaggaggcggaagttgcagtgagccgagatcgtgccattgcattccagcctgggcaacagcaagactccatctcaaaaacaaacaaacaaaacagacaaacaaacaaacaaaacaaaaaaaattaaacacacatttacgaaatgacccggaaattctacttctatgtgaatgcttagttttgaaatgtcttgttaattgtgatgactttcttctatccttagccaatgtctcaagtcacaatatacacatgaggtgcagtttattgtagatgaaggtggattcaaatcccctatttcaatgtcttcttgttagtactcattatttggttgtagttcttgtcagatattatgagatcgttatgtttttacctcattatgtggctgacccttgatataatagaaactgtaaaatgctatgagctggtgggataactgatgaaatgcaattttctggaggcagtttttttttaatttttttttttgagacaggctctcactctgtcgcccaggctggagtgcagtggcgcagtcttggctcactgcaacctctgcctcctgggttcaagcgattctcctgccttagcctccttagtagctgggattaacaggcatgcgccaccacacccggctaatttttgtatttttttggtagagactggggttttaccatgttggccaggctggtctcaaactcctgacctcaagtgatacaccggcctctgcctcccaaagtgttgggattacaggcgtgagccgctgcaccctgccaggggccgcatttttatgtgatcatccccgcgtggctttcctgtttgagactgaataattcactgttacatttccaacacttaccaggatacttagcacatagagttattggttgaatgaatatttacatgccagtgtctcctctgttaagactccttttaggctgagactctttttttttttttttaatttttgttttcaggcaatgtacagtaagccatgatgggcagaggcaggaaatacttagagaactggaaagaataaaggagccggtgttctcttcgcagggcccggtgagtctgtgagatgctcacacgccccctggtggtgtcagtaggaattcttcctggcgctcagcaatttggcaatcttgaagaaccggctgaaatcaagatgaaattatctgcccacaggtttaaaaatgtagcaatacatgatggggtaaattatgcctaacttagacaagtatagcgataaattttacatgtggcctgaggctgatagaactgtgacgcctgagagttacaggatttgagggctggagttacttccgattcatcttaactgttcttaatgcatcattgtttattttttctttttttaagagaaaaaaaagtcacccaggctggagtgcaatagcacgatcatggttcattgcagcctcaacgtcctggggtcaagcagtcctcctcagcctccccaagtgctgagcccacatgtgcatgcccctatgcccagatattttttgtattttttgtagggatgggatcttgctatgttgcccagggtggtctcgaactcctgggctccaggcaattgccttagcctctcaaagtgctgggattacagatgtgagccacctcacctggtcccgaatttttaattaaaaagtggtgcatgaacttgatataaatatttagacaacacaagaggaaacagaaggagaagtctttctccaggcccagaacctaagacccagtcccttagctccccttttgttttttggttttttgtttgtttgtttcttttcatataaaatagagacagggtcttgccatgtttcccaggctggtctcaaaccgccaggctcaagtgatccacctgccttagcctcccaaagtgctgggattacaggcatgacccaccacacccgggccattttccctttctaataggaaccattggtaccagattctcagaaatcttcccaggaggccgggcgcggtggctcacgcctgtaatcccagaactttgggaggccgaggcgggtggatcacctgaggtcaggagttcgagaccagcctggccaacatggcgaaatcccgtctctactaaaaatataaaaaaattagccgggcgtggtagtggacacctgtaatcccagctactcaggaagctgaggcaggagaattgcttgaacccaggagatggaggttgcagtgagccaacatggtcccactgcactccagcctgggtgagagtgagactccgtctcagaaaaaaaaaaaaaaaaatctttccagtagggcaattgactcatcctgttttgcccgggactttcccagttttggcactgaaagtctcacatcctgggaaacccctcactcccaggcaaacctggacacttggtcaccctactttccaaaggcatctatttatcatatacaaacatatacatatattagttgcattacttggcatcttgatgttgttttaattaaaaatattttttgggccaggtgcagtggctcacacctgtaatcccagcactttgggaggccaaggtgggcagctcacttgaggtcaggagttcaagaccagcctggccaacatggtgaaaccccgtctctactaaaaatacaaaagttagccaggtgcagtggcgcatgcctgtaattccagctactcgagaggctgaggtaggagaatctcttgaacccaggaggcagaggttgcagcgagctgagatcgtgccactgcactccagtctgggtgacagagcgagactccattttaaaaaaaagttttatatatatatatatatatgagatgattcaatatcagcttcatatttatttaacaaatatttatgtaattacctagcatgcaccaggcattattttggaagctgaagataacagcagtaaacaaaattgacaaaacctcctgacctcatggaattgatatactagtaattatatctattgcatttgtttaatcacccccaatcatcattttggttgcttccagtatcttcctagtgtgacaacgctgtcctggatatccgtgtgcatgtagctgtctcacatgcatgagggtatctatagcagcgctgtccaatagatcttcctgcaacgatggaaatgttctgtgtctgatcttttcaatatgtagccacgagtcacttgtggctattgagcactagacatatggctagtaagactggggaatagaattttatattttatttagttgttttgttttgttttgagacaaagtcttgctctgtcgcgcaggctggagtgcagtggtgcagtctcagctcactgcaagctccgcctcctggcttcacgccattctcctgcctcagcctcccgagtagctgggtctacaggcacccgccaccaggcccggctaatttttttgtattttttagtagagacagggtttcactgtgttagccaggatagtctcgatctcctgccctcatgatccatccacctcggccttccaaagtgctggggttacaggtgtgagccactgcgcctggccttttttttttttttttttttttttgagaaagggtctctgtcagtcaggctggaatgcagtggcacaatcatgtttcactgcagcctcgatctctagagcttaagcaatcctcccacttcagcctcctgagtagctgggaccacaagtgtgcaccaccacacgtagctagttttttttatgtagagatggcggggtcttgctatgttgattaagctggtttcaaactcctggcctcaagcgatcctcccatgttgacctcccaaagtgctgggattacaggtgtgagccactgcacctggcattaattttgtttttttttttttttttgagacagggtcttgctcttgcccagactggagtgcagtggcaagattacagctcaatgatgctttgaactcctgggctcaagcaaccctcctctgagtagctaagactacaggcacatgccactgcactcagctaattttatgtttgtttgtttgtagacagcagggtcttggtacgttgcccaggttgatcttgaactcctggcctcaagtgatcctcccacttatttttgtattttttgtagagatgggggagggagttgggggtggtggggtgtctcactgtgttacccaggatggtcttaaacccctggacaaaagtgatccacccccctcagcaacccaaagtgctgggattacaggcgtgagccaccatgcccagccctttcttaaatttaagcaaacaaattttaataatgatggctgactcctgtaatcccagcactttgggagaccaagacaggaggaccatttgagctcaagagttcgagaccagccttggcaacatggtgaaaccctgtctctacaaaaaatttaaaaattagctgggtgtggtgtgcacgcctatagtcccagctacttgggaggctggggtgggaggacggcttttgcccatgaggtggaggttgcagtgagccaagattttgccattgtcctccagcttgggcaacagagccagaccctgtctcaaaaaagaaaaaaaaaagcctaggcaacatagtgagaccccatcactacaaaaaatagaaaaaatagctaggtgtgatggcacatgcctgtagtctcacctactcaggaggctgaggcaggaggatcacttgagcctgggaagtcaaggctgcagtgagctgtgatcacatcactgcactccatcctgggtgacagagtgagactctgtctcaaaaaaaaaaaaaaaaaaaaaaaggaaagaaagaaagggagggaaggagggaaggaacaaaggaaggaacgaaggaaggaaggaagggaaggagggaggaaggaaggaaggaaggaaaaaaggaaggaaaaatttaggctgggcacaatggctcacgcctgtaatccctagcactttggaggccgaggtgggccgatcgtgaggtcaggagatcgagaccatcctggctaacatggtgaaaccccgtctctactaaaaatacaaaaaaaattagccgggcgtggtggtgggcgcctgtagtcccagctactcaggaggttgaggcaggagaatggcgtgaacccaggaggcggagcttgcagtgagccgagattgtgctactgcactccagcctgggcaacagagcgagactctgtctcaaaaaaaaaaaaaattaatttaaaagaaattttttttgagactgagtttcactcttgttgcccaggctggagtccagtggctcgttctccactcactgcaacctctgcctcctaggttcaagcgattctcctgcctcagcctcccaagtagctgggactacaggcatgcaccaccaggcccggttaatttttgtatttttagtagaaacagggtttcaccatgttggtcaggctggtcttgaactcctaacctcaggtgatccacccgcctcagcctcctcctgctgagattacaggcatgagccgccatacccagctttttttttttttttttttaaagaacatgattcaactgtattgctctctataagaaactcactttatagactggttctgaaaggatggaaaaagatatttcatgcaaatatctttttgcgtgaccaaagaagaggagggctggcaatactaatatcagaaaaattacttgtccaggccgggcacggtagctcacacctgtaatcctagcactttgggaggccgaggcgggtgcatcacctgaggtcaggagtttgagaccagcctaaaaaatatggtgaaatcctgtctctactaaaaatacaaaaattagccaggcgtggtcgtgcatgcctgtagtctcagctactcaggaggctgaaacaggagaatcacctgaacccaggagacagaggttgccgtgagctgagatcacaccactgcactccagcctggacgacagagcaagaccctgtctcaaaaaaagaaaaaagaaaaattacttgtccaaaaggttacaagagataaagaaggcattgtatgttaataaaaagttcaatacagcaagaagatataacaattataaacatttatatacctaataacagaccatcagaacatatgaagcaaaaattggtagaattgaaggaagaaatagacaattccacaataatagttagagacttcaatgccccactcccaagaataaatagaacaaacaggagacaagtaaggaaataaaggacttgagcgacacagtaagacaaccaggtctaacacatgtacagacactccccagcaacaacagcatccacattcttctcaggcacacatgggatatcctccaggatggaccatatgttaggccacagattaagcctcaagagattttaaaaggtagacatcagccagctgtggtggcttaggcctgtaatcccagcactttgggaggctgaggcaggaggattgctcgtgcccaggagtttgcaaccagcctgggcaacacagccagacttcatctctacaaaaagagacagaagaaaaggagaaagagagaaagataagaaggaaagaaagaagaaataaaagagatcataccaaatatcttctccaagcacaattggataaggctagaaatcaatatgggggggttaaaaaaaaaaagaaatcaatatcaaaggaaaactggaaaattcacaaatttgtggaaatttacacactcttaaaagaaccaatggatcaaagaagaaatcacaagggaaattagaaaatactcagaaacaggccaggctgggtggctcacacctgtaatcccagcattttgggaggccgaggttggcggatcacttgaggtcaggcgtttgagaccagcctggccaacattgtgaaaccctgtctctactaaaaatacaaaaattagccaggcgtggtggcaggcacctgtaatcccagctacttgggaggctgaggcaagggaattgcttgaatccaggagagggaggctgcagcgagcagagattgcaccaatgcactccagcctgggcgacagagtgagactccatctcaaaataaataaattaattaaataaatagagaaaatattgagaaacaaatgaaaacaaaaacacagcatgccaaaatttactggacacagtgaaagcagtgctcaggggaaattttatagctataagtgcttcaaaatcatagacagaaaattgccagggcctgggggtatggggatgggaggagggaagaggaagttattgtttaatggggacagaatttcagtttcagtttagcaagaagaccagaattttagagatagctgatggtgatgattgcacaatatgaaatgaatgtactttgttgttggggtttttttgttttgttttgttgttgttgttgttgttttttgagagggagtctcgcgctgtcgcccagactggagtgcagtggcaagatcttggctcactgcaagctccgcctcccaggttcaagccattctcctgcctcagcctcccgagtagctgggactacaggcgcccgccaccacgcccggctaattttttgtatttttagtagagacagggtttcaccgtgttagccaggttgtgtttttgtttttttttttttttttcagacggagtttcgttcttgttgcccaggctggagtttagtgactgttggagtgagtgagccatcttggcccacggcaaccttcgcctcccaggtcaaaggcttttcctgcctcagcgtcctgagtagctgaggctacaggcatgggcaaccacgcctggctaattttagtattgttagtagagacggggtttcaccatgttggccaggctgctctagtactcctaggctcaagcgatccgcccacctcggcctcccaaagtgctgagattacagaagtaagccaccttgcccagctcctttgtataaataaatgatattgattttcttcttgcagctcaggaattagatctgttattagaatttgcttaaatttaagaaatggctgggtactgtggctcaccgctgtaatcccagcacttcgggttgccgaggcaggcggattgcttgcgtccaagagttcgaggccagcctcggcaacacagtgagacccgcccgctctctgcaccactccttccccccctcctttccccgtctctacaaaaaatacaaaaataaataaattagtccggcatggtggtgactgcctgtggtccagctacgcaggaggctgaggtgggaggatcgcttgaaccccggtggtcgaggctgcagggagccatgatcgcgcgcgccactgaacaccagcctgggcgacaaagcaagaccttgtcccaaaatagattaaataaataaataaataaatttaaggaaaaagcaacttgattcgaagataaatagtgatagtgcaagtggtgccgaactaacgataaatttggaaaacagcggcccacgcgcagagcccgtcccaattctggcagcctttggatttggcttccacgttttccagatttccctcggcctctagctcgcttgcgtcagaggggccccgaggggcggcccacccgctagccccgcccccaaccgctcaccgccccgcgagccccgccccctcggcctcctcctcatcggccgccgttgcgcggcgcagagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtgtaagcggcgagcccgggcctggtcggggggcgcttaactgggaagggaatggagccgaggagcgagatgggtctcagggcgggagccagaggacccacccagaggggcctcccgggggtgtcccccggggctcctaagggccgtgaaagctgccggggcgctcttctgtcccgccccgctcactcctaagtatcccgttcctccgcccgtcttagcggggcagctgctgtctgttgagcgcctgcgatgttccaggcggcctgtcagtctccttcccacacgtgatagtggactcgtgccctgcggggactttaggctccgaagtccgcccttggagagccgacgtttcctttctagtccacgtcgctcttaaagcataggacatttggcgtcgtgtctagctgtggcgagttattctactgtgcactaaagtcgggagaaacgctgaactagactaaaacaacaaaagggaagtctttatggggatctggccagtttgcccttagctgtgaaaggggggtgggagttggcagatgggattgttagcattctacttcctgtgtaggaggtttgtttctttcagttttcaattaagccttcatgacctgaatattgtgaatagagtggttataatgattaaagcagatatgtgtataaatgtccagtccaggtcctgggctgtggccggggctttcgaggttggtcaggttggtcgatttgaatctaagccttgttccatcagacgcacaaacacatctgagttgaaagaattgtagacaacgtggccacctgcttcttgcctcagaattggcttttcctctggcccctctcagtgcttatcgtgggatcaccttggcattggtcttggcagcgggcacagtagccattgcactccatgggcattattctatagccaccctgcagcgggggagggttggcagccattttacaggtgaatacactgagggtccgaggctctcttagggaagggtcaccgtggcctagctcttcccagatgtactgcaggtgaccatttcagtagtccagagaacagtgcttggcacctagctggctgctttttgcttcatcatgttgctttaggctattcatctttgcaattcggttagcctggaactcttccccccacccctcccttttcaggcttcaagtcccaggttaagttacctcaccaaataccatccccatctaaattacttcccccacttcctttctgggacttaacttccttctccttgcttgcacagagcaaaacttaacagctcatgacggagtggccatatctttattgcccctgaactgactggaatggcctctgtgtgccagattttggggtagactctgccttcagagtttacagtccagtgaattgattataaataagtaccaatgactggtcaaactattgtaaaaattcattctgcaagtgggagggtatttcagggatcacacctctgtgcgtggggtgagtgatcaggtaatggttgaatgaactaataagtcgtgtaagcaagcttcacgagagttgaagtggtctttagctttttcattgaatccacttatccttggatcagatttacctgattttggattaattcagtggatttcatttactattaacatttgtaaaaaggctagacccagcacagtttgctaaatgaagagcagcaaaatttgagattttcttgagcttggtgaacctttcctaggtcagagggcaaggaacagtactggttttcaaaccttggctcttctctatcctcgctgtcctagccccacgtgatcagcagttcagtgcaaattgaagacagatggaagcacctctgtgagggcagcccaaatccccgctagctccaaccgactgctttctcctgtgcctagttgatttttaccttttgtgcttggaaagttgagcatcactgcaactctggctggggcattggatttttataaaactttatttcaagccctgaatgactgtgttctccaatctggtagaatacagctggagaaaggcagctggctgggtgcccaagagaagggaatttcttcctagcactgtgacggagtggagcatcggaaggctgaactagaaaagggcgcataagtaggaaatagaaactgaaaagccatcccaggatatttgagttgttcaaaagcaggctggtagtttgggcatgtctcaggcacaaagtgactcgtgaacatttgatagatgagctgtacctgtgtgtgtgcttgagaagagacttcgagctgcttttatctgcatgctgggtttggttccattatactcactggaccctctgtgctctcttgggttcctcttgtcatctgcctttgtgaacaggcaacacaagtgatggccacaggccctgcctgtctctactgcctcatcacttgcccttctcaccatggtctaccgcatcatggcccccaaggtctgcctgccttcctttccagtcctcatttgtgtgtggcgtgatcttggtgtggagctctgcacccagatctgtgtggctgtcctcgtaatcaggtcccacccagctcaaatgccaactcctcagaagcagctttctatgatcaccccagctggtctgtttgccatatttccttcatatttttaatcactatctgaaattaacatttgtgtttcccttcactctagaatgtaagcatcatgagaacagggctttgtcaagtttccattgccctcagtggtgaatgaatagactccctcaccttctctgtacctggtctggaattttgcctaacagcattaacatctaacttaatgacaaggaggaaggagattcttagaggcagtagaaaatggtcaagtgttcagaagatggcctttcattatatatctttagttctttctggcagatttggttatactgtcttaatctatcaggttgggtaagtagcccagggtgtcttctccattctttctgtatgccttatctcagcattaccatcttcctaggcttcaggataggaactcggtcatctttgacttcttttcttcaaagtcagtaagttatcaagtcctcctgattctacctttctgtgaatggtttcctgaattcatcccctgctgcttcagtcagaccctcacaatcctctgcctttagccatctgtttggtttctactttgtctcttctcaccttctcacctaaaaaaaaaaaaaactatagggctgggctcagtggctcacacctgtaatcccagcactttgggaggccaagacgggtggatcaccagaggtcaggagttcgagaccagcctggctaacgtggtgaaaccccgtctctactaaaaatataaaattagctgggtgtggtcatgcgcgcctgtaaccccagccacttgggagtctgaagcaggagaatcgcttggaccggggaggcagattttgcagtgagccgagattgcaccattgcacttcagcctgggcaacagagcacgactctgtctcaaaaaaaaaaaaaaaaaaaaaagtaacaaaactttgttttccatgatagcacagagatatttttctgaaacctggatttggccttgttttgttaataccttccttttaaactcctggctccctactgtttatgaggaaaagtctgttagatttttatttcctcagatacatatcaattttaagcctaaattaggcctagaatagtcttcccttcctctgctagctgacctctttttttaaaatgccagaggggtaatgggccaacatctgtaacaaggttcgagggtggcacatctcacacatgcacatgaacacccagtcctcaggttcatgaactacaaaaggatccatctgaacccttttttttttttttttgagacggagtctcgctctgtctcccaggctggatggagtgcagtggcgcgatcttggctcactgcaagctctgcgtcctgggttcatgccattctcctgcctaagcctcccgagtagctgggactacaggcacccgccaccactcccagctaatttttgtatttttagtagagacggggtttcactgtgttagccaggatggtctcgatctcctgaccttgtgatctgcccgcctcggcctcccaaagtgctgggattacaggcatgagccaccgcgcctggctgagctgaacccttttaaggctgatcagagatgccgtctctgcagtcttcccctccaccccccccttgagacagagtcgcactctgttgcccaggctggagtgtgcagccacctctgcctcccaggttcaagcaattctcctgcctcagcctcccgagtagctgggattacaggcatctgccaccatgcctggctaattttggtatttttagtagagacgggtttcaccatgttggtaaggctggtctcaaactcctgacctcgtgatctgcctgccttggcctcccaaagtgctgggattacgggcgtgagccaccgctcccagccttcactgcagtcttaccagccctttccttctcaggtcactagttgattttccctttatgttcctgtagcgctttgccttcacctgtaatgatagcagctcccgtttgtggtgcgttttgtaagggctggacactctgccaggggtctgctatacaaactgtatcctcccagcagtcctagaggtaggtactactctctccatttcacaaaggaaaaaatggagattcaagaaaccccactgagatccttcagtggcagggcctaaggcttgaagcctcaaccttaacaccttcactgtgtctatcacaggagtttgcatttgtttctgtagttgtgtgttctttgtagtccactcctatccctcattttttctggcttggaaggacttagtatttgaactgggaggagagagcaagttgttttttactccattatccattgatgtctttttaaaagttgatccatatttgtcgtcttgtctccatgatgcgtgacagaggttctctgtatgtcttgttctagcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatgtatgtggaagtgatgtggaagagtccatgtctttccatgataagttggggtaaaacgtacagctgccatgttgttgctgaagttagagcatgactaggtcactaacagcacgcgtgcatgccaattacctgtggtgatggctgggctggtttgttttcataaccttactggtttttgtttctttttttaagagttggttaagtatatattttaggtttgaaagccatagaaatcagttatcccagttttttcctataaaagatcaattatggccaggcgcggtggctcattcctgtaaccccagctctttgggagtccgaggcaagagcttgaggctaggagttaagagaccagcctggacaacatagtgagacctcatctttacaaaaaaataaaattagccgggtgtggtggtatgtacctgtaggcccagctactcaggaggcagaggccagaggatcacttgagcccaggagtttgggattacagtgatctatgatcatgccactgcactccagcctggctgacagcaagaccctgtctcttaaaaaaaagtcaatatgaaatcattggattgtaataacaatagctaacatttgaaatgcatccatgctcttgtataatcagagtcaagtatatttattttcatacctgttataactgctactggaaaggagaaatactgttgtcttattttccaagagatatacacagccttgttgattttagaatcattaaaatttttaaaattgcagaccatacaaaagtacacaataatgtaggcttgttcctcattccagagattacttcaaaattcgttcaacttaaggcctggcaaggtggttcatgcctgtaatcccaacactttgggaggccaaggtgggtggattgcttgagtccaggagttctagaccagcctggacaacatggtgaaacctcggctctactgaaaatacaaaaaactagcagggcatggtggtgtgtgcccgtagtctcaactgttcgggaggctgaggtgagaggatggcttgagcccaggaggcagaggttgcagtgagctgagttcgtgccactgcactccatcctgggtgatagagccggaccctgtctcaaggaaaaaaaaagtgatttaatttcgaaagctgcataacattttctgccctttgacaaacactgtagaatttttaccaaccaagttgtaggatttttgcaaaatgagattatactataatatatatatttcttcaacttttttcacttttttaaatgtacactcattcccaactttttttttccacttttcaggttttttttctcttacatattggacagccttgcatgtcagtttcattatttttaacacttcggtatggatgcccatagtaagaatataccttaccatctccttttcagcgtgatttagtattagggatgcatagtagggccatttcaatgctgaatagggctattttctgtgtcttaattgggggcttcactcttgaggctgggcatggtggctcatgcctatatcctatcatttggagaggccaaggcaagaggatcactgaccccaggagttcgaaatcagcctgggcaacatagtgggactctgtatataccaaaacaaaccaacaaacaaaaccagctgtgtgtagtggtgtatgcatgtagtcccagctccttgggaggctgaggtgggaagattgcttgagcccagaagtttgagagcagcctggggaatatagtggacccagtttctacaaaaaaaggaaaaaaaaattgaggattcctcagtttgtagcttaaagtcaagttcttgagctggaggtgagacaatcatcatggtaagctggagctcaaatattggagcatttttttccccctttgaagtttacttttagaaactcaaaatattgaaatacaattccctactgtcttctttttttttttttttttttttttttgagacggagtctcactctgttgcccaggctggagtacagtggcgtgatctcagctcactgcaggctccgcctgttgggttcacgccattctcctgcctcagcctcctgagtagctgggactacaggtgcccatcaccacgcccagctatatatatatacacacacacacacacacacacacatacatacacacagagatatatatatatatatatatatatatttgtatttttagtagagacagggtttcactgtgttagccaggatggtctcgatctcctgacctcgtgacccgcccgcctcagcctcccaaaatgctgggattataggcatgagccattgcacccggtctcttcatctttatttatgcatgcataatgtggtttttggttttgttttgttttttttctgagacagggtctggctttgttgcccgggctggagtgcaattgcgtggtctcagctcactgaaacctctgcctcccaggctcaaaccatcctcccacctcagcctctcaagtagctgggactacaggcatgtgtcaccacgcctgcctaatttttttgtattttcagtagagacgagttttgcatgttgcccatgctgatctcgaactcgggagcgtgaagtgatggcccacctcagcctccctcaggattacaggtgtgagccaccgtactccgcccatgatgggctttttgtttgttttactgtatgcttttgcttttctccattttcaagattagtgattgtactgttggcatgcctcagaaaatgtttttctttcctttatcttccctcttttcttcaattcttaaaactttctttctttttagaaaacctgtaatgaagcactattctctgggttttcttctctttctgttttactgttgcacagcctagattttatatgaaaggctgggccgggcgtggtagctcacgcctgtaaacccagcactttggcaggctgaggcaggcagatcacttgaggtcaggagttcgagaccagcctggctaacgtggtgaaactccatctctactaaaaatatgaaaattagctgggcctgatggcacacacctgtaatcccagctactcaggaggctgaggtgggagaatcacttgaacccgggaggcggaggttgcagtgagccgagatggtgccactgcacttcagtctgggcgacagagtgagtgagactctgtctcaaaaaaaaaaaaaaagagaatttagattttaaagattatttctcagaggctggtgatagatactttaaccagggttagtggcttttatatgttttacctaaaggatcacttttctctgctgcacataacagaatgtggtttttggcttgctgtaaggagactagtttaaatgctagtatagaaaacttttaaaaacatcctagatttggagcttgtctgtgagcagacagcctatcatgaataggagcaaacctctaggagagttattttagagtggaagtggatatcctgatttagtcgaataaaatagcagccttggtattaatgggaaatctgcaataatcagggtttcagccccatcagcgtagtcaggagtttggtgagattatttgccagggtggtgtaggtctagttttctttgtgcccttgtttgggactatattttgcctgttgcaaggtcctcactaacttatgggctctgattcttcctatttgagttcttcctgtccaagatccggtcccacgtggctacttgttccaaataccagaattacatcatggaaggtgtgaaggccaccattaaggatgcatctcttcagccaaggtaaatgactcagtctccccttaggtggaggtcatctcttgctattaatacaaagaggttgcatgcccaggggtttagttgtatgaattgttatgctggctaaagctgatacaagtattttgggaggagtatgcaagggaggactctggtgttcacttcagatgttagctgagctatattctttttttcttttttgagacagagtctcgctctgttgcccaggctggtgtgcagtggtgcaatctcagctcactgcaacctctgcctcccgggttcaagcgattctcctgcctcaacctcccaagtagctgggattacaggcacctgccaccatgcctggctaaattttgtattttttagtagagacagggtttgtcatgttggtcaggctggtcttgaactcctgatctcaggtgatccgcctgctttggcctcccaaagtgctgcgattacaggcgtaaaccaccacgcccggccagctgagctgttattttcacaacacttgacctgagtctgaagtgatcatcagcatccttatcattacacatttggtgagctttgctcctttttggagtgtactgtggttgaagtttaatggaaaggtactcacagaaaagttttcttttttcctgtgtttcaccttccaggaatgttccaaaccgttacacctttccttgtccttactgtcctgagaagaactttgatcaggaaggacttgtggaacactgcaaattattccatagcacggataccaaatctgtggtgagtaacctttttttttttttttaaacttcattaagggaaaggatcaagcttggagaaaaatgacgggattagtagaatgaactcctgtgtgcccttcacctagattgacagattgttaacattttaccatatttgcttaaccatgctctatagtacacattttttgctgaccacttgggaataagctacagataccatgaccatttttgcaccctgaatacttcgcaccctgatacaggagtgtgtatgtcttaagaacaagaatgttttcttggaaaattatatttttgtgtgtataattaatcatattcaagaaatttaacattgattcaatctaatgtctaatgtgaaattcatgttttaattttaacaattgtaatgtctttcatagcaatttccccctccccccaaggcagaggcagggatggtacacgagttctctgtcctctgggtgctacattaagtcatgtgatgtctgttgttggtaacattaacttggttcccttggtgtccaccaaatttctccatgaagctgccattttatttttggaagtagcttcttcatagttgtggggaaagaggatttaggtgaaattattaggaaaaggcttatcaatccttggacattttactcagatattacctactggcatgtgtagtctcctttaaaaaaaaaaaaatgtaggctgggcacggtggctcacacctgtaatcccagcactttgggaggccaaggcgggtggatcagttgaggtcaggagttcaagatcagcctggctaacatggtgaaaccccatctctactaaaaatacaaaaattagccaggcatggtggcgggcgcctttaatcccagctacttgggaggctgaggcatgagaattgcttgaacctgggaggcagaagttgcagtgaactgagatcctgccactgcactctagtctgggcagcagaacaaaactgcccccccccccccccccccccccaaaaaagtatttgttccatcttagcaatgtgttacctttctctctcaatgtgattgacagaccaggtctttttttatagttaggtgtatacttcctctatagttttaatttttccatttatctcatactgcttctcttgaactacatactctgttgtatgggcagccttcagctccattgctgtaaacagtggtgcagaaattttagaattttaatgagcttttgtgagagtactagggcagctatcaatgctcatcttaagatggaactggccattttgagaaacatatctttgcctgtatctatgtatgtttataagctaaagtcttagatacagattgacttggttaaatgttacttgcactcataattttgttggatactgttattgctgaacttttctggtatggcagcctaattttctgtctttttcccctcctttggcttctgaaatccctctgattatgttgtctatgttgaggccttctcttcagcctttggccctctgttctgtcttcctctccctctgcaagttttttttttttttttttttttttttttttttttttttttgaggcggagtttcgctctgtcgcccaggctggagtgcagtggcgcgatctcgactcactgcaagctccgcctcccgggttcacgccattctcctgcctcagcctcccgtgtagctgggactacaggtgcgcgccaccatgcccggctaatttttgtatttatggtagagacggggtttcaccgtgttagccaggatggtctcgatctcctgacctcgtgatccgcccgtctcggcctcccaaagtgctgggattacaggcgtgagccaccgcgcccggccctctgcaagttcttaactctgcgtttctcccttccctttagaagccatctccttttcagtctctagtcccaccctatgttctagctccccagctacagctgcctgcccaccttttccactcagtcttctaccattccagatttctctcttgtcaatcccctttatcactgtatcttccttgctgtggggtagggttccacctttaagtgggggcacttaggtcttctctctccctggcatgagttttctgcactcactggtctggttgtttacatgtgttgacagtaactgccgccttctggccttttctccgtgctgctgcctctcttctggagcacaatttttttttttttttttttaagacagagtctcactctgtcacccaggctggaggctggagtgcagtggcacaatcttggctcactgcaacctccacttccagggttcaagcgattctcatgcctcagcctctcaggtagctgggactacaggcgtgtgccaccatgcaaggctaatttttgtatttttagtagagaagatgtttcactatgttggccaggctggtctcaaactcctgacctcaggtgatctaccgctttggcctcccaaagtgctgggattacaagtgtgagccactgtgcccggcctggagcactctttcatgtcctctttgcctttccaaatacttcccaatcttcaaaaaccaaatcaaccttttgtgtgagggcttttcagcctgatccccctcttctgagcatttcctttgttaagatgcatgtaaggctgtgttttacttccctgggacattgctcatcggcttattttcttagttttcctcatgcttttggattgtcttgtgtgctggattggaaggccagtctaggccccccaccaggctgactcacttctctgcttacagtagggaatgagaaagggtggtatcatgatttgaactttacccagtcccacgtgtcatttgacttgagctggaaatttgcagtgtttttttgggctgctgatgtgcacaggaaggagttactggccctggacagtatgtcaggaaagctgtcctggaagaaaggaggccagacacaggccacagagggctggtgcaagcttggaaattgggtgcctaagaccttgcttttgtgttgaaaggtttgtccgatatgtgcctcgatgccctggggagaccccaactaccgcagcgccaacttcagagagcacatccagcgccggcaccggttttcttatgacacttttgtggtaagtctggagcctgggctctgatccctcccctgggggagtggcacggctacttcactcttctcaaaaggggaaatggggatccccagtgttgaactttgtcgctgttgtgatgggcttccagtctgtatactggatacagtgataaaggggattgacaagagagaaaagaagactgagtggaagaggcgggcaggcagctgtagctggggagctagatgggcttccagtctgtatactgtagctactatacagtttctattcatgggccaggcaggtggccagagtgacatttatttacttacatgagatggagtcttgctctgtcgcccaggctggaatgcagtggcgtgatctcagctcactgcagcctccacctcccgggttcaagtgattctcctgcctcagcctcctgagtagctgggactacaggcgcatgccaccatgccccattactttttgtactttcagtagagacaggctttcactatgttggccaggctggtctcgaactcctgacctcgtgatctgcccaccttggcctcccaaagtgttgggattacaggcgtgagccaccacgcccggcccagagtgacatttaagaagatgatctgggctgggcgcagtggctcacacctgtaatcccagcactttgggaggccgaggtgggcggatcctgaggtcgggggttcgagaccagcctagccaacatagtgaaatcccgtctttactaaaaatacaaaaaaattagccaggtgtggtggtgggcacctgtaatcctagctacttgggaggctgaggcaggagaatcgcttgaacctgggaggcaaggttgcagtgagccaatatcgtgccactgcactccagcctgggcaacagagcaagactgtctcaaaacaaacaagaagatgatctggtcagtctttgagacagagacagtgatacttgctctttccatctcctagccctgccaccaaatttttgtctacttttcttgtggtttatataatttctgcctgttatagaacttggtttggggacaggtgcggtgcagtggttcatacctacaatcctagcatttttgggaggctgaggcaggtggatcgcttgagctcaggagttcgagaccagcctgggcaacatgggaaaaccttgtctctgcaaaaaatacaaaaagtaaccaggtgtggtggctcctacctgtagtcctagctactttgagggagctgggacaggaggatctcttgagcccaagagacggaggttgcagcaagctgagatcatgccactgcactccagcctgggcaacagaatgagaccctgtctcaaaaaaaaaaaaaaaaaacaaaacacacacacacaacaacaatttggacttgggaggctcaatctcgcatgtccatggggaccataattgaaatgatcctcctgaggatttccaagccaggtggtgcctgactcgttatgctgccatcaccttgttttcctatggaaatgcaggcgcagcattgcctagcttctccaccccccatgcccaagcaggacaggaaaatttcacaggaggtttcacaggttttaattatcttcaaaaatacttcaggtcaaatagcatatatccactagccaaatacggctgtcaggtttatattctttccctagagctggatggtttcaaaggggcacactgttgtcttgccattatagtagtaggtaactttggccaactatatcaagtaaacctcttacttacatatatagatgtcaagttaggattttagagtggtattcggtcttgatggctgaatttcagtatctaagaaagaaagctctctgctaaattgtcataaagaatattttttctcagtctgacagtgtctgaaactcagacttcagaataactgccctttttgttaatgtgacacagatgaattacattcatctgtgtcacattaacaaaaatgactcattaaaaatgagtcctaaaaatgactcattaaagagggctagttgcgctatagtttctgctgtattgtatggctctaaaaatctgattctgtactgtgcactgattccacctctcagaaacaactcttcagctcagtgcatctgcgtgctctgttccgacagacttacaaatgttctgagcacttggtctgtgccagcctccattcgtgtgctgtctgggtttctcaatctccatttaagggaggcatccttaacttcatttaagaatcaggcagcagactgggtgcagtggctcatgcctgtaatctcagcactttgggaggccaaggcgggtggatcacgaggtcaagagattgagaccatcctggccaacatggtgaaaccctgtctctactaaaaacataaaaattagctgggcatggtggcgcacgcctgttagtcccagctactcgggaggctgaggcaggagaatcacttgaacctgggaggcagaggttgcagtgagccaagactgtgccactgcactccagcctggcaacagagcgagactccatcaaataaaaaaaaagagaaggcagcagagacagattaattttcccaaagttacatacctagcatcacaaacagttgcactggggatccggtccctggcaacctgctccggatccagttgctaggctgtcctgcttctactgaaagccagtctttgcatctagaaacagttgctgaggctgcatgtctctttttgcccttaggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataacttaatctaagtggtaagctatggttcttgttttcattcaacacatttgccatagcatgggcttggggagtctccagaagatggttaccctttctagaagggaagttcttgcttgttgctgagtcctgtttggcgtcaaatctcagctgatgccaccagctgggcctcatggtgcctgtcctctggaaaaagaacacttgttacagttgggaggctctgggaggtgagaagtggcagcgctccatatagcaaggctttagacatgcggcttctgctacgtgcgggtaacagcagcagtgctgagggcttgtagtaaaggggctccgcagggtcaagtttcaggtcctggatgtgtttaagttcatactctgctgttagctgtggggcatctagcgaatattttctgaacctgtctcctatgaagtggggataattttatctgcctcttaaggatgctaggatccaaggagcaaagtacacagagctctccctgcacagcgctgcatcgtgggtgctcactgtagtgtttggctgcttgagcttcattccaatcccatagaaacgttattttttaattttttttagtaagagatagggtctcactatgttgcccaggctgggcttgaacccctgggctcaggtggtccaccttggccttccaaagtgctgggattacaggtgtcagtccgagcctggcctggaacctatttgttttgttttgcttttttgagtcagggttccgctctttttgcccaggctggagtgcagtggcgcaatctcggctcactgcaacctctgcctcccaggttcaagtgattttcctgccccagcctcccgagtagctgggattacaggcgcccaccaccatacccggctaattttgtatttttagtagaggtggtgtttcatcatgttggtcaggctggtctcctgacctcacgtgatccgactgcctcggcctcccaaagtgctggttttacaggtatgagccactgcacccggccctggaacctcaaatttaatacagccgagacagttcagcatctccaatcttcacccatgccttcttttgtattattccatcttgcagtggtaactacccaagccagaaacctgggaggcctcttcctccctcacatccgtgcaggccacctctgtctaagtatcagctgagtcctggacgccagttacctcagaatattgcaatttgtgcctgtttctttgaggtctgacatcctctggaaatgaagtcccgtgtcacgccaaaacaggtcgagaaaatgacactggaactgagacctgaatgaaatggggagaagcccagtgaccatgttggggaagaggattccttgcagagggaaccaagttcagaggccttaaggtgggagcccatgggttacacttgaggccctgcagcaaggaggcggctggtaagcccatggtggagtgaatgagggagagaatgaggcagcacggggcagtctggaaggcagaccagaggggctgtgtacacatggtcaggccttgggcttttctcagtgagcattcttgggttctaagtgaggtgatccagcttagattcctaaaggatgcttctggctgtgtttggagaagggactgtagtagggaaacaggaagcagagaccagggaggcggctgcaggaatccaggcagctggtgatgggggcttggaactgtgtggtgatggtggtggtgggattttgaggtagtctgacgtggtcaggtatgttttctgtgtttttttgagacaaggtctcaccccgtcacccaggctggagtgcagtggcacaatcttggctcactgcaacctctgcctcctgggctcaagcagtcatctcacctcagtctcccgagtagctgggactacaggcgtagccaccacgcccaggtaatttttgtatttttggtagaaacgaggttttaccatgttgcctaggctggtctcgaacccctgggctcaagcgatcctcccgccttggcctctcaagtacctgggaggccgaggcaggagttcaagaccagcctgaccaacatggagaaaccccatctctactaaaaatacaaaattagccaggcgtggtggtgcatgcctgtaatcccagcgactctggaggctgaggcaggagaatcccttgaacccgggaggcggaggttgcggtgagccaagattgcgccattgcagtccagcctggacaacaagagtgaaactccatctctaaataaataaaggcattctaagttctgcatggctcaaactgaactcatccaccaccttcctaccaccccacactgtgtgcttggcttctctttcccggcagacgtaaccaccatccttctaattgctcaagaattaacccacacctcatctttaactccttgtccacctccatgccccatattaccaaatcaagttaattttatttatttttatttttttgagacagattcttgctctcttgcctcaagttaattttagctcttaaataacacatttgggccagatgtgggggcccacacctgtaatcccagcacttgggaggcctaggcgggcagatcacttgaggtcaggagttcgagaccagccttgccaacatgatgaaaccctgtctctactaaaaatacaaaaattagctgggcatggtaacgggtgcctgtagtcccagctactcagtaggctgaggcaggagaatcatacgaaccctggaggcaggggttgcaacgagccgcagttacgccgctgcactccagcctgggcgacagagtgagacaccgtctcaaaaaaataacaaaaaaataatgttggcaaagcctgagtcctgtcctctcgctctccccactggacagcatgaccttcaccactcgctccaccttctccactaactacccggtccctgggttctgtccaggcgcccagctatggcgcccggccggtcagcagtatggttagcgtctatgcaggtgcccggggctctggttcccggatctccgagtcccactccaccagcttctggggcggcatggggtccggggacctggccggggggatggctggggatctggcaggaatgggaggcatccagaacgagaaggagaccatgcaaagcctgaacgaccatctggcctcctacctggacagaatgaggagcctggagaccaagaactggaagccggagagcaaaatccgggagcacctggagaagaagggaccccaggtcagagactggagccatcacttcaaaaccatcgaggacctgagggctcagatcttcacaaatactgtggacaatgcctgcattgttctgcagatcaacaatgcctgtcttgctgctgatgactttacagtcaagtaggagacagagctggccatgcgccagtctgtggagagcgacatccatgggctctgcaaggtcactgatgacaccaatgtcacttggctgcagctggagacagagatcgaggctctctaggaggagctgctcttcatgaagaagaaccacaaagaggaagtaaaaggcctataagcccagattgccagctctgggttgactgtggaggtagatgcccccaaatctcaggacgtcagcaagatcatgacagacatgcaggcccaatatgacaagctggctcagaagaacagagaggagctggacatgtactgatctcagtagattgaggagaacactacagaagtcaccacgcagtccaccgaggttggaactgctgagatgactcacagaactgagacatgcagtccagtccttggagatcgacctggactccatgagaaatctgaaggccagcttggagaacagcctgagggaggtggaggcccgctatttcctgcagatggaacagctcagtgggatactgctgtacctggagtcagagctggcacagacccaggcagagggacagtgccaggcccaggagtaggaagccctgctgaacataaggtcaagctggaggctgagatcaccacctactgccgcctgctggaagacagcgaggacttcaatcttggtgatgccctggacagccgcaactccatgcaaaccatccaaaagaccaccacccgccagacagtggatggcaaagtggtgtctgagaccaacgacaccaaagttctgagacattaagccagcagaagcagggtaccctttgggaaacaggaggccaataaaaagttcagaggtaaaaaaacaaaacaaaacccacatttgtgttttcttatcatcccactggcacctacatttttttttttttttcgagatggagtcttgctctttcgcccaggccagactgcagtggcgctatctcagctcactgcaagctctgcctcccgggtccacgccattcttctgcctctgcctcccgagtagctgggactacaggcgcccgccaccacgcccggctaattttttgtatttttagtagagacggggtttcaccgtgttagccaagatggtcttgatctcctgacctcgtgatccgcccgcctcagcctcccaaagtgctgggattacaggcgtgagccaccgcgcccggccggcacctacatcttaaaagccactgtgatctcatctgaaatactgccacaactttccatttgacctctctccattgctgcccagccaacatccagtcctccgccaccaagcagccagaaggatcttccaaaaatccaaatgtgaccgaccatatcctttaaaacccttcagtggcttcagttaccctcaaagccccacacctcacagggtcctcaagaccctgtgacctctgccaactgcctacgtctccaacgtcggcttcttgtgaaaggtcagaatcaaaacgtagtcaccagtattaaacaaaacaaccctgacaccaagagcgaaactccgtctcaaaaaaacccccaaaaaaccctgacacagagtcagggaaggctatgcagtgaatgcttgcatgcctgataacaaaaaccatcacaaaagactctgcaaaaacacaaccttgcacaaaggccatcgcaatgcaactttttttttttttttttcgagacagtttcactcttattgcccaggctggagcacaatggcatgatcttggctcactgcaacctctgcctcccaggttcaagcgattatcctgccttagcctccctagtagctgagattacaggcgcgcagcaccatgcccgggtaatttttgtgtttttagttgagacagggtttcactatgttggccaggctggtcttgaactcctgacctcaggtgatcttcccgcctcagcctcctaaagtgctgggattacaggcatgagccactgcacccggcccagaatgcaactttatacaaaaaatacttctacaaggacatctgcccagcaactgcctgtacaacctcacgctgccttcacccttgttaatgatctttgtagccaaagataaattttcaaaaaaattatgtgcccagcgcagtggctcccgcctatcatcccaacattttgggaggcccgaggcaagaggatcgcttgaggccagtagttagagaccagcctggccaacatagtgagatctcgtctttgaaaaaaaaattatttttaattatgtaggctgggcacggtggctcatgcctatagtcccagcactttgggaggcagagatagaaggattacttgagcccaggagttcaggaccaaagccagactaacctcaaaaaaaaaaaaaaaattagctgggtgtggtggcacccgcctctggtcccagctattcaggaggctgaggcaggaggattgcttgagcccaggaggtcaaggctgcaataagccaagattgtaccactgcactccaacctggatgacacaacgggaccctatctcaaagataaaaaaaaataacaatttttaaaaagtaaccctcattttgtcctttaaacaactttgtctgttccatagcttggttgatacttgatcatcaaaaagaaccaacctttgtctatccaggtgtggtggcacgtgcctgcagtcccagctactcaggaggctgaggcgagaagatcacttgagcccaggagttcaaggcttcacggagctatgattgtgccaccgcactgcagcctgggcgacagggggaacttgtttcaaaaaacaaaacaaaagcttttgtcttcctttacctccctgaatatgcagtagtttgctatgacaaatgtattcccatggtaatgctctattcccgactaaatatctttttcttctagggagcctctctctgttatttaggttgacatatatggtgtcagaaatgggacctgaaaaagattagtactggaagaaatcggtgattcttggaactggtgtacagtattcactagagccctttgagcgcactgcttccatggctccccttttctgccctggtgagtcttctctcaggttgagcctccctctttttggtagaggcttttttgttttgttttgttttagagacagggtctcactctatcccctagactggaatataatggcacaatcatagctcactgcagccttgaactcctgggctcaagtgatcctcctgcctcagcctcccaagtagctgggactatagacgtgccaccacacccacctaatttttttttttttttttttttttgtagaagcagggacttgctatgttgcccaagctggtcttgaactcctggcctcaagtgatccgccctcctcaggctcccaaagtgctgggattacaggcgtgagccacatgcctggccaaaagtgtgcgctttttttttttttttttttttttgacggaatctcagtctttctcccaggctggagtgcagtggtgcagtctctgctcactgcaagctctgtctcccgggttcacgccattctcctgcctcagcctcccgagtaggtgggactacaggtgcccgccaccatgcctggctaatttttttgtatttttagtagagacggggtttcactgtgttagccaagatggtctcaatctcctgacctcgtgatccgcccacctcggcctcccaaagtgctggaattacaggcgtgagccaccacacctggccaaaaaatgtgttctttattgaaaataaaagaataattttgtttaatttggagattatgtaagttttttgaaaatatgggctggctgggcgcggtggctcacgcctgtaatcccagcactttgggaggctgaggcgggcagatcacctgaggtcaggagtttgagaccagcctggccagcatgatgaaaccccatctttactaaaaatacaaaaattagctgggcgtggtggcacgtgcctatagtcccagctacatggaaagctgaggcaggagaatcacttgaacctaggaggaggagcttgcagtgagccgagattgcgctaatgcactccagcctgggcgacagagcgagactctgtctcaaaaacagaaaagaaaaaaaaaagaaaatatggacttatgaaggaaatagaaacaagatagtaagaaaaccaataactgagagacagagatatgaaggaagttatggttatgaagatatattttttaaaaggaaagttgaaaagaataattttgtatgggaaagagtctctggtaaatttatgttctaaagtaaaatgattggtatttaatgaagaggaagtataagacagggcacagagtcaaagcacatcatcaatggtctgaataagtcatgatggtgttcatgaagggagaacttatgaaaggcattttgtgtgtcatcaagttggctataattagaagggaattatttctacgtctttctaaagatagattaaaaatacactgatagaaaactaaaaaattcatatcccctatgttaaaacaactaggttttcttttttcttttcttttttttttttgagacggagtctcgctccgtcgcccaggctggagtgcagtggcacgatctcagctcactgcaagctccacctcccaggttcacgccattctcctgcttcagcctcccgagtagctgggactacaggtgcccaccaccacgcccggctaattttttctattttttagtagagaccgggtttcactgtgttagccaggatggtctcaatctcctgacctcgtgatccgcctgcctcggcctcccaaagtgctgggattacaggcgtgagcccctgcccctggcccaggttttcttcttctttttttttttttttttctctgagacagagtctcgctctgtcacccaggctggggtgcagtgtcgcgatctcggctcactgcaacctccgcctcccaggttcaagcaattctccgtgtctcagcctcccgagtagcttggactacaggcacactgccacgcccacctaatttttgttattgttgttgttgagacagagtcttgctgtgtcgcccaggctagagtgcagttgcgtgatctcggctcactgcaacctctgcctccctggttcaagccattctcctgcctcagcctcctgagtagctgggattacaggcgcacaccaccatgatttttagtagagacagggtttcaccatgttggtcaggctagtctcgaactcctgacctcaggtgatctgcccccctcggcctcccaaagggctgggattacaggcatgagccaccttgcctggcaggttttctttttcttttaaatttgtatttattttttgttgtagagatgggaatctcactatgttacccaggttggtctggaactccgggcctcaagcagtcctcatgtctcagcctcccaaagtgctgggattaacaggcctgagtcaccacacccaagccaattaagtctgtttgaactggaatgaacttagggattttgcagttgggccagtggagggcctctaatgatgtatttctcagcttgtagagatattaaatgattaggtttatctggtaagttgtacaggaagcattgtcaagtgataagtgattctattactagatctttcagttacatttatgggtctgttattgatataaatatttcaaaaattatataaattcatagatacctaatattatctgtcataattttggttatgttaatctcttctaaagttaaatttatctggatattttattaatgtgagtttgtttttttttttgagatggagtctcactctgttgcccaggctggagtgcagtggcacgatctcggctcactgcaagctccacctcccaggttcacaccattctcctgcctcagcctccagagtagctaggactacaggcgcccgccaccacgccaagctaattttttgtattttgtttagtagagacagggtttcaccgtgttagccaggatggtctcgatctcctgacctcatgctacacccgcctcggcctcccaaagtgctgggattacaggcgtgagccaccgcgcccggccgtgaattttttttttttttaatttgagacagagtctcacactattgcctgggctggagtgcaatggcacagtctcagctcactgcaacctccgcctcccgggttcaagcgattttcctgcctcaacctcctgagtagctgggattataggcacccacgaccagcctggcttattttttgtattttttagtagagacagggtttccctatgttggccaggctggtctcgaactcctgaccttgtgatccacccaccttggcctcccaaagtgctgggattacaggcgtgagccaccgcgcccggccaattaatgtgaatattctaaagattatattcaatttataaaagtctgatgtttcttgtgtgactgtgtcagtcatgattctggttgttatcttaaaatactgtatatggccaggtgcagtggctcatacctgtaattccagcactttgggaggtggaggcaggagggatagcttgaggccaggagttctaaaccagcctgggcaatatagcgagactccacctctataaaaaattagccaggcatggtgatgcacccctgtggtcccaactactcaggaggctgaggaccctttctcttttagagagcctctctctctgttatttaggttgatattttcacatctacttctgcactctttttactccaaccacacgggccttctttttttttttttttttctttttttgagacagagtttcgctcttgttgcccaggctggagtgcaatggcgcaacccaacctgcttcaccgcaacgtctgtctcccaggttcaagcaattctcctccctcaacctcccgagtagctgggattacaggcatgcgccaccatgcccagctaattttgtatttttagtagagacagggtttctcaggctggtcagactggtctcgacatcctgacctcaggtgatccgcctgcctcggcctcccaaagtgctgggattacaggggtgagccaccgcgcccagccccatacaagtcttctttctgcacctcaagtgggtcatgttccccacctcaaggagtacacacgttccctttcctctggaatatttggtgccccaggcccatctttgccttttttaaaaattttttttttcagatagggtcttgcttcattgcccaggctggagtgcagtggcaccatcacagctcactgcagcctctacctcctgggctcaagggatctgccttgtcctcccaaagtactgggattataggcacaagccaccgcacctggccaaatacttttttagtataaatattttccaaatattgcatacgagtgtgaataatttgcacaagcaggccaggaagtaaatgccaggaatgttcatcctaaaaattatttgctgtttatctgaaattcacagttaactgagcattctgtatttttattggttaactctagcaaccctactcgacatgtttgcagaacaaatgttctgaacatctgctctgtgccaggcaactcacaccttctcattaagttatttgtccaattacaagaaattaagctcttgagggtaatggctgtgtctgtcttatgcaccaccggcctccatgcctgaccccgggtagactcaataaatgttcctagaattgaaatagaactaaaaaagaatttccagtggttactttctttccatggcagcttgtccaccctggaaggagtctggtgcagcggtaaggagagcctgaagggggcagtgtcaccccctggctctggcttcctgttgtccatcaccatggggaggcagggcctcaaatcggaagcacatgaaactggaacttggaaggcagaggaggcaagacaggtgggcaggcaagatggctactgccaggtggggtctgacctgctcaggtcctcaatgtggtccctttattcctcccttgttactccttggctttctgcggtgtcttctgctgaatgtctcatgcagggctcagctgggccctatgaatacaagaatagcaacaatgatggtaattattttcattcctggttcctgacaataattttgatttaatcctccccactttaggccctgaaaggtgatcaaaaccaggcattcagtttctccaggaaagtggatctcatggaattatcttagccagcattggtggagggatactaaatagcattacctttacagatgagggaatggagcccagagaagctgaggtcatttgcccaggacaagaagtgagacttgatattccagtgcagaggtgcgattagatgtatagtcccccacacagactgtgtggagtctcctattcccagcatccacactcactagctgatctaggggtcagctgatcactcactagcttgaccttggacaagttattctaatctgtgcttatctgtaaatggggctaataagtgtctttctcgtagagttgtgggaatttagtgaaataatccagagcatggcacaatgtaagtgcttaatcaatgcgagctaccaatgtcactattgtttgtcccctccattcctaagccctcccagggcccaaccccaccccagcaggctagctgttaatgtttgatgactaaacattactatgaagtgaagtgattccctaatttggcctgaagagatgaattacctggaaggcactcgctacagaaatctattctcaggtccctgccttagagattctaattggtggggcctgggaatctgtatctttaaaaaagcctcgggtgaaatctatctgtaggctgatttcgaaagtccttatgtaatgtaaaaccggaaagacagggcgcggtggatcatgcctgtaatcccagcactttgagaggctaaggcagttggatcacaaggtcaagagatcgaggccatcctggccaacatggtgaaacctcatctctattaaaaatacaaaaattagctgggcgtggtgacatgcttctgtagtcccagctactctggaggctgaggcaggagtaatcgcttgaacccaggaggtggagggtgcagtgagccaagatcatgccactgcactccagcctggctgacagagcgagactcgtctcaaaaaaaaaaaaaaaaaaaaaagaccggatagtgctacagcaaacacattgtgacaggggtggggtggaggcgcccggtgattagaatcggtggactagctcagcccttacaggttacaagaatttaaagtgatgattaccttttctgattataaaaatcatctagggctgggcgtggtggcttacacctgtaatcccagcactttgggatgcctaggtgggaagatcacctaagcccaggagttcgagaccagcctgggcaacatggtgaaaccccgtctctacaaaaaaatgtaaaaaataagccagacttggtggcacacacttgtaatcccagctaggaggctgaggtgggaggatctcttgagctgaggaggtggagggttgcagtgagccaagatcccgtcactgcaccccaggctgggcaacagagtgatacactgtctcaaaaaacaaaacaaaaaactagtctatttacatggtctcagatgatcacatacattatttagaaagggaaaattagtgactttgtagaatcactgctagtggcgaaacctagctaatcccatcttaactaagcgatgaaagttactatcacagataatggaacagaccatagatgactcaatgggatgcactgaagaggcagcaccacttctgtggttccaggcaggaaaacatacaagctcagtgtcatcataaggaagcaccaggcaaatgcaattgagggacagtccacaaatcttccaaaatgtcaacatcagaaactacagatgcctgacaacactgcaatgctgcatgatcctgaattgaatctttgagggtgtgggggttgctataaaggatgttattgggccagttgaatatggcctatggaataaggaataagtaattgatccatgttagatttcctgattttgataatgatatcagagttacataatagaatgtccttgttcttagcagacatacagtaaagagtataggggtaaaggggcatgacatctctaatccactctgatatggtttagaaaataatagtgtacgtgcatataaaaatatatatacacacacacatgaacacgcaggtaaggtataataaagtaaatatgcaaaaatgcacagtgttaaaaattataatgccccttgttaaaaaaaaaataaccgggaagaaaaatataaagaagaaaatggaagccactcctactcctacccccccgcccccctttccctccctgcctcccctatcccccgtccctgagacaaccaggatgactatttcaatcagcagtgaaactcttacatgtctttgggtcgttttatatatatgtatatatgtgcatatatatatatgtgtgtatatgtgtgtgtgtgtgtgtgtgtgtgtgtatatatatatatatatatatatttttttttttttgagacagagtcttgctctgtcacccaggctggagttcaatggcacgatctcggctcactgtaacctccgcctcccagggtcagggtcacagggtcaagtgattctcctgtctcagcctcccaagtagctgggattacaggcacatgccgccatgccaggctgattttttttgtattttagtagagacagggttttaccatgttgccctggctggtctcgactcctgagctcaggcaatccacccgccttggcctcccaaagtgctaggattacaggcgtgagccacctcacccggcctggggcattatatttttgattgaaactgaaatgcgtgaatgctttactttccatctataagttgtgtttttcactctgatgtatgtcaatatctttccatgttaatgtgctggtgtttcaaatggctgcatgatgctgcctggtagggacagagcatactttgtttatcaataggtgtttaggttgtttccagcttgactcctacagacagtactagagtgagcatccttaaaaatacatcttccccaacttgtcagattattttgtttgcagagctgctgggtcaaaaggagagagtctctgagaagggacagaggctgacagtcggggagactgcaagagaaagactgagagagagagagagatctatagaagcagagagagggggaaagaaacagatggagagagacagaggctgggtgcggtggctcacgcctgtaatcccagcactttgggaggctgaggtgggcagatcacttgagttctagagtttgaaaccagcctggccaacatggcgaaaccctgtctccgctaaaaatacaaaaattagccaggcttggtggcacacgactgtagtcccagctactcagaaggctgaggcacaagaatcgcttgagcctgggaggcaaaggttgcagtcagccgaaattgcaccactgcactctagcctggccaactgagtgagactctgtctcaaaaaaaaaaaaaaaaaaaaagagatggagagagacgagaaagagcaaggttgagggttgagagagagcgagattgggagggtgacagggagttgctttcgatggagactgagaaggaattcctctgacccatggggtctctatggccacaggaatccagtcaggaaagtgactaagtgacttttaggaacacacccaacagatacaatcgtagatgaggtcagagtcctttgtgcaaggatcttcatggggctattgttcctggaaagcaaaaaatgggaaacgacctaattgcccatcaacaggggactggttatagattgtgctggaaatgctgatagaagcccatctccaagtagggttggcagataatagcaaataaaaccacagaaggcccagttaaatttgaatttaaaatgaagcatatgtctcatgcagccttccttatacactaaaaacctatttgttgtttatctaaaattcacatgtatattttatctggaaactattaatctccaagataagtgagaaaagccaggtgaggtcaggagaggggttgctcttggtgagggtgtgtgtgtatttgggctgctgaggtggccgtcagtttcagctcctgtcctgggtgtggttacacttgaagggaagggactgatccgggctcacataagcagaggttgaagggctaggctccactccagggtccgtgctctgtagtgatttgtatatatgtgttaaaagtgttttcaataaaagtatgacagaccacaattttctaaactccatttaaacatttctgatttaaaaaaataatactagcagtctcagctgggtgtggtggctcacaccagtcatcccagcactttgggaggccaacgcgggtggatcacgaggtcaggagttcaagaccagcctggccaagatggtgaaaccctgtctctactaaaaatacaaaaattaaccggacacagtggcaggcgtctgtaatcccagctacttgggaggctgaggcaggagaatcacttgaacctgggcggcagaggttgcagtgagccaagatcacatcattgcactccagtctggacgacagagtgagacttcgtctcaccaaaaaataaaataaaataaaataaaacaacaacaacaacaaactggcagtctcagaaactctaaggggcctccctgaacattttcatttcctggaacactcatctgcccctgggcttttttatcactgtcgcctggaatgccctcttaccccaccccacccccaaccccctcattcacctgctcatgcctgtgacctcaacctggagtcagcctggttctcactcctctgagtcaccttaggtgcctcggagttgcaagaacactgaaccagctgttaccccctttcccccctcgcctgtgagctacgcaggtgcaggaaccttgtctgtgtgcagctggtttatcacagtatcctagcccattcagccaggtacatgccacagcttactcactacaccttggacatgttagtaaagcgtctctctgagcctcagtttcctcatttgtaaaatggagctgatcatcttgcctaccactcaaggccaatgtgacagagatgggaaagggaaatggcattagcatcactaaggtaatatttcaactgaggccagcactgggaagatctggggaagggtattccaggcatccttgggaaaaaaaaggagactgcgggcagccgtgagagccaggtcactgcggtctgtgtggcagccaagtccctaagaaaaaaaaaaaaaaaggagtttgctctcattttccccttcttgccaatacctctcacctgctgtgggtcaaaggtgcacaaagctctacaggtatgcaaggtaggtgcaggtaggggagccaggagaccctggggctttcctggaggcaggttcagccttctgcgaggaagatggagagagcagggctctatcagtgcagtctgatgggtaaggggcctaggcccgagacagtctgcgagcaagtgtgcgtgtatgagcccctgagcccgcccaccctgcaagtgcctggagactcactggggaaggtgtgttttgcactatagagacatcccaatggcctatctcagtccttgagctccagaggcatccatctcccaggcgtagagctgggctctggcaggtgtgtgatcggactcgggcaggtgcagagaggcctggcttcagggcccagctcagcccccacatgtccaccctcgaaggcttccacagctttctgttttccaaggtgaccacgtcatcccactttgtccaggattgccccagaacaccctcactgccaggcaaactggactggttggtcaccagacatattactccattggacagaggaagaagagtctcagaggctgtcagtatctgcctcattttttggggctgggtttttttcatgaaaagtttatttgaaatggtgacacatatatctgaaataaaacattcatattctttaaaaaaggcttctaggccgggcacagtggctcacgcctgtaatcccatcactttcagaggctgaggcaggtggatcacctgaggtcaagagttcaagaccagcctggccaacatggtgaaacctcatatctactaaaaattaaaaaaaaaaaaaaattagctgggtgtgatggtgcacacttgtagttccagctacttggggaggctgaggtaggagaatcgcttgaacccaggaggcagaggttgcagtgagccaagatcgcaccactgcagtccagcctgggtgacagagagagactccacgtcaaaaacaaaaaacaaaaaggctcctagaggccgggcgcagtggctcacacctgtaatcccagcattgtgggaggccaaggcaggtggatcacctgaggtcaggagttcgagaccaccctggccaacatggcaaaaacccgtttcttaaaaaaatacaaaaattagttgggcacggtggcaggtttctgtaatcccagctcctcaggagactgaggcaggagaatcacttgaacccggggaggtggaagttgcagtgagccgagatcgagccactgtactccagcctgggcaacagagccagactgcatctccaaaaaaaaaaaaaaatgcttgtagaaaaagaagacatctttctaccccaccctgctcctgtcctctgaagcagtcagcttcttggacctctcagagacagatattatttacttctgcacaaaaggcagcctattacatatgctgttcatctgatatatttttttaagagatgaagtcctgtgcttgcttcagcagcacatacactaaaattggaatgatacacagaacattaatgtggcccctatgcaaggatgacacacaaattcataaagcattccatatttttaattaaaaagaaagagaaagaaaaagcaacggagtcttgctctgtcacccaggctggagcgcagtggcatgatcatagttaactgcagtctccaactcctgggctcaagggatcctcccacctcagcctcccaagtagctgggactacaggtgtgtgccactatgcccaactaattattaattttgttgttgttgacacagagtcttgctatcttgcccaggctggtcttgaactcctgggctcaactgatcctcctgccttggcctctcaaaatgctgggattacagccgtgagccactgcacccagcccacttgaattttttcttcttcttcttttttttttttaacacctgatatttttttcagttaaaaatatgagttccggcagggcatggtggctcatgcctgtaatcccagcactttgggaggccgaggcgggcagatcacctgaggtcaggagtttgagaccagcctggccaacatggtgaaacctcatctctactaaaaatacaaaaattaccccagtatggtggctcgcacctgtaatcccagctacttgggaggctgaggcacgagaattgcttgaacctgggaggcggagtctgcagtgagctgagatcatcccactgcactccagcctgggcaacagagcaagactctgtctccaaaaaaaaaaaaaaagcatatatatacatacatatatatgtatatatacgcacacacatatatatatatgagttcattcatttcattcagctaataattactgaaccagaccctgttcttggtgctcaggtcatagtagcagacaagacaaagttcctgcctgtgtggagctgtctagagcagaaagtgaatgtttaggttttgcagacttaaatagcaaggatgttatgtcagtactcatataacaagagaaaacaaattcccacaaaatttttatggacaatatttaaattataataatatttgagtacaattttgtttttcatttttttaatttaatttttttttgaggcagggtctctcattgtcacccaggctggagtgcagtggtgcagtattggctcactgcagcctcgatttcccaggttcaagcaatcctcccacctcagcctcctgagtagctgggactataggtacacaccactacacctggctaatttttgtatttattttttggtaaagtcagggttttgccatgttggccaggctggtctcaaacttctgaactcaagcgatccacccttcttggcctcccaaagtgctgggattacaggcgtgagccaccgtgcccagcctgtctgtttttaaaatataaataatagagatagggtcttgatacattgtccaggctggtctggaactcctggactcaactgatcctcccgccttggcctcccaaagtgctgggattacaggtgagaggcactgggcccagccagttttttttgtaagcatgaattattattattattattattaattcaagacagaatctctgttgtccaggctggagttcgatggcacaatcaccgctcacagcacccttgacctcctgggctcaagtgatcctcccacctcagcctcccaagtagctgggactacaggcacatgccaccatgcctggctaagttttgtactttttgtaaagatgaggttttgccattttacctgggctggtctcgaattcctgggctcaaacaatccgcccgcctcaccttccaaagtgctgggactgccggcatgaaccatgaggtccagcaagcatggaattttgaaggttcacatattgccttaattgaggttccaagtaactgttatctaccattaaatcggttgcagtgttcatctgtagaagctactcttagctcaaggaccatacaagaaacaaaccttggtcagatttggcctgagggctgtagtttggcaacctccagtctaaagggaaatcaacaaaatcagtgaaacatacaccatgccagattatgagcgaagtggagaaaaactaagcagcaagaggggaaggcgtgccagagggaaagggaggagagggggatgaagtggtggcctgggaggctttgctgcgatggggggtgagccctgtggctatatgggagaagagctgggaggagacagggaacaccagatgcaaggtccccaaagcaggagcatggctgatgtggtttgccctgcagccggagccttgtgggcgatagtgagtatgggggctagggtggggagctcaaggggccacagggggccaatcctgtagggcctcgttgtgggccatagtgaaggctctggattttcctacaagagagctgggaccagggagggtttatgtacccacagaacagcatcgacatttttttttttttttttagatggagtcttcctctgtcccccaggctggatggagtgcagtggcacgatcttggctcactgcaacctccgcctcctgggttcaagcaattcttctgcctcagcctcccaagtaactgggattacaggtgcctgctgccatgcccagctaattttttgtatttttagtggacatgaggtttcaccatgttggccaggctggtctcgaactcctgacctcaagtgatccacccactttggcctcccaaagtactgggattacaggtgtgagccaccgcacctggccgagcatcaacataattttttttcttttttttttgagacggagttttgctcttgttgcccaagctggaatgcaatggcacaatcttggctcactgcaacctctgcctcctgggttcaagtgattcttctgcctcagcctcccaagtagctgggattacaggcatgcaccaccatgcccagctaattttgtatttctagtagagacagggtttctccatgttggtcaggctggtctcgaactccgacctcaggtgatccatccacctcggcctcccaaaatgcagggattacaggcatgagccaccatgcctggccaggcgtgaacattttaacagtcgtgaaagattccattgatgcgcctgttttacactcaacagttcctctatcatggacgactttttttttttttttgagacggagtcttgctctgtcgcccaggctggagtgcagtggcgtgatctcagctcactgcaagctctgcctgttgggttcatgccattctcctgcctcagcctcccgagtagctgggactacaggcgcctgccaccatgcccggctaattttttgaatttttagtagagatggggtttcaccgtgttagccaggatggtctcgatctcccgacctcgtgatccgcccgccttggcctcccaaagtgctgggattacaggcgtgagccactgcgcctggccgtatggacgacttttgctaccctattaaaaattaatccaattgtccagattcgtggctcacacccgaattccaatactttgggaggccgaggagggaggattgcttgagcctaggagttcgagaccagcctgggcaacatagcgagacccagtctctaaaataataataataataatgccgataatacttgtaaatgataaaaaataaaatcaagacatgggaaaggatatttagtaaagaatcttccttccacccctgctgacagctaccagcttctcctcagagacaggcacattaccctctctccagagatggtttaatgtcctaagaaatacctgtataatggtgttttgcaccttgctttttttttttttttttttttttgagacagagtcttactctgttgcccaggctggagtgcagtggtacaatctcggattactgcaacctccacctcacaggttcaagccatgctgcctcagcctcccaagtagctgggattacaggcgcacaccaccgtgcccaggtaatttttttatttttagtagtgacggggttttgccatgttggccaggctggtcttgaatgcctgacctcaggtgctccacttgcctcatcctcccaaagtgctgggattacgggcgtgagccaccgagcccggcttgcaccttgctttttagcacttaatatcttgatatgatttcattacatccagagctttttccttcttttcggggcagatgggtaatgtattcattggtccccgcatggcctcggcctgtatgcaggagcctagaatacaactttgggatgctatagggacatccctgaggtgagcctcctacaacgagcctggcacccagcaggtgctcagtaaataggaatgaaaaggctagctgtaatactagtactttgggaggattaggtgggaggtttgcttgagcccaggagtttgagactagcccgggcaacatagtgagacccccatctctaatttttaaaattataaaaaataaataccattttacaaaggcttgtatagcttatcttggagcctccccccatgggtcatgcccaacggacttagaccttgacccagaaacctcccttagaagcaatttgtattctgaaatggtgacttcacagagggcttattggataaggcccacggctgaatcactgtttgtttttaggcaagtgtgaggcataggaagaggttaaatccaggatgaggatggcagtagagcattgactcattcattgaactttctgtagacaatgtctttctcctggtcaagattaactttccaactcctgatcaattcattcactgataatgagctaatcaacaggggccaccagtctaataaagagctcttagaaattaagaagttcattcactggaaggacatgcaggattttaaaaaaggaaagaaatcaagttcatcaatttggtgaccaaaggacatgaagcaatagttcagagcacagagaaacagaaatggctttggtgtatgtaaaaaatgctccacactgccgggcgtggtggctcacggctgagtgcggtggctcatgcctgtaatcccagcactttgggaggccgaggcaggtggatcacctgaggttggcagtttgagaccagcctgaccaatatggagaaacctcagctctactaaaaatacaaaattaggtgggtgtggtggcacatgcctgtaatcccagctacatgggagggtgaggcaggagaatcacttgaacgtgggaggcggaggttgtggtgagccgagatcacaccattgcactccagcctgggcaacaacagtgaaactctgtcgcaaaaaaaaaaaaaaatgctccaccctagtcatgtgaaatgcaaatgacaacaggagatcccattttcccttatcagacaggcaaagataaaaaagttaaaggccagcaaggtggctcatgactgtaatcccagtactttgggaggccgaggcaggtgaatcacttaagccaaggagtttgagaccagcctagacaacatggcaaaacctcggctctacaaaaaaaaaaaaaaaaaaaaaaagcaaaagacaattagccagatgtgatgcctcgcacctatagtcccagctactctggaggctgaggtgggaggatcacttgagcctgggaggcggtggttgcagtgagcagggattatgccatggcactccagcctgggtgacagagtgagactgtctcaaaaaataaaaaatagacagggtcaggtgtggtggctcatgcctgtagccctgtagtcctagctgctcaggaggctgaggtaggagaatcacttgagcccaggagatggaggctgcagtgagttatgatcatgccactgcactccagcctgggcaacatagcgagaccctgtctcaaaaaagaaaaacaaaaagacaatactctgtgttgggcaacttttgaaaaggggccctcaactccctgctagtgggagtatagttcagtttcatctttttggatggcatttggacaaatgtatcaacattttatataacataccatttgatgtgaagtgcaatgatgtgtgtagagggcattcattgaaattgccacattatttgtagtagccaataaattgcaatctaacctaaatgcccatcatgagtcttcgtgttaggtaaattgtgtgattgtgctataatccatacaatgaatagtccgcatccctgcagaaaactaagggagctgcgtgtaatgatatggaatgattttcaaaacactgaatattgttatagcattacccatgtgatgacgattcaaaacaaaaaaatgttactatagcaaggtgtaggttagtgtggaggttcctatttgtaatacataaagggctgtacatatatacatatatatatatatatatatatatatatatatatatatatatagttaaagacaggatctcactctgttgcccaagctggagtgcagtggtatgatcttggctcatggacgcctctacctcccaggctcaagtgatcctcccacctcagcctcccgagtagctgggacaacaggcatgtaacctgcctattttttgttttgttttgttttgtttttttgagacagggtcttgctatattgcccgggcttgtctcaaacttctgggctcaagcgatcctcccaccttgacctcccaaagctctgggattacaggtgtgagccaccacgcactgcccatgcacatattaatatatacataggccatccctggaaggtcatacaagacactggtttaaaaaaaaaaaaaggttgctttggggagggaaaaggaggtctggaatggagggagactcttcttttagttgggtaactgtaaatcacattatttagctactggttttacttctagtgggagattggcacctgcagaaaatgcaggtgtctattcaaatgtaccttccttccagaagcctttcgtgagcacactaggtattcccagattgccctcccggcagttataccagccttcacctccctgaaaagcacgtgccccctgcaccccgcgacgattgcagggaggcgccttggccagcagagggcgccagaggaccgcgccccaggcctggggcgggaccccctcgtgcggggagctggggagggcctggccctgccgggtcccaggccacctgggccgcagatgtcgcccatttccgggaggacctgaccccacagtatcaaaagtgtcacctcaccttcccctgcaaagggagctgggtctgcggccgagaggcctggcccgaagcctcctctcacctcgtggtctccgccgcctgcaggagggagtggagcgagggcgggcctggagggggtggcggggacaattcgatccgatctgagcaaggcccctcccctctgcgttgcctcccacccccatgccccgcgcaggtgcctgaccactgaaggaaagtggaaagcgggaggcccaggcagtggctgcctgcaagtacttgattgagcccccattatgtgctttgaagaaaacagaataagacaatgagagagaaaggtgggctgggcgcggtggctcactcctgtaatcccaccaagttgggaggctaaagtgggaggatcaattgagccgcagagtttgagaccagcctgggcaacatagtgggaccccatttctacaaaaaataaattagccaggcatggtagcgcgtctcagtgaaaaaagggggaaaaaaagaaaaaagaaggtgggtgctggggcaagggtgggtcctactttggctagggtgatcagggaaggctcccctgaggaagtgacttacattttttgtgttaaatatattattcatacctaaaagtgtttaaattgtctctgtacactaccatgtcatgaagatacggtaaaataaatagtccatgtacagtagaaagactaacaataaagatccctccctgcctaggaaacagatcattaccaaaattctagaagcttcatgtgcagcctgttcttgcctcccctcctcaccagccactcttcagaattttgtatcaaacatctccttgcagccggcatagtggctcacccctgtaatcccagcactttggcaggctgagctcaggagttccaggcggcagtgagccgtgattgtgccactgcactccagcctgggtgacagagcaagaccccgtctcaaaaacaaaacaaaaaaccacttccttgcttttctttctaattctacaacccccacatacatccctaaataatatagggtttcatttgcctgcttcagaacctcgtataaatccaaataactatgcatttgtttgtgacctctgctcgacattgtgtttttgagattcatccctgttgctgcatggagttgtagttcatttttattgctgtatagtattctattacaggattgcaccagggttcattaatccagtctactgtttataaacatttgtgttgtatccagttttgttttagtttttgctttttttgctattaggaacgagggtacaatgaatatccttttttgttttttcggggtttgggctggacaacagttctttactttgcttggttgctcattataatccccaggggagttttttaaaatgctgatgccagaggccccacccagactaattaaatcaagatgtgggtgggggtggggtgggccgaggcttaggtgttttaatccttccctgtggggatctaatgtgctgccagagctgagaacccctgggatgcagttggtttgaggacagacttgtcagctgcagcccctgggatgcagttggcttgaggacagacagggagaggagtcacctgttgctagctgatgccaaacttttccaaagtgactatgcccaccgaccctctcgccagctctcacctcctcatcaactcttgatagtgaccaaatttttccttgttgtccttctgatgggcgtgaaatggcagctcactgtggcttgaatttgccatttctctcttcactaaacgaggctgagcagttagtgaagttgctgctgaaacaaagaatgaaaggaagccagcgtgaagatctaggagcaagagacgtaggggagaggaggaagagcagcaggtgccaaggtgggaaaggtctgggatgttggaggaacagaaggaaggctgggggtgggatccttgtgcatgggggagggagagaggctcaagccaatgtcagctggggtcagagcagcggggccgagttggctgaggagaggactttggcttttactctgagacaggcgcatgggagggtttgagcagaggagggggtgatctggcctcactttggcttcaagcaaaggatcctgattggagctaaattgacacgggacggggagtattccgcttaatgactgcttactgcctctgtcccccaccctactgcccgctctccagctagaaccaggggaggacgattttgttcacggctgtcacacccggcaccaagtgactaaacagacagtagttctgcccttcaggttggtggtggtggtggtgtggggtgcttataggtttttatagtcttccttcacaggtggaaacaagaacggtgagacctgtgaggtttatttcagagccacccccgggcctggtacgcctcccagggaagctggggtgggggtgcagctgcccctcacttgggcccaccccacatgcattcagtcagggcccctatggagccgtgttacagcctttagacacaggatcgaggatcttcacggggtgaggagacacgcccggcccatgccttctttctcccgccagcctacagggatctttttcaacgaaactctaaccaggtccctcctcagctgaaaatccttcggtggctccccagtgcccttgaggcaaagtccaaactcctacgaggccctggggcccagcacatctgacccctccgggcatgcccatcccaccccatccctggaagctgctctctaggagttactctgaagcagttgccacttcttccctcgggccttttcccttgataattcttcacttcctctgggaagtcaccccgaccccctgtcaggtgacccgcctcttaacggtcgccgcgtcccgtctctcccccaccaaagcacacttccctttgcattgtaattatctgtttacttcgtctgtctccctcactggaccagaagctacccttcgggagaggctctgagtgttctgtccggggctgtgccctggccccaggtacagtgccccacacgtgctgggcgctccgtaaacactggataagggaaggaacgggtgctcttggctagctgggccaggctgctttgcaaaaaggccgtggcatttcaagccgccgagagccacgtgcggtgtccctttcctcgcttcctccccagtgatgtgcgtttccctcgtcaatgccacgctctccaggcgccagccgggcggaggaaatttccgccccctcccaagcccgaggcgggggcgggcgtcggaaggtcaggtgtcccggccggcgcgcagcgccagggggcgtcagaagcgctcagaccaccgggcgctgagccggtgggcgcgcggcgtcctgccggggtcccacctcgcagaggcctcgcttcgctcgacgtcccgccccggacagccccagcaccggggacgacccgcgctgcgccagcgaaccccgcctcggaggagtccccgcccgggctctcaccgccacgcggcgcgagcccggccagcagccggcgcacctgctcggggagtggccttcggcggagacgagcctccgattggcgcggaggtgacaaaggggcgtggcagataaggccccgcccctcccaccccccaccacccccccggagtacttaagggagttggcggcgctgctgcattcattgcgccgcggcacggcctagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccaggtgcgttggaggggttctgggctccaggaggtttgggggagacaggcgaaggctgcgtggggggcacctgagggaggcggcctgcctgagccaggatcgagtcacaggatgttttgtggaccattgcgggctcgggagaccgggcaagtgggtccccagttccggggatctgtctgggtggttgggggagtgccgtgtagagggcaggggtcttcagcttggggggcctttgtagccggcgagaggcggaggagctccgcaagaggggaaggagaggaggcctgtgtcaggagggccctctggacgctgctggggagagtccggagtccagagggttgaggggaggggtggggagacgagatgtgtgtgaggagggggattggggcagggtggtggctccggggctgggatgatggggttctggcctcaggctggagactggggacttaggagagggagatcaggaaatgacctccttcaactgggggtcctacgtgtgagagactcagattgggtgacctgggcgaggagggcaggaacctggtctgtcctgtggataatttttttgatctaattatgtattgagaatcggccccacccagcccctggccagcggtgggctcatgtttgttgattgagtgaatgatttaattaacgcctgactctgctttttctccctcagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggtacgtgcccctccaggcgcccccaccgttgctctctctggcagcttttgtgaatctgggcttgctgttctcattcccaaagctgtggacactgaggccccgagtcttctaacttctagctcaagttccagggcctggctctctggaaacgtttggcagaaactttcttcatcagctaagcagatgggcaaagcagacaccttcccaatcccctgcagcctgtttctcagccaaatgggtcggagctggatatgggaaaggtgcaaccaacaccttgctgtgggggccaggtgtgaaggggcccacccggccacaccctctcccgggtccgccccctccctagccagacaggatgttgtcagaccccccgcctggctctgaatccttctttgagaactttctcaaaacttaggctgatgtttctcttctgtgagcctcattttctctatctttcagatgggcatgagaacagcttttggggtttctatacaggctaaatgcaggaatgcatatgggaagcacctggcaaagtgccggtacctgctaaactctcacaaaaatggttccttggcatttgctctgcttccttgctgtgtgactttgggcaagcaacttaacctctctgagccttaggggaaaactatgatagcatatgttttagagagtggctgtaaaggtggctaatcactttatagtaatttattatacccgaacggttctcaggtcggcttccccacccccactgaatcctagcacacagaccaggaaacggcatctttggggcagaaaacacaatcacgtcttttgaaaatttactaaatgtgtaaaaaactttctggacatggagaaaaggtagaactttttagaacttgaatggtggcagccactgtgcctggagctgctctttggagagtgacagttgagggagaagattccacagggttcaagctggccaggttctgccatttcctggcctggcgcctgacctctgagcggtgagggttagtgaggtgtctgggaggactggcaattcgcgggctttattggcatcttattcgactaaggctacccatttctcttccttcgtgcaccaattgctctgattttaacatgtaaaggtccaactgcctggcctcctgggtgcctgcccagctcacagggctctattttgggacagttgaacccctcagggtgctgcagtcctgcctgcctctctcacctcccatctggacattattttaatgtaaaggcatggctgagacacagaaatccccttgaaatgtatcattgcggtcctcattgactcccattgtgtgccttaatggtgggcccagtgggtgggggctgggaggggtggagcaggtgcatggggcagcggtgcccagcacctgttccagtcacagctgctggcccactgcatggcaggcccctttaatccggggatatcgcatgtacagtgcccccctcggcgccctttgtccccgccggcctggtgccgatttcacacttgccaggagtaccatgaaggcgtctggggggcgagggatccaaggagtgggggtctgtgcctcctgcgtgtgcacacagcccccgcccccagcccatcatgtcctagaatgtctccttccccttttgtttgggttcaggtctcatcacactttgggcacttactgtacaggagggtagtgctcaggacttcaccaacagccctgggaagggaagggaggtgctgtcctaactctggtcttacaaatggactccagccccttttccagatctccagagtcagcccttagttcacaagggtgaacttacccttctcattcacatgaagacttagaatgcaatcaacaaacccttcaggcgtggcgtgtggaggctgctgagtaatggcagagtggagtagtgctcaggcacccctcccccaatcctctatgtcccccaccctttggagtggcgagtttccatttctgccccatgagactgagtccagctctcaggcgctccataagtccctattgaatgcatgggtcccattggagccatcctctggactctctcctaccctggtagctcagtgtggcaccctaggcacccaggaggtgatggaatgaattcactctcagctcttaaattccatccagcgctgggatttcacaggcgggccctgaccttgcgggcatatcagactgggcgtgaggggattggagaattgcatgttttttaaaaagactattcagtattatggaatagtgtctagcacttagtaggagctcagtagattaaaaaaaaaattatagacagggtcttgctttatcgcctaggcttgtctcaaactcctggcttcaagcaatcctgcctcactcggcctcccagagtgatgggattacaagcgtgagccaccacacccagcctcaatagatttttgtttaatgggttactgttatgaccttttatttggaaaatgctgcatcccccagaaaaaaacaaatcaacattattggtgtttttggaactatatagctttttggttggagcagggattgttatgaggcatgagtgagggggcagactcctctgaggcctctttaatttttaaaacagacttatttattctctaagggcttgttgaggatttactgggcacccagctccatgtgcaagacttttcccaacacagccttggccaggcagatggtgtgtcagggccacaggtttccgtagcctcttgggtgatagaaaggggcccaggccctgggctggggctcagaagggactcaaaggaggcccttgcccttatgggactcagcctgattggagaacagacaaggagatttgggattacagcgcaggaggtggggtggtgaggaaagcaggctgctggccgggccccaggagtggcctaaccagcttggaggtgggggtggggaagcctcttaaggctgactctggctttggcccccaacagagtaaatcaaggaatgactccaggactgatggtaaggacaccagtcacgtcctcccttgactgaaggcagtaagggcagtaggtgaaatcagaggctttggggtcctgccaggggaacctgaacatgctacttctgggcctcagtttcactgtctctgaaatgagaccacagtaggatcaagtgacagtaggatgaatcagtaaaggtgttgagtcattgttgaccacttcgcacgtccctgcgggatgtggatgagtaccctaccttctgtcacttatcaacccctatgagtggggggtgaatagccccattttacaggtgggaaaatggaggctcagagaagccagacaacttgctcagagttgcacagtgggaagcagcagagctccgtcaggtcccggcctttggaccctggctgtgtgtttgacggaggcctggctttcctgggatcatgggattctttcagggtttggggtatgcggggagggattcccatcactgccagccgttgtcccacggctcactcggcctttctggcgttctctccccaggcgagaagcccttctcctgtccccactgcagccgtgccttcgctgaccgctccaacctgcgggcccacctccagacccactcagatgtcaagaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccatggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacacccccccacaaggaaccctcaggccaccctccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaagtctttggtgtcatagaggagtgggtattttgaaaggtctttggtaagggaggaggggacaggaattcctgaagcttagatatttctgacacagccttaaatcttgtccttggaaacatcatagggctttggagtcctgggtgtcactgtcagggaccttatgagactgggttttcccgttggcctgggtgtcctgtctgctgctgtttgggtgagccagcggcatccatacgagctcttcactatacactgtggctttttactttctcgttcttgaattttgaagttgatctggcccacggagtgcaaagctggcttcctgggtcttatcaactagacaggctgcaaagctctgccccagcactgcaggtcttttggggtgggattgtccgcttcccccagatgcgagtggaatgcgaccaaggagacagaggatgtccttcctgtttccaagggctccaggcccccttgggcctccttgtcagtcccacacctccgtcttgctgctgggtaccaaatggcctttgatgcgaggaaattggctggctggagccagtagggtgagaagccaggccaaagggtaggggtcactcagcttcctgctccgaggacggcgggacggtcagcatgcgtcttgggctagggtaattcattccccgccagccgatggtggtgacctcaccactgggggcctcttggggccaggagaaaatgagtgtcctttttgaacacaaaaggtgctggaggtgccagtttcctgtgaggagctgaggcgtcccagagcttcggagccccagagtcaggctgggggtggggggagcttcatgttccaaaggagagatgattctttcttctaaacaggaaatggtgacccgcaggccgggagcagcccttaatgacttgcagctttcctcccaaaaggaaaaaaaaaaacgttctctaacaatcgccaaattgtggcctgcctccctgaagggaagttagggagttggggggatgggggttgggcatccatgagctgaaggcctactgtgtcctgggtccctgcgggtccctctaggtcgtctccatccacccacagtaggtgctgaatgaatgatttcatgacttcacataatccctgggggtcgggcctccggaaaatgaggcacagaggtgggcttgcctgaggtcaccaagcccggcccctcaggtcatcctgggagttcggtaggctgggctcatgccgctgactctcagggcacctggagcaaggctctctccctctgggggccccagtttctgtgtctataaaacagggtgacagtagtgccttcctctcggagactgtacagaggcattcattcattcaggggtttcgagggtaccatatgtgccaggccctggggttacacccgtgaacaagacaggccatccctgcgttcatgggacgtatgttctggtcggggagagagaaagcaaacaagtgattaaataaacaagccgcttttctacagtgatggtgccaggacagaatgaaagggtgccaggcactagagaacaacggggtggggctccccaggccaaggcagtgagagccctggaagagctgaattccagcccggacctgaaggaggagaaagatgccggcagggaaggatctgggggagggaatagcaagcctgctggaatgtgctgcccccatgagaaagaccaggatggcggagggactgggaagacagggtgggagaggagagtgggcccagctctgcagagcttgtggtgctaagcaggtgggaattttgtctaagcccctagggcagccactggggctgtaaagcaggagagtgctgaggcctgctgttacctttcctacaaagatctccctggctgcttgggagaatggatctcaggggtccaggaggagaaagacaaaggcagggagaccatgagaaagccagagggggccaggcaccctggctcatgcctgtaatcccagcaatttgggaggcttagacaggcagatcacctgaggctaggagttcgacaccagcctggctaacatggcaaaaccccgtctctactaaaataaaaaattacccgggcatggtggggcatatgcctgtagtcccagctacttgggaagctgaggcaggagaatcgcttgaggtcgggagctgagatctcgccactgcactccagcctgggtcacagaacgagaccttgtctcaaacaaacaaacaaacaaaaaagggccagaggggagggagggaaggaaaggagggaggatggtggcctggctcagggtgttggtggccttggagatgaagcctgtatttaagaaacttgtggcagttgtggccacccagcccatggcccagcacacctgagccctagtgggtgacagttatttagtattattatctggggaactgggcatggtggttcacatctgtgtagtcctagctatttagaggctgaagtgtgagggttgctggagcccaggagtccaaggccagcctggacaacacatcgagacattgtctctacaaaaaaatttaaaaattggccgggcgaggtggctcacgcctgtaatcccagcactttgggaggccaaggtggggcagatcacttgaggccaggagttcgagaccagcctggccaacatggtgaaaccccgtctctactaaaaatacaaaaattagctgggtgtggtgtcatatgcctgtaatcccagctacttgagaggctgagcacgagaatcccttgaacttgggaggcagaggttgcagtaagccgaggtcgtgccactgcactccagcctgggctacagagtgacactctgtctcaaaaaaaaaaaaaaaaaaaaaaaaaaaaaagtccgggcttggtggagcacaccaccaaggggatgttggatctagtgggggtagatactatgaagctgagaaaagaatggggaaagcctctatattctgatcctgagcaaaccccaaagcactaagtgaaaaagaaatcaccggcagatgtgctcccttctgtgggcagaagagggatgaaaatcatcaacacgtgattcattcttgtttgtatttgcatacggagactctggaggttaggacaatatactaacaaaagtggttccctggtgggttgcaggaggtgggattggggtggacaaggactggagggagggaagaagggagccattttttaaagatttttaagacgttttactttgaaataattgcagcctgacagaaattgcaagaaacagtaaactggaatcgtacattcagattcttcaatacgttaacgttttatcatggatacatcttccctctcttcctagacatacacacacattatttagttctgaaccatttgaattttttttttttttcagatggagtctcgctgtgtcacccaggctgggatgcaatggcgtgatctcggctcactgcgacatctgcctcctgggttgaagcgattcttgtgcctcagcctccccagtggctggaattacaggcatgtgccaccatgctcggctaatttttgtatttttagtagagacggggtttcaccatattggccaggctggtctcgaacttatggcctcaagtgatctgcccgcctcagcctcccaaagtgccgggattacaggtgtgagccacggcgcccggcctgaaccatatgagagtaagttatagacacagtgcccctttactgctaaatatttaagctatgtgtcctaaggataaggacattctcccatagtttcatgatcaaaattaggaaatttaacattggtgcaatgctactctgtaatccatagtcataatcacatttctgcaagtgccccaatgatgtctttcacagcattttggggggtgtagctggtggggaatgaccaggatgcaatgcaaggatcacacactgcattcacttgtcctcactcttttatttatttatttaaaattttttttctaacagagacaaggtctcactctgttgcccaggctggtctcgaactcttgtgggttcaagcaatctgcccgcctcagcctcccaaagtgctgggattacagacatgcccagctacttgtcctgactctttttttttttttttttttttttttttgagacagagtttctctcttgttgcccaggctggagtgcaatggcatgatctcggctcactgcaccctccacctcccgggttcaagtgattctcctgcctcagcctcctgagtagctgggattacaggcatgagccaccacgcccggctaattttgtatttttagtagagatggggtttctccatgttagtcaggctggtctcgaactcccaacctcaggtgatccacccgcctcggcctcccaaagtgctgggattaacaggcgtgagccaccgctcacttaatctcttttttcccaaggcagctcctcagcctttctttgtctttcacaacattgacgttttttgaagagtacaggccagttgttttgttgaatgccctccagtttttttcctgatgtttcctcataattacatttgggatacgcactttgggcagaaccacagaagcagcatgtgtcttgtttggtgcaaggtgtcatgaagcacatgaggtcggctcatcccagactgacatcaactttgactgcttggttaaggtggggcccactaggtccctccttgctgaagttcctctttttccctttgcgctcaatctgtatcttgtgaagagatacttgaagaccatgtgatgcctccgagtatctcctcacaagatacggaaaggaccatgtgatcctatgatgcctcaaacttccatccacaagtttcatccctttcaggttctttttgcctaaatcaattacattttacgatggtagttaccaaatgatgatttcctttctttttttttttttttttttgagacagagtcttgctctgtcgcccaggctggagtgcagtggcacgatcttggctcactgcaagctctgcctcctgggttcacgccattctcctgcctcagcctcccgagtagctgggaccacaggcaccctccaccacacccagctaattttttgtagttttagtagagacggggtttcaccgtgttagccaagatggtctcgatctcctgaccttgggatccgcccgcctcggcctcccaaagtgctgggattacaggcgtgtgccactgcgcccggcccaaacggtgattttctaaccccatcattccttctactttactggctggctttctcctgcaggacttcccctctgtcggggcagcggcttagagctgtgggttgggagaaatggggccaggagcagcaggatctggccaggccattagatcctccccggggattttctttaaaacgagtccaggaaataaactggctataaagccagtctccatgcaagtgtcaaggcaggcaggtctggggccaaggccatctctgggcacatctgggctgcattagtgacctgttggctacttatgggtatcctctgagctgggatgagggtctcctggtagacagggatcaggactgtccttgttcttctttgctttcaaactgtttatttttttcgtttttccttttttttttttttttttttgagacagagtgtcacccaggctggagtgcagtggctcaatctcggctcactacaggctcaacctcctgggctcaagagattctcccagctcagcctcctgagtagctgtgactaaacacacacaccatcatacctgcctaatttttgtgttttttgcagagatgtagtttcgtcatgctgcccaggctggtcttgaactcctggactcaacctatcctcccacctcagcttcccaaagtgccgggattacagtcatgagccgctacacctgcccaaattgtcagtttcataaatatcacaggaacgtattccctcctttaaaagagtgagaaggtgacatgtgaagctccagtggcatgtgatcaacactctctatccttatgcctttactgtccccagcatgacgccatggagatcttggtttacatctttgtcagttaaaaaaattagcaactggccgggcgtggtggctcacgcctataatcccagcactttgggaggccgaggtgggtggatcatgaggtcaggggttcgagaccagcctgaccaacatggtgaaacctgatctctactaaaaatacaaaaaaattagctgggcatggtggcgggtgcctgtaatcccagctactcaggaggctgaggcaggagaatagcttgaacccaggaggcggaggttgcagtgagccgagattgtgccactgcgctccagcctgggcaacagagcaagactctgtctccaaaaaaaaaaaaaaaaaagcaactatatttcttttctttctctctctctgtctcttttttttttttttttttttttttgacagagtctcactctgttgcccaggctggagtgcagtggcatgatctgatctcagctcactgcaacctctgcctcctgggttcaagtgattctcctgcctcagcctccaagtagctgggattacaggcgcccaccaccatgccccactaatttttgtatttttagtagagacggagtttcaccatgttggcaaggctggtcttgaactcctgacctcaggtgatccacctgcctcagcctcacaaagtgctgggattatagatgtgagccactgcacccagcaaaaaaaaaatgagcaaatatatttccatgcatacatggctccgtctcacttacctggttccacaagggcctccaccacctctgcctcatccctttccccgcccccctcactccttccagccacaccaggctccctgccccctcagggcctttgcactgccactccttctgccaggagcactaccctagagagccacatggccactcacctcccatccctctccctttcattccaacccctttccctgttattttctccatctgacaaaacactcatttccctgttcagagtttctctgttgactgtcttcccccaccagaatgtcagctccatgcaggtggaattttttttttttttttttttgagatggagtttcgctcttattgcccaggctggagtgcaatggcacgatctcagctcaccacaacctccgcctccagggttcaagcaatgctcccgcctcagcctcccaagtagctgagattacaggtgcacaccaccacgcatggctaatttttgtatttttagtagagacggggtttcaccatgttggttaggctggtcttgaactcctgacctcatgatccgcccgcctcggcctcccaaagtgctgggattacaggcatgagccaccatgcccagccatgcaggtggaaattttgtcttcttcattcactgtgcagtgatccctggagtccctttcacatgtgggaggcacacgctccgggaaacattgctgaaggaatgatgagtgagttgatatgtgcctgtcagaaacaccgtgtggtcaccatttttttttttttttttttttgagatgaaatctccctctgttgcctaggctggagtgcagtagtgtgatctcagctcactgcaacctccgtctaccgggttcaagcaattctcctgcctcagcctgccgagtagctgggattacaggcgcctgccatcatgccttttgttgttgttgtcgtctttttagtagagatggggtttcaccatgttggccacggtgacctcgaactcctgacctcaggtaatccacctgcctcagcctcccaaagtgctgggattacaggcgtgagccactgcgcccagcatttttttttttttttttttgaggcagagtctcactgtcacccaggctggagtgcagtggctcgatctcagctcagtgcaacctctgcctcctgggtccaaatgattctcatgtctcagcctcccaagtagctggcattacaggtgtgtgtcaccaagcccagctaattttttttgtatttttagtaggacggagtttcaccatgctggccaggctggtctcgagctcctggcctcaagtgatccgcccacctcagccttccaaagtgctgggattacaggcatgagccactgcgcctggcccattttgaatttttgtttttgagtttgtttggttagacttccttctgctgtgaaacccacagttgggtgatatattagtttcctagggctgcccccaccaaattcccatgaacttggtgggaagagcagaagtttattccttcatggtcccagaggccagaagcaggacatcaaggcatccacagggctgtgtttcctccacagactgtagggtagactccttccttgtctcttctctgtgtctttgtttctctttttttttttttcaagatggagtctcactctctcgcccaggctgctcactgcaacctctgcctcctacttcaagcgattctcctgcctcagcctacagagcagctgggattacaggcatgtgccaccacacccggctaatttttgtatttttagtagagagagggtttcaccatgttggccaggccggtcttgaactcctgacctcaggtgatctgtccgcctcggcctcccaaagtgctgggattacaggcgtgagccactgcgactggttagccgtctctgtttctcttaagacaccagtcattggatgtaggggccaccctaatccaggattatctaatctttacttgattgcatccacaaagatgctatttccagataaggtcacattcccaagtcctgggaattgacttgaacatatctctgggttctacaattcaaccccaggtgtactggtggctacaaccaaaggcttggcaaggctttctcagggtctggaatgaatccaggtgcacttatctgtttatttatttggaggtcggtggggggggggggttctcacgctgtcacccaggtggaagtgcagtggtgcaatcacagctcactgtagccttaagcagatccaggaagtttttattattcactcaccaaaccctgcaggagggtcaggaaggtggcctggaggaggggacccttaggaggagacttgggaggtgagtaggattttgcctctgtggctccaggaagagagagagagccctaggtcaaagctccaccaagccctgactgcagaggttactgcatgagcaggtaccccagggttgggtgacagccacagagggagaggtcggcttgcatcagggccaggccatgcgggcctcggagtggggaactacagatttatcctgagggcaatggggagccatgggaggggctggcagggaggggactgagtgggtttactctttggaaagatccctggggccactgtgatgggagcaggtctggcagcaggaagagcagttgaggaggtggccacggccccgtgatggtggcagatgaggcaggggtgctgtttggcgacacatgaatgagcagactgagggaggagacaaggatgatgccgggacaggatttttcgccaagtgagggaaataaggacccagggaggcaaagagcaaacactcaggcaaataataatgacgatgatggtaacagaaacacttcattccagttcactacctgttttgcacggattatttaatttaatcatcacaacagcctgaggcaatgtgggtataagagaaggtcctatagagtttaggggctctagagtcaaacttcctgggttcagtctctgctccattgcctacctcctgtgtgacctagagcaagttgttcaacctctctgagtgtccattttcttatctgacaagcagcctctccttcctggggttgttgtacagattcagtgagtaaatccttgtaaattggccggcacggtggctcacgcctgtaatcccggcattttgggaggccgaggtgggcggattacctgaggtagggagttcaagaccaacctgaccaaaatgaaggaaccccatctctactaaaaatacaaaattagctgggcgtggtggcacatgcctgtaatctcagctgttcaggaggctgaggcaggagaatcgcttgaacccaggaggcggtggttgcggtgagctgagatcgtgccattgcactctagcctgggcaacaagagagaaactctgtctcaaaaaaaaaaaaaaaagaaaaaaagaaaaaaaaaacttgtaaattgcttgccctcgggcctggaagagtaagctttagtaaacagtggctgtaactatgcccattttacggatatgaagaaagggagagtagcgaagctttccaagttcatctagaggataatcctacggtttcaggcactctgcgtctcttaccaaagtctggggacctgagctggcctgcagatcccagggtctggcatcctgtttcatcccctggaatcctgagtgccagggctgggcagcccagacctggaggagccgggacacttgccgtgcacacttcctctctgggtacaacctggaaggtcctcaggctaggggacgcagggcaccaaactcaattctatttagctggagctatggcctgaaataaaagcttaaatggggctgaaaaggtagcagcaaggagaaatgaaacccatgtgtcactcatgggggccctcgggacggggatccctcagagaaactcatctttaccccagggaaagacccagcgctgggcacggggctttcccaaggctgtcaatcttctgcttgcagttacaaatgccaccaatgtctcactttgtgacccaggatgagtccttgccttctccagcttcactttgcaggtcaccaaaatgtgcttaacttttgacccaataataaaataaaaagcactttaacacacacattttacccagcacgtttcagtagagcaaacaccatcaacaatctacatgcccagcacaagtggattgtatatgttacctggagtcctggtgtgttctgaaaactttgcaattatagatgattatacaatccctaaaatatacatggtatgtatatttttctctattttttttttttttttttttttggagacagggtcttgcgctgtcatgcaggacggagtgcaatggtgagatctcggctcaccgcaaccttgacctctcgggctcaagtgaccttcccatctcagcctccttagtagctgcgactacaggtgcatgccaccacgcctcactaatttttgcattattattattattttttttttgtagagacggggtcttgccacattgcccaggctggtctcaaactcctgagctcaagtgatcctcccacctcagcctcccaaagtgctgggattacaggcataagccaccatgcccggcccattatatgtatctcatatgaacagagaaagaataagcctggcacatgattagcagcccaaaatgcttttttttcttcttctcgagatggagtctctctctgtcacccaggctggagtgcaatggcgcaatcttggctcactgcaatctccacctcccaggttcaagcaattctcctgcctcagcttcccgagtagctgggattacaagcatgcaccaccacatccagctaatttttaggttttgtttttttgtttgtttgttttttgagctggaatcttgctctgttgcccaggctagagtgcaatggtacagtctgacctcaccacaaccttcacctccggggttcaagcgattctcctgcctcagcctccccagtagctgggactacaggcacacgccaccacgcctgggtaatttttgtatttttagtagagatggggtttcactatgttggccaggctggcctcgaactcctgacctcgtgatccacctgccttggtttcccaaagtgctgggattgcaggcatgagccacagtgcccggccccaaaatgtttcttgaacaattaaatgaatgaacgaataagcggtcagtactcagtgaatatttgttgacagaaaggaaaggagaaaaagaaaggaaaaaaggaaggatctggaaggtttgtacccacagtcacagtgattttctgggagaggaggctgaggcaatggcgaggaggagggcatttcctgttaggtaatgtttaacctcttctgcgtctgtattatgatagcttcccctaagggagcatcttttagttcacaagcaagcagtcaatagtcccacggacaaactcgattgtcacacattgccttgagaaggtgctgacaggcagaaaaagcagtttgccaagcagcctgaaaaaatgatatggccccatttcttttcttttctttttttttttttttttgagagagtctcactccgtcacccaggctggagtgcagtggcacgatctcagctcactgcaacctccgccttctgggttcaagcaattctcccaccttagcctcccaagtagctggacctacaggtgcatgccactacacctggctaatgtttggtagagatgaggtttcaccatggtgctcagctggtcttgaactcctgagctcaggcgatccacatacctcagcttcccaaagtgtgggattgcaggcgtgagccactgcgcttggccaaggccccatttctgtaaaattttacctctagctttacccatccttgccttcacacagagggaagcgcctgtctgccctgggggtcaacagtggttctgtctggatagtggggtggctggggttaagttttcttttttataggtctctgaatttctgtaatgagcatgcaccaggcatgggttttgggtttttacaggctcacacctttaactccagcactttgggaggctcaggcaggaggatcccttaaggctaggagttcaaggccagcctgggcaacataatgggaccccacctctacaaaaagtagtaacagtaaggagtatgtatttttctttttaaacagaaacacacacacacaggaaaaacatgcaacacttggcaatgttccgggacctagggggtctggcactctgcagtcatggccaccctgtcaatcttgagggccatagagtgacatttgggtgccctgtggtgcccaccctgagcactgccagtgaactgaatccatcctccacctcagtatctatggacagctcattcttcaactctggggggccgatattcaccaagaccacgaatattcacccagaccacgaatcttcaccaagaccacaaatcttcaccttgcaggtgctcactgctgtgactcaatcattccagggaatgagctgcatggggtgacagccccttcgagagagtcagggactgagctcagaaaagacaaaggacttgtccaagaatgcacagccattaggtaagtggtggcaccaggtttttttttttctttctttttttttttttcttgagatggagtttcgctcttgtcgcccaggctggagtacagtggcgcgatcttggctcaccacaacctccgcctcctgggtgcaagtgattctcctgcctcagcctctcgagtagctaggattataggcatgcgccatcacgcctggctaatttttgtatttttagtagagacagggtttctcaggccgggtgcagtggctcacacctgtaatcccagcactttgggaggctgagacaggaggatcacgtgaggtcgggagtttgagaccagcctgaccaacatggaaaaccctgtctctactaaaaatacaaaattacccaggcgtggtggcgcatgcctgtaatcccagctacttgggaggctgaggcagaatagcttgaacccaggaggcagaggttgtggtgagctgagatcgcgccattgcactctagcctgggcaacaagagagagactctgtctcgaaaataataacaataataataaaaagagacagggtttctccatgttggtcaggttggtctcgaactcctgacctcaggtgacctgtccgcctcggcctcccaaagtgctgggattacaggcgtgagccactgcgcctggctggtacctggattttttttttttttttttgaaatagagtctcactctgtcacccaggatgaagtgcagtggtgcgatctctgctcactgcaacctccacctcccgggttcaagtgattctcctgcctcagcctcccaagtagctgggactacaggcaagtaccactacgaccggttaattttttttttttttgtatttttaatagagacggagtttcaccgtgttagccaggctggtctcaatcgcctgacctcatgatccacccacctcggcctcccaaagtgctgggattttaagcatgagccaccacacccggccctgcaccaggattttaaaaaatggctgtattgagatataactcacatgccacacaattgatctacttaaaggctacatccacttaaaggatattcagcaggctttagtatcttcacgaggttgtgcaaccatcatccctatctaattctagaacattgcatcacctgaagaggaaaccccatagccatgagcagtcactccccatttcctcctcctctcagctcctggcaacaactaatcagctttctgtctctatggctttgcctatcctagacatttcatagaaatggcatcatagtaatggatcatacaagtcatcacgtggtctttagtgtctggcttctctcacgtagcataatgtttttgaggttcatccatgttgcagtgcataacagaacttcattatttttgtgtctggatgaatacagcacattctatttgttcattcatcaactgacggacatttgggttcataaatggaaacactttggggctattatgaagaatgcagctgtgaacattcctgtccaggtttgtgtgtggactacgagcaacatttgagagagctgaagttgttctgcatccttgtcagcacttgtcattatcagttttatttatttatttatttatttatttgagatgaaatctgactctttcactcaggctggagtgcaatggtgtgacctcggctgactacaacgtctgtctcctgggttcaagcgattctcccacctcagcctcccaagtggctgggattacaggcacgtgccaccactcctggctaatttttgtatttttagtagagacggggtttcgccatgttggccaagctggtctcaaactcctgacctcaggcgatccacccacctcggcctcccaaagtgctgggattacaggcatgagacaccccacccagcccagttttaatgttttgttttgtttttgttttttggggacgaggtctcactctgtcacccaggctgaagtgcagtggcatgatcatagctcactgcagactcgacctcctgggctcaaatgatcctcccacctcatcctcctgagtagctgggaccacaggtgtgcaccaccatgcctgggtaattttttaattttttgtaaagatgagggtcttgctatgctgcccaggctggtttcaatcccctgggctcaagtgagcctcccacctcagcctcccaaagtgctgggattacagggatgagtcatcacacccggcctgtttttatcttttattttagccattttagtagctgtgtgtgcgtaacagttttcgcaagatgtaattgacaaatagtaaagtgccatatataaagtacaaaatttgataactttttctttctcttgggaaataaaggagtggcatttctgggtcacgtagtaactctctttaggcaccaaaatttgaatgggatctgtcctgtggcagggctagggtcacttctgctggcagagtccaccgccttgggaaggagaagctgagccctggctctcatcccgactcttttctctgggaagggggcaagtctgcagaaggttcaaggatccagctctgagcccctgcaatcatagctcagtccttcctgcattcaccacatgtgcactcagtcctaaggtcaccaggccaggagtaacacaacagggaacagacaagtccctgttctcaggatgctgacaactcaccttggcttgagaaggacacagccttgggccaggcgcagtggctcacacctgtaatgccagcattttgagaggccaaggcgggtggatcatgaggtcaggggatcaagaccagcctggccaacatggtgaaaccctgtctctactaaaaatagaaaaattagccaggcgtagtggcgtgtgcctgtagtcccagctactcgggaggctgaggcaggagaatcgcttgaacccgggaggcagaggttgcagtgagccgagatcaggccactgtactccagcctgggtgacagagcgagactctgtcttaaaaaaatatatattgtgctgtttgagaaggatacagtctgtctggggtcctggctgaggcaaagcaactggttctggagcccaggaataggttcttcctgcagccctccagagaagcacagagctgttactatcatacccccattcagacagatgaggaggcccaagtcccagaggaaggagggatttgcccaaggtcattccaggtgataatggctgagcagggattcgaacccatttctcagggaagggagtgatgttgcctgggaagagtgcagggtgctatgggagagccacggggggcacgagcttagtcagggacttggggatattaggcggagccttcccagagatggaagaagtaggagttacccaggcaaagataactggaagagggggaggaagttgcaggcagagagcatgacaagtgccaaggccctggggtggggaaatgtttggggtattgaagaaatggcaagaggtcagtgtggctgggggagagaggtaggaggaaggcgggcaggggctggcatcccctaggcctcataggccacagccaaaggccaggcatttggattttattctaagctgtgggaagccaccaggggattttatgcggaggagtgacttccctctggctgcgtgtgggaaataggctgtggggactgaaggaagtgggaggccggggaggaggcacctgcagcttgtggctttccctggcaggtcagagaggaagaaggggtgggagctgtctttgtggatgggctgggtggggttggagagtgagtgaatgcaaggaccaggctggaggagggttgcagccctcatgaaagggtggggggatggtggcaccaagactgggtgcccaggggaagagacagggaggaaaacgtagaaatgcatttttcttctttttttttttttgagacggagtctcgctctgtagcccaggctggagtgcaatggcacgatcacagctcactgcaacctctgcctcctgggttcaagtgactctcctgcctcagcctccagagtagccgagattacaggcgcccgccaccttgaccagctaatttttgtattttagtagagacaaggtttcaccatgttggccaggctggtctcgaacttctgacctcaggtgatccacccacctcagcctctcaaagtggtgggattacaggcgtgagtcactgcgtccagctgcatttcttttttttttttcttttttttgagacagagtttcgctctgttgcccaggctggagtgcagtgacacaatctcagctgagtgcaacctctacctcccgggttcaggcgattctcctgactcagcctcccaagtagctgggatgacagatgtgccccaccctacccagctaatttttatatttttggtagagacaggggctggtcttgaactccttacctcaagtgatccacccaccttggcctcccaaagtgctgggattacaggtgtgagccactgtgtccagcaaaggctttttagaaaaataaaaacataaaggcccaagggacaagaaagaattcctctaagtacagggtcttccacaatctatctatctatctatctatctatctatctatctatctatctattttttttttttttttttagaaatgggatcttaccctgttatccaggctggagtacagtggcacaatcatggctcactgcagcctcaaacttctgggcttaagctatcttcctgcctcagcctcctgagactacaggcatgtgccaccacccctggctaattttttaaaattgtattttagagatggggtctttgtatgttgcccaggctggtcttgaactcctagactcaagtgatcctcccacctcagcctcccaagtagctgggattataggccccagccactgtgcctggctcagagtatttttaagcataaatacagacgtgttaacacttgtgtctggtggcctctgtggaggaaacttggggtttgtttcagggcgggaaggagactgacttgttacatttttttctttcttgaactgtctggattaaaaaaaaaactttaacgaaagcatgacaatataaaagatgcaaatcagaagtgtccatccccaaaaataaaaaagaccagaagtgttcatctcaatgcctgttttcaacgtgaacccatttctgtgatcagcacctagatcaagaaacaaaacatttcagtcccacacaaattagcttctttttaattattattatttattttgatttttgatttttttagagacaggatcttgctctgttgcccaggctggggtgcagtggtgcaatcatagcttattgcagccttgaactcctgaactcaagtgattctcctgcctgagcctcccatgtagctgggactacaggcacacaccaccatacctggctaatttatttttcatagatacagggtcttgatatgttgcccaggctagtttcaaactcctgggttcaagcaatcctaccacctcaacctcccaaggggccaccacgtctggctttgataagtttttttttgtttgttttttgtttttgagacaggatctcgcttggttgcccaggctggagtgcagtggctggatcatagctcactgcagccttaacctcctgggcttaagtgatcctcccatctcagcctcccaaactgctgggattacaggcgtgagccaccgtgcccggccaagaaaaggatatttttattgcatgcatcttcacatagagatgagccaccaggaagaatcctaccaatgggtgtggaggtgggcattgttctcaaactcttcctctcttttgtccctcccttgctgccccggacagtccctgtgctcaaggataggggatcagaggtgaatcagacctgaccttgcccggtcacagcaatgtaccagcaggagagaccctggttcaactctcagcttggctactgacctgctagggggtctcttaacctcttggttcaccctcttaacctcttggagcgtcagtgccctcagctggaaaaggaacattccacagattcctggactggcagagtggttgaaagggatagaaagaaagaaagcatgagaggtacctatagtaaatgatgaaggaatgatagctaagcatggtctttccacagggcctttgtgcattctatttctgcttcttggaacactcttccaggaagatgctttaatgaggggacttccagcagcatcaccagtggcaacaggacagcagggcctggccggcagggtctagctgtccacaggactccatccctcaaaaagaccttctggccaggcatggtggctgatgcctgtaatcccagcaccttgggaggccaaggcaggagaatcgcttgagtccaggaacaaaaacaggctggattcggtggctcaagcctgtaatcccagcactttgggaagccaaggtgggtggattacttgagatcaggagttcgagaccagcctggccaacatggaaaaaccccgtctttactaaaactacaaaaattagctgggcggggtggcaggtgcctgtaatcccagctactcgggtggctagggtaggagaattgcttgaacctaggaggcggaggttgcagtgagccaagatccagccactgcactccagcctgggtgacagagcaagactccatctaaaaaaaaaaaaaaaaaaaaaaaaaagggccgagcacggtggctcacgcctgtaatcccagcactttgggaggctgaggcgggtggatcacgaggtcaggagtttaagaccaacctggccaagatggtgaaaccccaactctactaaaaatacaaaaattagctgggcgcagtggcaggcacctgtaatcccaactactcggtaggctgaggcaggagaatcgcttgaactcggggggcggagcttgcagtgagccgacatcgcgccactgcactccagcctgggcgacagagtgagactccatctcaaaaaaaaaaaaaaaaaaaattagccaggtggcgcatgcctacagtcccaactactcaggaagctgagacaggagaatggcttgagcctgggaggtggaggttgcagtcagcagagatggtgccactgcactccagcctggtgggcagagcaaaactctggctccaaaaataaaataaaataaaacgaaaaataaaagaaacaaaaacaaaataccttccctgaccatcccaggagccatttcatgcccaccaccgtcacttcccaacccccttccctgcattattccccccgccccgcccccccccgcccctgcactcactggcacctgacactttatttcaggggtttctttgccaatgtctggttccccccgatggaatgtcagccccaggagggcagggaggtttgcatctgttcactgcaatactccaagccctagagcagtgcctggcacgaagcagaggctccacaacgaagctgggctgggagcccgactcattgtaattgccccattcctcctgcacaaccttggacaacttcttccaacccctgagcctcctctaccctcctgcaaaggctcagagaaggctttgccacccaggtcgactaggagggtgccatgggttctgaagcccctccgcacccttagcagggcccagcgcaggctggctgcgatgtttgctctttgtctttacggtgtttctgaacttggagttctggaggctgcgcctgccgggccgaggagggggccctttctgcagccgcaggcggaggcccctcgcagcccgggcgcccctccaggccgcggccccggcgagacgaatgcagcacacggccgcctttatggggcccgcagacagcgcgtcgccaggctaaccctgcgtggaaaattcggaggtggaaggcgaggcgccttattgagggggccggcagcggcggcggcggcggcgagggggcggcgggggctgtgcggcccgggccggaaacgtgagccgggctgggggcggcgaccacccccgcgcattccccggccctcccgggaccaccgcgcgccccggccggcaggtggaggagcaggaggcgccctcaccgtccccgccctgggaggacgccttcagggccaagctcccctggcctcgttgacctcctccgctgaataggcccttcccttttggggcggcaggactaaattgcggcctggggcccaggacacgggagcaaccagcgacaccggtcacttacggatgctgttaacacgatggtccgccccatggaccacaaattgaggctgagacactcaggagacggtggcacactcagatgccagggccgtgccccatggcctaaggggacacctgaaccacactagaaattggagcggcccctgaaagtggaggtcattaataagatcaaagttaagggcccaggacctgcaggtgcccagcccggagctgccatggtggggctggagccaccccgaggtacctctctgaacctcagttttctcatctgtcaagtgcggatgggccaggcactgtgtcagaagcccaacgaagaacagagggcaggagccactagcttcttgactcctgggtttccatcccaggcaaggcaacagacggatgcccctggcagagggacatagaaacaaaaagtcaagcccggcccagtggctcaggcctgtaatcccagcactttaggaggccgatgcaggaggattgcttaagcccaggagttcaagaccagcctgggcaacatagcgagatcctctctctacaagacatttaaaaattagctgggcatggtggcacgcatctgtagtcccagctactcgggagactgaagtggaaggattgctcgagtttgggaggttgaggctgcaatgagctgtgatcatgccactgtactccagcctgggagacagagcgagaccctgcttcaaaaaagaaagaaagagccgggcgcagtggctcacgcctataatcccaacactttgggaggccgaggtgggtggatcacctgaggtcaggagtttgagaccagcctcctcaacatggtgaaaccctgtctgtactaaaaatacaaaaaattagccgggcatggtgatgtgcacctgtaatcccagtcaccaggaggctgagacaggagaatcgcttgaacccagaaggcagaggttgcagtgagccgagatcgcgccactgcactccagcctgggcgacagagcgagattctgtctcaaaaaagaaagaaagaaagagcctggcacagtggctcacacctgtactcctagcactttgggaagccaaggcaggcagatcacaaggtcaggagttcgagaccagcctggctaatatggtgaaaccccgtctctaccaaaaatacaaaaattagccaggcatggtggcaggcacctgtagttcgagctactcgggaggctgaggcaggagaatcacttgaactcaggaggcagaggttgcagtgagccgagattgtgccactgcactccagcctgggtgatagagtgagactgtctcaaaaaaaagagagagagaggagcgaggaggggaggggagggaagggaagggaagggaagggaaaagctgcacaggttgcatatataattaacaccctgggtccttggattggaaggagagaggaggcatgagaggatgactggaggaaggggaaggcaggtgaccctccaggatatgggacttggggaaggggcaaacccctaatttcttttttttccttttcttttttatttttattttttttttttagatggagtcttggtctgttgcccaggctggagtgcagtggcacaatctcggctcactgcagcctcggcctcctgggttcaagtgattctcctgcctcagcctcccaagtagctgggactacaaggaccccccaccatgcccggttaatttttgtagttttagtagagacgggggtttcaccatgttcggccaggctgatctcgaactcgtgatctcaggtgatcctcccaccttggcatcccaaagtgttgggatcataggcatgagccatcacacctggcccaaaggaccaatttcagactcagactcagagaaggcagaagtgaagctcagggtagccaggtgttgatttttgcatttgccgttccctcttcctggaacactttcttacccctgttgtctctgcagctgtttccctcacttccgctaggctggggcttgaagatcgcctctttaaagaagctttctcagaccatgtgtctaagccctgctgccttggcccttctctttgcccctggcaaagatacttatttctttttattatcttgcatgcctttggttcacttgtttcttgtctgtctcctccacctgccagtgagctcagtgagggtgggacttcgttcacagctatagcctctgcccccaacccagcacacagtaggtgctcaagaaatgctcaagcagtgaatgaatgaatggacaaagccaggccgtggaagacaaagaaagcctcagctttctttctggtgacttggtttctggctagcagaggacaggtttcctgagttacagataagcagaaggtcaggtgaatcaacgataagggatgataaggctccaggacccaccggctgttcctgcctcctggggccccacagaggaagctcattttcagcttactgcagaacctccagcagagccggggcctgggagctgggagcctactctgactgccactgctgcggggtgagaattctcacacattgtaaacgctgccctggctcctttctggctggggcagccaggtggacctgccctgggctggacaggaggtttccaggtccccaggatggatggtgtgtgtgacggggcctcccagaccccaggatcctcttcctgggggcggggcttgggcactgggttcccacagatagaatagcttagagctcaagggtgagccagctgcctgggttcaaatcctggctcagccatttagaattgggcaagctattccagctgtactgtggtcctcactgtaaaaagctataatagtagaagtgtgtaagaatacagtacctgggcctagttcggggctctgatcagctcctgtgccatagatcccttttttattatacatttagattcatgtgtgtgtgtgtgtgtgtgtatatatatatatatatatatattttttttttttttgagacagagtctcgctctgttgcccaggctggagtgcagtggggcaatctcagctcaccacaacctccacctcccgggttcaagcaattctcctgcctcagcctcctgagtagctggaacgacaggcacgcaccaccatgcctggctaaattttagtagagatggagtttcaccatgttggccaggctagtctcaaactcctgacctcgtgatccgcccacctcagcctcccaaagtgctgggattataggcatgagccaccacgcccagccttagatttacctttataaatgaaattgtatagcattaaagtaaaacattatattaaactaaagtcattaaaatatttaatagctgaatgtttgatatggtgacagctgtgctttttggtttttgtttatttatttatttttgaaacaggcacttactctgttgcccaggctggagtgcagtggaatgattatggctcactgcagcctccaccacccaggcccaagcaatcctcccacctcagctccctgagtagctgggaccagaggcccacaccaccacacccagataattttttgtatttttggtagagacagggttcaccatgttgcccaggctggcctcaaactcctcagcctcccaaagtgctgggattacaggcgcaagccaccatgcccagccaactatggtaattttgaaatcaggaagaggacgaatgctctttctatgacactgtaaagagacatggacaaaggatttctgattgacaaagccaccgtccagctactgccactgtggtttcccacgtctgctcgtaagggaaggaaatgccaaattccagttggcggttagtgaaaatcaggacatccctttttttcccccagtccaagttcacagatccctgaattctcttcgagggccctggaggtggtggtgagtgataggatctcactggggatggtgcaggtgcccagaaggaggggagtcagatgggggctccctcaggggtttgagctggagtgctgagtgcccagtgtaggtggcctgggttggaatcggtctctgcccacactccctggagacctcggccagtggctgctggtctccaggcctcctctgaggaatggcctcctcggcctctagggttgaataaggaggaggtgggacagcgtgtggcctgtgttggcacaggggtctgggctcttgatagaggggttgggggagaggccgtcctgtgccttggagggggccccttccccatccaatggcctctccgaggtctgggcctgtgtggaagtcaccgttttgtgtttgtgtcatctgggtaagctggtgtgtctttgtgtgttggggtggatgtgtgtgtgtgtgtgcaggtgtgagtgtaggggcacatctaggaagggtgtcaggcagtgtgagtcagcgtgttgtgtgtggctgtgtgtgtgagcaggggtccgttctgagagtgcgttgtgtacgtgtgtgtcagggtttggtatggcgttcactggtgtgtgtgtgtgagttgaaagtctctggtgttagttgatgggagtgaatgtgagactgtgggtgtatttggggacgtggggggtggactgatgtgtgtgtgtgagcacacatgcagcagggttggtgggcggtgtccagtgtgtgtctgtgtgaacgtgtgtggccctgtcaccgccggctccaggcccagccacataaacttcacacccctgcgggcgggctccagcggccccgcagcagccgcgtagggcaatgggaagcagatgggccaggaaggaggccatatggggctgggggtgggggcgcattcctccctcccagggccgccaggaagccccctgcctgccggcccccccatcggggtgggagctagaactgacacagtaacaaatgtcctgtagccagcgtggagtcagcgtggagccggcatggaggcagcccccgccccacagcggggggtagagagagagagtataaatgagggggatccaggagatgccggcggggaagatgctgccctgataagccacacctgaccccacggctgtgcacccttgggcgccgcacataccccctccgggcccatttccttggcagggtggctgttggggatggaatatagggacgttccccccaccccccaccgcgccccctcgtcccctccccccctccccccgcctccgtttccagaccagggtaggaccctaactccagaaaccctggtagatgtcaacagcaacagggtaaggagctgctaacctggaacttgactgcattccggcgctggggagtggcgaagaggtgggctctggagccaggtctgcctgggttccagtccgtgctctgacacttcctgactgtgtaactatcatctggcaagtcacctcctctgtgtctcagtttcttctctgtaaagtggaggtaataataagagcacctccctccccgcaggcggtgatgaaggaagtgcttgctcatcctaggccaatcccaggttttggccaggcttggggcttcgtaaatgttagctacaagcaccagctcctgggggcttcccacacccccaggaggttgcctggacgtactttgcagaggagaccagagaggtcaggtactcgccagttcacacagggtttaaggggcagagatgggttcaaacccaggccttccatccccggcgcctgctctcctcaccactcctcagggagcatggctggcgcctcccttcccaccctctccagctccgcccctgccctgtctagggtgagctgctgggctgtttcttgtcacatccagatgagagcagaggctggggccctcttccagctgagacaaggtccaggaggtcgctggaaaggcggcaggctcctcccactgtaaccctggccccgacggtgggagccagccctgactttcaggccctaattagatttaggcagctctgggtgcagaccctggctcccctctccctgctgtgtgacccagggcaagggcctggagcactcagagcctcaggggtatccggggacagggtagcagggactcagccatggggaaacggcagcgactgttcttgcagcgagtgtctgatgaacggcccctattagttcccccctcgtggaggtcgagatcaggcagggccggagtggagggaagggcttagaagcagagcttgctctgggtggctttggcctggtctgttcacctcctccaaggctccctttcctgtttcccaaagcaacatcatcaggcaggtttgtcgggaggcttaacaggatcatgtgaaagcacttggcacatgctaggtgctcaaccagtgctgtgttggcttctctgtctctctctctctctttctctctctctctctttttttttttttttttaattgagacagggtctcacactgtcacccaggctggagtgcaatggtgtgatcatagcttactgcaacccccacctcccaggttcaagggatcctcctgcctcagtctcctgagtagctgagattacaggcatgggccaccacgcccagctaatttttgtatttttattttattttattttttggagacagagtctcgctctgtcgctcaaggtggagtatagtggcaaaatctcagctcactgcaacctccacctccctggttcaagcaattctcctgcctcagcctcccaagtagctgggactacaggcacccgccaccatgcttggctaatttttgtatttttagtagagacggggtttcgccatgttgtccaggctggtctggaactcctgacctcaagcgatccacccaccgccacctccgaaagtcctgagattacaggcctgagccaccgtgcccagccagtggcttctctcctattcttgtcccttgtgggcccttgtagggacatctgttttaagttcccacccagcatggactctcctttctctgtgcctcagtccaagggttttgggtggggcatgcactcagtactgaccaatcaggacaactgcatcctctcagccaatgagagacaggcctgggatttttgctggacccatggggaaagaggcacttcgtttctattggggttgctaaatgggctgggtggaatcctggacttgggggttcatcctgccttgttgaggagaggcttggctgagtggaggctgcaaagatggagaggaggcaagtcccacggatgaaatgtgaatgcccagatgcaatcatgcctgggactgttgttgattcctgctttgtgggagagaaactgaggccaaatccaaggtcacagagccaggaagggggcagaactgggatttgaacccaggccgactggcgccagtggctgtgtccttaacctccagactctacagaggcctttggtataaatccctccctgtagcctgaaatcctcacccagcctagtttttgagctcagctatttctgagcttcccaagggagaatgttttctgcctctggcagaaaaatcgggagaaaatgaaagccctgtggtctggctgcaaactcaatttgggcaagcttgggacaaatgaaaattctttccttctttcgttcttcctctttctctctttctcctctttctttctttctccccctccctacctcctcctttccttcctctcttcctccatccatcccttccttcctctctcttccttcccttctccctccttccttccctccctccctccctccattcctactccttccctctatccttcctcctaaccccttcctcactctccttcctgtctgaaataaaccagagcttactccagcccatctcacatcctggtcctgctctcacctctgcctggatgacttgcatctctgcccagttccaagcctagttggccatgttgggccccagtacagccatcaccagtgacacctattaaaatgcagatccctggcagggcgcagtggcacatgtctgtaaccccagaactttgggaggctgaggcggatggatcacctgaggtcaggagtttgagactagcctggccaacatggtgaaaccccatctctatgagaaatacaaaaaattagccgggtgtggtggcacattcctgtgatcccagctacttgggaggctgaggcaggagaattgcttgaatccaggaggcaaaggttgcagtgagccaagattgtgccattgcactccagcctgggcaacaagagcgaaactccgtctcaaaaaaaataaataaaatgcagatcctggggccccacaccagcagatgcatatttgtgcgtttggggcaaaggcagaggagatgaacacccagtggacattcagatgcaggtggttcttgggacactgggtgtctagggtcttgtagggcctggaagaccaaggttaaaggttgtgcttaggggccagccatgatggttcatgtctgtaatcccagcactttgggaggtcaaggcgggtggatcacctgaggtcaggagttcaagaccagcctggccaatatagtaaaatcccatctctactaaaaatacaaaaaattagcctggcgtggtggcagatctctgtaatcccagctactcgagaggctgaggcaggagaattatttgaactcgggaggctgaggcaggagaattgcttgaacctgggaggcggaggttgcagtgagccaaggttgtgccactgcactccaccctgggcaacaagagcaaaacttcatctcagaaaataaaagaaactgagtttcagagtggtcaagcttcttgcccgagaccacacagctggtgggtggcagagctgggacttgaacccaggcatctggctccagactctgtgctcttactggtactgtaggaagctttagttttgcttattttattcactgctgcatctccagtgcctgccttgtgctgggtcttaataaagatttgttgaatgaatgaatggatggatggatgaatagattgctcattgaagggagttgactcaattagtaggtgttctgcaattgctctttctctcctaaatatgttgtctaggctggtctcgagctcctgacctcaagccatccacccacctcgacctcccagagtgctgggattacaggcgtgagccaccgtgcctggccgggagatcttagagcagtgctaatcctgtagcagagtcctggccttctctttccactctgtgtagcagggatagtagcaatcccactgctcagggctgtcatgacttaagtgagacagtgccagggctgtgcccagcacaggagtatatgctccatgagccgtaacaggtttgatcagtttcccaggctcttctttactctgatttccttgtctgatcctatctccctctcaggccaaacagggccacacatggtgccaggcacacagtagttgctcagggaagaaggatagctacatgagcgcttgctgtgcgctaggctctttttaaacactcatgatctgatctacttcttccaacagccaacaaggaatggacccagtgtttggcccagcagaccctccataaatgtttgttgagtgactgaatgaaacagcgctggctacattggcagagtgcctggcacaagctctgccagcctcctacctgctgccagctcacagacaggcctgggtttctacatctgccagcgctgccaggagatgaactggccttgggggaggtagttcccggctgtggagcccgagggagcaaagctgcaaaggaggattttcctccacgcagttcagcctgggctgagtaattgctcactgggtcttggtccagcggcggccagggcaggtaggcatggggctgcaggagtcaccagttgatagccaagcctggagttctgccagccacagctctagggcccctggatgacagcagcatcccggagatgccaccatgagctcagaggggtcccatcacttctctgagcctcagtctcttggttggcagttgccccagctccatggggctgtgtgagatttgaaggggtcctgtatgtgaggctgggacaggtgttatgattgtgtggagggcagaagctgcctggaagtgtgaaaaggcctcgacctcagatgcagacaggcctggagggccttgggtgagtcatttccctctgcaagcctcggcttcctccagcctgctgtcatgagccaaagaaaggagaaagatggttctcaaaagcaggaacttttgaaccataagtgagaaaagagtaataaccgtagtaataatgcctataaaaaagggctttcaatcactcattcatttgtttttgtttttcttgttgttgtttttgtgagacagagtctcactctgtcacccaggctggagcacagtggcgcaatcttggctcactgcaacttccgcctcctgggttcaagcaattctcctgcctcagcctcccaagcagccaggactacaggcatgcaccaccacacccgctaatttttgtatttttagtagagatgggctttcaccatgttggccaggctggtctcaaactcctgaactcaggtgatccgcctgcctcggccttccaaagtgccgagattacaggtgtgagccaccgcgcctggcctatgagagtccatttttatgttctccatattgtcgcttgatgctgtttctccagctgcctttttggtgtcagattcacaaagaaatattggcaatcttaaaatttacattgattcaattgattaaagtgccagaggaccaaaacatatgttagagtatttttgagttttctcatctgtcacacttctgttctttgccatatgtgagtttaattctttaatatattcactaaaatgttttgtttaatgtatcatgattttgaacttatactctctatttgggatgggataagcttctcacttgtcactgatagatccataagtctacaggatctctgaattccaacaatacttggacttatgtccctggagtggaccctgaagttctataactaggatgtggttaggccatttggaattaaatgctcttttgttttgtagaaaatattgatgtgttaactttgtatgcagtttttaaatggtttagaatattagtaacttgctttcatacatattttatgaaacaaagttcattttatagtgaagaattctttgacttgtgtggtttgggtgagaaaccagttttccttcattaaaaaaaattgttaagtttccctaaaattctatttattaaaaataaaactatcaaattttacttaaagtaaaaaaccttacatatctcaattatatggtatcagtgtccagtattttggacctagtagaccatattagagtttacaatagggaaggaaggagatactgccatttcttcaatcactcattcatttttgtattccttcagccagtacactttagcttcattcattcattcattcatttagagaacattatcgaacatttatttcctgccagactaggatagtcagatttagcaaaaacaggctgggcacagtggctcacacctgtaatcccaacagtttgggaggccgaggcgggcggatcatttgaggtcaggagtttgagaccagcctggccaacatggtgaaaccccgtctctactaaaaatacaaaaattagccaggtgccatggctcatgtctgtaatcccggcactttggaagctgaggcaggtggatcacctgaggtcaggaattcgagatcagtctcgccaacatggcggaaccccgtctctattagaaatacaaaaattagatcatgaggtcaggagatcgagaccatcctggctaacacagtgaaaccccgcctctactaaaaatacaaaaaattagccgggcgtggtggcgggcgcctgtagtcccagctactcaggaggctgaggcaggagaatggcgtgaacccgggaggcggagcttgcagtgagccaagatcgcgccactgcactccagcctgggcgacagagcaagactccgtctcaaaaaaaaaaaaaaaaaaaaaaaaaaagaaatacaaaaattagctgggcatggtggcatgtgcctgtaatcccagctactcgggagactgaggcaagagaattgctcgagcctgggaggtggaggttgcagtgagctgagatggcgccactgcactccagcctgggcgacagagcgagagtccatctcaaaacaacaacaacaacaacaacaaaagatttagcaaaaacaaaaacaagaagatctggcgaagcatagtggctcacgcctataatgtcagcattttgagaggctgaggggggcagatcacttaagcccaggagttcaagaccagcctatcagcctggggaatatggcggaactccatctctacaaaaaaaaaaaaaaaatacaaaaatttaccaggcgtggtgatttgtagctgtagttccagctactcgggaggctgagattggaggatcgcttgagcctagaagatggaggctgcagtgagccatgattgcgccattgtattccagcctgggtaacagagcaagatccagtgtcaaaacaaaacaaaacccaacaagatcaacaacaacaaaccccagaatgcctagttaaatttgaatttcagataaacaacaaacacttttttggtagaactatgtcccatactctatctcttagtgcaagtgtgtcctatgcaacacttgggcaagcccgtgggaggtgttttgcccgtgcaaccccatttcttgctcacatagccctgagaggcgagaattattgcccgtgaggaaatggaggctcagagaagtgtgtccttctgctcaggctcatgtggacgggcattctggctgagctgggggcttcggtagagtcccagtgtcatgggcactctgtcacccctgctcacttcctggatggcagtttcgggaacagagagcccgtcttggcagccacctgacactttcccctgccccagccctcacctgttggggaaagtccctatgggtcacccacaactggaggctggtgtagccaggatgcaggctagggagtggagtgggcagaaatcctaagctgtgcggcggagggggcatcagagggaaggagataggtggggcagtggtccccaaacctactttggccacatagcttcctgcctgccccacagcccctggtcaataatcggccttgctgacactccaggtggggcctgggcagagagagggcccctggagtcacccctctccccacctgtgtgtcgttgggggaagtcttggcccccctcagggcctgagcctccacctgtctacaaagaagcattcattcattcacttattcacacatttattcactcatgtatttgtgctttacttctatagatatttcttgagcacctgttacgtgttgggttctaggcatgaggcacagggatatgccagaaaatgagacagactgaaagcctcgctctcatagagcgaggtctatggtctgatgggggagacagatcatagagacataaggaagataattgtgggtgggaaaagtgctaagatggaaacaaggcaggggaaggtgatggagtgtgactgagaccgggcagtctgggagggcatccctgaggaggtgatatttgagcagagacccagatggtaagaaggagcctggctgggcgtggtggctcatgcttgtaaccccagcactttgggaggctggggtgggcagattatgaggtcaggatttcaagaccagcctggccaacacagtgaaaccccgtctctactaaaaatacaaaaattagctgggcgtggtggcaggcgcctgtaatcccagttactcaggaggctgaggcaggagaatcgcatgaacccaggaggcagaagttgcaatgagctgagactgtgccactgcactccaacctggcgacagagcgagactccatctcaaaaaaaaaaaagagaaggagcctgtccaggggatgcgtagaaagggagcctggtggggctgaggtgggagaggggggtgggggtgcatcacctggagcttcgaaggtcgcagttagagatccacttggctcctcctttgctttgttcagactctgtgtcacctcctctgaggagccttccctgatgaccctggctaaaccaggcccttctttaccccttacccttatctgtagatggcatcatagtatctgtttattgggtgtgtggggatatcttgtctttcttcctccacagttacaaggccagctgggtagagttatcatgagatgcctattgactcccccgtggtgcagaaaatgtggccacaaggatcccagcatgggtgctgttgatggatggcagggaaaatcagtgccgtgttttatggattgcagttttgactcaacttaagcctcagaagccaactctggaacccaagccttgagccccaaaagattcccccaaaatcacagtgacaatcatggctttcactggatgcttgctgcatggcacgcactgctacgcaacctttcaacatgtgcgattcactggtatttagtacatgtgcagtattgtgcaaccactgcctagatccagaacatttccaccaccccgaaaggaaaccctggactcacgagccatcacttcccatccctccaacaccccagcccctagaaaccactcacttagtttccatctgtgtgaatttgcctttccatattaatggaatcatgtactatgtggcctttcacatgttcacccatgctgtagtgcatatatggtatgtagcatgtaggtacacattttatttctgcatcagttgatggccatttcagtttcggttgcctccactttctggctatcatgaatagtgctgcaatgaacatctgtgtacgagttttttgttggtttattttgagacggagtctcgctctgttgcccaggctggagtggggtggcgggatcttggctcactgcaacctctgcctcccaagttcaagcgattcttgtgcctcaccctcctgagtagctggtactacaggtgtgcgccaccatgcctggctaattttaatacaaaaaataatttttgtatttttaatagagacggggcttcacgatgttggccaggctggtctcaaactcctgacctcaagttgatccacctgcctcggcctcccaaagtgccaggattacaggcgtgacccactgtgcccggcctgtgtataagtttttgtttgaatatctatcttcagttctttggagatatacccaggagtggaattactggatcatatggtaattctgtttaatttattgaggaactaccacctaagcacttcaaatatataaatagagatgggatctcactatgttgctcaggctggtcttgaacgcctgggctcaagcgatcttccttccgtctcagccttcaaagtgttgggattgcaggtgtgaaccattgtgctcagctgacctaagcaccttttaaagcactcatgatcctggggaacgctcacaacaaggcaatgagggaggctctgtgctgcccccattctgcagatgaggaaactgaggctcagaaagcagaattcatgagccaaggttacactggtgagaaatgatgatgtcaggcctgttggattccaaaccaacttgaacctaaagctgagaaggaagagtgtgagaaaaaagagagattatgagagcagtaacaagggtgacttcggtccacacttagcctcttgagttgccatctgtggaaaaggtgaggaaagaggtaaaagtcagtgtttctctatcaaacttgcatggattcccaccccctcctgctccgtcctggctgagtgaggttgggcaagctggttcacctctctgtgcctcagtttccccagtgaatggtgctaaggagaaaaactccctcaaatggtgaggataagaatgaaataaggccaggcgtggtggctcatgcctgtaatcccagcactttgggaggccgaggcggatggatcacttgaggtcaggagttcaaggcgagcctggccaacatgatgaaactctgtctctactaaaaatacaaaaattagctgggcatggtggcaggtacctgtaatcccagctacttgggaggctgagacaggagaatcacttgaacctggaggcggaggttgcagtgagccaagatcatagccgctgcactccagccggagaggcagagcaagactctacctcaaaaaaaaaaaaaaaaaaaaaaaatttaataaggctggcctgctgctatggttatcaatgttgttattatccttttctacacaagggtccccccagccccagaatcccatgctcttgtttcgggtgcagctctggggcaaaagggagtcagggacccccagaatcttctccccagggttggaaatgttgggtggcccagaagtagaagtagtgtctacttcaaaagtcccatgtccatgctacaactgaatgttccagatcagaaaacagcacatagttttccagaaatgctgggaccttatctcctcaggagtgagagtagcctggacccattaattcaccagaaacacattgtattttaggccagaaacaataataactgtggcctgttaagtggatgtcagagaataaaaatctaatctgaatttgtaactctgtcagaaggaatggggtgaccgagaattccacaggcgagttttcaacatggacacagggtggggggtccctgagcctctctgctgaggttttgcacagatcagggcttgtggagaacaatggggacattctttgagcacttgctgtgtgccaaggcacaaaacaaccctgggaggctgtactgttagaagttccgttgttcagatgggaaactgaggcccagagaggtggagacggttgcccagagttgaacagctaagaagcggctgagatggggcttgaacccagacagtcaggatctgactggagcccaaactctgaaccacgtgtgtctttctcagggaagtctggaaaaatgtggtttagtgttctgcacaatgaagtaacttgttcaactgaggtcactggctgatggtgggagtcactgatggaggaaatggggagagggcccaggaccccccaggaagtgtcccctgtctcctttgctgggtattttccttccctgactcttggcctgtttctttcttggtgagtgtatgtggggtggggttagtgagaaagggagaccccagctctggcgttgcgggagtgttaggatccaaggccaggcctgcagccctgggtccctcctgcctgggaggtacctggggaagtctgcagcctgtctacactggtgaagcctcagccccaaccagccccctgccctgcacttgccaactgggcaccgccactgtcggcaccacatccccagggtgtgtaacaagtgtcacagcctcacccagcctcagtttcctcccctggaaaatggggatagccacgacacgtggtggggaaggttatatttacatgacctgggctgttactcttattcctgcctccagtaagaagccacgtggagtgtctgccatgctgaggagagggcacccctggccggagcccagctggatgtcaggcctgaggctggatgtcaggccaaagctggctccagcccagcagcctgacacgaaggggagggaggcctgagtcggccagactcctgagtcactgtttcccggctctgccaggccaggcgggaaaagggggagcggggcggagggaggggaaggggataatctgggggagggagggagtggagagtgagacaccagttgtaaccattgttgggtgggacagacagaaagccacctgccaggggggcaaggagattctggggtgtcagagtggggtccttgcacttccctgcattataggctgcaaactcctccctccctcgccaccaacacatacacacacacacacacacacacacacacacacacacacacacacactgcactcagcttcacagctttccttctctttcttgagtgtgttgaccaggttccagcctcagggcctttgcactggctgtgttttctgcctggaacacttcaaggttctttctcaaatctcaggcttcagcttaaatgtcacctcttcagtgaagctgtccaggctggagtgcagtggtgccatcatggctcactgcagccccaacctccccgggctctggtgatcctcccacgtcagcccctcgagtagctgggaccgcaggcgtgcaccatcatgccctgctaatttttgtatttttctgtagagatggggttttgctgtgttgcccaggctggtctcgaactcctgagctcaagtgatccaccagccttggcctcccaaagtgctgcgattgcaagcctgagccaccacactggggcctgcctgagctttctttttcttgagacagagtctcgctttgtcgcccaggccagagtgcagtggtgcaatctcggctcactacaagctccgcctcccaggttcaccacccgggttcacaccattctcctgtctcagcctcccaagtagctgggactataggcacccgccaccatgcccggctaattttttgtatttttttagtagagacggggtttcactgtgttagccaggatggtctccatctcctgacctcgtgatccgcccgcctcagcctcccaaaatgctgggattacaggcgtgagccaccacgcccggcacctgcctgagctttaagtgtgctcttcctactccccctcccaattcctttagttcatccattcattcatttatttgcccggaaggtattgcgcacctccttcgggcagggccctgctttaaacagtgaacagagtagacaacctgcctgccctcatggagccatcactccacccaaggagatggcacaatgagcacaccgcacactgggctggaacaggtgtctctggaggagccaggcacaggtgggggagccaggcgcagctgggggagtcaggacatagcgcgggggctttccctgttggagggggttgagtacggtgtctcagaaagtgatgccagggagatctgcaggacgaatcgaaggaagccatgtgggtgtctgcggagagagagttccaggcagagggaacagccagtgtgaaggccctgaggcaggggtgtggtgggcagagtcaaggagcaggcaggaggccagtcgggtgggagcagagtgggcgaggccaggaggtgaggccagcaaggggacggggcgggcaggtggggcaggcaatgaggaggatgtggcttttgccttgagcccctggagggtcctgagcagaggggctgcagagacatggtcaagttccaggtggggttagggcgagaactgaccttccaggcagacaggcagggtccccccaccttgcccctgccctgagatgaagcgccagccttggatcaggaccctgtccagaggtgggccagggctctcaagccagactcgagtctgcactgggtagggacagcttcccacggccagccttccccgtggaggattgcttgcgggggaggggtcccctaagtctcttctctttctccctctctttcgtaaccatcagcctagccagacctttggtcaggcctggtggagagagtgttctctgtcatcatctggccatgggaaaggtgaagtaaaagccaccagtgacggagagaagcagcctgtggccagcccagcaccaccctcaccccacgcacccgtaggctgagtgcctcatcccttggccatggtcccccaacctccaacataatcaggcccgtgggagcctggccagaactgtggccagtgactcagcaggaatcaccccagacaggagccagagccccggtgtccagaccagaaaccacccctgacctgttcggctgggcaggaacagggacagagcaggcggaaaagctctcagcccaggatagccgggggagaggggcgtgggaagacccctgtccagatgcagttcgtggccacccaccctgatggtgtctgctgaggtccagatcgtagttttaggagggggttcgtggctgttctgcccaattctgttgaagccctgagcatcagcctggctttgatgggttatactgggctgttgtggtgtagcttgtctattccattgcattgtttctgttctattgtgtgttctggtctgttctagaacctaccaatcctttctattctattgtgtttattcattcagcagatacttactgaccacccctgtgtgccaggcagtcttccagatgctcgggtcacaactttgtttatttatttatttatttatttattttgtgacggaatctcactcactctgttgcctaggctggagtgcagtggcgcgatctcggctcactgcatggagttacaactttggatgaaatgagacctctgccccagggcgttcatggggagaccagcaactgataaatatcaggtagtggtaagagctgagaacagcagcagcagcatcaaagcagagagccacagaaggagcgaggcgcaggctgcgttcacagtgcggggagcagggtcaggagcagccgcagcctcactggcaagatgacagtctttttttttttttttttttttgagatggagtctcactctgtcacccaggctgcagtgcagtgttgcaatctcggctcactgcaacctctgcctcccgagttcaagtgattctcctgcttcagcctccggagtagctgggattacaggtgcgtgccaccacacccggttaatttttgtatttttagtagagatggggtttcaccatgttggccaggctggtcttgaactcctgaccttaagtgatccacccgcctcggcctcccaaagtgctgggattacagatgtgagccaccgcagccagccaagatgacagtcttgagcagagtcgggaaggagctgagggagggaggcacacagatatcaaggggtcaagaaaagcattctaggcagagagaacagcaagtacaaaggcctgaggctggaatgtgcctagtgtgttccaggactggccaggaggccagtgtggcagccaaggggagcagtagggaagatggggtgtgtggggacatggcttggaggaggttaaagccaggtgggagagagcaagagggacagagctctccacggtcctcctggggtgtggggccagctggatggccttggatagggggtacgcgtgtgagtgtgtgtctgtgatgtggacagatgcatgtgggtccgcgtgtggtgttgtgcatccctgtgtgtctgtgtgcgcccatccatgcacctgcattatgtgtctctgattcaggcagttagtgcttctgtatttgtaggtgcctgtgggtatctgcagtgtattgtgggtgtgtgttgtgtgtctggaatttggtgtgactgtataggagcaggtctgtgtgtgtcacgtctttttttggcaggtgcctggacgtgtgtgtggagtgttgtttgtctgccatgtattttgtgcatgtgtgggggtgtgtgtgtgcattagtctatgttcctgtgattgtggcatggtgacaagttttggggttcctgggggtgcaaaggcatgggaaggagccttcctgcagacccaccccaggccagcagcagcccctccccatggcagcagatacacactcactctgatgccccgggaggaggctgggcaagcagccccagagcagcaggcagcatcaggtggagaatgagggtgggagctcagttcagccaccttttctaggcatttcagggcctgtcagaagctcccatggaagatgtggaggttggggagcagtagacattcacaggcctgggaatgggggtgcttgagtatctggggcacccacgggaaactctggcctccttgggcttaatgggtggagccgggtttttgcacacacgtggtgggggcgactacatgtactgagctcatgccagagtatgagaggagacagtgcccgacgtatgcacagatgaacacatgtatggaaggataagtatgtgttcaagggtggacacatgtgaacacagacacttgtatgtagggacaaacatttgcgtgcagggacagacacacacatccaaatagacacacaggtgcaggagcagacacttatgtacacaaatggatgtgagtgtacatggatagacacacatgattgtcctttgtgggccccagaacctctcctgcacacacttgcacacacatgcacactgactcacatgcactcacgtgtgtgcagggcctggtctaccatgcacaccatgcatatagggtccctatgcatacagaaaatccccaaatgggcctggcatggtggctcatgcctgtaatcccagtgctttgggaggccaaggcgggtggatcacctgaggtcaggagttggagaccagccttgccaatgtggtgaaaactcatctctactaaaaatacaaaaattaagctaggtgtggtggcaggtgcctgtaatcccagctactccggaggctgaggcaggagaattgcttgaacccgagaggtggagattgcagtgagccgagatgacgccattgcactccagccttggtgacggagcaagactctgtctctcccccaaaaaaagaaagtccccaaatgtaatgtgtgcctctcatcctcagtatcaggagagtgctgagagcacacacggctgacattctctgtgtggggagccagcacatggccctgggagccaggcctggctgccttttggcctttgtgatcgggtcctgtactgtgcgctttactttctgtgccttggtctcctcatttcttagcgaggactgaagctgttaacccatgccaagtgcttggctttacatcaaatagtaaaagttactcttactcctgtctggtgccagcctaggctcatattacagacaagaggcctggggcagtggctcatgcctataatcccagcactttgggaggccaaagcgagagggtcacttgagcccaggagttcaaaactagcctgggcaacatagcaagaccccatttctacaaaaaattttttaaaaaaattagccgggcatggtggtgtgtgcctgtagtctcagctattcgggaggctgaggtgggagtatcacttgagcctgggaggttgaggctgtaatgagctatggtcatgccactgcactccggtctgggcaacagagggagatcctgtttcaaaacaaacaaacaaacaaaactgggcccagaaagagtaaggtccttgcctgggaccgcacagccagaaaatggcagattcaagattcaagtaccctgaaagtcttctgtgcccagaaatacacacacagggcccacacatccacttggaaggatacccaggactgtgcatgcacttacagccaggaccgtggccacagaaaggccctggggtcagcagaggctggaatggtcagtgggaatgttccctcccagccagggcttgcaaattccagaacctccagtgatagctttcgggagcctagattcttcctactctaacctctgcctaaaattccatttcttcttcttttccttgctttaagcaagggtcagatgattccaatgcctgcagatgctaggcaggtacttaaataagttaagggtgaagcaataggggttggtggagactgtgatgggtgtgattcattgccacgtaggaaagccggcccgctgctgtgggaaaacgggaagtcagaattgtaatagaatttttttttttaaagtgactgagtcttgctctgtcaccaggctggagtacagtagtgagatcatagtccactgcaggctggaattcctgggctcaaaggatcctcccctctcagcctcctgagtagctgagtaggtgcaagccaccacgcccagctaatttttgcatttttagtagagacagggtttcaccatgttggccaggctgatctccaactcctggcctcaagtgatctgcccacctcagcctcccaaagtgctgggattacagaagtgagccactgtgtccggcccacacctggctattaaattttttttttttttttttttttttttagagccagagtctctccatgttgccctggctggttttgaactcctgcgctcaagcgatcctcctgcctcagcctcccacagtgctgggattataggtgtgagcccctgctcccaggctgattttgtgggcaagaaattccagttgtttctaactctgtgggggtcaaacaagtctcctctgtccctctgtgggtctggttggtccgagcaccccccgtttgtagtctctgcctgttcactgaggccagaggctgggtgcttgctgtgtgccctagggaagggcctgggcttctctgtgttcaatttcctcatggccagaccctggggaggacacacatggtagagagctgagactctccaggggagagccagacctggacagcagaggaaggaccgtcatgcctgaaaaagtcatttctctcctcatccctactctgcccgtctcctgctatccgcagggaacttaatggagaaaacaccctgccagtgcctgttttcctttccatcctgcggtgggtgccagctccagatgagtgactcagggcttcccatggcagcagataaacactcgctctgatgccccgggaggaggccgggcaagcagccccagagcagcaggcagcatcaggtggagaatgagggtgggggctcagctcagccaccttttctaggcctttcagggcctgtcagaagctcccatggaagatgtggaggttggggagcagtagacattcacaggcctgggaatgggggtgcttgagtatctggggcacccacgggaaactctggcctccttaggcttaatgggtggagccgggtggatagaggggtagggtgtcagaattggcttaagaatttcagagtgggccgggcattgtggctcacgcctgtaatcccagcactttgggaggctgaggcaggtggatcacgaggccaggagatcgagaccatcctggctaacacggtgaaaccccgtctgtactaaaaatacaaaaaattagccaggcatgctggcaagcgcctgtagtcccagctaatcgggaggctgaggcaggagaatggcgtgaacctgagaggcagagcttgcagtgagccgagatcgcaccattgtactccagcctgggcaacagagcgagactccgtctcagaaaaaaaaaaaaaaaaaatttcagagtgaggcaggtcccagcaggccagggtcattatggcagccttcctggaggagggggctgaaagtagctctgtggctgctagccttgaagtcaggatacctgggctcacactagatggttggaaagcatgaaggcagtgactatgtcatctcagtcacttgtgtcctcagctcccagaccagagtctggtatacagcaggcactcaataaagatctataggccaggcatggtggctcacgcctatattcccagcactttgggaggccaaggcaggaggattgcttgctgccaggagtttgagaccaagcccaggcaacatagcctgtctctccagaataaaaaacaaacaaaaacatttagccgggtgtggtggcactcacccatagtgccagctcctcagaaggctgatggggaaggatcccttgagttcaaggctgcagtaagctatgatggcaccactgcactccagcctgggtgagagagtgagactctgcctctaaaaaagtaataattaaaaaaatatttgtaggccaggcgtggtggcttatgcctgtaatcccagcactttaggaagccgaggcggttggattacttgaggtcaggagttcgagaccaccctggcaagcatggtgaaaccccatctctactaaaaatacaaaaattaaccaggcgtggtggtgggcacctgtagtcccagctactcaggaggctgagatatgagaatcgcttgaacccaggaggaccttgtctcaaaaacaaacaaaaaaaagatttgtaaaatgagatgacagaaaataatagctttagggaacactcaccctgggctaagaaccgtgaacaaccctatgaggtaggtgttattattatcttctattttatacatgaggaaactgaggcacagagaggttaagtaatatgcccaaggtcatacagctagcaagtgacaaccagggttcaaacccaggcctgtctgcaaagcccagggcatatcacttcctgaatggttcgatgtctgtcactcccacggggcggtgagggccataaacgctgggcttatctgttttggtccctgctcatctattttggcctggcatatagtagatgcttaataaatacttgttgaataaattacaaaagtcctttgggtcctcagacaagtcacttctctccaagctttggtttccccatctatgcaatgggcatactctaagtaccaacctcattgtgttgttttgacaaagaaatgaaagagtggaggaggattgtggctctgtaggaaaagttccagagtcagccagactgggttcaggtctacactgcctacccttccagctgtgtgaccttagacaagttccccaccctctctgagctgcagttttcttatctgtgtgatggaacagtttggaggctgggaatctgggttctctcgggcccctgtcaagctctgcctcgggtaacgactggccctggagcctccacccctcagatctcaggggcactaaagcttctgaggaggtggcttctggactcatctcagacggggcaactcaccccagcaggcaggcagagaggatggctctctttgggcctgacctagggctaagaaccttcttgttggagtgggacagggcctgagctcagagttccagctgcctagcaggtttgagcttgcactgggttaagcaacgccctaccccactccacctccaacgagggagatgggagctcttttgaaccaagcacctgctgagtgccaggctcctgctctgaaacccctcaacctccctctcctgtgaggtgggggccagggccatgcccatttcacagacagaaaaacaggttcccagaggaacctcacccaagatcatagatcccagctcctccagctctgagctgtctcctctgcctgacccttcttagatcgaggagggagatgggtgagaacgttctctccagagaaggaaggagtctgatgactccacagcaggcaggaatggcagctccaactctctttaggggtctgtgtcattttgcagccttaggagcagcttaataccattttcagatgagaaaacagcccatcttcttctgcggggtgagcgctccttctccttacactccctctctccctcccccttccctccgagccctgagtaatctgcccctatctcttgctgttcctcagacatactgggcgcacttccaccccagggcctttgcttatacaggtccagctgcctgggacgccctttctcctcttctcctggtggctccttctcttccttcaggtctcagctcaaacctcatctcttcggagatccctcagcagccctaaagcgcccccagctcagccccctgttaagttttctttcatgtcctggtcgtatctaatgtgatctcactggttgcttcctttgctggtttcttctctgtctccccactggaaagtgggctccctgagactgggtctgtccatcccgttcatgctgtgtccccagacctagcccagtgtttggcaagtccgtgtctgctgcaggagtcttctgaatgaacttgggcatagctaaatgcctggcaaagtctctagtgacatcagctgcccgaggggagacaagttggaagaatagggaaatcacacaaacttgggttcaaatcctgcttgctgtgttaccttaggcaagtgccctgtgccctctctgttttgttttgttttctttttctggagacagggtctcactgtattgtccaggctggtctggaactcctaggctcaagagatcatcctacctcgacttcccaaattgctgggattacaggggtgagccaccgtgcccggttgctctgccctctctgcttctggacttccatttcctcggctagattgagggatgaccacagtgactatctccaggattgttggaaaacctagagattcgatgagaatgggaaccagccagccccaagtggtgcccatatactgtcatccctgccaccctcttcaccttcccagccccgaagttccccagctggcagggatgagtggagaggcccctgtcaatggtgtctgtgctgaacaagtcccatttgctgctgcctcctccccaggccagaataaacgtgcacctgccccaggtcacagagcacacagcagggagccgagggggtggggcagggagctgagggctggagcagggctcctggtgtctctgaggacaaaacagtccattgtggccctgtgggtattgagggaatcacagggcctgaatggaggcgggtgaggaggcagggcaggtgtgggagcaggtgtccacggtcatcccacggcatcgcccctggggggaagtgcccccctatgcgtgccctggaaccggcctggctggtcggacacctgtcccctgcagcttcttgtcaggagacaacataggcgtgagccaggccccaggggtggggtgggatgagggagtggggggtgggatgagggagtggggggtgggatgagggagtggggggtggggaagtagaagatgggaaggatgggactgggggacagagactctggggtctagggcagagagacccaggatagaatcccagccctgctccttcaggctgggaacactggacaagtcacctctttaagcctgtttcctcattcacaaagtggggctgaaactcccctctgtgccccagtgaattttccaggcacacgcatggggcggggtatggggggctttgatgatttggggcctcagtctgcccacagcctccctcccagaaagggttcatcattcttttactgaagaaacacttaatttagaaaaggccgggcgcgatggctcacgcctgtaatcccagcactttgggaggtcaaggtgggaggatcgtgtaagtccaggagttcgagaccagcctgggcaacacagcaaaccccatccctactaaaaatacaagaaattagcaggcatggtggcatatccctatagtcccagctatttgggaggctgaggcaggagaattgcttgaaccccagaggcagaggttgcagtgatccaagatggcgccactgcactccagcctgggcaacagtgtgagcacctgtctcaaaaccaaaacaaaaacacactcttattgagctcctactgtgtgccagaaccatgctaggtgctggggacacaaaagtgagtgggacagacaagtttcccttactggggaagaagacagaacatccaaaggataaagaatgagcaagagaattccagacagtgatgcgggcaccaggaattaaattgaagttgtgctggagggtgactccacagtgtggtcaaggagggctctctgaggagggacctgaagccccgaggaggagaagcagaaaagaggagcaggtggggagacctgggggtgggctgcaggcttcaggcaaaggcctgtggtaggactgagcttgcatttgcacttgcagaggaagtgcggggagcaccccagcccaggaggtatctggcccgaggggaccctctcagcctacccctgcccctccctgtccccggaggctgaggctaagaggcaaggtgcgggccaggctggaggaaatggggccaagacccgtctggccagcagactctcctgggactgctaatatcccaagtgctggtgacaagacacagccccgggtggcagggggctgggggcctgagactccgtaaacagccctggctcgtaaagctgatcaaagcagcaggcctgtcccagccctggccacttcctgcagggcccagagccctggcctgtgggagatcctgggaagggcctctcagcagaggctgctttggggtctctaggcactgggggcaggggcaggggcagggccaggtccccgagcctgtcctggcttcggttttccctcttgttttgcaatgaagactggctggaacctctgagaagcctgtttcactgcatgtctttgacaaaagcttggcctctggaaccggaggtctgggggtttgaatcccagtcctgctacggtgtgacctcaggcagtgacacccgcacctcccctaccgcccaaaactgtccttagctctaaaatgaggataatgatggtacctatttcaacagccttagactgtgaaattttattgatatgatttctaattatagttcattaattatctaatgacaacagtgacagtagcaggcatcctggtggaaaaggcatcccaggttgcaggactggctgaggtttgtggagccaacggcaaggattgttgggaaggtcccggctcccatgtgctcctcctgggccaggtctgggcaaagagaggccccgaggtggaggatttccaggcggagtggaggttgccagggctacagcccctggcctgacgtgaagtagcttttcccaggcctggctccaagaccccaggggtctcactctctcaaatcggcctgagaagatttgaggatgaaaacagacccaggactcggccaagtctcccctccctgttacccactcagcctggccccaccctctcacgcccggactgttgcggtggcctcctgggctccctgcctcccattcagtccccttcggtccccttttggccacagaagctaagtcagacagaccctgtccctctgctcagagccctccagggttcccaccccactcacaaagcctgagccctcccacagcccacaggcccaaccagccaaggcggagtaggcctgtcacctcccaacgcctccctgtcactcactgagataccgcctcaccacgtaaaaccaccacggcccgcatgccagctgcctctcccggcctggtgttttcattttctttagcactggttcccttctgacgcctggtataaaatccctgttcatcttctccgtctctgccacaggagagtcagcaccatgagggcagggatttttgtttttgttttcttccattttgttcccagccatatctatacccagttcctaaaactggaggcacttaataggtgtctgtgggaggcaggaacgggtcctcaccagctctaggggcaggtactatcgttatttccactttacgaaggaggaagtgaaattgagcaagacctcacacagctgggaagcggaaagtcagtgccttgatgatcatgatgatgatgatgataacaacagctaagatatattaagcacctactgtgtgccaggcaccgttctgggtgctggaacaatagcaaaagaaaaacaccaggtgcggccggcaaggtggtgtgtgcttataattccagcattttgaaaagccgaggcaggcagatcacttgagcccaggagtttaagaccagcctggccaacatggtgaaaccccgtctctactaaaaatacaaaaattaggctgggcgcaatggctcacacctgtaatcccagcactttgggaggccgaggagggaggattacctaaggtcgggagttcgagaccagcctggccaacatggagaaacccccatctctactaaaaatacaaaattagctgggtgtggtggcgcatgcctgtaatcccagctacgagggaggctgaggccggagaatcgcttgaacctaggaggcggaggctgcagtgagctgagatcgtgccatcgctctgagcgacaagagcaaaactccgtctgaaaacaaaacaaaataaaacaaaaaacagcacgaaaattaacctggtgtggtggcacatgcctgtaatcctagctgctcaggaggctgaggcaggagaattgcttgaacctgggaggcagaggctgcagtgagccaagattgtgccaaggaagaaaaggaaaagaagaaaaataccaggtgcattgtaagtacgttacagcagataactcttggaatcctcagtggggccctctgtggaggggactattactgtccccatttcacagatgtggaaacagaggcccagagggattaagtaaccggtctctaacaacaacagctccaacagcagcccccatgtactgagctgtgctctgggccctggcattcacccggtatccctcacctttcctacgcttttggttatcctctacagcaaagaacccagcctctggagaagcagtaagtcccagcccatttcccaggctcttctgccccctgggcacacctggtaccaggcatggacaggcccaaacaccgaggccattgcacatttgctgcctcagagggactcaccttggtgtctcagtttcccaagactcttcggggtctggggcccatggaacgggtaagcagttctttctcattcacacctgggacccctgctgtccccagggagggcctgaggaagtgttggccactctgctgtgtgaccttggacaaactgctgtgcctctctgatcttccaggctcaaccaactccatggggtggtggcttgctgagaaaactgtgggctaggatctgtgagccagggtctgggaggagtgaggaccattcatagaaagcctggcaactgggagcacctgcatcctgcctgggaggaccacgtggagggagcagagccaccttcacccctgtctcgggcctgttttcccttcccgctctgccctgtactttgcaagcccccaagagatggggttgggtcctgtccactgctccccctccctgttttggccacactttctcactaggaaagaaaatgaccaggaggccacattctccaggcccccaaagcctgcaccagggtctctcccaatccacatcattccaccttttcccgctgccactccacctctgtgaccccttctcctgtcactcagtccttgcaataactaaggattcagccagggttatggctctgcctcttttttttttttttttttttagacggagtctcgctctgtcgcccaggctggagtgcagtggcacaatcttggctcactgtaagctccgcctcccaggttcacatcattctcctgcctcagcctcccgagtagctgggactacaggcgcctgccaccatgcccagctaattttttgtatttttagtagagacagggtttcactgtgttagctaggatggtctcgatctcctaaccttgtgatctgcccgcctcagcctcccaaagtgtggggattataggcgtgagccaccgcgcccggccggctctgcctcttttgccgattgggagacaagtgcaaagaggtacctggcatggttctgagtccagggaaagacaggacgccatccccagagggccatggtgatctctccagaggccagccctccccactgtgcccttgcttggggcaataatggctcagctgatggaccacgcgcggtgtgcactgtcccccattttaagaaagagggaactgggcttcagaggggacagccacctgcccgaggtcacccagccaggaggtggcagtgcctgtctgatgcagagcctgtgagtatggtgggcaggggagaatgaggcccagcgagaggaacggccctgcccaaggtcatgccaccgctaccagggcgcagaccccccaggctgggccagtgctgagagcactggaatcccaggcagagtcttcccatgaccctgggtgggggtgggggctggcctggcatttcctgtttgggcaggacccagggcatggcctgagtggggagatagggagacttcctacggcccctccccgctcaggaactagcccaggatgcagtgcggggcagggttggggcccgtgtcctgggtcccaggccagctctccccttgatatcctggtggtcttgttctcgtcccccaaccccacctcagagtctccacatccttggatttctccattctgggagttcaccattcaatgaacagatccagttccaggtctttaggagagcctgaagccatgaccttggacaatcacctcccctctttcagcctcagttgcctcctctgtcaaacagggtgattgattgtgaggatgaaatgagaagtcgcctgcccagcacttcgggaaccccactgccccaagggagaaagtcaccaaggtcctgacaatgacctcatgtgcttcccagacacagacccgaggccacagaggttgggggacctatgtgaggacacacagccagctgaggcctctccactgccatttcctgggacacagccatgaagtaccaagagggtgcactattgtgtccagtgcactgagttcaccccagccatgctgctcactggctgtgagtggcactgggaaggtcaccttacctctctgagcctcagttttctcttcttcaaaataggaagaaaactaacctgatggcagaacttaatgagccgattaagtgcacaagccaccagtggcagagtctggcacctggtaattcatggtctccccagaggaggaggctgtggtccgctgtctcgggtcccttcgggtgggatgaagggcccccagctgggaagggtcgagtccagctgaggttattgggacagccaggagcagtggctgacccatgctctatgtaagcaggaccaagctcgtctgcacctcaacactccacagcgtctgccctgtcaatgctctggggtataggccctgctgacctctcccaccttattcccccaccacactcctttgctagcaccattctctaaccacgaagcccgctttgtgttcctccattctacaagctcattccagcctcaagatctttgtagctaaaggtctctctccctaggtcacacacccccacccccatatttcccctattttattttttatttgtatgtatttatttattttgagacggagtctcgctctatcacctaggctggagtgcagtggcatgatctcggctcaccacaacctctgcctcccaggttcaagccattctcctgcctcagcctcccaagtagctgggattacaggtgcatgccaccacgccaggctaatttttatattttcagtagagatggggtttcaccaagttggtcaggctggtcttgaactcctgacctcgtgatccacccgcctcagcctcccaaagtgctgggattacaggcgtgagccaccttgcccggctcccctattttatttttatcttctatcattggaatctaaaacaggacctagaataatttaggcactaaataaatgaaaggcaatgaataaatgaatgcattctgattttgaatctaatgagtctttgttttttaatagacccatttaactcatttacatttattgtttaaatggatatgtttggtattgtgtgattctgtattgtgttttctgttaattgactgattgaatgaatagatgaatgaatgagtgagtgaagcaaagtaaatttcaggttgctggggtgggctgaagattggagctttcctgggctatccagggtgaaaagagcaatggcattgaccctagacccctcacttttgcaattatttattccacagcccttgatcccccagatgaaggatctgtccattcttctcatctccagcctctccaatgtaaccttcatcctgtccctcccaaaccacctccccacacagggagcatcaggcttatgattctgggttgtaagttagattctcattcccatgcctgctcccccattaactggtggtgtggccttgatttacctgagtcttcatttcctcacttgtaaaatgggatcatagtatttgcttcctactatgactgttgaaaggattacatggaacaacttgggtcaaagggcttagcacagtgcctggcttagagaaagcactcagcaagctaagatttcattattattgttgttgtacctcagtttccttccattgtaaatgaagctgattttcacttcctttcaggcaccttaggatccctagcctcaaaatctggagctggggaatctgtccaacccaccttctcactgtgttctctaccctcagctcccagagagggaatttctggggactctaggggatcctcagaggcctgacctgccaccaggaggtggggagagaagacagcacaaaaaatgtgaaagcttcttcagggactgggtgtggtggctcacacctgtaatcccagcactttgggaggccagggcaggaggattacctgaggataggaatttgggaccagcctgggcaacatagtgagaccccatctttacaaaaagctaaaaaaaaaaaaaaagagcttcttcatgccatctctgtggccacatcagcattatccccacacacagatgaggaaactgggactgcactcgctcatttaattccacagacacacccccctgagcacctactgtgtgccaaactgtgccaggccacagggcaggcagaccaggcctctctcccccagggctcatggcccatcagggaagacaggaaatagcaagtcagcccgggaggatttaaatcaagcgccttgcccagcccttcaaagcctcctagagaattttccagcatccctgcctggtgggcggccctgctcccttgctcccttttctcaaaagagaaagcccgaggccagagaggggcgttcccagcctggctggagtcacagcttccgaggggtggtgacagtcttcctgcctttgccccagctggtgtccctgccgggaatactcttctcctggtgggctgccagcagatcctgcccagtgctgggacactgccgggcgtcacttcctctgggaccttcctggctgagagggcaaggcgctgacactcttgctcagcgccagagggtttcctctttcataatgagtttcctactcactaggaaggtctgcgtcccttgagactctgagcttcacgaggggcacaggctttgccatcttcctggcacctctcacctgcccaagcaagatgggaacgaggcgctgctgggtccctttctcaggaagacgcccctacctccgctccaggcgtggatggcactgaaggcctctccctgcatcttctcctgcttcaattctgcacttggtttatggagttatttcttttgatttttcttaagaccttaagtgcttttttttttattcttcttgcccaggctgcagtgcagtggcatgatctcaactcactgcaatctctgccgcctggtttcaagtgattctcctgcctcagccccccaagtagctgggattacaggcacccgccaccacacccagctaatttttgtagttttagtagagacggggtttcaccatgttggccaggctggtctcgaactcctgacctcaggtgatccagccgccttggcctcccaaagtgctaggattacaggcatgagccaccgcactcggccaagtactttatttttttaatttaaatttttgtaaagacagggtcttgctatgttgcccaggctgatctcaaactcctggcctcaagcaatcttcccacttcagcctcccaaagcactgggattacagccatgagccactgtgcccagcctgtggggtcatttcgttgtctaactccctttctagaatgttgtctctgtgaggacaggacttttgtctgtttggggcaccactgtgtccccagtgcctagcatggtgcttggcacataggtgcttaataactatctgtggaaggaagggaagaagagagggagagaggaagaaaagaagaagaggagggagggagaaagaagaagggaaggagacagggaaggggaggttgccatttatttgtccagtttttcatttgttcattccacaaatacttattgagcaccaattgtgtgctagttctggggagagaatggtgccagacacagacacgatcctgccggcaaggcactgactttctggttagtgagaaccagtcaggttcagtggcggaaagtgtggggaggcaaggtaaggtgggcgaggggctgcagacagcatgtcgggggcacctgggccaggctgctggcaggagggctcagctggcagggacaggccccggctccccctacccccagctggcagatgcacagggctgtggtagctgtgggcagcccggttgccaaatgccaccacagctgcgtcactgagagctgggagggccccaaggctgagggggctgggaggggcccccacacccaggctggctccagccccgaagcagatagaactggtcaaaggcctgccccgtgcccactgttccccactctatgtgatgtggctacatggctacttcctgttctggaccattttcaatttgcaaaaaaaaaatggtgcaaaaaatgtgttaaaaataaaatgaaaaagaaagaaatggtacttgagcctctgtacatgttcctacctccaagagagaagttaaccgtggcagtgaccgtgggatgctcctggcatccttctgatctcagcccctccccgccccctccagaggcgacatcatcccgaacctggcatccatgactctgtgtgtgatttcatagtgtaactttcctgggtctactttagtgtgtccctgggcaaatcactcatcttctgtgagcctcagtttcctcaactgcaggatggggataatagtccccacgtcggaagagtcttgaaaattaaatgagtgcgtctgtgtaaagctctttgatgggcacctggcactacataagcattcgccagtgttgctgctggacacccagaacagggggcagacaggtgtcacttgtgtcaagaatataacttttttttttttttttctgagacagagtctcatactattgtccaggttggagtgcagtgatgcaatcacagcccactgaagccatgacctcctgggcttcctgcctcagcctctcaagcagctaaaaccacaggtgtgcaccaccatgtccagccaattttttatagagacaaggtctcgctatgttgcccaagctggtctcgaactcctgagctcaggtgatcctcctgcctcagcctcccaaagtgctgggattagaggcatgagccactgcacttggccaagaacccaacctcttaaacaagctcatgcgcggcggtgccaggattcacaccagtggctggctgcagagtggcattacagaggagctgggtgttagctctggtttattctgtttcacttcctgtcagatttgtctccctgatcagttctgaaaaaccagggtcagtgcctggctggttctctgctgtcacccctgccccagccctggagactccaaggatgggtttgtggagtgaacgaaggggactcagtttcctcatctgtgtgatgggtcttacaggccgtaggaaggcgagagtgcccaatgtgaagtagatgctttataaacccttgtttgtttcttcctcttccagctggacctcctccccctcccccaggtctgggcctggaccccactaccttcagggcagccatcatgctgacagagccctccgaggcagtcagactgggctcgtcactgactcactcattctttcatataatcatatattcatgcacactcgcattcaacaactgttttgagctgtggctcatgcctctaatcccagcactttgggaggccaaggtgggcagatcacttggggccagaagttcaaggcaagcctggccaacatggaagaaccccgtctctacgaaaaatacaagatttagctgggtgtggtggtgggcgcctgtaataccagctacttgggaggctgaggcacgagaattgcttgagaatcgcttgaacttgggaggcagaggttgctgtgagccaagattgtaccactgcactccagcctgggtgacagagtgagatctgtctcaaaaaaaaacacacaaatgttttgagcacccactatgcgccaggctctgctctaggctctggggacatggacgtgaataacacaggccaaaatctctgtcatggtggggctgacacctgtctggggagacaaccatcagacaatggttgtggcactgggtgacccaagtcagagggaagggaggggagggagagggggctgggccttatcctgagggtgatgggggcacatgagttggcagaggccagacttgatatacgttcttcatgcttcactctggccccagcagaagcgtgtgctggagtgaggcttagcacagatagaggtatccgcaaaccctgccgtgtcagacctggtctgagttccctaggaacaggcccatgatgtgggagccggggcttccactgtcccactgtcctcgcaggggatgggatcaggtgtcagcacctccccatggagtacagttgggcaatggccttgggcctgagggctgttcagtcctgtgaccagccaggccccttctgggaatggaaccacaccccaacccccaggcgatgacgtcccaccagggtgttccccacacagttcccaccagccccagatgaaaacaactcaatgctgcatccaccacccaaggcctcatcaaatccaccaggatccatccagacggcagaatattctggagtctcggacaggcaggatggggcggagttttggaccacaggcctggcctgaacctgagttctccagtcactgctgtgtggagttgggaaggtgccttgcttctctgtgcttctgtttccttatcctcaaaatggggatgatgataacaacagaccctcggccaggcatggtggctcccacctgtaatcccagcactttggaggctgaggtgggcggatcacctgaggtcaggagttcaagaccagcctggccaacattgtgaaaacccatctctacaaataattaaaaaaaaaaaaattagctaggcatagtggtgcatgcctgtaatcctagctacttaggaggctgagtgaggcaagagaatagcttgaacctgggaggcagaggttgcagtgagccgagatcaagccactgtactccagcctgggcaacagagcgaaactttgtttcaaaaacaaacaaacaaaacacaacaggcctggcacagtggctcacgcctgtaatcccagcactttgggaggccgaggtgggcagatcacaaggtcaggagttcgaggccaccctggccgacatggtgaaaccccatctctactaaaaatacaaaaattagccgggtgtggtggcgggcgcctgtaatcccagctactcgggaggctgaggcagaagaatcgcttgaacccaggaggcagaggttgtagtgagccaagatcgcaccactgcactccagcctggtgacagagcaagactccacctcaaaaaataaataaataaataaataaataaataaacaaaccacaacagactctcatgataggttcacttcaccctgggttaatgagttaatccatataaagcagcggtctccaacctttttagcaccagggaccggtttcgtggaagacaatctgaaaggggctgggggttgtgtggggggttgtgtgttgtgcatatctctcgtatatgcaatctgcaatagggttcgcacttctctgagaatctaatgatgtgggtgatctgacaggaggcggagttcaggcggtaatgctcgcttgtctgctgctcacctcctgctgtgcagcccggttcctaacaggccacgaatgggtacctgtctccagtccaggagttggggaccccgatataaagcctcagactgtgtctgatacagactaagccctagagaaactttgctgttgctatgattattattgacattattgatattattgacattatcattaggtcgggcacggtggctcacacctgtaatcccagcactttgggaggctgaggcaggaggatcctttgagcccaggagttagaggccggcctgggcaacacagcgagacctcgtctctagaaaaataaaaaaacaaaaaattagctgggtgtggtggcatgcacctgtagtcccagctacacaggaggctgaggcaggaggatcacttgaatctaagaggtcgaggctgcagtgagctatgattgtgccactgcattccaccctgggtgacacagtgagactctgcctcttaaataaataataattaatttaaaaataaaagcattagcagtagtagtagtagtagtagtagtagtagtagtagtagaagtatggattaatccaagggggaaaaaaggagggagtgggactgaggtaaagcaagctgctacttggagaaaaaggtaaagaagatgaccagatagatgcgtgtgtagatgttcacaccatctccagagacccaagagactggcggcagtggtggagggagtggggacctgagggaggggaaaggacaccgactttccaccctttgtccccttccacgctgtttgggttgttcctttttttctgtgcacttgtgtggatattcaaaaccaaacactacagaaagaaattctgcaagaggtttccttccttagcgaaagccccaaatcgtccctctcagccccgccccctcccacccccacatcccggcctgtgggtggcccagtctggtctcccacctctgctggtgttctgcgctcctggccttggagcaggtccgagctggaatgccctgcaagaaagggggctcctcagagtccctcagagtggccctggctctgggcagccaggggtgtggggctttggggaggggggtcccggctgactgatgagaactccaaatgctccccagccccggctgctaatcacttccagattggccgggtcagggccagggccgccgccgcctggctccataaacagcccgtcgctccagatggcggctggctccagcctggcgagcaggttcatgggggactggggggtggcagcaggtggaggacccccacctcactagccgcctcagctgccacacctccacaccgccctgagttggggaccctgggccagaaggggtggcagaaactgaacccattgctcagaggagggaaactgaggcccggaaggggcaacgtgggtggtggtcaaggtggggggaagacagagatgtaaggggggtgctccttgagggttgatgctgggttcactttacctctgtgaatccagcacaccatgaggatgccgtaaagacccgaggagggagggaaggggggcatcattgccagctgggtttaaattctggctccagcttttactccctgagtgaataaattatttccacccccagcctcagttttctcatctgtaaaatggggatggctggagtacaggattgctggaagattcaatgattcggctcctgcagacagtttgcactccacacacggcgcaggcgctgaacacagcttctccctcttccttttccggaaactccttctattcctgcttctcctgccgccggagagcacagtggcctcctccaggaagccaccttgacttttactcagacctctccctttgtgccaggcactgtgcttttcccacagcctctctcacagggtctctcctcgacacaactggcacctgacgctcttgtccttttgaaaacaaggaaacagagggtcagggaagtaactggtacctagtgctgttagggccccgccccttgcagatgaggagacaaagggccagggaggcagtgggatggatatgttgaggtcgccaggaaaagacagcctgatgtgcacctggagctgtctctgaaggtctcacagaacctggcacagcgtcaggtaacccggctgcctctcctgccacacccaccaaccccagagcccacaccttggcacagaaggaagagatccaggctggtgctgggtcgtaatatcccagggaaaggggtaaggagccttgacctgctcccatacctgcctgtctccaaactgggctggatcctggctgggtggccgctgggtggtagccttgtcccaggacacccggcagcaggacaaggtgggggagccagttgctctgtgagttcccctcaggaccatcccttcctgctccgctgagcagagacacagctccccgaggcctgagtccccatttttcaccatctttatcctcgttcctggcacagaaaagcctcagtatcactttgtcgaatgtggtattgagtgcatgggtgaggcactcctccaagcaacttactacagtaactttttaaatgtttacatagccctctgagaaggggactattattattgcccgttcacagatgaggaaatggaggctcagagaggttaagtgacttactggaagtcacacagctggagctaggatttgaactcaggtctcctagctccagcgtgcacattcttgcccacatgtctctgctcccagggtagcagtgagcctgaaatacgtgcagtgcctggcaggtagtaggtgcttttccaagcccttcttttgcttcactcagccttgaggtcagcggcccgttctgccctgtgcctgggaggaatgttcgtggtggccccagcctggatccgagaagaaaggcagccttgtgggcgaaaggtgagcggctgggtgggcgcgggcgtgtttatccagggccggcgtgtggctcggggtggcgccgctgtcagccgcgccggctgccccaggcctgtgctggcctccagatgtgagctggctccagccggccgggcccccccaccccacgcacagaggggctttatcaaaagcggctgtgaggaggcccaggaggccgcctggctccagcctgctggctctgagccccgggcctgcagaagccaggccagtcgcacttgtgctcttgtgccctggtcttcgtgtgctccacggcccagctcctctgttctcctcgagtcccctgggggcccaggcgagggacagcccctttgccaggaaactgaagctgcaggagcagtccgggaggggtaacaatgccagaaccctcctgcagcgtttatttttctgcattccaggggggtagaggtaacccacacggaacaaaagtgcaaaattcatcaaaattcagagagtgctcagtgagacatcaaagtgtagacactcgtgggaaggagaaattgcagattcagagagccagttcttagcggggaggagagtaactggggttggggggtttgcaggggctatgttttctctgcggtattttcttttttaggtgggggtgggggtgttattctttttctttttcttctttggagacaggatctcgctttgtcatccaggctggagtgcagtggcgccatcgctggctcactgcagcccttgacctactgggctccagcagtcctcccacctcagcctcgcgagtggctgggactccgggcacgcaccaccacgcccagataattttttaaaaatagagacagggttttgccatgttgcccaggctggtcttgaactcctgagttcaagcaatcctcctgccttggcctcccaaagtgctaggattacaggcgggagccaccacgcctggcctccagggatgctattctgtatattttattcagtggcctgaactattttgtaataataaatcataataactgggaaaaaaaacagagaaaaaacctgagacatccacctgctcccgaccctcagccctactcctgttaaaaatggcttctaatgctttctagagattgtctgaacacccacaagaaaatccacatacattctctgtcctcttttgtttttggttttataaatagtatcaaaatatagtctgagcacagtggctcacgcctataaacccagcactttgggaggccaaggtggacggatcccctgaggtcaggagtttgagaccagcctggccaacatggtgaaaacccatctctactaaaaatgcaaaaattagtcgggcatggtggtgagcacctgtaatcccagctgcttgggaggctgaggcaggataattgcttgaacccgagaggtggaggctgcagtaagctgagatcacgccactgcattccagacagaatgagactctatctcaaaaaaaaaaaaaaacaaaaatgctgctctgcacctggcttttttcacttagcagtatactccggccctctctgcaactgtccttgtttgcagctgtgtggtattccaccatgggaatgcaccacgtccagttttccaggcccctgttgatgatgatgtaggttgctgcctgaggttcactactacagaccacactgactacgggcacccggtgtccgagtcttcgaggactcaggcaggtgctgtctagactctgatggtcaattcttagaggtagagctgtgcagggtagacacttttcctcttctgagagccattgctaatttgctttccccaaagtgtgtgtccctgtgttgtcccaccagcactgcggctgaaagggaaactgaggcacagggacagttggctgttcagaagggtgagagaaaacagcttcataaggaatctctactaaaacaacatgctttctcggtttcgtttctttctgattgcaaaagtgaaacatgtccattgaacaaactttagaaaatacagagaattgcaaagttagaaaagaaggcctcctccctcctccccacatacctacctctagtggctggacaaagacgagggtttgggccgcagggcaagctgcctggtgtccttgctatccccatgcctgacttgctgtgtggccccaggcaagtctcagcctctctggacccctgtgtcctcatctgtaactgggaatccaagggtgccagactcgaaaggctgttgtaaggatcaggtgagatcacgtgggtacaggagtggcccagcacaaaaggtttcataagaggaggctatgataggtcttcctcctgcccctccgcttgtgcggctgaatccaggatttttcccttgacttgccccgcacagtgaggcctggcattttcttcccgctccccatgctggcacgtgacacagccccgggcacatgggaggaacgtgataaatgctaatggatggcccgggaacgccctgtcctccaccaaggtcctgaagtctgagcagtggttggtgacggaagacctggatgcgaaaagccgaccaccagagtcaagacccagagaaaacagcaggtgcctgaggcaaggaagccgggattcccagactctggcagcctggccccagctgtcccagagggcaccccgccagcccctgggtccactccacccagggtccagccctgactgcgccaatggcagcaaagatggcagggaccccaagggcaacttcccaaccaccagcagcatttagggagcaccaactgtgtaccccactctggactgggcagcatagagattgtaccgcagtgaattcctggggaccaggggtggtgacttcattgtcttcctgtccctagagcccagcactggctactcatggattcaaacatttatggtgcacctactgtgtaccagtgactatgctgagtgcatctgcctgccaagagagggaatttctggaccatatatttagggaggggaggaagacagtgcactttctttttttttttttaatcttttgttgttgttgttgttgagatggagtctcactttgtcgcccaggctggagtgcagtggcacaatctcggctcactgcaacctctgcctcctgggttcaagtgattctcctgcctcagcctccaaagtagctgggattacaggcgcctgccaacatgcttggctaatttttatgtttttagtagagacagggtttctccatgttgaccaggccagtctcgaactcctgacctcaggtgatccacccgcctcggccccccaaagtgctgggattacagatgtgagccgccacgcccggccgagagtgcacttttctatcaaagttttttttttttttttttttaactgaaagcagtcttttcgtaagtaaataaacataaagaattcccaagttaagccgggagcggtggctcatccctgtaattctagcgctttgggaggccaagatgggaggattgcttgagcctgggagtttgagaccagcctgggcaacatagagagacaccatctctacaaaaaaaatcaaaacattagctgggtatggtggcgcctgtctgaagtcccagttactcgggaggctcaagtgggagagttgcttgagcctgggaggtcgaggctgtagtgagctgtgattgcaccattccagcttaagccacagagcgagaccctgtctttaaaaaaataaaaaattcccaagttagaaaaaaagacaaccctaccacctaccagtgataggaggaagttcgggggccttgggagcgccagaggaagcacctgacatagactgtagggccaggagaggcttccaggaggaagtgagttccaggcaacgaccccaggaagcatgagagggaagttgggtggagggaaataggcctttgggaggccgctgcccaggcctggcaaggcaggctgggtgactgggtgctgatggtctcacccatcccagcccagccgaaggtgagggctctgtccgatgcttcttggcagagcttattgcagttgtaacgaaagcatcacttctgtaattatgtttctgtcttcctccctcccaccccacctctgaactggagctctatgagggcagagcccgtcctgtctgcctcatccaccatactgtcccctgggcctggagcacacagtaggtgcttatggtggatgaccttctgttcccctgaagttcatgtctaccaggaacctcagaatgtgaccatatttggaagtaggggcattggctgattaattagatagggatctccagataagatcacactggagttgcggtgggcccgaagtccaatgcctggtggccttgtaagaagaggagtgggaaggccaggcatggtggctcacacctgtagtcccagcactttgggaggctgaggctggtggatcacttgaggccaggagttcgagactagcctggccaacatggtgaaagcccatctctactgaaaatacaaaaattacctgggcgtggtgttgcacacctgtaattccaggtactcgggaggctgaggcaagcgaatcacttgaacctgggaggcggaggctgcagtgagtcatgatcacgccactgcactccagcctgggtgacagagcaagactctgtctcaaaaaaaaaaaaaaaaaaaaaagaagaagaagaagaagaggaggaggatacacagagaggcacagaggagaaggccgtgtgaagacagaggcaggaactggagagatgcggccacaagcccaggggtgccgaggaaccctggggaacaccaggagctggaataaggtgaaggcgggtaattgcccggagccttcagaggggcgcaccctgctgatgccctgacttcagacttctggcctccagaactgtgggaggacatatttctctgtctctctctctcctttttttttttttttttttgagacagagtcgcccaggctggaggcgcctcctcccgggttcacgccattcacgccattctcctgcctcagcctcctgagtagctgggactacaggcgcccgccaccacgcccagctaatttttttcgtatttttagtagagacggggtttcaccatgttagccaggatggtctcgatctcctgacctcgtgatccgcccgccttggcttcccaaagtgctgggattacaggcgtgagccaccgcgcccggcctttttttttttttttttttttttgagacatggtcttgctttgtcgcccaggctggagtgcattggtgcaatctcagctcactgcagcctcgacctctccaggctcaagtgatcctcccacctcagccttcctagtagctggggctccagacacgaaccaccacgcccagctgatttttgtattttttgtagagatgggggtctcgccatgttgcccaggctaatacttctctttttctaagccaccacgtttatggcagccctggaagactcgttcggattttgctgtgtgaataaatgtgtgaatgaatgaatgaatgagagaaggaatgaatggagagctcctttgagttgtgcagggcccgcggggtgtggccagatgtctgcctaagggccatagggagctatggcagggtcccagccgggagctggttgggtcttcctagtagctgggactccagacatgcaccaccacgcccagctgatttttgtattttttgtagagatggggtctcgccatgttgcccgggctgatacttctctttttctaagccaccacgtttgtggcggccctggaagactcgtttcggggcatttcagggctgttgttcaggctgtgttgggggctggatgctgtccagccagtgaggtgggggctgtgaagagctgttgagggcccggcctcaaggaggtaaccaggaaatcaggttctgtggaacccctaatcccagaagcccatgtccacacccaacgtggacacccacagccgagatttcgggggtctctccccttctggtgccttgcagataagttagagccaatgtttatccccgagttctgaatgcacctcagaaggtccacccaagtgagtctcatcaccttcggctacagcccagagctcaggcagttgggagggaagttctccacctgtctgcccttcgtccctcttgctgtgactctggaagtcgggaggcagcaggatgcaggggaaagagcctagatcctgactctgcccagtgactggagtgactgttcctcactaagccccattttccccatctgtaattggggaaaagtcatctggctttgtagaagctgttgtggagagtggaggccaacatgggctggcagaacacccagcacatagtaggtgcttcctaggagaagtgggccctgggtcccctctccaggcacagccctgagtcttaaagggagactctggctttcccaacctcagatcttttgaaagccctgacaccttccctgtggcctgtccagtggccccacaaggccaccctatcccccaaggagcttgacaacctcggagggagtaagacttgaatttcatgctcataaaatgactggaatcaaagcagggcttatgacatggagctgttttgaagttggcccagggcaggaggggcgtgaaattcctggctgttttggcccctcttcagagaaactggggcccctggcaggatgtctggggcccaggcaggaggttaatggctggctacctgaggtacctgccattttagcaatgatccaaatgccaacatagacttttggggaaaaaattctaagttttagagaagacaaatgggaaaactcaattgaaaaccccccccttatctggggctggagacggtgaggacccaatggttgcagtgtgggaacttgggccctgtagctaggcttcccatccctgccttgccacttacttgctgtgtgacgttgggcatattgcctagcctctctgtgcctcagtttccttctctgttgagtgggcctaataccagtcctttcgtcaaaggcttgtggtgagggtgaccacattgacgtctcctgccctgctggcccagtctctgggcatcacaagctcagtcactgatgctgttactagcattttttttttttttgagatggggtcttgctatgttgcccaggctggtcttaaactcctgacctcaagtgaacctcccaccttagcctcccaaagtgctgggattataggtgtgagccactgcacctggaccagttaccagtatttttcctatagatatgaacagcttctcctgaattgagggctacctgtgaaccagccccttcataggcctcctctcaccaaatcttcctacagctgcatgaggcaagccatgcaccccccgaggcagatgatcagtgatgtctggacacttgcccggggcacacagccggtgagaggcagggccagaattccagcgccagtccttctggtggctcagtccacattcttggtcactttcctttaggaaatacggaaaggcgaggagaggaaagatatgtccccacacccatacagggagagcagggttgcttttctttgattttttttttttttttgagtcagggtcttgctctgttgcccagactggagtatagtggcatgatcatagctcactgcagcctcgaattcctggactcaagtgatcctctgatcctcccacctcagcctcccaaagtgctgagattacaggcgtgagccaccgtgcctcatgagaacagggtttctcaatgtcggccacattctgggcccagtgtgtctctgcgtgggggctgcctgtcctgtccaccgtgggatgcttagcagcatcctgggcttctgcctacagattgggaggccccccagagtgtgacaacccaaaatgtctcctccacgtgtcccagagaggggcaacccctgcctgagaactgggctggagtactggggttgaaatggtggagtgttttcttctggattttttctctaactacacacactggggaaatacagacacacactggggaaaacaggcatttcattgcatgccttgcattttctctttattttttaatttttaaaaatgtttgtcgacctggcccagacgtggtggctcacacctgcaatcccagtgctttgggagacagaggcaggcagatcatctgaggtcaggagtttgagaccagcctggccagcgtggcgaaactccttctctactaaaaatacaaaaattagccaggcttggtggtgcgtgcctataatcccagctacttgggaggctgaggcaggataatcacttgagaggtggaggttgcagtgagccgagatcgcgccactgcactccagcctgggcgacagagcaagactccgtctcaaaacaacaacaacaacaacgacgtttgttgacctgtcagcaggaagaaattttaaaattgtttatttatttacatacctatttagcattttctcataaaaaatacagctgggtgacatcacacatgcattgaacttaggcgaatccatgttcttgggctgggatgaaggagagagagcagtaccatgagtgataatggggtgatgctggcatccgtgacctgagccaggagctgtcacaggtccattggctggggctttcccctgtctttgcccttgtacagatggggaaactgaggctcagagactggacagggttccagaattccaggggtaaacctctggaacccagtgtggctccataaccagggctgcagatgtcgtcccctctgggtcaggccccccggtggctcctcagggtaccccctgtctggaccacttctgcaccaggggcccccaagagcaggataaggaatcaagaggggttgagcaggtgggaaggaagtgaggggttgggcccagtggcttacgcctttaatcccagcactttgggaggccaagacggaggactacctgagctcaggagttcaagaccagcctggacaacacagcaagaccccatctctacaaaaaatgcaaaattagccaggcatggtggcatgagcctgtggtctcagctacttgggaggctgaggtgggagcatcacttgggcccgggaggtcgaggctgcagtgagcagtgatcacgccactgcactccagcctgggcaacagagcaagacccccatttttttttcttcagatggagtcttactctgccacccaggctggagtgcagtggggcgatctcggctcactgcaacctccacctcttgggttcaagcgattctcctgcctcagcctcccgagtagctgggattacaggcgtgcaccaccaggcctggctaatttttgtttttttagtagggacggagtttcaccatgttggccaggctggtctcaaattcctgacctcatgtgatctgcctgcctcagcctcccaaagtgctgggactacaggcgtgagctactcaggaggctgaggcaggagagtggcgtgaaccggggaggcggagcttgcagtgagctgagatcgcgccactgcactccagcctgggcgacagagcgagactctgtctcaaaaaataaattaataaaaaataaatttttaaaggaagggagagaggcagggtgagaggaagaggccctgcacccgccgtcccctgcagcagccactgcagggaggactctgctgaaggaggcccaggggctgcagggccagggcccaaggctgacagctccctcccaggcacacacagaggggccgctcattcccattacacaaataaggacacccctgatgtgggagagtgatggctcccaggttgtctacccaagtgggccatgtctgcaggaggcggacctttcgctaatctgaacaaaggcctccctttctccttccatccagaggtggggttgtttgcctaaagtcacacagcagtaaatcacgggctgggatttaaatacagactgcctgctcaggaatccttgttttacccattcagtatcttatatggcttgtggacatgcatatgtgtgtttggacacacacctacacacccccacacacacacaaacacgcacacacacagtggcagctgctcccccagactcaagaacccctgcatctgtctccagggccctccgagacctggggccgcaacagttgtgtctggtttgcagcccagctgagagcggataatcccaaatctctcagactccattccagcccccatcagcccactccccagctgtgcatctttgggcaaatggagcccctctctgagcctcagggtctttgccaccccagcacccccgcacaccaggactttactaggggttctgtgagctgaggctgctttgtgatttatctgagcagagcttcagtgggacacagagaccaccacacgcagctggtgtccatgcagcctggccggctggtagggctcagtggcctcccagggtccctgtttggccaggcttcagggtctggtgtgtatgatttcataggaagcaatgaccttgggcaaaaatgtcacagggcatcagcctaatggattcggcctggctgacagtgagcaggagggttggagtcctcctcctggggctgggttcttcagggtgggggaactcagggatctgggtcattgcctgtggtcagggtgaggagacagaggcccaggggccagcagccttcccagggtcacccagcactgcctgacctcttccaccaccttggggcctttgggaaggacagggtcggtgggggtagaggaacctgcaggggccaacagaccttctcctggcaagtcattgatgcctcagtttcctcttctgtaagatcggtttgattaatagttccgatctcagggctgggggagagtccatgaattgctttataatgagctcagcatagagaaggtgctcattacgtctttttttttttttttctttttgagatggagtctcactttgttgcccaggctggagtgcagtggtgcgatcttggctcactacaacctctgcctcccagattcaagcgattctccttcctcagcctcctgagtagctgggattacaggcatgcgccaccacacccggctaacttttgtatttttagtagagatggggtttcgccatgttggccaggctgatctcaaactcctgaccttaggtgatctgcctgtcttggcctcccaaagtgctgggattacaggcgtgagccactgcgcccggccgctcgttaagtcttgactgtcattcttggtttgcctcacatctctgaccccatctggaacgctctgtacttagcactggttgctgggtgctgccagtcctgggttcagatcccagctctggtgggtcaccctgagctagtgacagagactcttggagcctcagtgtcctcatctgtgaaatggggccaccaacactaccaaggaatggttgggagcaaagtgagatggtggctgtgaggcacttcaggcacctcagctcatcagggtaagtaaagtcctctgttgaccttgccaggctagaagtagctaatttatcgtcatggtgggtggcagaggggcagctaaggccactggctcaaggtcacagggatcagagtggaatctcactttgtggctcaaagctgtgtgatcttgggcaagccacttggcctttctgggcctcagtttcatcctgttgacatcagaagaccccaggaccatacagtggagggctgagtgtaacttggcatccagtcagtgatgtgttttgcacccaatgcctggcacagtgctgcacccaccaggagaggtgggagggtgatggctcccaggtcgtctgcccaggtgggccgtgcctgccggaggggagacttttcctaatctgaacaaaggcctcctttcttccatccacaccctccctgggagtacagcctcacaccttaaactccatttccacaggggccactctggtgcctgtccccaggtcactctggactggccagcctccttgagcccctgatctgagggtctcacaggcatcgtagtttaacacactcccacccagcaccggaaggcccccacaaactggctcttcctgagcctcccctgggctaggccaaaacctgggagtcccccagctcctttccccctcttaccctctcacttctgagtcctgtgggctccctggtctgagcgttctgcattgcatggaagtctaagaggccacaggaaaggcatgcattccggaatcaaggaaatgcgggagctggagtctcattctgttgctatgttgctcaggctggtcttgaactcctggcctcaagtgatcctctcacctcggcctcccaaagtgctggcattataggcacgagccactgtgcccggccactgatcagttcttacctcttctggaacaccaggtccagtgccatcctctgcccctctggtctactgcagtcaactgcctgcttccagcaatgccccgtggtctgttctctgcaggaagctagagggaagctagaggtaaaaacctggagcacatgcgtccctcctctgcaatggttcccatctcccttggagaaaaagatggatctttgaaaggccctgtaggatctgccccaccactacccctcccccaccccatctcctaagcctcctcctccctccctgaccctgtactctgctccagccacactggcctcctggttgtttctccaacaaattaggcatgctcctgcctcacggcatttgcactggctgcttcctctgcaggacacattcttcccccagatgtccacatgcctcactccctcacctcctgcaggtctttgctcaaatgccacttctcaagcatcaggcacctgcccccattccaattttcaatggcacctctgccccaccccatcccctatccccctccctgccttgtttccctctatagcatttatcaccatctcatcttctacatggtttactttttcatctgtttactgtttctccctagtcctttgccctgactgtcaccattcccagaacatccatttcacgagggccgcgttttctgactattttgttccccgctgtgtctgctgggcctagggcagtgctgggcacacggtagctgctcattaaatatctgtggaatgggcagctctggagtgtggataccaacatgcccctggtgaagcgggagctctaggatttggaatcagcctgtaagctgtagagggcagtgccctttggatggcacagccaggtaggcatgttcccagcaggggtttgtgggaaacggctgtggagggtcctggtgtctacagtcagattcccagggcaggatgctgacagatgggccatggcacgatggggaggccaggtggtgtggctgggtccggctttaagcctctggccaccgtgtcaggtttgtaaagcaaagggtcaggaaggcaccaagggcagtgtggccggaagtgaacggcccaggcttctgggaagaaaaagaattacattccaaggaacccatggcttgggcgcctgagccactgggggcagggaagagtatgaaagaggcagggctggcgtgggcagatggtggccttgcctgaggttcagagtggtcaggtctgtaggtcagggtgaccctggagagctgggatttggaccaggtcaggggaagtgtcccccagattgtgaatggctggggcgtggcagccagtccacagctcctgctgctgttgggaggggagacccccactctgggctggggtgcagctcagggagccccggagctgactgagccacttccttgtgccaggcggtgtccatgtccacccccagggcgagatgtgggcaaccaagccaagagagggggctgccaaggccacaagctcatccatgtgtccatttatccatctgtccatttatccatctgtccatttatccatctgtttacagagtgtctattgcatgccatgtgctgcagactcttttttgagacagagtctagctctgttacccaggctggagtgtagtggcatgatctcggctcagtgcaacctccacctcccaggttcaagcgattctcctgcctcagcctcctgagtagctgggattacaggtgcccaccaccatgctcagctaatttttgcatttttagtagagacagggtttcgccatgttggccaggctggtctcgaactcctgacctcaggtgatccacctgcctcggcctcccaaagtgctgggatcacaggtgtgagccactgcgcccagcccctgtgctgtggacttaatgtgataatgtgacttgcatcttaccgcccagggcctctgctcttgctgttctcttggcctggaacaatacctaccagactccagggctggcagctcctcctcacttggggtcacctcctccaagaggccccctgcccactgctgcctgcctgccctctgttcctttacttgggtatgtgctgaacgcctggaaaagaacctagtgcatttccttctttgtctgttgtctaactcccccattcaaatatcagctccacgaagggagggttttgtctcatcactgcatgtccctacacacggtatttggcacacagtaaacactcaatgaatgcttgttgaatgaatgaatggacaaatgaacaaatggaagctctactggggaagctcagggatggagactggctcctaacccagagggaggggatgtcctgggtagcgcagtcctggaagatgcagtcactggtaaactgaagcctaaagaagctcaggcaggcaggtgaagaaaccagggggatggttttgtttcaaaacaccttcctccaagggaggaagaggtgagctacctccaaggttgctcagaggtggaaactgtgattaaaaataaaaaaggcggccaggcatggtggctcatgcctgtaatctcagcactttgggaggccaaggtgggcggatcacctgaggtcaggagtttgagaccagcctgggcaatatggtgaaaccccatctctactaaaaatacaaaaagtagccgggtgtggtggtgcacacctgtagtcccagctacttgggaggctgaggtagaagaatcgcttgaacccgggaggtggaggtagcagagagccgagatagcgccactggactttagcctggcgacagagcaagactccatctcaaaataaataaataaacaaataaggctagaagtggtggctcacgcctgtaattccagcactttgggaggccaagacgggaggatcgcttgaggccaagggttcaagaccagcctgggcaatataatgagaccctggctctacaaaaacaaacaaagcctttaattcattgctaccataaaaatcgagacatttcactacatcctgatgtccctgtctctcttgaagacttggaagatttggccatgtgggccagcattctagaggcaaaggtggtcagtcctgtgttctccacagcccctatcaggtccttgaggtatgtgagcttcaaagccttgtattcacagcatgacccccactacccccacctgctgggtgaccttggacaaccctttctgagtctcagctggtccttggcaaaaaatgggttggaggccaggcatggtggcttacgcctgtaatcccagcactttaggaggccaaggcaggaagatcacttgagcccaggagtttgagaccagccggggcaacacagcgagaccctgtctctactaaaaaaaattttttttttttgagactgagtctcgctcagtcacccaggctgccgtgcggtggcgtgatctcagctcactgcaagctcgcctcccgggttcacgccattctcctgcctcagcctcctgagtagctgggactacaggcacccgccaccacgtccggctaattaaaaaaaaaaatattttttaattggccagtggcctgcacctgtagtcccagctactcaggaggctgaggcaggaggattgcttgaggaggaggttgaggctgcaatgagacttgatcatgccactgcaccccagcctgggtgacagagtgagaccctgtctctaaatgaataaataattagttgggcgtggtggcgcccacttgtagtcccagctacccgggaggctgaggaaggagaatcgcttgaggccaggagttggaggctgcagtgacccgtgatcgcatcactgcactccagcctgggcgacaagagaccctgtcgcaaaaaaaaaaaaaaaaaagaaagaaagaaagaaagaaaaagggttggaagcgcactgggggaaaaagcttgcccactccgctttgggagcctccagcaggctcccgctgtgccaaaggcacacacccagatgtccggtggtccacccctgccccggcggtcacgcctgtcccctcctccagccccagcctcgggtcggctgagagatgacgcgtggcccggcccagccggagcgttggtccctagagcgctagcgccctctgctggccaagggcgggcgtgcaggcccgagccagaacggggaagccgggcgccaggagagcggggaggagcttcactcttctggtcggtgagatggggaagagcaatagcgaatacataagcagaatacaccgaaaggaaaggaaagaacaatagcgaaataacatttacggaggggtgctccgtgccgaggactgcaagaagcccacaccatgtaaaaccacacgtaatccttagaataacccggcgaaatggcaacggaaacgcacagagaggttaaggagccctcccggggccacacagctggtagtggaaacggctgactcctgggcctgcactggcatccaccgaggcggagagaggatgtgaaggtgtcacctccgctcattcactcatgcatggccttccagccagccattcacccattcacaagtattcactgaacacctactgtatgcccaacattgtgtgagatggcaggaacacagccgtgaacacaattggcctcatccctaccctcttgaagctgacattttagtgggggtgggagggggcagataataaacatgaatatatcattaacagctgggccagaggccaaaggataaacctgtatgcgctcgctgatgttactcaggctcctaccccaacatgattttttgccgcatctgagccctacctgtacttttacttgacatttgctcctagataattggtttttacttaagtgtatatatatatgtgtatatctatatctatatctatatctatgtatatgtttatttatttattgagacagagtctcgccgtgttgcccaggctggagtgcagtggcacaatcacggcccactgcaacctccacctcttgggctcaagcgatcctcccacctcagcctcccgagtagctgggactacaggtgtgcaacaccatgcccagctaatttttgtattttttgtagagagggggttttgccgtgttgcccaggctggtctcaaactcctggactcaagtgatctgcccaccttggcttcccagagtgctgggattacaggcatgaaccactgtgccaagacaaagttgctgggttttttttgttgtttgtttgttttttgagatgcagtctcactctgtctcccaggctggagtgcagtggcacaatctcggctcactgcaacctccgtcttccagattcaagtgattctcctgcctcagcctccctagtagctgggattacaggcacgcaccaccatggccagctaatttttgtatttttagtagagtcggggtttcaccatgttggccaggctggtctcaaactccttgacctcaagtgatctgcccacctgggcctccctaagtgctgggattacaggcatgagccaccgtgcccgcctgccgaagggtatttttaaaagggaatttcggcatggtgaaactctgtctctactaaaaatataaaaattagccgggcatggtgttgcgcacctgtagtcccagctacttgggaggctgaggtgggagaatcgcttgaacatgggaggcagaggctgcagtgagccgagatcgcgccactgcactctggcctgggccacagagcgagactccatctcaaaaaaaaaaaagggggggtggtgggaaatctcatatcaccacacctacccaaccagtatcagttgtcacctatcagacagcatcctggactgagggtgaggtattgacatcactgttatattaatcaatgtccttggcatgccacatcagttcccctggttcctggcaggggcactagaatctcccactgggaaccccaagatgaagccagccccagggccaggcctagggaatgaaggtgccatcagcttctgaagaaggtgggtggcctctccaggatcctccaagccactgtggcctgtgctttctctggattctgctggtgaccctgaagaatctgaggcacaggccttccctggccaatcagaaagcagtggcttccatcttagcttcctgcccaccatggacaaccctgggtcgtggaacccccgtctgctctctttcatggctggcaatgggtgtaagggggacttgctcagatctgattctcaaaattcctgccagggaaggccaggcttctgagccagtccatctgttgccccctgacccagccacccagcttccctgcatgcagggcagagggaacaggaggccccacggggccactgggacccctcccttgtcactgccagtggcctcacaggtccatgtgacccaccaagagaggaaggccaggcccagccctgaggagtgattcattcattcagtttacacagtcagactttgtgctggacactgtttgttgttgttgttgttttgttctttgagacagggtctcactctgtcacccaggctggagtgcaatggtgtgatcttggctccatgcaacctccgcctcccgagttcaagtgattctcctgcctcagcctccggagtagctggtattacaggtgtgcaccaccacgcctggctaatttttgtatttttagtagagacggggtttcactatgttggccaggctggtcatgaactcctggcttcagtgatcctcccacctcacctcccaaagtgttgggattacggacttaagccaccgtgcccggcctagacaccattttttattttatttacttatttatttattattattattattattattattttgagacagagttttgctcttgtctcccaggctggagtgcaatggcgcgatctcggttcactgcaacatccgcctcctgtgtccaagtcattctcctgcctcagcctcctgagtagctgggattacaggcacctaccaccacacccagctaattttttgtatttttagtagagacagggtttcaccatgatgatcaggctggtcttgaactcctgacctcaagtgatgcacccgcctctgcctcccaaagtgctgggattataggcgtaagccaccacgccaggcctattattattatattttgagacagagtctggctctgtcacgcaggctggtacaatggcttgatcttggctcactgcaacctccgctacccaggttcaagtgattctcctgtctcagcctcccgagttgctgggattacaagcacgtgccactacgcccagctaatttttgtattgttagtagagatggggtttcaccatgttggccaggctggtctcgaactcctgatctcaggtgatccacccaccttggcctcccaaaatgctgggattacaggcgtgagccactgtgcccagccttcaacactatttttaacactgggttcatggcagtgaagaagccagatgaggcgcccacctgcaagagggacaaaggaataactactgcaatgaatgagatagttaaaatacactgggcatgggagtccaaggcgggtggatcatttgaggtcaggagttcgagaccagcctggccaacatggtgaaaccccgtctaccaaaaatacaaaaattagccgggcgtggtggtgcacgcctgtaatccccagctactcggtaggctgatgcaggagaatcgcttgaaccagggatgcagaagctgcagtgagctgggatcgcagcactgcactccagcctgggtgacagagtgagattctatctaaaaaaagaaaagaaaaagaaaaaaaaaagaggccagctgcagtggttcacgtctgtcatcccagcactttaggagtccaaggcaggcggatcgcctgagttcaggaattcgagaccagtctgaccaacatgatgaaactccatctctactaaaaatacaaaaattagccgggcatggtggcaggcgcctgtaatcccagctactcgggaggctgaggcaggagaatcacttgaacccaggaggcgtaggttgcagtgagccaggatagtgccattgcactccagtctgggcaacagagtgagactctgtctcaaaaataaaataaataaaataaaataataaaataaaataaaatataaaataaataaataaattaattaattaaaataaataaaataaaataaaatatgcctgtatccttggatggagaaacctgctcctagaactgtgttctacagaggtatgcaaatgcacacacatgccctgaggccagcgggcagcagagcagcagagaccacctcaggcccagcagtccaggcctggccaccgtggtggtggcccttcatgtgctgggtgtgctgcgcttaactacggagcggatccccaaggctgctctgcagggcactgggaagaatatcccggggaggagctaagtggagatcacattcccatttgcgtaaaaaagtgggggaagtgcatgaggggagggggaaagaatgcggagtggtgctggctgcacttgcgtttgctcgcgtgctgcctgtgccatctcagaggctcacacactggtgcttgccttgggagaacggggtcagaggtgagactttgccctgcactctattccctttattttctttttgagacggagtctcactgtgtcacccaggctggagtgcggtggtgcaagcccagttcactgcagcctccatctcccaggttcaagcgattctcctgcctcagcctcccgagtagctgggattacaggcgtctgccaccatgcctggctaatttttgtatttttagtagagacggagtttcatcatattggtcagactggtctcgaactcctgaactcaggtgatctgcccgcctcggcctcctaaagtgctgggatgacagacgtgaaccactgcacccggcctctttttttgtttgtttttcttttctttgtttagacagaatctcactctgtcacccaggctggagtgcagtggtgtgatcccagctcactgcagcttctgcatccctggttcaagcaattctcctgcctcagcctaccgagtagctgggattacaggcgtgcaccaccatgcccggctaatttttatatttttggtagacggggtttcaccatgttgcccagcctggtctcaaacttgttggctcaacggatctgccagccttggcctccgaaagtgctaagattataggcatgagccactgcctctggccaactctgttaattgacacataaatgtagggagacttcacgtacaaatctgccttcacagcttccttggaaaatcagaaagatctggcattcactcagcccatgtgcccagtacttagtaacaccttcacactcacctgtccccacccagctgcataacatcagacacatatcagaaccccaaggatgtggcccgtgtcttcttctcacagtgacagggccaccagcagcaatgaggtggctctagcctaaggtctcctctctcccaaggtcaccttggcccgtgtgtgacagctgactgcatctagcaggtgaccttgcccaggtctcacaaggaagtctttgaggttgatctgttatcttctggagctcagagctctgtacaatccacccaccccagcagcttgtttcttgcaaactggaaagaatgaagctttcacaagctgcctttttttttttttttttttgagactgagtttcactcttgttgcccagactagagtacaatggcgtgatctcggctcgccacaacctccacctcccaggttcaagtgattctcctgcctcagcctcctgagtagctgggattacaggcatgtgccaccacacccagctaattttgtatttttagtagagatgggatttctccgtgttggtcaggctggtctcaaactcccgacctcaggtgatctgcctgccttggcctcccaaagtgctgggattacaggcgtgagccactgagcccagccaagctgcctcttcttaaaggaatttcctcctctgccaagtaaggaaatccctaatgctgtatcttgaactttgtcatgaggctccgtgatgaaggagtgacgtcaagaagggacaggccaagagagggaatgtgactgtccctgggctccctaaggttctctgaggggaggtgcaagaggccaggcaggggccgggtgcggtggctcatgcctgcaatcccagcactttgggaggccgaggcgggcggatcacctaaggttgggagttcgagaccagcctgaccaacatggagaaaccccgtctctaataaaaatacaaaattagccaggcatggtggtgcatgcctgtaatctcagctactcgggaggctgaggcaggagaatatcttgaacccaggacgcagaggttgcagtgagccgagatcatgccattgtactccagcctgggcaacaagattgaaactccgtctaaaaaaaaaggccaagcagggatccacaggcagggtggaaaggggcacagaggcaggggccgctccgtttatgtgacgccatccacatcgttatgcaacaccacagctaaaggtgcagtacagccaacagtgctcccacccagagggccggagaactttctccagtggagatgcagtccaaggaactggctcttgccccaagaccagagtcagtcagagatccagggcagtggggccccatggctggcttgctgttggtcagccagaaggggtgctttctacacctgctgtctccccgacctttgtcaggtaacgacagatgtttccccacaccacaagtttccacacagtgaaaattaccagtggatgcatcccctccggtacacaaacctggcaggggctggagaccagaggtgtgacccagggaaaccacctggcaaaagtggcaacatctggccaggcgcggtggctcacggcactttgggaggctgaggggggcagatcatctgaggtcaggagttcaagaccagcctggccaacatggtaaaaccctgtctctactaaaaatacaaaaaattagtttggcgtggtggcgcatgcctgtagtcccagctactcagaaagctgaggcagaattgcttgaatccaagaggtggaggttgcagtgagccaagaccactccactgcactccaacttgggcgacagagagagattccgtctcggaaaaaaaacaaaaacaaaaacgtggcaacatctgaacctcagacaagcacttcctgtgtgccctaggcttaaactctgtccataaactttagaccatctgtaaacccaccaccaaggaagagcaaattacacaaacgtgggacacagtgcccacaagatcacagatccaaacaactgtctcagagggttttgagtgttgtttcacaggccttaagcccaggtccacccagcccgcatcccctctggtatataaacctggcaggggctggggaccggaggtgtgacccagggaagccaggtaaagtgcacactctaggatttgagacaggatttgttttcctcttgggggtaactcagcacagaagaggccacctttagatttaaccacgaatttgttctggggttttccagcagcattttattatttatttattttttgagacggagtctcactctgtcgcccaggctggagtgcagtggcacgatcttggctcactgcaagctccacctcccgggttcacgtcattctcctgcctcagcctccggcgtagctgggactacaggtgcccgccaccacgcccggctaattttttgtatttttagtagagatggggtttcactgtgttagccaggatggtctcgatctcctgacctcgtgatccaccagcctcagcctcccaaagtgctgggattacgggtgtgagccaccgcgcccggccattttattttttagagacagggtttccgtctgtcgcccaggctggatgcagtggcaccatcatggctcactgcagcctcgacctctcagattcaagtgatcctcccacctcagcctcctgactagcagggactacaggcgtgcactactaacctttttttttttttttttgagacagtctcgctctgtcgcccaggctggagtgcagtggcgcaatctcggctcactgcaaactctgcctcccgggttcatgccattctcctgcctcagcacctgccaccacacccggctaatcttttatattgttagtagagacagggtttcaccgtgttagccaagatggtctcgatctcctgacctcgtgatctgcccgcctcggcctcccaacatgctgtgattacaggcataagccaccgcgcccggctacactggctaattttttaactttttatagcgacaggggtctcactatgttgctcaggctggtctcaaactcctgggctcaagtgatcctcctgccttggcctcccagtgttaggattacaggagtgggccaccatatctggcctgaaataattttggaacctctcctctcctcccttgggagggctgactgaggatgaagaacccacagctttccctggcccaatgtatgtactttcagaactgaagggcaccagtccctgcagaggactccaaagaccatccaaagaaatctgggcagggctttctggagggtggcctgttgggaagaacctggccctttccttacagccagctcttctcacacctgagctggccccaacagccagagggaatagcctgctcctgccacagggcaccaagatcgtacctgtatgtagttgggactacagcagaagttcaaactctgggtaaaaactagacacgttcccactgcatatgcagtagatggtagacaaatagttaatcatcagatcaaaaaaaaattttttttaaacatcagaaatacatgtgacaatccgatgatttttttttttctctgaatagactactaagtccagccaataaatggcttctagtggaggcttaatagctcaagacctgtgaggctacttaaatcaaaggaagaacgcttttttaaactaccatcttgggctgggcacggtggctcacgcctgtaattccagcactttgggaagccaaggtgggtggatcacctgaggtcaggagttcaagaccagcctgggcaccatagtgaaacccccatctctaccaaaactacaaaaaattagctgggtgtggtggcgggtgcctgtaatcccagctattcgggaggctaaagcagaattgcttgaatctgggaagtggaggttgcagtgagctgagatcgcgccattgcactccagcctgggcaacaagagcaaaactctgtctcaaaacaaaacaaaacaaaaacctaccatctttaggacaggggttggcaaactatgatccatgggccaaatctagcccactgactgattctgtatggcttttagcatgaagaattatttttacagatgaacatttgcaagaggcttgatgacagggaacactaatgagtcccagttaaacaacatgttatctcctaaaagaactccagtcctcacgttagtgggccagtagcattataaataaactgaattccactttgaatttcaccaattaaaaatttgggaaatctgttttctctcagaatataagtacttacacaatgtccttagattttgcctcttggcctgcaaagtctatatatttactaatttaggcccttttagaaagtttgccgacccctgctttaggatgtcaatttgaatcccaaagcatctaaaacattaaattctgtccctaatatgccaagaggaagaaaagtacagcctgttaaatattaacgcacactttttttttattatattaaaatcaggcaatggtctgacaataaaaaggctgcttatggaatactgttatgttaaacttcacttacaggatgttaaatccttagaactaaggttttccccccagaaaaagattaatggaaacatcaattgcttttcagacttgatagttgctgcttcaaaaggtggttttacacaaatactaaattaaaaaaaaaaaaaaaacctttagtacacaatgaattgcttttatttcggtatgcatccacatttcagcatttagtggtcctgaacagcaagtggaaagacgcagcaatttgccaggaggtcaagcccaccaatttcggggatctgctgtgcacaccgggttccttcttaatccctgctgaggatcttgggaagcagcagcagcaccaaaaccaaggcatgcaccggattcaaggttctttttgttccagttgtcagattccaaactagaccccaatggattgcaaggatgaccaaatgaaagccctgtttaaaacttcttcaatttttaaaagcaaaagcagttacaggaaagtaaaacaattcagagggatcatgtgtgcttacaagtatcttcatgcggtctttctccaagttcaaccaccaaggactccgagagctggcaggtctgagtaaccctggtgactattcttttcaccttatcaaaacctgagctaaaaacaatgcatcagctgatgacagcagagggtggcagggctgaggacccaatattcatttcccaggctggtggagagtgagtgagtatggttccaaaactaaacaagggaggtcagaggctctttccaaccttacctgatggcttctggccaaagcaaggaagtgtcatggaaggtgttgggtggtgacggtgcaaaaaggaacttgaggaggagggagaaaaagcagcacccctcgataaaggtgggggagagaagatatggggaaagccctgaattcctcaccgaaggccaatctcagaggggagtggaggggttacaatctatgcttcggccaagggcgggagtggaggagcgtggggacaggatgatggtttggaaggggcatcacttaagacttaaagaaaccaggggtgcaggcgaaacaccccacacacctagcagtagtcccacaggctgcgacctgaaaccttcacatctactctaacaagccccccaggctagagggctgttgttgcagggagggtgggaggcgggagggtaaggggagaaggcagagaccccaggccgtgtaatcagcagcaaggtgattgtgtgatgtgtcttttcacagttgagttagatgtgccccaccagttatgatgggaatcaatttaaatagactttcttgatcccagaagttcaactacgtggacagtggttacacttgacaggatgatttgttatagcacaacttatatatttcaaatggacaaaaaattagtatcatttacagtatcttaagataaatttcctttgaatgggagcttcctttccggtactttgaggtctacaagacgtatctagaaaatttactactgtggaaaatgaagactgattaaatcgaattggggggaaggggaagggcctgtggtttttctttttgattaattgctgtaacactgtccttcgggcggctgagggagtttcatattttctttagacatcattaggcgccgaagctcttgcaggacaactttgatgctatatgaattctgccattttgctagcactgatatggctcttgggtccacctacaacaaggcaaacaaaagcaaattactctcagactctcaaacaaaatagctatatgccggggttaagctaaggtgcaaactggagtaagatgtactttttaagctgaacctgctgctaatcctaataccttacatgcggaatacctacctgctagagtccctccctccagtcagcctgcctttcccttttgtgccctgaaccattactatctgggataaggaaacggtggtactgacacttgggtgagactcaacccagccctacttggctcttcaataatggccgctgctgggctggcggctgccgggctcaggacctgtcctcttcactgcgcccaggtcagggggacagatgtgcatgcagggcagtacggacagccaaggcaaagggtggccaggacacctgctccagtgacaagggcctgccacagagccagcacctctcaggttaaggcagcatttcccaaaataaattccccaaagcacaggttgagctctgggctcaggactttaggtggaactcagattcaggattaaacactaaacacactgtaacaaagctcatctcttttcaattttccagtcttctgagtatctcaaagacgaaggcttggcgtgacgttaacatgtgtagcatcccttcaacacttgctgatctcctctttgaacaggagagcaggcctcaaaggctcaaagcttttggcaaatgacacatggagtcaagatttattaacattgctctgtttttgtaatatttactgttgccattattgcccagttatgacaactgagacaggtttttcatttatggtagtaaaaataaaaaagcaaggccattaaaggaaaaaaatattacatgccagtggttcacaaataaggcccaggggggtaaaggtgtagccctgggaaagatcttccacgtctgtgcctcagtttcctcatctctacctcactggggtggcatgaggaaagagctcatatttcaaagcgaccagcacagaactagcccagggtaagtgctatatgagtgatcgccagatataattgggaaacaggccccatcccaaatctgtgctcctatgcacagtgatacagtttatcaacaaataaccaaagaacctaggaattgggcccagtctaaaagctcctgatgttaagtacaaagcaactgtcaactccaaggaacaagtgggacagagaaaacaacttaccactccattagaactatttactccattcatattaatttttgttacaaatcttacaaaggggggtgcttctgggtatttaggtccacattctattttaaggctgtatattcggttttcataaattgtctggaaaaaaagagtacggagatgtcacgcaattacaaacaaagcattcaaaaaggtagagcttgtgaaaccccatttatccctgactgtagaactggtacatctgcttccagcatggagtctacttgttctgtggtaggtcagcagttctatactagttcctacactagtttatatgacttccgggccttgggggaatacaaagaagatggagcatttaagctagtaccagtgaagtttttagtattaagtctaatcagagggacctgtttttatgttaatttctctactttgcagtccttctctggggaatggtaagaggcattctctattctaggaagccgagttaaatgtccactcaccaggatcatcagccaatcagttaaataacactatgtggtattaaagcacagaacaggtcactgctttagagaacctcaaaattaagacaagacgagggaggggtgcagactcagagctgcttcccccttctccatcactccggggttaggcactgggtaagggatttcaactggggtgttccatccctccctgcagtctttttttttttttttggtagtctgacctgagagattactggcattcaatgggtgaggcagcacagggaaaagcagtcttttttttttttttttttttttgagacagagttttgctcttgttgcccaggctggagtgcaatggtgcgatctcggctcaccgcaacctccgcctcccgggttcaagtgactctcctgtctcctgagtagctgggattacaggcatgtgccaccatggccgggtaattttgtatttttagtagagacagggtttctccatgttggtcaggctggtctcgaactcctgacctcagctgatctgccctcttcggcctcccaaagtgctgggattacaggcatgagccaccgtacccagccaaaaaccgtccttctttaaaaggctaactgtgcctttgttgagaaacactgaaaagtccaaccccctatgccaataacctcttcactgtaccatctaccccataagcagggagatgcgctctgttgcccggctgttccttctgcttggagcgtcctgcccccacctgaaatgccttgcaaccctgaagacccagctcaaacactacctagtccctagctttctatcccatatgaagtcacactgctatcacatgtgtctgaagaccacactgaagggtgatgtctcccagtaaagagtaaccccctcaaaggcaggggctcccctctctgtgggttcccctgtcaggcatcagtgccttctccggcatcagtaccctctccggcatccgtgccctctcctcaggaaaggagtcttgtactgcataattgctcccgtgtaaacagcggcatctagtggtctttggggagaataaatcagaggatgtgatttaaacccttgattcagaaggcattcataatatacccatggaaacttttcttgtccacagggatcccaaactacaaccaaaccaaaactgtgaatttctacctaccctcaacctgccctcttcctcctcagtgaatgacatcagcatctacccagttagctaaagcaaaaactagcaggcaacccaattcccctctcccttaccctctacctgccagtggtcagaaggtcccactgttctacctctgaaagagaccccactgttctacctctgaaagagaccccatatccatccactttcctccaccaccgtcacctcttctgaactcccccaagtctctttctctcttgctcccggcacagcagccagaccaacgtcttaaaaacaggaagctgtctctgctggcttaaccctctgatggctcctagtgacctgaagaggaagccaaagttcccagactgacccgggcagccctaactgcctcttcttttactcttctccctcccctgcccaccattcctcttcaaccttgccaagttctctccaccttggggctctcaccccagctgcttccccttggaagtgttcccgatcccctcagcccctcccaactgaggctcagttatgcatcagacaccctcactaaacacagaaaaaggagggtgggggccttgacaggggccctcaactgaattggtactcaaatgtttgttgaatgtttctcttcacacttttatattataaaataaacacctcattgcaattaaggtgtttcctcaaagaaaaaaaaaacccagtaaacagaacaagtaggaagcaaacaaaggcatgactcacatacagatttatggagaatataacagatccatcctcagaacctatcatagtctccatcaacaactatatactcagtgttgactgaatagatcctgaatggagcaaaaatcatgctccctggttttgtcacacaattcaagaatgaaattccttacattttaaggaatcaaatttctcaccactgatattcatctggtaatttcactggaagacagtaaaaaaaaaagcctcaagtcatcacagacacacacctgaagggtcatttaaaagccccaacctaaggccgggtgagctggctcacgcctgtaatcccagcacttcgggaagccgagacaggcggatcacaaggtcagtagatcgagaccatcctggctaacacggtgaaaccctgtctctactaaaaatacaaaacattagccgggtgtggttgtgggcgcctatagtcccagctacttgtgaggctgaggcaggagaatggcacgaacccgggaggtggagcttgcagtgagccgagattgcgccactgcactccagcctgggcgacagtgcgagactccatctcaaaaacaaaaaacaaaaaacaaaaaaccccaagctaaggctgggtgcggtggatgacgcctgtaatctcggcatctgggggggccgaggtgggtggataacctgaggtcaggagttcgagacccatctggccaacatgatgaaaccctgtctctactaaaaatacaaaaattagccaggcatattggcaggtgcctgtagtcccagctaaccggggggctgagacaggtgaactgcttaaacctgggaggtggaagttgcagtgagccgagactgcaccactccactccagcctgggtgacattgcgacactttgtcaaaaaaaaaaaaaaaaagccccaagctagactttaatagaaaccagggttacagggtttctggtttttttattttgttcatgagtgctccagggacctgctaaaaaggtttcagcaaaggaaatgtgcctgaaggagaattgctggaacattctgcgtctgtgagaaatactgctcttaagattcattatttgatcatgaaacaaacactttccactttgttgatatggctcatgctttgtggagccgtttggcagtgctcatcaacatgtgaaatgggcatgctcagaccagcaggccccttcctagcaatttccttcagagagacgcaaacttgtgcacaaaatgtgaagcactgtctgcaatagcaaaaataactacaatctacatgtctccttgcaagggactatatgaacatggcatattcatataacccggagacttcgtagccttctcaaaggccgagggacactccttgggcacacacacacatacgaaagactggcaaaacatggcaccaggtatagacgatacattgtaggatatgtatagcctataaaagcagacatacactttcttccaattctggatatatttgtgtgcacacaggctactttgtccattaggcactacaggcccagagcctggagattataaatttttcctgggccaaatgcatacatatgagataaccccagtctaatcattaaaaaaaaaaaaaaaaaaagacaaattccaatagagagacagtctacaaaatacctgaccagtactcctcaaaacagccaagggcatcaaaaacaagaaaaacctgagaaatgtcattgccacgaggagccagagatatgatgactaagtgtaatgtggtatcttggatgggattctggaacaaaaaacagatataagtaaaaactaagaacacctgaataaagtatggactttagctaataataatgtatcaacgttggtttattggttgtgacaaatgtaccataataacataagatgctagcaacagggaaaaggtagcacaggaagtactacctttgcaacttttctataagcctgtaagtattagaaaataaaatttgttttaaaaatgtatgagctaggctaggcacggtggcccacgcctgtaatctcagcactttgggaggccaagacaggaggactgcgtgagcccaggagttcaagaccagcctgggcaacaaagtgagaccctgtctctacaaaaagtaaaaaaaaattagccaggtgtggtggtgcgcctgtggtcttggctacttcggaggctgaggcaggaggattacttgatcccaggaggtcaaggctacagtgagctgtgattgtgtcactgaacttcagcctgggtgacagaatgagaccctatctcaaaaaaaaaaaaaaaagtatgagatatgagaaaaggaaaaaggtattaattacaaaaatatgcaaggaaaattacaaaatctaaacatacaaaaaggaaacattaggtcaaccagtcacctgctattcagttccaatcttacatagttatatacaaattacgtttaatgtacaatgtgggtacatgctatgttagaatgcagatcacagtaactgttggggagaagagtggggatatggcagttagggataaatcaggaaaaaagactccacactaggttttataacagaatttaatataagacattgcttaaacaggcgtcagtggactgaaaatgttcaaagggaatctaagctaacacagatgtaataacgaaatgaagcaggatggaaactcttaagggagggggggataagctggagtttaccagggttgagtttaccagggttggaggctaaggaagaggtctgaagagttgaactcagaactctgaggaaggggtgctgcctggctgctgctagaacctccaaggagggggcttggcgggatgtgatgaggctggttttgtgaatgtccccagaaagctggaggttgaaacacactgctgatgccaggatgaagggctgttaccagggtggtacagacagaacaaacaggcaaactggatacagcaaatcccttttcccttccccatgcctttcaggctctctcttgtgtccctgactggtggaaccttcagaggaagccagctgacaaaggaaaagtgtagtgtgcagagtcccagccccagcatccaaagcagagtggagagaagtgggcttggagtttcctagccagcagcagcaggcacctctctgcacagcgacgagacacaattatcctttgtacagagactctccctcttcccaccattcatggtatctttctgagtgagcacggggcccatctctaggcaatagtaagttttcacttctctagttaggttgtagaatatttgggtggcactcaaatattcttaaggactgaatggtcaaattaaccacatgatcctaatagaaaataaaaagtaggaggcatttgacccttcacatttgcttgctgttcctttaggtatcaccccagtatgagccccttacctcggcagcaagagctggttctgggcttcagtgtcttttgcactcccccaaccaggcttgcccctgccccgcaggtgccagcagcagcagagggggcaccttttccccaagtgccaggttctgacagcccaagcttcctctgctggcctcccaaacccagagggtggttactgtttctgcagcagtatctctgtgttctcatattgtgccttctttgattttttagtccaacatctatttgatcaacttcctatattaaattatctctgttgcctagtattgggtatcaatccaaaggaaattaaatcagtatctcaaagagatcatctgcacttccacactcattgcagttattcacaatagccaatatatggaaacaacttaaatgtcctagagaaaatatggcatatatcacacaatgaaatattattcagccataaataagaaatcctgccagtcggagaattgcttgaacctgggaggcgggggctgcagtgagccgagatggcgccactgcactccagcctgggcaacagtgcgagactctgtctcaaaaaaaaaaaaaaaaagaaatcttgctagtcatgacaacatagatgagcctgaaggacattatgctaagtgaaatcagccagacacagaaagacaaaaagtgtatgatctcaattatacatggaatctaaaagtagaactcacagaagcagagaacagaacagtggttgacagggaccagggtgtaaggggagatactggtcaaagggcacaaactttcagttatgagtaagttctgggaatctaatgtaaagcatggtgactacagttaataatactggattgtttacttgaaatttggtaaaagagtagatcttaagtgtccttaccacagacacacaaggtagctacacgtggtgatggatgcgttgattaatttggttgtggtaatcattacacaatgtatatcaaatcatcacactgtataccttggatatatacagcttttatttatcaattacatctcaataaagctgggaaaaaaattagctggtatgatttctcttttcctgactgacacagagttaaagcgggactaagttaacctcttattctatatactctgtattgttggaaaaaaaattttttttgagacaagagtctcactctgtcacccaggttggagtccagtggtatgatcttggcccactgaaacctctgcctcctgggttcaagcgattctccctcctcagcctcttgagtagctgggactacaggcgtgcatcactacgcccagctaatttttgtatttttagtagagatggggtttcaacatgttggccaggctggtctcgactcctgacctcaagtgattcacctgcctcggcctcccaaagcgctgggattacaggcgtgaatcaccacacctgggcttttgtcattaaaaatttttacaagaatatattcatattcattaatcagtcatataacttaaggcttttttttttttttttttgagatggagtctcgctcttgttgcaagcagtggcgcgatctcggcttactgcaacctctacctcccaggttcaagtgattctcctgcctcagcctcctgagtcaggcatctgccaccgcgcccagctaatttttatacttttttagtagcgaccgggtttcgccatattggccaggctggtcttgaactcctgacctcaggtgatctgcccgccttggcctcccaaagtgctggaattacaggcgtgagttaccacgccccgcctcaaagcttttaaaaaagagatcagtcaatatgcactgatatagaaagatgtccaccatctattaggtgaaaaaaaattaagttgtaaaacattatgcataggaagatcccatttttcttaaaaagatatatatttacgtttgcatacccacagcaaaagtgggtagaaccacaccacacaccaacttaagtttcattcgatggtgagcataatgaatcagagaaaggatcacttttcttttacttcctacacccctgtaattatgttcagttcctctgaagcatgggtaccagtactccagggtataaacacacatccaggctctaatccacacataaaacacttggccgggtgtggtgggctcatgcctgtaatcccagcactttgagagaccaaggtgggcggatcacctgaggtcaggagtctgagaccagcctggccaacacggcaaaaacctgtctctactaaaaatataaaaattagccgggtgtggtggtatgtgcctataaccccagcgactagggaggctgaggcaggagaatcgcttgaacccgggagacagagactgccgtgagctgaaatcacgccactgcactccaccctgggcaacagaataagactccatctcaaaaaaacagaaaaaacactattttggagaaccccagaggctcaacagtgctcctcgatgagggccatttttgcccctctgctgggaaggggaagggaggatcaagcgttgcctagacacatttatggttgctgcaatggagacgggggtactgctggcttctagtgagtagaggccagggatgctgctaaacagcctacaacgcacatacctagcactctcatgacaaagaaaagaaccagccctacatgccacgtctgagaaactctgctctatataacttgactattgttagtacttctgtggtcaaagtagaaatattccatgtctaacgctgtggacagctagacatttgccagaattgtgcaaggagcagttggctcagaagctttgtttttaggtttggaggatttgcttttctttaaataaacaaacaaacaaaaaaggtgggggcactattcaaacagcacacacatatgactaaaacattcaaagagtacagaagggtatatggtaaaaagtaagtttcctttccactccagccctagccagccagctcccttctgaagaagacaaccactgtcagcagcttctttcccattcctccagaggtattctaagcacacagaagcagtgtatgcatgagctcttcctctgcacccaaggccccccactccaactggcagcatactctgtctcctgttttataatttactttttcacaatatcatggagatcattccatttcagcacacataaatctgtctcattgttcaacagctaaacaggacataatatggtatactcaaagacaatgatgttgtttccaatattttgctactactgacaatgctgcatgaaataattttgtacactgcctttgggcaatacattcaagagaaattggaaagtaaattcctagaagaattcctggatcacatggtatagacctttgaaattttgatggaaaatgttcttttgagtaaaacaataacaaaaacctaatagggagatgagttactcaagtgctctatttagatgctttaataattatgtggatattcgagttacacagcaaatagctcatgtgctaatcatgaaagattggtcacaggaagcatctacacacagatagttccttttatgacttagtttctgaccttggggaaccaggataataaaaactacaagggtgaaaagacaataacaagtgttggtgagaatgtggagaaatgggaactttcgggcattgctagtaggaatgtaaaatggtgcagccactttgggaaacagtttggcatttcctccaaatgttaaacacagttaccatatgatccagcaattccactcctaggtatacacccaggggaattcaaaaatgtatctccggcagggcgcgatggctcacacctgtaattccagcactttgggaggccgaggtgggtagatcatgaggtcaggagttcaagaccagcctggctaagatggtgaaaccccgtctctactaaaaatacaaaattagctgggcgtggtggcgggtacctgtaatcccagctactcgggaggctgaggcagagaattgcttgaatccgggaggtggaggttgcagtgagccgagattgcgccactgcactccagcctgggagacagagcgagactccaactcaaaaaaaaaaaaaaaaaaaaaaaaataataataataataataataaaatatatatatataaaatatattatgtatgttatatatataatatatataggcttggaggatttgcttttatttaaataaaaatatattatatattataattatatatcttatatataattatatgtaatatatattacatatcatatatgttatataaatatacagtatatataatatataacatatgcattatataatatataatgcattatataatatataatgcattatataatatataatgcattatataatatataattatatataatatatgtccatcttcaaaggaggaaaaattaggtagctaaaaacaactatgtccatctattccagcaggtgtagataaaaaaataaaaagaaaatatatgtccacatacaaacctgtatataaatgttcctagaagcattatttataatagccaaaaggtagaaacaacccaaatgttcatcaacaaatggaaaaacaaaatatggcgtatctgtacaatggaatattattcagccataagaagaataaaagtattgatagatgctacaatatgcttgaaccttgaaaaaattatgctgagtaaaggaagccagtcacaaaaggccacatactgtagaattccatttataatagatgttcagaaaaagcaaattcattgagctagaaagtagactgatgattgtcaaagatgggaaatgggggatgtgggagggagaatggggggtgcctaccgatgggtatgggttcctttttgaggtgatgaaaacgttctgaaattagtgacggatgcacaactctgaatgtaagaccaccgaactgtatatttaaaagggtgaattctatcccaataaagctgttaccaaaaacaaatacatggaggactcctggcataccgtagctacgcattacaacttccaaagcctcttttggaaagagataaactgaaattcagggtagcccaagctgttttaggcagacagaatattttcagcagaatttactgatgcattgttttgtgtgtttttttgaaagtgtacaattcagtggtatttagtgtatcgcaatgttgtacattggttcaattctcagtattttagaacctgtaaatcagtaagttgattaacaaatctactgagtaccccattctgagtcatttctaggtattctgggaagtaaggagggaagcacagttctcatcctcaagaaaccgaaatcattcttaggaagagaagacatgcagtgaagaagatgtcagcatatgatggaccttcagagacagcaaagaaaattatctccatggagaaacaggatttctagattgggttttccccggtatttagcagacgcagaaaattctggttttcacaggaaaaaaaggataaagaaatgagtaaaaacagatcaaatgtatatatttttaaaactccacaaaactatagggtcacaaaatgacttaagaagcaacattaaatggcaaagccaatcattcaccatgagtgttgatgaccatctgaaatgagcattagtgtcctaacacttaacgaacatgtcacttgtccctgttccagcccgggccacgccctacatgtctttctgctctcacagtgctagtgcagagtcctgcacacaatcaaaagaatgaatgttgtcatcatccttaaacacaagcagacacaggacaggtcttgctacattcaggcagaggcccttactgcttgtctgaagtgtgtgtcacagtatggaaatcaatttcttgactcctacatcaagttactacttgattagtatcttctataatggtaacagatgaaaactcaaaatgtaaacaaaagggagacaccacagcacagtggttaagagcacaggctctggagtcagatctggtttgggggttaccagctatgtgactttgggcaagagatctgactcctctgagtctgtctcctcatctgtgaaatggaatgcaattgcacctaacaatggggtcttgtgagagttaagagacatttcttgagggtttactatgtgtcctcaaaaaacggttggctggcattatgaagactgggaactctcacaaatcaggaaggtctgaaagaggccacttttccccatcctcattgtcttcgtcttctttgcaaaggcctctgggtctagtagtgcctggaatagaccaggagctgacaggcttgccagggacctttgctgaatggcccaaggaactaggatacaggtgcacggcagacctgggagacagtgaagaaaaaccacaactgggaaggctttccagagttaatttggagactggcttcaggaatgctggctatacctagggcctagttatttggttagcccagagattgttctgaacgacatctgatggtgcaatgacttcacacctcactgtctacattgtcatataaattcacactatgagtctaaacaggtttttgcttaccatttagaggggttaaacagcatcagagggggttcaaatatataaactgaaactggtcaaaaaagaatagccacatttcagaaaatataccattggtgagctttttttccgtgataaggctaatattttttaaaaggaggcacagtgaatttaagacattgacatttatagccgtagctcgacgcttactcttggaggcccaattatcatccctgtccatcttgtaagtgtcatgtcttcgtcatcttctagaccccagctaactgtgccatctcctactcctttctggccttcttcgagttcttccaacagtcggaaattgcgagggacttttactcctaaaataaatggaaagaaattcaagataccagcaactccaggggaacttgtaagcctagagctagctgctcattatctctccctgggaatcaagatgctaacatgcaaaaaaatcacggaaagttatcacacctcaaacttgctacttataaagctatcagtatcaaccagcacaaccagagggaaggggcacatggttctctgacaggtgaagtgactagggctagataaccaaacttagaaagataccccacccctaccccttggacaaacctcctaaggggcttacatgtctaaatgtctatgaattggggtcaactagtatgagatgaaaaccatcaatatcaggtgctaacaaaagtaccttggaagacaagaggctaagactacgcttatttgttggcatgactctcaaacaacctttaggaggaatagtcaccatggatatgggaaataaaaatggtatcctcttaatcaactaagagtcaactgaaggcaccaaggataaaatattctattgtttttcaattatttaagtgatagtttctcttttaacttacaaaaaagctaaaagggaatagctggttctcaattgttttccaaaaatcccaaagcctggcaagtagctcttgaaagcaacgcatgaaaacacctcacaggttcaagccacagtaccgggttcaggctgaggcttgagccatttctaggtgtcttccagaacagaacctaggtactggggccagacaagggagggggctatgggaggagagagagatggactttccttctgtgcttggggaacaaatcatctctcctagggttgcactcccaaccaatcctgactgtctctccttcctccattttccctggcatatgcactattttctctggaaaaaactcaggatccagtcaagtttcaagttctctgccttgaatgctgagctctcaattggccagactctcagagacaaacaggactaaccatgtgactgtgaagagaggctcactggagggaccccagattgtgggaggtgttgccagtatatgtatttcccaaagtgtaggacacacgccattaattcaattggaataaatatttgagtacttagtatacatcggggacttttctaagcactgaagaacaagcagtgaataaaacaaaaatgcctgcagcttacattctagtagaagacatataatggacaaaaatgaatatgtaaattatacagtatgacagatcctggtgttccggaggagggagtaatacgggaggggctatacttttaaatggagggataaaggaaaagtgttattgcaatcaggtgtcataactaaagacctaaagaaggtgagagggcatgatttatggatagctgaggagaaagtctttgagacagagcaaacaagtgcaaaggccctaaaatagaggctgcttagggtgtcaaaggacagcaaggaggccaatttagctcaaaccaagtgaggaagatgagagagcaagaggagattaaggatgccaactgttactgagtgacatgatctgtcttgtttttaataggatccctcagactgctgtgtgaggatgagagtgaagggagcaagggcagaagcagctaggaggctactgcaataatcctagcaaaagataatacccgtttggaccagggtgatagcaggaaagtagtgaggagtggcgtaattctaggcatttcagaggtctgagctgtggagatttgctatcaggttgcctgtgaggtgtgagagacaagagtcaactacagctcccaggtttttggtccaagcaactgaaggacagagttggtagtggtatgttagaggactttcggtggtatgtgattgaacacttcgttttacagtcacgtatttatgtttaagaataacttatttagggtaagtaatatactaacttcccatttataataatggtaaaagtttcctttaaaataaatgtaagcaaaagagtcagttgattacaagaaaaatattaaatagtactacatatggtatttgaaaggaaacagcaaaacctgcaagcatacttgaactgcttgtttggaaaacactggcattttcatctgcacagcagccaactggattattcagctatactggattaagtctcctgtagcaaacataaaactgaaagatagtggtgacattataggcaaaaagccagacaacacaactattgttcagaaagggttcaatctaaatctttaataatcctaattaggctagcgggggaaaagtcactacattactactggttaatttacaagcctgcactaataaaaatgaacatcaaaagaatcatattgataggaaggctgatgactgaggtacttgttcacagatcgtgctatgggctgggctgaactgtgttcccctcaaatttatatacttaagtcctaactcccagtacctcagaatgtgacaaaacctgctgacaccttgatcttgggcttctggtctctagagctgtgagaaatttgttgtttaagccccacccagtctatggtattttgttatgacagcactagcaaactcatatagatgataagtgacatcttaaggagctttatagagttggtaaggatacagaacaagatgttaacagctgttatctctgggtaaaagaattatggatgattccccctactttctctatttcctgatttttttacaacaatcccatgttatttgcataacaaaaaaccaattaggaaccatttcaactgcacccccacgcaaggacctacccagggcctgtgcgactgtcattcctgctgtccagaaggctccttcccctaggaatccataagccaagctccctcagcttctttagggctttggttgtccagcacttcatctcaataaggatcaagggttcttctctgagtaggaatctcacttaacggcattccttaagtgactaacttttaatggacaatgattttaatgttactaaaacttggtcagctgggtatggcagctcacacctgtaatcccagcactttgagaggccaagacaatcgtctgaggccaggagttcgagatcagcctgggcaacatggagaaatctcatgtctacaaaaaaatacaagaattagctgggcatggtggtgcccacctgtagtcctagttactcaggaggctgagaggggagggtcacttgagccaggaaggcggaggttgcagtgaggcgagactgcaccactgcactccagcctgggcgacagagtgagaccctgtctcaaaaaccaaaaataaacaaaaaataataaataaattagctgggtgtggtggtgcacacctgtagtcccagctgcttaggaggctgagacaggaggactgcttgagcctggaaggtcaagtctgtagtgagctatgatcacgccactgcattccagcctgggcaacagagcaagaacctgtctctatttaaaaaaaaaaaaaaaaaaaagacggggcgcggtggctcacacctgtaattccagcactttgggaggccgaggtgggtggatcatgaggtcaagagttcaagatcagcctggctagtatgatgaaactccgtctctactaaaaatacaaaattagccgggcgtggtggtgtgcacctgtagtcccagctactcgggaggctgaggcagaaaaattgcttgaaccctggaggcagaggttgcagtgagctgaggttgcaccactgcactccagcctgagtgacagagcaagactccatctccaaaaaaaaaaaagtgttaagactgtcaaataaatggcaaagtataacagcttctacagttaagcccttcattactgaatggaagctgtattacacaagtgacctctattttgagttgctctttttggcaagacaaaaaaatgtgttagtttcttatgtcaggtatttaaatgtcagctggactatttatagtaggactattcctcttgcaaacttaagcaaagaacttctctatggctgaaaggttaccttttcacctaacaatcagatctgattaggaaatcctaacattcaaatatcacaagcttgttgctattagtttcaaaacagtgaattcaagttataattttctgatatttaatttttacttgtgaagtagggcaaaatatattagtaattaatcctatacttccaacatacatttctactggattagatattcgattacttaaaaacaagtgtgcaaagcccacacatacaactgaaccaaagaaataagtcaggtcaatttattttaggctaggatttggaacaggaattgagacccacagagggaaaggtcagctttcttttgttcctgcattataggacaatttgattctgactcaagttgtaaagccagcaccagaaacagtttaataaatgaaaaactttggactggccaatatctatctgtattgcaactaggagttgtgatatacatataaatatctataactgctatctactgaacaattacaataaacatttatttcatttgaacagcagttctcaaaccttttgctctcaagaatgctttatactctcaaaatcattgaagacctcaaagaactttttttttttttttttttgagacaaagtctcgctcttgttccctaggctggagtgcaatgacgcaatctcagctcactgcaacctctgcctcctaggttcaagcaattctcatgatgtttaatgtgtatagaactggacttcacatttataagcaaaaaaaaaaaaaaaaaaaaaaaaattttacacatttcaggaccacagtgaaaaaaagtttgcttggctttttacctgcttgtcaaaatttccctatacataaattatcagtaacatataggcacacacaccttctctcagtgtgatagttatccaatacctatccagcactttgctagacaatctaggggctatgaacaaaataaaaactggggtctccctaacacagtctaaggtgtcagtgtggaaacaagatatacacaaagggcaatgaaataaaaccatatcaaagcacgagaaacagaacctaccagaggacactgttacttagcctttgagggctcacagccttctctgaaatctgacaaaagatgaagaggttggagccatgttactactggactttaccttaagggtaatcggggggagctgcaaaaggctcagagtagggcaagagataaggcatatccaagtctcctaggtaatgatcagctttggggtgtgctactgctaacgtctcaggatatagagccagaagcatttgcctagagcaaacactgtgaccgaacatgtggcatcaaacttcttataggcctgcgtgatgggaagtagaagagatgtagaagatagggtaattaattcaacagctcatattcatttgcatgactgtggtggtagttcaaaaaacaacaacaacaaaaaacaaaaaaactggcctgtacccagtacttcagataaatacctgttgaaaattttttaaatcgagtaaaaaaggacaaaaggtctgcaaacctcattttctaaaaaacaaacacaaaagcaaccttgtatgcatccttgcatgttcattgtactctcaccaatgatcttggggtgtcatgacccagaatcactaacgtaaggatacctggtctaccactctgtttttaaaagacaggtcagagtaatggatatattacctcccacatgcgctaccatgcctgactaattttgtatttttagtagagacggggtttttccatgttggtcaggctggtctcgaactcccgacctcaggtgatccgctggcctcagcttcccaaagtgctgggattacaggtgtgagccaccgtgctcggccgacgatcctcttaaaggtaaactaggtgccctcgctctcctaccagaagcctactcttggcctcccgttgcacccgcaatccacccaaacttgtcacctggccgagagagccccacctgcttcgccaacatcattttgtgccactctgccttgctcccccatcctcctccagctacaccagtccttctctaagtttctgaagaggcatccttacatcccgcctttgtatttgtgagtccctcaccctggaattctctgtcccagagctgtgaatggctgactggttcccttgtcctcaaccaagggtctaactgtccattcccttatcttgccttatttttcttcatagtactcattgccactcgacattgtaaatatattcattttcactttattggttgtttcttgtctgtctcccatctgaacataagctccatgagagtaaaacttcatctgttttgttcactgctgaatctccaatgtgtcagggtgttttgccctctagagtaagcacccaaatacttattgaaagaattaatgaatgactaggtattagctaggaacagtatttcagaatgaacaacgctcaatgtcacaaaattctaatctggtttatttttgaaaatacaagagagaaacattcacagcaccattatctgggagtctaacattataaggattattaaaggggcttagtatgaattttaaagcctaagaacagttatatattaagaggcagagtcccactctgttacccaggctggagtgcagtggtgtgattttggctcgctgcaacctcggtctcctgtgttgaagtgtttcttgcacctcagcctcccaagtagctgggattacaggcgcctgccaccacgcccagctaatttttgcattttcagtagagacggggttttaccatgttggctaggctggtctcaaactcctggcctcaagtgatctgcccgccttggcctcccaaggtgctgggattacaggcatcagccattgcacccggcctgactataataattttaaaagctataaagcttaattagaagccaggcagtcaggagaggccctctcagagaccccggtcccggtcccaaacacctttacttccacacaggcatgtgtggtatgttttctttacatttgattttcttccttttttattgtctgactcactctctaagtttctcaagtcagagctgtgactcattcaatcccgcctccccagaatctggtatgctgtctggcatataatgatactcaatatcaataaatgtttgctggttgaagaaatggcagtatcaggccaggcgtggtggctcatgcctgtaatcccagcactttggaaggctgagacaggcggatcacgaggtcaggagatcgagatcatcctggccaacgtggtgaaaccctgtctctactaaaaatacaaaaattagctgggcgtggtggtgcgcgcctgtaatcccagctactcgagaggctgaggcaggagaattgcttgaacctgggaggcggaggttacagtgagccgagatcgcgccacggcactccagcctggcaatagggccagactccgtctcaaaaaaaaaaaaaaaaaaggcagtatttcctattgtaaactctaatctactgggtccaaaatattggacactgttgccatataattaacatacctggctgggcgcggtggctcacgcctataatcccagcactttgggaggccgaggcgggcggatcacgaggtcaggagatcgagaccatcctggctaacacggtgaaaccccgtctctactaaaaatacaaaaaattagccgggcaaggtggcggctgcctgtagtcccagctactcgggaggctgaggcaagagaatggcgtgaaccccagggggcggagcctgcagtgagccgagattgcgccactgcactccagccagggcgacagtgagactctggcacaaaaaaaaaaaaaaaaaaaaaattaacatacctaaggttttttattttgagataagtaaaatttggtaaccatttctaatttatttttagagatggagtctcactctgtcacccaggctggagtgcaatggcgcaatctcggctcacttcaaccttcaccttctgggttcaagcgattctcccgcctcagcctcccgagtggctgggattacaggcacgcgccacgacacccagttaattctcatatgtttagtagagacggggtttcaccatgttggccaggctggtctcagactcctgacctcaagtgatccacctgcctcagcctcccaaagtgctgggattacaggcatgagccaccacacccagcctagttttatttttaataaatgagaattttaggaaaacttaccattttttttaaaataagggaaaactggtttctcacccaaatcacataagtcaaagaattcttcactataaaatgaactttgtttcataaagtatgtatgaaagcaagttactaatatttcaaaccatttaaaaactgcatacaaagttacatcaatattttctacaaaacaaaagagcatttaattccaaatggcctaatcacaccctagttatagaattcagggtctactccagggacataagtccaaatatggttggaattcagagatcctgcagacttcaggatgtatcagtgacaagcgaaaagctcatcctatcctaaatagagtttaaattcaaaatcacggtacattaaacaaaacattttagtgaatatattaaaaaattaaacgtacatatgccaaagaacagaagcacaacagatgagaaaacccaagaatactctaacatatgttttggtcctctagcactttaatcaattgaatcaacataaaattttaggattcccaatatttctgtgtgaatctgacaccaaaaaggcagctggagaaacagcatcaagtgacaatatggaagacataaaaatggactcttacaggccaggcgcagtggctcacacctgtaatctcagtactttgagaggccgaggtgggagtttgagaccagcctggccaacatggtgaaaccccatctctattaaaaatacaaaaattagccagttgtggtggcacatgcctgcaatcccagctaattgggaggctgaggcatgacaatcacttgaacccgggaggtggaggtttcagtgagctgcgatcatgccactgcagcccagcctgggcaacagagactcgtcaaaaaaaacaaaaaacaaaaaaacaaaaaaacaaaaaacaaacaaacaaaaggactcttataatcttgcaaaaccaagagaactacaggctctataatagctaggaagtacactaggaaaatctatagctaatgataagtataatcaaatagactatgactattaaaaagtgaattatgaaaatgctaaaaaaaaaaacttcatcaaggtgctaaaatatcacagtaatccaagactttttgaagaaaatatttgttcctattatttcagaattattctttccagaaggctttttcctggacctgtgtcagtatcaaaagtcagccggttattctcttagctaaatataaactgaaaagacagcagttgcaggatattacaaagaaaatatggcaaccaggttgaaaaagcatgaatatttgatagagctttacaccatgccacagtaaaacatttaatgcagtaatctgaaacacagcaacatattaatatatttgtggtacaaaaaggattctgaagtcgtttaaaacatcttttgggaaaatcatggccaccaagcagcagctaccacagcatgtcaatcttggaaaaccctggcctaggtcttgaattaaaatggtagagctggctgggcgtggtggctcacacctgtaatcccaacactttgggaggcagagatgggtggatcacctgaggtcgggagttcgagaacagcctgaccaagatggagaaaccccgtctccactaaaaatacaaaattagctgggcgtggtggcgcatgcctgtaatcgagctactcagggggctgaggcaggagaatcacttgaacctgaacctgggaggcagaggttgcggtgagccaagatagcaccattgcactccagcctgggcaacaagagtgaaactctgtttcaaaaccaaaaacaacaacaacaacaacaacaacaacaacaaaaaaaaaaaaacaaaaaaaaggtagaacctcagaggtttctcctgaaaagaaagctgctagttaaaaatggtttggttgcccattcagggaagacagtgaactgagctaggaatctgatgctgctcccacttcagaaaatgaggaggtatggaaggtgatgcactgggattcaacgtccctgaaaactggacatagagccataagcaagtaacttttatttctgagcaaccgcccaagtgtagtctggctgtctagttagcctgcccaggagatctgttcttctccttctctagagcaatggttctccaagttagtccccagacctcatcgcaaactcgctagaaatgtacattctcaggtcttcagcccagaattcctgaatctgaaactccaaggttgggcctaagaatctgacaagccctccaggactctgaggtatactagtttgagatccattgctctaggggaattctagggaaagaattagtagcaagctgtcattctttacagtccagccacgtgacaacagctagtgacagaatgcaagaccctgtgttctgctgctagggtcagtgaccaagaccaagcatcagattttctttgacaaagggggaaacaagatgtgggaaatgagtcaggacaactggagaaggggaggatggttaattctacgatcaagtacctctataaataccaccaaataaggataagagtttcagttttttgaaaggctgaatagccacttttgcttctgccctatcggatacattgtttctccacaaattgtcaaatgtatccatttggctacatcaaagagattctgaattaactcactgcaacattcacaaatatttactgagtacctactattttgtccagaactgtgctggtgctagggacacaacagaagttgagatagaatcttgccctagtgaaaaggcatagaaaatatgcaacgaaacaacacttcaggtaaggttaagtgctttagagaaacagaacaaaacaagaagctgtgacaatgactaaaaaactattgaatggagtgctcagggacggcctttctgggtagctgcgacctgaagaacagcagtcaggcccatgaagatctggggacagagcaagatcagaggtgtgtgacaccacatgaagtcaaggcggcagggccttgtgggccatggaaaagggatgggttattctgtaataagagcagtgggaagggcttgctgaaggggagtggcagtttctattttacgtctgtgaaagatcattctgtctcctgtatagaaaatggaaagggcaagactgaaagcaagaggctttttccatcttccaggcaagagaaagacggttctggttagattaggatgacaagagtggagacagaaaggaggatttggcatttagtttggggttacacctactggacttgtgacagggtggatgtgaagatgaggaaagactactacttgagaggtcactgccatctacccatgaataagctaatcagccaaggcagaaataacagacatgccaatggctgaagatgcttgcgaggcctacctcagagaataagaaatgggggctggaagaacgatcatccggccaagagcacgtgtcctgaagcaacaccatcccagagcacccaggctctgcacctcaggctagtcactcctctcctggcctgtttcctcaccttcacaatcgatacctgcctcaatgggctgttgtgacaagtgagataatgtagttaatacagtgtctagcacttagtaaacccaagagtgcaacttaaaaagaagtctgatggcttgcatgtaaataaggatgaggtactactttgtacctgccatgatggggctccaagcccaagaggtgtgagtcattcagtataaaatataagcaagagcttcctgaaaaaaggacctcactctccttggacagcacataacccagaagaggacaaacagtggccagagatgctataaaaagggttcctgaaacgggtagcagtagacacttcttactaaagccctttctctctccaagattaaacactccaagacttaggaagaacatatccctaaatccatgccttttccatttcctgcaggctggtgagggaacaggagttaaaaatgcctgggctctagtccgagcatcaccagtctcccttggcttttggctcctccctcagtaatgtgggtggatactgcccctggctggtgaccaggctgtggagagttagatgagacaacatcacaggtaagtcgaagtctatgggacactctaaagcactatccacaatacaacagtaatagtattcaaacatttactttgccaaatgtgctgctctgaacttcactgtgccccttcaaaattaagcagaggattcctgacttcatattttgtattctacttttaccaaattactgcagagctacaatttgtggggaggtgggagggatagagatatgaagagaaaagagaatgtggtgggggaaatagagtggttttcagttaacatgaagggggaaaatcatgatcatcaaaattaaccttggtaatcccttaagaaaataatagcttgcagcccggcacggtgacttacgcctgtaatcccaggactttgggaggctgagacgggcggatcatgaggtcaggagtttgagaccagactgaccaacatggtgaaaccctgtctctactaaaaatacaaaaattagccaggcgtggtggcgcgtgcctgtgatcccagctactcaggaggctgaggcaggagaatcgcttgaacctgggaagcagaggttacagtgagccaagatcacgccactgcactccagccaggtgacagggcgaaactccgtctcaaaaaaaaaaaaaaaaaaaaagcttgcactagcccaacaaagccagtttcccctccatcactggagcaggctgctatttctttggctgagcacaatatgaagctgttctttgaatgtagggcccatgttgtacaaaaggcacttaattacaattggcataagatgctcacacagtgagacatacaggaactgagaagaactaagggactgtgagttttcatccatttccagctctctctggggaagactcttgaatggaagggaagactaatctctgctgcccacatggttaagtttttataagctgaatgtgcatatgaggccactccgatgtatgcaaatttaaaatcatgccccaccagggcttacccctctggcactcattttctgattaaatgtcagggaagctcgtgggctgctgagtgagaggaagggcctggcaaccaagggccactatttgatgtgctgcaatcctggccaaggcaggaggaagtcacccgtcataacatggggattctgaggatctgtggtgggcttttcacagttccaccctctaagacatatgtagatatcacacattgcagaaccaaaggaagtgggaaggtggtgtagccaaatgctgaaagcagtgaccataaaaaactaagttcagcccttacaggaactcaaaggcttcacagctgtttcctggcaaccggaggcacagattaatcaagagcctcactctaaacctgactaaggaaggcctctgggccctgaccacacctggaagacttctcagggttagaaagcagagaggcctgtacactcattttagtttaccccaagtaaggtctgctttactcttagcaccctgcactcttttcactgcctagggacgaaggtcagatcttatcatactcctctttttaagactcttattcattcattcaacaaatatttactgaatgcctacttcataccagacacttgtttgatggcttcccctcataccatctcaaatccaaagccatgtctctccaactcatctccttaacaagccttgcttgcacatgaaggccttttatcctgttatttcaacatgccaagcagagtcccaccacagggcctttgcactaacagcccactctctctcctgcctgtgacactgtagggttagctctttccattatttgactcagctgaaatgtcactttcctgaccacctctccagacactatcacatcacacaatttcctccatagcacttactgctatctgaaattgtcttatttactccttaacagccttctctccctgacttgaatggaagctcccgaaggatacagactatgtccattttgtttgctatccacgatgggacataataggccctcagtaaatatctgttgaataaacagacaaaagaattttgggaagtccattttagggcacctcaaagcctgtcctatgttatctaaaccatgccaagtgctcttgtattccactagacagcagctgacattttatctgatcaccatagccatttatgaagcactcactttttaactgtcagggtctggagaagttagaaccgggcagctgttaacccagattgtaggtagccaaccgagtgactgcaagcagggctgagctgcaacagcaccttattgctggctaccaccagcacactgggccccttcgtttattacgacccggtaggagtgttattctggtgagaagttttacccagcagtctggcctgactcagaatctctcttctgggagtgcctggggcagcgtcatggtaaatgaattgactcagcactgttccagctgaaaccaaaatcgagtaaaaggattcatggtctccgctattctgcaagaagaccccactgttttaaactcaaaaggcagcagcttgtggtgggtcacttcagtcagatcccccacattcaatttcttttattcccaccccaaccatcaggcaagtatggctccttgagaccgcagagtagcaacatttataaagaattcccctcaccctatttcccatggatcaccaattccttcccaacactgccgctgctgtggccttaaatatgccaatgattgctgtactcaggctggtgtccctgcagccccacagtggggaacactgtggccctgtttgcttcctccatcagagaggtaacccattttcaccccatctgagagaacctccttggccaacttcactgccaggcacctgagggtgcagcctcacccaagagttcccatttcatctattcacctccctactcccatcagccagtggggaacttctgagctgaacccacatatctgtcccaattattaaaggagtcgatgagagtgagcgtctccacagaagagacacttctaggatatgcttccctcactcaattcaaaaagaggagacttttctcctttacaggaaacatctccggaacccgaccttttccactccctcatttcaggggcttccctcagttgaatccccactcccaaagagacatcctcggggctcccaattcatctgttctccctcatccaatatcagaggcttccaccaactgccccactcggaccttgtcccctgaaacctaacttgaagcaatccatctgtatcctcgaacaggagactggtaatgatggggtcatttcactatcaccgctattaggtccctctggcatctgaatccttttccctcctctcacttatcatgcggagacccccttcattctccccaaaagcagctgctccaaggctcctcctttctagtcaacatagctatttcctcagctaaccccatctctaaaactaacgccggagccgttccctcaaccgataggggatcctctcaagtcaccccctcaggatcccgtttcttccatccagcctgaagggcttctctgatgtcccctccagacatcccaaggcccctctcagccgcacccctggcacccagtatgggacttccatccgctgtggggcgcctcctctaggggacctctagatcgccccttaagagtcgccagccccggtatcctcaggagtgcctcggagctcgctcctcgcccactccggctcccccagacagcacagagggccctcacgcctcccgggggagcctcagggcctcgccgcgccgcccacaggcccctcagccccccgcccgtgcttccggccaccgcctgctcctcctcccccggtcaggccgcgccggtggctgccgcggagcccagcagacagaggcggcgcggggaccctggctccgctgcaggaggctttgagggtccccggcccccggcccaagcccatgccccctcggccggccgggcccggcgcccccgctcacccgagcccgtggtggctgccatcttgcgtcgctcttgcttgaaggccggccccttcttcaccccccccttacccgtcccccggccctgatgcgcaggcgcgcgcgcacgcacatacgccgccgctgacgcccgccccggagacctgcacgacccgtggcctggaaggctcttttccttcccttttagagaaaggaaatatctgcgtgctcgagggcccagcaacctgcaagtccccacacatcgggtgcgagggaggttgtgatgtgcttagtgagaagggcaggggtgactaggcttgggaaggcgcgattgtgaaagaaaaagaaaatatagcttcaaacaaaagcgccgaattcgcttggggctttttcctgtctagttcctatctagatcctcaccacatctccgcaaggtcagaattaatgtgaaaaatgcagccgagagagatcaagcgatttatctaaactcagctgttaagtggcagagacaggcagaattttaacctccaggttcaaattttttgaatcatcaccctccaggtcagatgatctggctcctaggattgatgctccccggccagagaaggcttggagtgggtgcagctaaatgatttaggggcattaaggtggcagggaaagcatttgctaaccatctacccaattcattcattcattcattcattcattcgttcattcattcattcaaccaaacaaacaaacattaagcacctactatgtaccagacactgtgctaggcgctggggatggatagacatctctgaagaagcaaatccctgctttcagggacttacattctagtcgtagacagcaagtaaataaacaggaaactataattctgatagggtagagataaaccaagacaagagcagcagaggatggtcaggaagggcctcctaaggtggtcatatttcagcagagaccgtaacaatgaggaggtagagggaacagcttgtgcaaaggcccttgggaaatatttttgcaaataaataaacccaagaaggtactcctcctttattataaattgtctgagaagcccttatatggatgtagacactgaggctgagagaggtgaagggactggcttaaggtcacagagcaaaatactggcagaaggaccaggactctaaacatagagggacaaggaagctggaagccctcacccagcacatccaattcatcacctttgtctgatagcagtgcctactctgcatctctccactccgttcacttctccactcagggcaagctgcctttatctcccacttggaagaccccagcagcttccattctctcccctatggcccattctccatatagaccaacatctgctcaaaacaccctccagctaaagccttcagtggctccccattccctctggataaaatacaaactttacaagttgagcgaccatagaattatcacctaatgaggacacacatcagattaaaaggggacttattataatctcaccaggacaagtggaaaccagggctctccagggcaaagcaggatgcctggacaccctgtgcaccaggctctgcacccagggcagggacgaggatggggtggtcagatttaacggggctttcactcaggtcctgactccgcacttgcacagcgctgcaggtgagtgactccttaaaatctgcaccctagggcagggcatggtggctcacacctgtaatcccagcactttgggaggccgaggtgggcagatcacctgaggtcaggagttccagaccagcctggtcaacatggtgaaacctcgtctctactaaaaatacaaaaattagcggggcgtggtagcacacacctgtaatcccagctactcgggaggctgaggcaggaaaatcgagcgaacccgggaggcagaggttgcagtgagctgagattgcaccattgcattccagcctgggcaacagagagagattcagtctcaaaaaaaaaaaaaaaatctgcaccctaggtaccccacttgcctcaccatagccttggcacagcctgcgcctctgagactttctgtacctctgcggcgacactggccctttgcaagccccctggaacacatgccctctcccacttcaggggctttgcctgtgctgttcccactcttcagttctcagatccagcaccatcccctcagggaagccttcctcgattcctccaaccacatcaaattcagctataattagctctcaaagtgccagcactggctacaggtgaagcaacttgacttttcgtgtatcacgtgatacaagtttgctttggggagcacagaaaatacttgccctggacttggggtcactgtaaagcatcagtagcaagtggaagcatttgggttcctaaggtggactcacctttgcagtgaaattttctaggttcaagtcttccttcatcactcagtttgctttgtgacttcaggtaagacgcttgaacctctcctggcatcagtttccccttctatgaggatagtagtatcaacctcataggattgctgtggagataaaatgctttcctaaaaccccttgggcacagggaagaggaagggacactagaagagctcataattaccaagccgttacatccaacttttaatcctcacaactcgatgcagcaactcctgtgaatatccccatttttagagatgagaaaactgagactcagagctaacaggtggagaggatgaggattaaaacacaagccttttatctatggtgcccgtaaatgtttactcgcatggattccttggctcttgtaggaaacttcttgcaagtaaaattgacaataataattcccgtgccgagctcatcgcaggaagaggttaggcgggacagcccgaggcatgctggttgttgtagtctagcgttggcgcagtgcctgatgggagttgtagtacgtcccgcgcacacgctccctcgaagagtttctgccccattcctggacgtcacagccggtccccagagcaggattccttccggcgcctgcgcctgatcaccgctctgcgcttgagctgataaactcagctgatgggataagagtcttgttttatcggattttggggaagattaaaatggttaatagaactagagaatttagaagagggcttggcactaagtgcaatataagtattagctgctattattacctaatcctcaatgaaccttgcaaagtagctgttaccatttccatttgtgagatgagaaaactgagacttagaggagttagatggcttttccaaggtcacacaacaaggaaggagtaaaatcagttttggaatccagttctctttaccctgtgtcacccgctggctctcccgtgatgagggaggtggagcctgggaggttttgagctaaatgtgggcaggtttgcctttttacaaagtgcatcgtgctgccatgaggagacagggcgaggacacccaattgggcagcagcaatattggtagcagggaacccagagagaaggtgtattgggcatgtttaccgccattccagtcgccatggccccacatggcaaggtgggtgtttggaaactttccctcccctcataaaagctgaagagaaggttgggcgccctggttcacacctgtaatcccaacactttgggaggccgaggcgggcggatcacctgaggtcaagatttcgagaccaccctggccacaatggcaaaaccccgtctctactgaaaatacaaaaattagccgagcttggtggctcaggcctgtaataccagctacccgggaggctgaggcacgagaatcgcttgaacctgggaggcagaggttgcagtgagccaagatcgtgccattgcactccagtctgagcgacagagcgagactgtctcaaacaaaaaagctgaagaaaaagcctatttttgtcccctttcctccttcctacaatatgaggttgtaatggttagaattagaatcctgggtgatgtggctgagctgctgaaggaattgcagggctgcccaactgcagacatctgaagacatgagataatgtgcctgttgcttaagttgttcttaaaggtaggtttttgttacctaccaccaaaaagcatacctaatagatacaggaagctgacgcagtggttcggttgagaggcatgtagacctgacagatccacaatgtccattcgtgaactctcttttcaagtgggaaaacactagggctggtttggaatctctgggatgtaaaaggcatgagtagtttgaaaaagtatattcaaaaggtgaaaaaacaaaaattatataatgttatccacaaccttcaatttcctatttatagttaaggaacccccccaacctcgtgctacagtttttgtagcataagctgcagaaagtaaagctgacaaactgtcgacaggaaggactgtggacttgcagaagacagagaggagaagggatgtgtggttaacagagtgtgtgatgaggccgggcatggtggctcacacctgtaatcccagcacttagggaggccaaggccggtggatcacctgaggtcaggaattcgagaccagcctggccaacatggtgaaaccccatctctactgaaaatagaaaaattagccgagcatggtggctcatgcctgtaatcccagctacccgggaggctgaggcaggagaatcacttgaacctgggaggcagaggttgctgcagcattgcactccaggttgggcaacaaagcgaaactccatctaaaaacaaacaaacaaacaaacaaacaaacaaacaggatgtgtgatgcatttgctagtgaaattctatggcatttatgtggagtcatggctccctgaggtgtgtctagccatggcgctgagacatcttatttaatgtctgatgtagtttccgaaatatacagtcaaaaagcggtggggatgggtgggcagggggtcttggtgtacttcattaactcactctatcaatggacatctaagttgtttccattggcttcttctgatacaatttttgtaatgtcttaattttgtattatatgttacttctgtggtcaaggaaaaaggaatgaaaactggggtttggggcagggaggtggggggacaaaaaggatgtttccttaacgtataaagagcccttgaaactcattaagaaaaaataactcaaagatgacagttacagcaaatatttattgagcatttgccatattccaggaacatggtattttgcatataataatgtatttaatcttcacacctatcctatgaggtaggtaccattattattcccattttgcaggtgaggaaactgagacacagaacggttaagtaacttgcccaaagtcacaagcttgtaagtggcagaactgggatttgaaccctacactcttaaccaatgctaccctcccttccaagaaaaataggaaaaggacatgaacagatgaggaaatgcaaatgcattttaaactcacagtaagatacccaatctcacaaaacatattgtatttcagtgatttgaagctatacgtttttactttttttttgttttttttttgagacagagtctcgctgtgtcgcccaggctggagttcagtggcgcgatctcagttcactgcaacctccgcctcctgggttcaagcaattctcctgcctcagcctcccaagtagctgggattacaggcacccgccaccacacccagctaattatttcttttgtatttttggtagagacggggtttcactatgttggccaggctggtcttgaattcctgacctcgtgatccgcccaaagtgctgggattacaggcgtgagctaccacacccagccacatttttacatgtgaacttctgaaatcaggatgcatcttagaatcagtgacatcttagaatcaatgaaatacagtaagaggaatgcaaattaaaaccacctatcagattggcaaagaacaaaacatttgataacacgctgtgttggcaagggtgtgaggaaacagggactctgaaaacttgtgaacttaaaccggcatggcctctggaagacaatttggtatgcactatcaaaatttaaaacacactcgtggttcaagcctgtaatcccagcagtttgggagtctgaggcaggaggattgcttgagcacaggagtttgagacgagtctgggcaacaaagcaagacccccgtctctaaaaataataaaaaaaaattagctcagcatggtggcatgcacctgtagtcccaactacttgggatgggaggctgagagaggatagcttgagcccaggaggcagaggctgtagtgagctgggattgcaccactgcactctagcccaggtaatagagcaagactttgtctcaaaaaaaaaaaaaaaaaaaagtcaagtccattccatcctgaaggtggaacactatgcagctgtaaaaaataataatggtttgtgaacattaatgataacactatctccaaaatatattaagtgaaaaaaggcaaggtgcagaactgtgtgcataatatcctacatattgtgtgaaaaggagtggggcagacatacccctctgcctacataaggcattgcaagtgtcttgtcaaaatgatggcctctaaggaggggaactgagtacctgagggaacatgaatggggagcaatttacccttcattctagactagggagaggttggtaacttttctctgtaaagggccagatcgtaaatattttaggctgtgtggaccacgtggtctccgatgcaacgactcaattctgccactgcagtgcaaaagcagcctcggacaatatgtaaatgaggggcatggctgtgtgccaattcagctttacaaactggaatttgaattttctgtgttaggaaatattgttccccctcccccagccatttaaaaaatgctcgtggctgacatggtggctcacacctgtaatcccagtgcttcaggaggttgaggtgggaggatcacttgaggccaggagtttgagactaccctgggcaacatagcgagaccccatctctaaaaaaaaaaaaaaattagctggatgtggtggtgtccatctgtagtcctagctactcaggaggctgaggtgggaggatcacttgagcccaggagtctgaggttacagtgagctgtgattgtgccactgcactccagcctggacaacagagcaagaccctgtctctaaaaaacaaacaaacaaacaaacaaacaaacaacccacaaaagcttctgagctatagaaaagcaagtggctggatttggcccactgtccagggtcagcttatccatactctagccctgtttatattatttgatatgagccactgtacccggcgtgattcttattctttacctatgcaagcattacctattgcttatatagcaatatatatattgctatatatatatatatacccatatatatatgtgggtagcttgaaaaatatttttggtttatcaaaggagggttggctgggcgcggtggttcatgcctgtaatcccaacacttaggaaggctgaggtgggccgatcgcttgagctcaggcgttcgagaccagcctgggcaacatggtgaaaccccatctctacaaaaaatacaaaaagaaactagctgggggtggtggcacatgtctgtcgttcccgctattcaagaggctgaaatgggaggattgcttgagcctgggaggttgagtctgcagtgagcgcagatcatgccactgtgttccagcctgggtgacagagcaagaccccgtctccaggaaaaaaaaaaggcggggtgatggagtttcagttgggggcaggcgcccaaaggtatgtgcccaggccccttctaaagaacagtgagcacacaggggtatgcaagttcactacagctcccccggttgagctggaaatccatgtttgccctgcatgccactaccctgtgccaccaccagacagcagcacatgcctacctgaaaccaagccatcccacagcagctgggagggaggctgcaggcagttggcctatgcactcattttgttttgcccacagtacgttttaaacacggagccagcatttttaaagtttagatttctggctcctgtttaaccagctgctgtgagtagcagctgccctttaggcctgatgtctccaggtcatcccagtccccagcgtcagcggccctttctcaggcatgctgcagttgcctcatagtggacacatttctcacgtgccacctgtctcacctccctctccacaatgggagcgttaaagcacaggggctttgggtcagacgctggctcaaatcctgattctgccacctaccagctgtgtgaccttgggcatattacatgacctctgtgcctcagtttccccatctgcaaatggtgcaaagagtactcacttctcagagctgcagggactgcttgacaggacccatgccagagctctctgcacagtctggtgcaaagttaagtgctcagtaatattaagtagcattttcccctgtctggccctcataggcacttgtttgcaagtccctgatctcacaagtggccccaacactctcagacccaatgcagcgcaccttctggttttgagaaggatttttttccagcccccagaattcagaagtgaaatggtctgagtctgagggctgctctacccttactacctgtgggaccttgggggagtcactttacctctctggactcaggctgagggttttttttctgtcggctccaggggaactgacacagattggtggggcctggaaaccaacaccacagtggtgaggctactcctatggcctctaaagaatttagctgcctgtcccatccaccattgacttctttttgtagtaatgccttaggaagaggtgatcacaaccctgcaaatccagatggacatttttcagccctgggcaaccagagcatttcaccccactggccaatgtgattggttcagggatgggcacgtgacccagtccagaccaatgagagcctgccctgggacttccactgcaactactgggaatgcactttccactgagattgctgagctggtctagtaagtctcaactcaaagagaaaaacagagcttagagagaccacgttttgatgaatcatgtgagcccctgggtcctgccaaaccttaattcagaacacctgtagacttttccgttttatgagctaatacgattattttagctgtttactttaaatttctgtcatttatgagttgtcgaattctaacacccttccttgtgtggtcccctcaggcatagtcacaaatcaaaagtctagttggcaaaggaaaatggcattatgggtcacgttttaaaaaataaatgtcatggctggacgcagtggctcatgcctgtaatcccaacactttgggaggccaaggtgggtggatcacctgaagtcaagagttggagaccagcctggccaacatgctgaaaccccatctctactaaaaatacgaaaattagccgggcatggtggtgggcgcctgtaatcccagctactcagaaatgtcattatctgtgactgctctggagtcctttaggcatttccctgtccccaacaggctttcttttttctggctaatattgcagaaactatctagcctagactagctattgactatgtctgtagcgttcactacagaatcgcagtacctagttcataggagatgccttataattacttattcaacaaataaacaagttactaattggtctataatgtcctgacccggtgcagtggctcatacctaaaattccagcactttggaaggccaaggcggatcacttgaggccaggagttcaagaccaacctggacaacatagtgagaccccatttctttaaaaaaaaaaaaaaatagccaagccaggtgtggcggcatgtgctagtcccagccactcatgaggatcgtttgtgtccaggagttcaaggttgctgtgagctattacacctcacctctgcactttagcctgggtgacagagcatgaccctgtctctaaaaacatagtaataaatacaaataaataaaatgaccagcaggtccccactcacctcagcctatgagtctctgtataccaaatccatgttttcccaaccttgtcttccatttttccttagctcactctagtccagccacagtggctgcctcaccatctcttaaaatcccaagcttgttctttttttttttttctaagcgaagtctcgctcttatcccccaggtttgagtgcaatggctcgatctcggctcactgcaaccttcacctcccgggttcaaatgattctcctgcctctgcctcccaagtagctgggataaagtcgtctgccaccacgcctggctaatttttgtaaattttagtagagacagggtttcaccatgttggccaggctggtctagaactcctgacctcaggtgatctgtccgcctcagcctcccaaagtgctgggattactggcgtgagccactgtgcgtggccccaagcttgttcttgcctcagggcctgtgtacttgctgtcccatcaagaggcctcttccctcacttctttcgtgtctgacctcctctcctcccccaggtctcagctcagaggcccttcatgaccaccctgccaaagcagcaccgaccctgcttttccgctgtggttctgtcctgtttgattttcttcacaaatcaccacctgaatttccatgtgcatttatttgtttattgactcttttcccaggaggtcagctccaccaggataggtctttgttggttctttcaccgctgtacctgtgtacaggacagagcctggcacacaccaggtgccagtgaatatttgctgaaggaagtcacaaatagggatcagccatcattactttatcatcatgatcaacaggaaagaccactgtcctcacccaatcccctccaaaaggctttggagcagatgtcaacattaattcactgtctcaggtgacagctctcatcctgaggccagggttggggggagctgggaatggggcgagagtggggcctcacgtcccaggctccttgataccccccaccccacccagccaggaaacaccacgaggcagccaaggttaagtagactcttgctgctttgttataaatatattatgtacatccaaaacatgacattaaaatattactccgtgttacagaaaagatattaaggctttctattatttacattaaacaagcaagcacctttaaaaaaaaacaaaacaaaaaagccctactcttccttctctgacatactctggccagaggggataccgtgtcctcttccaaatgaccaagatgctctgcaggggctgtgccctgtgaagacatcttggtattggaaacatcagctctggcagggtgggggcagcagagaagtaggggtctagacttgagcaggaggttccagcctcttctggccggctaccctcagacccctgctgagcttcaccatccttgggggacaggctaggctgaaggtggtggctggggctgtccacctgcccagcctcccggggtcagtatgcagggctgtggcagaacaatgctccacgacgcttaggtgtgcctgggggctccccagaccactggggccagacaaggagggaaagaggcaactcactggccccaacgccagccacactgaagggctgcccagcggggcagggacggcaggcgtgcagggagtgggtaaacctcctctctaccaggggaggctggcagagtcaggcttgcagatagagcaactcaggtggctgaggaggggccgaggaaaaaaaaaaaaaagaaatgaaaaatcagtggctcaagtattctgtgtcatgaggggtgggctggggtacctgggcccagcccaggagatgtcctctccatctggaggggccagctcaaagaggctggaatttggcagatggcttcggtttgggggctagggaaggttggcaaccaggtagcaggctcggagaagttatttgatcttctgggcccatttcatgtcatctgcccgaggcttctcgcccgtcaggccctggatgaggtcctccaggcgtcgccagaagcctatcttctccagagggtagttgagccagcctgcagtagaaatggcagcgggagtttgaatgggagagagtagtcaaggggacattggaagagagctgaccttcactgggctggaggggcccaatgaggagtgagtcagtacaggataggacacagggaccggccaaggaactggaagtgggggcctcccaccaatgggcctggggccactcaggcctccaacccccatattcctctactttcttactatataccaggcacttacttatatttgagcacttactatataccaggcactgtggtggccttatcactcagctcaaatgctacctctgccaggaagccttccctgatcatccacttaagcagcaccccaggtttctcacattaccctttatctatctatctatctatctatctatctatctatctatctatctatcatttatctatctatttatttgagacagagtctcactctgtggccaggctggagtgcagtggggcgatctcggctcactgcaacctccacctcccgggttcaagtgactctcctgcctcagcctccgagtagctgagactacaggtgcacaccaccatgcccagctaagttttgtatttttagtagagactaggtttcaccatgttggccaggatggtctcgatctcttgacctcgtgatccacccgcctcggcctcccaaactgctgggattacaggcatgaaccactgagcctggctctatttacaatttttttaatgcagatggggtcttgtcttatataggctggtcttgaactcctgggctcaagcaatcctctcgccttggcttcctaaagtgctgggattacacgcgtgaaccaccatgacaggccaccctctttcatttctttatagcctttatgataacctgtaaccatcttcgttaattctctattttcctgttctgtgtttgttcaccccccaatccccaactggaacgttatccccaaaatgcaaaacaccatgttctttcactgctgatcctcagtgcttagaatacagccaggcgcagagtaggtgctgaataaatattgctcacaatcttacagccttccagctcaccatgaggtagatactaatatcagtcccattttccacatgagcacactgaggcttagagaagagtttcccaattagcaggtggccaaaccaggattggaactcagccctgcctaagtagttaacccatctcctaaatagcctgaattctaatccctccacctgccttccaaggagcacaaattgaggacatgaaaaagaatgtttttttgtggttctcagttctgtttccagaaagacctaaaaaaaaatagtagctgtaatttatcaagtacctactatatgccaaacaccgcatttgccattcccactatggccctaagaaggtgatatatgaaggaggcggctgcagccctattttgtaaggagaaaagcggtccccagggaggtttgtgagttgcctaaaggcacatgtggagaagctgagagttaggcctgagttagacttgacagcacctgatacacttaaccttgaaagcagcccagctggctccagagaaactcccagttcacctcacctctttcgcactggctgctaactgagcatggcacgtgggcctcctttcccttcctccactgcactgggcatgttcctgcctctggcctgctgcttcctgttacctttgctctaatctgtgctcatctatcttcagggccctcccacacttctctcctccctcttcagttgctctgcccccttctctcctccctcttccactgctctgcccgcttctccctcttccattgctctgcctcaactccagtcaggagcctctttgccattccggaaacacaccaagcaagcaaaggccagcctcagggccttcgcacctactgttcctgctgcctagagtgcctcccacagaggtctgcacggctttgtccctcagctcctcggggtctttgttcaagtgtcaccttccctgaccacccgatttaagaggcaaagcccccacttccttctcccacccctgctttattttcctccatagcagttagcaccattagccacgctacacattttattcattcgttccagctccctcactagatggtgagtgccacaagggcaaggatccgtgttttctggtttttttttttttttttttttttttgagacagtctctgtcacctaggctggagtgcagtggtgcgatttcagcttactgcaacctccacctcccaggttcaagcaattctcttgcctcagcctcccgagtagctgggattacaggtgcctgccaccaagcccaattaattttttttcgtatttttagtagagatggggtttcaccatgttggccaggctggtctccaactcctgacctcaagtgatccacccgccttggcctcccaaagtgctgggattccaggcatgagccactgcgcccagctgattcatgctattttgtttgctgcaggagcctacgcccaaagcaccatggcatgtggtaggtgctcaataaatacgggatgatgggtggctggaatcacaacgccatgaagtcgagggagagggctttgtcagtctcatttactgtgtcctcagcacctagaatagtgcctggcacacagtaggtgctcaataaatgcatgacctgagagactgttcccagagggcaaggactgtgtgacctcctgctgtgatctctgccctcctgacctcgaagatggtgcagtggctggggtggggaaagcccattccacgccactggtggccgcacctgtggtgatgcagaagtaggtctcgtggggtgagacgtggtggatgcgatggtgtttacgtggcaggatgacatgccagtcctgcaggagggtgacccagcgtggcagcccaaagtacgtgtgcgaccacttgtggatctggttggtgaaggtgccgaagatgatcaggcagaagacgaagcactcccaggggtatagctgctccagggcttctgcaggttggggagagggggggccggcacagctgtcactcgggacggggaacccaccccaaatggccctcaccacctgctcctgggcggctcctgagctgggcaagcacccaggattctcttccaccccctgcagggccgcaggcaagctcaggtgctgccctgggcttcaggctttcctcctgctcaggaagcaggcgtaatggtgtaataggataatggcataagcatggcaatggctgggaatgtagaccggagtcagctggagctgggttccgatctctgccgacatttcttggcagtatgggctggatcggtgactctgcctctaagaagcttaatttccccatcaggaaaatgggaatgatgccttcacccaggttccctagaagcggagcctgaaacaggttcttgtgcatgtgatttatcaagggagcctcttcaggaaaaaacctcgaagggagggagggaagcaagacacggcaggggaagagcagagcaaagatggggtgggtggcgtcctgtctcagtctgttcctgcaaggagctctgaggtgttaacggctctttagaattagacccactcagaggcaaagggactagcgtcggaggcgtttcagtcactggctccagccttatcccaaggagacaggtgggacctcccctccatccctggagaagctgggagctgtcagcagccaccactcacagaagcaggggctgggtgcacccccagggaaggggatgggcagggtgccatagcacccactacactacacgtcctcaccacctctacccaccggaggctgcctgaagaacaaatgggtgttaaggtgctggaacaggaccgggccccaacctacctccacctgacagataaggcaactgaggctcagagtggtgaaatcacttactttgggaccagtccctctaaaaataggcaggccctgttttcacagcctagacattttccactaggccacggtagcaaaaccccagaagccctgccaggcaggtaacacaaatgaacaaggtgggttgggtgcagggaagcaaggaatagtggggacggtggtaaactggaaagacgcgtcctgtcaaaggcagtggctgcagctcagctcccacccagtgaggccaggtgggaacatggacccaggggggccagagcagattgtgcaagagaagctggaaacctccatcttcatgtcaggtttcctgattttacatgaagacaatgaatgaaaactcttttaaaataccataaggagccaaacacataagccccagaaggctcctgggggtcggcctctgcccccaaggccccctcccagcccaccactagctgggtgtctcaccagggctgtgggtgcggaacttgtaggccatgtttagcagcggcagcagtgtcaccaggcagttgtccccgttggtctcgatgaagtcgtgccgtgtgatagctgtcgggtcaatgtggtgctcccggaagggtcggatgaaagcctggagttgagggggacacagccccagcagtcagcctaaggtggtcagctgctctccacagccccctaaacacattcaccctgggctcacctcccgcctttgatcctaagtttcctccacccgggatgcttgaacattcccacctggcccactgccagacacagaccccatccagcctttggggagatgagccgaaatgaccctggaagggctttgggttggcactgtctgcctctgggcctcagtctccctacctgtgctgtaagggggcttggagacaacctccgcccttcctccccaccccaaggcagttgaggaggtccctctaagtaaaaggtgggaccctctggaccccctgcacctgctggggtaacagcctcccctccttagtccaggctcttctgacaaggctgacctcgccccgggctgagaaagaacacgtgaccaggcctggccaatcatagcatctcctccctctagccagtgactgcctgagggcccagcacgtgacccaatctgggccaatgggagtgagccgtgggacttcagttggcggaaactacagggaaggagaaatgctgttctcctggaaggagaaggacagttctcttttcttgggagctggaaggatggatctctgggcggtgagaaagcacactggccaccttatgaggggaaagtagagatagagatggaagaagactgggcctgaagaatgtggtctgtcggtcctactggatgcagccattccttaatttggctctaaccctgaaatcttcagttacatgaatcagtacccttgtttgcctaagccagtttagattttctgtcaaaaccaaaaaagtgactaatacaggataaaatgcagttaaaacagcaagaagcagcaggggagacaatggaaaagcaagacacccccaaattcaggggttctgatgaggcaggcacatatctaaactcttggaccatcccaagcctgatgcttttgcttccaaaatcccaagggactcctgttctagtcttgcagcacaggggtgagggacaggctgcaatgatggttcccatctttcagatagggaaacagtcttagagaagaaaggggactcactcaaggccatacagcccaacctccttcttgaggacatggttaggtcaacatactcaccttccccacaatgggcagctccacagagccccatgtgtcagcaccccagtgtaccaggccagacaagaagtcagcaatgagagcccctgcaactgtggacaagagggtgagtgaagggacatccctgcacccccccaatcagaatcactcattcatttactcacttgcccgctcattcatttgttaggaggggaaggtgtcccttcttctctagttgggatgttttcttccctgaagatggagcctcaggcttaacactcctcctgcctgttacttgctgtgctcggggagatgccaagactcatgtgcttggagagtctggagagcataaactgggcatgctcagatcagctcaacctttccctattaggagcaggctgtgcccttctctctgccccatataaggaaagcctgctctgcaccagtgctgcctggaactgcagcaatgtccttctgggtttggtgttagaaagaaagtacctcggccaggtgcggtggctcatgctttgtaatcccagcactttgggaggctgaggcaggcggatcacttgaggtcaggagttcgagaatagcctgaccaatatggtgaaaccccgtctctactaaaatcacaaaaattagccaggtgtggtggcatgcgcctgtagtctcaactactcgggaagctgaggcaggagaatcacttgaactcgggaggcggaggttgcagtgagctgagatcacaccactgcactccagcgtgggtgacagagtgagactccgtctcaaaaaaaaaaaaagaaagtaccttacctgcagatagaagcctcgctgctccacccccacccctccagcttttatcagcaataaacatgatcatttggtctccagcagccttttccttgtttctgttctcaatctgttcggaacttgagcagggttccctcagactccaacaccattcactcacttgagggttcagtagatttggactcaaattccagtgctggcactcactagctgtgacgctgcacatgttatttagcctctctgtgcccagtttcctcttgtaaaatgggaatgatgcgactgggcgccgtggctcacacctgtaatcccagcactttgggaggccgaggtgggcggatcacctgaggtcaggagttcgagactagcctggccaacatggtgaaaccccatctgtactaaaaatacaaaaattagccgggtgtggtggcacacacctataatcccagctactcaggaggctgaagcaggagaatggcttgagcccgggagatggtggttgcagtgagtcgagatcatgcactgcactcctgcctggccaacagagtgagactctgtcttgaaaaaataaataaataaaagggaatgatgctaacatttacgagcactttctcaatgccaagcacaaatgctttacaggctagatcttgatgaattctcaccatttgttttaagttggtagcttttttattcccactttatagaggtggaaactgaggcttccacccctgctgcctcccatcactctcctctttcgctgcagcccaggcctactttatctcctttcccttgcatgcctctgggtctttgcatttgctgttccctctgcctggaacattctttcctaagatgcaacacagctcactccctcacctcttcagatgtttactcaaatgtcctccctggacacctgatggaaaattgcaaccacctcatcttccagcatttccgatctcctatgtatattgttctccaagcactcggcacctctgactgctcttgtgctggtttattttctcccccaacaaggaggttggctccaccatggccagggctttagtctggcttgtggctgcatcccagctcttggcacctattcagaactcagtagagcactactaagtgcagtgtttggcacatagtaagccctcaggccatattactgttgctgtcattgagtcaatcaactaagccacactccacaaaggcctcctgtgtgataagctctagggacagaaacatgtcagacactgaacacatgtctatggggaaacgctgtaaagtccagcagaggacaaaggcagctgtgagtgatgacacgtgtggccccctggctcatggggcttcagacaaaccccttcccagactcggtttgtctgtgtcaactggttgtccaagattctgagttctgctggtgccctcaaccccttggtgacaggggaccagggtcttgggggtactgtggagactgcagaaaagcccctggatgcctcctgggtgagtgagacttgtggttgaagggacaaaagtaagcacgcaagtcactgtgaatgtgcaatcctgacgtccaggcctggggtgaggggcagccactggatgccgactttccagaggccctgtggtatccatcacaggtgccaagcacgggaggggtggtgggggtgggggcagcacagcttcatgcaggcacctgcaagttcctggggataagggcggaagggcaggtggggacaggtggcagctacacctcctggcacacagacgcctaaggacaggctgaagggtgtcactgcacagtggctgggctgaggtaaaggggttgggactcagcaaggccccagagcctgtgcacccagtggccctgctctggtctgggcagtcttgcccatttgtgatggggagggtggacccaggccaggggcaggggcggggatgtagaaggcgagggaggtggaagccccagaagggcttctggattttctgttcctctacacagcaccccacccccactccagatcccctgtgctggctcctcctcggccttcttgctcagagcgaaggtcagccaacccttctggctaaagccatccttccgggcagttgctctcgctcacatctccctgcttcatttctttcatggcacttgtcatcccctgagatggcctcatttgtcatcccttcttggatgaagaaagaggcctggagaagttgaaccactgcctcccagtcaagtggcctggaaatggcagctgtgggatgggaagaggcctgtcgacctgcctccaaaaccagcacccttttgtgtccttaaactgcactgcagcaggtccatggcattattagagctcctactgcatactttgggatgctgtgtatgcactgcctctgtctaccagcagggacaaaaggccatgtggccaagagctatgacagaactagatcaagtgttgggggcctcagctcttgctaccatattgctgtgtgacactgtgcctactctaggcctcagcatctttacttgcttaatgaggtcaactgaggtatctcgaggtcctgtccccatagctcggactaatgacatctctaaatgctgccttcaggctgggctggagcacagtgcagagctgcagagctggcaccattgcactcctcccagcactttgggatgccaaggtgggcagatcacctgaggtcaggagtttaagactagcctggccaacatggtgaaaccttgtctctacaaaaaacacaaaaaattagccagggatggtggtgggcacctgtaatcccagctactcaggaggctgaggcaggagaatggcttgaacctgggaggcggaggttgcggtgagccgagatttcgccattgcactccaggctaggcaacaagagcaaaactctgtctcaaaaataaatgaatgaatgaatgctgccttcatgaaagaaatagctacagaggagaagtggctggatgtcataagggtggggcctcgcaagggattcagagtccaggttccttgttccccgagttctgggctcctgatgagatggggacaagccccttcccctctctaaaccttggctcattttatgttataattgaatataacctacaaacagtaaaggccataggccttacacagctcacagcctttttatgcgtagacacacctgtctgaccaacccccaggttaagatagagattctatacctacacagaatataagaggttggcaaactttctttaaagggtcaggcaggccgggcacggtggctcacacctgtaatcccagcactttgggaggctgaggcaggcggaccactggaggtcaggagtttgataccagtctggccaacatggtgaaaccccgtctttactaaaaacacaaaaaaatcagctgggtgtggtggtgcggacctgtagtcccagctactcaggaggctgaggcaggagaatcgcttgaacctgggaggcagaggctacagtgagcagagctcgtgccactgcactccagcctgggcaacagatggagactccatctcagaaataaataaatacataaatggacagtaaatattttgggctttgcaggccaaggcagtctccactgcagctcctcaactctgcagctgtagtgtgaaggcagacatcaacagcattcccagaatacctgtttacaagtgtttttggtcctcaggccatagtgtgctgacccctgatagaaagcatttccaggccgggcacggtggctcacatctgtaattctagcactctgggaggccgaggcaagcggatcgcctgaggtcaggagtttgagaccagcctgaccaacatggagaaaccctgtctctactaaaaatacaaaattagccaggtgtggtggcgcatgcctgtaatcccagttactcgggaggctgaggcaggagaatcacttgaacccagaaggtagaggttgcggtgagctgagatcacgccattgcactccagcctgggcaacaagagcaaaactccatctcaaaaaaaaaaaaaaaaaaaaaaaagcatttccagccccacagctggctcccctgtcccactaagctcccttctgaccctgttccatgcaaccatagagctgcctcctatcagcagagactgattttgcctattctagaactttatttaaacggattcagatggtaggtgctctttggagcctggcttcttttactagtgtaatgtttctagcgtgggccatgcagtcgtgcggatcagcagtggttcaccatttttagggctgagtatcccaccatctggatgtacaatgatgcatttatccacctggccatggttggccatttgggctgtttccagtctggggctgttttgaatctgctgcagtgaatattggtgtacaagtctatgtgtagacatccaccctcatttactttgggttaagatgtcaactactttttttaaaaaaaaaaacctgatatttattgagcacttataactaccaggccccgtgccaacgccttaaatgttttatctcctttaatccctgaatggcatcaaggcctcgcttaggccgaatcttatctccttaatcattctaaacacttaatcctcacagataatgagaaagatgagcataataaaaattatacagatgagaaaacagtagttgggttaacactgtgtactggggctttgtgaagtgttaagaagtgcatcactgggagcataacttcccattccttaagtgtgggctgtgtacagagacctccttccaaaaagagcacagtatgaatgaggacggaggctgggcgcagggctcacacctggaatcccagcactttgagaggccaaggcagatggatcacttgagttcaggagttcgagaccagcatggccaacatggtgaaaccccatctctactaaaaattcaaaaattagccgaccatggtggtgtaggcctgtaatctcaactacttgggaggctgaggcaggagaatcacttgaacctgggaggaagaggtagcagtgagccaagatcgtgccactacactccagcctgggtgacagagtgagactctgcctcaaaaaaaaaaaaaaaaaaaaagaggggaggaaggctgggcgcattggctcacgcctataatcccagcactttgggaggccacggtgggaggattgcttgagtcctggagttcagtaccagcctgggcaacacagcgaaaccctgtctgtatataaaataacaaaattcgccaggtgtggtggcatgtgcctgtggtcctactggaggctgaagtgggaggactgcttgagcctgggaggttgaggctccagtgagtcgtgatcgagtcactgcactccagcctgggtgacagaggaagacttcatctcaaaaaaaaaggcggggtggggggagcagagtaacttttgtttgttgtttttttgagacagactctcccactgtggcccagactggagtgtggcggtgccattcacagctcactacagccttgagctcccatgctcaagcgaccctcccacctcagactcgtgaggagctgggactacagctgtagagacaagggtctcaccatgttgtccaggctgaccagtgaactcctgagctcaagcgacccactcacaaatcctaaagtgcctcccaaagtgctgggatgacaggcgtgagccaccgcacccagccgagggtaacttaactgtggagaactctgacatctgctaccttagtcatgggatcagagtcatcacagtgataagtcatgttgacagtctgtacttttgctatgatgtgatgaaaatggcacttcacctctgaactcttcctcctcataacccgtaaccccagtctaatcatgagaaaaacatcagatagataccaacagaggggcagcctacaacacacctgactagcactcctcaaaaccgtcaaggtcagccaggcgcggtggctcactcctataatcccagcactttagaaggccgaggagggtggatcacaaggtccggagattgagaccatcctggccaacatggtgaaattccatctctactaaaaacgcaaaaattagccgggcgtgctggcgcgcgcttgtagtcccagctactcgggaggctgaggcagaagaatcgcttgaacctgggaggcggaggttgcagtgggccgagattgcgccactgcactccagcctggcaagagtgagactccgtctcaaaaaacaaacaaacaaaaaaaactggacaagaggagcctaaagggacatgacaactaaaggccatgtgataccctggatgggatccaggaacagaagaaggacattagggaagaactaaggcaatctgaataagccatggactccagctcatgataatgtatcaacactggcacacactgtaacaaatgtgccccgctaatgtaagatttaggatgtgaataatggaggaaactgcgtgccccaggcatatggggactctctgtactatctgccccatccttctgtaagttgaaaacttgttctaaaaaataaagtctgtttttcaaaaagtggacaatctcacttcatgtccacagtaacaggccccaccccatcctgaccttccagaggagggtaagaactccccaaggtcacacggtggcaggggcaaggcagggctgctggtgagtagccagagactcgctagagtcattcaggatgatgcaaccttagggttagggttagggagacttcgcacccaggtatggagaatggggacatttacctcccttaactatgagaagttaataaaatgggctgctgggtaaagggcccggtgggtcccacgacacagcaagcatccccccaacgcagctcctgtgagctctctgctgagcctcagtcttgccatctgtccaatggtcaaggcctggcgcctgcacgctgcccagcagggagggatgtctgctttggacagaagtcaggaatcatcttaggagaccaggagccctccccctggctccgtgatcttgcggcctctgccggtggcagtgactccaggctgctgtctgaggctgctttaatgggggcaggggtggcagacaggcacacagaagcctctttgtcccagctttggggtggtggcagctggcagccggctccccctgggggcagcttcggcttggttaccacccttccccgcagaacactgggacaaggagagggatgggagacggctcaccccaggctaccctgactcacgggggaacttgaggtagtcgctgggcccgtgcgggcttccatttccccagaggtcacccagctgggacttcctcacccctccctgcccacctcaaaggcctggcgtggagatggaaggcgtggctgaggagccaagtgaatgcactgagggcaaatccatgggtttcggtcctgggtcccagtcctgtctctaccgccttccagctcagtcagatccagactccacttccagccacaggacgggccacgacccgagcctgggacttctctgacctcatccctgacctctggactcactgtgccctctgcccggaaggcttctcccaaggtccacgaaggactctgctcctttaagggccaactcacaacccaaacacttcctcccccttctccacgtggaacaaaagctcagggctcctacggccttcacttgttcacccactcactcacgacaacgatgtgcgtgtcacagtggctgatgacctccacgtggctaaatccaaaggtccctttactggccaccttgctggtccactcggtggctgttcccagtcgacccccaagactcctggaaacacattctcctcttggcccctgcaagccctccctggttctcccccgacctccctggttctccccccatctccctggcagcgccatcccagcctcccttgctggctcttcctcctccccagcctggaaacacgggagactcagcccctgggggtgctcagccagcctaggagataaggagcttcatcttgacacagatgacccccggatttctttctttttttttttttttttccagaggaagtctcactctgtcgcccaggctagagtgcaatggggcgatcttggctcactgcaacctctgcctcccgtgttcaatcaatttctcctgtctcagcctccccagtagctgggattataggcgcctaccaccatgcccagctgatttttgtatttttagtggagacagggtttcaccgtcccaaagtgctgggattacaggtgtgaaccaccatgcccggccggacccccagattgctatttccagctgcctctccctgcctccagacctagatttccagtttcctgctcaacacctctccttagctcaacagcggccatctcaagcatctccctcaggcctgctctgccgatgacctctctccatctctgtgaatgacagcttcatcccttccatctctcaagagagaaaccttggagtcaagctaattctctctcacctccacagccaacctggaagcacattctggcagctcacctttcacagctcctccagaatttgacaacgcatcaccacctccaccgctccacccaggtctgggccacccttaggtctgggctgccatcttcacgtggctggaccatggcaggcgcctcctccctggctgtccccacccccagccatcttccctgcagcatcagatgatgtcaactccctgtgggaaactcaccaatggcttctcatgaccccatatccagaccaggccctcatggccccacaacatctgcttccagtgccttgctgggctgccacaattttcctttgatcaatttcctccagccacaatggcttcgctctgttccccaaacacacgaggcacgtgccaacctcggggcctttgcatttgctcttccctgtgccttggatgcccctccccaagatctctgcacggcccctccctcacctccttcaggtctctgtgcaaacgtcatcttttcagagaggcctttcccgcctacccgcttagcttgattttgcttcccaatgctgcatcacgtgtgtctgtgtttattaactcgacatcttttcgtgcttctgccttccttgatttctgggacctgcctgggacagtggaagctctggggagataggggtagggggcaggctctgcaggctggcacagtgcccttactgcctgcatgttaacacacaaatcggggtggctatttaaatcgattagggactgtgcaaacaccattatcaggggattgtctgctctcatcagcccagagagaaatgtgtgggatggggaagctggtgctgtgcagcctcgaaagccagagatttcctgggctgtggctggaagatcagatcccaaccagggaagggagatagtgacctacctgggacatccaccctcccagcctgcacagcacacacctgggctctgatccagcccatcctttacccccgtagaggcctgaaacagcctggcctcccaatgttaactggaggctatacacgccctggtggggaagtcctcaactgagagccaggcaggtctggatttgcaatctcagactctgctgctgcctgggtgaggaccaatatgtgacttacttagcctctcagatggtgatgggaacctcctcactagggtagcacaaagagtgaaaagtgcccagcatggggcttggcacatagtaggtgctcacaaaacatccgtgattaaactgaccagcgaggctgaagtgaaagccttgatcagtggtctggcaggtgctgtcccctccccgcccctgcttagtcactggttttctcagcacttaggcacacctgcattttgccttcacaacagccctaggaggcaggtactgccagcagcctcatttacactgtggtaaatgaggctgagagatgcaatgtggcccaaggccacagagccaggaggtggtagagctgggacttaaacccaggtttgtagaggcctgctcgtaaccatccccagatgaggctgcaaagctcagactgtattcctgcccttgaatatggggcttgaggcagagaggctgggggtgcaggtctctcccatccctgggggcaggggacatgcctggctcctgcctgggcttcccagcaatggatgggttcatctctctcccctccagctggtccggcccccgtccccagcatataccaaccccaccccagacccagatggctcaattagctggcctgagcactattggcttaggtggctagaacgcttttaatgagattgtgggagttgaacccttaggaagggccaggcaggaccaagggcacagccgcccccttcagtcttggagccggggatggggaggggaagggtggtgcatggagaggaaggaaactgagtcatccagggcctgggagtggagatagtgtattaacaactatgttgtactctgccttgaagtgtgactctggactagtcccttctctgagcctcagttccctcatctggaaaatgatgacaaccttagcgtaagaagtgaccgatggaaaacaccaggaggtactaataaacaacagctctctcatttattcattcatcaattcaaaaaatactgagcaccggctgtgtgccaggcctgaggcttgagctagggacacagcagtgaatgaaacagacaaaaatctctgctctcagagagctggcatttgagttgggagagatgttgggagagatagatgataaacaaataaagacactgtggacacagtgttaacaacagaaaagggggatagtgtgtgacaggcctgctattttgagacggagtctcgctctgctgcctgggctgaagtgctgtggcgtgatcttggctcactgcaacctccgcctcctgggttcaaatgattctcctgccccagcctcccaagtagctgggacctacaggcgcctgccaccacggccggctaatttttgtatttttagtagagatggggtttcaccacgttggccaggctggtctcgaactcctgacctcaagtcatccgcccccccccccccgccccaacggcctcccacagtgctgggactacaggcatgagccaccacacctggctggggctgctatgttttgtggggcaatcacacctcctctgctgagaggaggtgacctctcagcagacacctggagtgagccatgtaggtgagagttctaggcacagagaatggcacatgcaaaagccctgaagtaggaatgtatctgagagcaggtgacagacgcacagtcagggggccagcgtggcaggtgcagggtgacctagcatgagggtggctagaggaagctggggcaggtacactgaggagccggtgttctattcagctgcagatgtatgcagatgagagtgggggagtggcatgatctgcctggggctctagcaggatccagctagccatgtggagactggacggtgcagggcaaaggtgaaggcagggagaccaggaagaaggctcctgaaacagcccaggcgggagaggatggtggctggacaagcgtggggaccatgaaggtacagagccatggctgtactcctcatgcagtttgaaagtagagttaacagcatttgctgatggtttggatgtgcaatgcaagaggaagagaggaactgaggatcatgtttaggttttgggcccaagtgacaggctgcagggaggtgctgctgactgcaatagggaggtggggtactcaaggcacatactggactcaagcacacacatccatgcatgtggacacacacacgcgccagttacccggtgggtccctggcccctagggaagttgaggcaggcagcagtgcctcgggcactcaccaacaccgagtatgacgaggggtgtgtcctcccagcgggccagcagcaggagatggaccaggttgtgggcgatgaggctgaagcacaggatcacagagcaccactcctggaggcgcttgcctgcagggagcagaggcgagaggtaaaggctggaaggtcaaggccaggcagagtgtggccccatgggaacttttcttttcttttttttttttctgagacagagtctcactctatcacccaggctggagtgcagtggtgccatctcggctcactgcaacctccacctcccaggttcaatcgattctcctgcctcagcctcccgagtagctgggattataggcacccgccaccatgcccggctaatttttatattttttagtagagatggggtttcaccatattggccaggctggtcttgaactcctgaccttgtgatccgcccaccttggcctcccaaagtgctgggattacaggtgtgagccaccgcacctggccaggagcttttcaactttgtttaatgcatctatattgccaaccacaagctgagcttacagactcccgcaaaggagtctgtacccatttcacagatgacgtcactgaggccctcaccaaggtcaaacagtcagggctggatgcattaaaccaaggatggggcccttcagagagtggcccaattctctgacagaccaattctttgacagacaggaccagaactctggtctcctgggcccctctgggctctctctggagacacctaagggaactttaatgagcttctttttctttttttaaagtagaatctttgtggcttcacttgtccccttttgcaggtaactatttggaggcagaggctacaaacaacctttaatcctggtggctcacaccctgcccagcctccctcaagcaggctccagacaatgagtcaggaattcatggacaaatagggctctggggcagtggggcttctaaaagtatggcgtgtgggccagggaggcagagcttctgattcccaagaggagccagaagtcaggctttgggtgtgcaatctgtttcagtgttgccacatagttttcacagacacacgagcccagacaagctgattcactcgctgcagctttgtttgtggtgtcaaaacttgggaaataacctaagtggccattgcctggggattggccaaatgaattcagtccacatcatctctgcagccaggaaaacacctgggcagttgtctataagtggacgtggagagatgtccaggacatctaggtaagtgcaaaaagcaaagtgccaaatagcagccatttatgttaaaaaaaaatctatatagttaagaccggcttttcccttatttccttttaaagtactagcatattacattgttttcttttaattgtaaattaaaataaaaaaataaaagggggccatgcatggtggctcacacctgtaatcccagcactttgggaggccgaggcaggaggatcatttgagactaggagttcgagaccagcctggccaacatggtgaaaccccatctctactaaaaatacaaaaattagccaggcatgtggcgggtacctgtaatcccagctattcgggaggctgaggcaagagaatcacttgaatctgggaggtggagattgcagggagctgagatggcaccactgcactccagcctgggcggcagagtgagactccatctcaaaaaataaaaactaaaataaaaataaaaataaaataaataaaaggggttaggcccagtggcttactcctgtaatccaagcaccctgggaagctgaggcgagaggattgcttgagcccaggagttcaagaccagcttgggcaacatagcaaaaccctgtctctattaataaacaaaacaaaacaaaaaattttaaacattaaaggaaataaggccgggtgcagtgtttcacacctgtaatcccagcaccttgggaggccgaggcaggcagatcacctgaggtcaggagtttgagaccagccaggccaacgtggcgaaaccccatctctactaaaaatacaaaaactagccaggtgtggtggcaggcgcctgtagtcccagctactcgggagaggcaggagaatcgcttgaacccagaaggcggaggttacagtgagctgagatcacgccattgcactccagcctgggtgacaagagtaaaactccatctcaagaaaaaaaaaaattaaaggaaataaaaacaccatgtgggtgacatagaacatgtgactagggtatgccccaggcagctgctccataaggcacagaagacctttaatgacaacaattttatcatgggtgtttaaaatatactgagcagttactacatatcaggcgcctgctgaagtgatgtccttttgcagatgagaaaactgaccatcagagtggtcaaggaagtagcccaaagccacccaactagtcagcagagaccagaattccatggccagaggtctggctcctaagatcccgctctcgccccgctctatcctgttcctgctgcccctggtccctccctctattccccatcaccctatcaccttgacgacattctgggtcaggagcccaggcccccacttaagcagcggggccaggcaggtccctgtgaaggggtcagggccagagcaggtgagaagggctcctcctgtgtccaccctctcttctttttaggactctgtgcatgctgttctcttcactccctgtgcacctgacactgttcctgcagatctcaccctggaaacctccatctccaggaagccatccatgatgcctcctctgaccccacactccccccacacgaggcccattgctcatgcctgtggccttgtctacgtttgtctttccctacctaaatgtgaagtcgggaggcccagaaccatgtctggctcactcaccagggccctgacactcagtaaatgcttgcagaatgagcaaattcccaaccacaatcctaacggacaactccatggctttgtctctgggtgccgctcaccgacataccttgggaaggaagtactgggttccccatttgtcatgatagggaaactgaggctcagggagagagaaggccttctccaggtcacacaacagcaagctgctcctgacctaccctgacccagaaccaggacagctgccctcccctgccccttgaaaagaccaaggctcagaaggggaacggaacacaccagggttacatgcccttggctccttttgtgcagaagaagaccgtgaagcccaggaaggagaaggacctcaacagaggtcacatagcagaggtcacaggggcctagatctcctggttccccaattctcaggcgagggctgtttctcttgagccacgcagcacccccactgccccagcagccgccccagcctggggatcaccatgatcaggcccagcaaggccttcccctttctgattcttgtttgtagccaaggcccagggctcagaagcagaaaaccccgagtgggtggggtgggaggacacggagaggcggtgagaaggaaagaacaagtgaaccttcccgatcgacctgcctgcctgccccacagcatgcagggacaggaagtgggcagagccaactgcaacatgatcaaataacagttaccctaacaatggctgacacacactgaagcctgtcatgcgctggggtgtggcccatatcggagaggttgcaaactgactccctctgacatgttttgccctcagttttaaaaagtgagctaaatttgaaaatcacgtaaaattcctagtttcctgcttccctcaacaacacagggctctggccaccctaggcctaaacaataagtaatagctgcccccatccaatgggatatgagctccaggttcaccctggtcctctcccttccctggggtctcacactgggtggccagatttggtggcagccctggctgggcccctgcagtcatctgagtttttgagtctgaggcacagtctctcattcaagtatcagcccgtcaaggaaggaactgagtgatctcatttcctagacaaggaaactgaggttcagagctgggtttggatcccagacacatcaatgagacatgttagcctggacgttcggggcagtcctgaaaccaaagatgatccagctctctccccacgccatggagaacgtcctccaaatctgaatatttttccatctaaactccatctctctttggcctctggaagctggatccttctgcagaccaaataccttaattctcatccataaagaatgcatacacaatggccgggtgtggtggctcatgcctgtaatcccagcattttgggaggccgaggtgggcagatcacgaggtcaagagttcgagatcagcctggctaacatgaacatggtgaaaccccgtctctaagaatacaaaaattagccaggtgtggtggtgtgcacctgtaatctcctagctactcgggagggtgcacctgtaatctcctagctactcgggaggctgaggcaggagaatcacgtgaacccaggaggcagaggttgcagtgagccgagatcgtgccactgtactccagcctgggcgacagagcaagactccgtctccagggggagaaaacatacacaacttaagtagctttcactgagcaactggaacatgccagatacagggctaagatgatctcagcacccctcaccacctcctggagctagggaccctctgtcccatccttcagagagagaagctgggcctggagaggtcaaggcacttgtccaaagtcacttgagggtcaccaaagtcacagcatggatcatcagcctggcagggcctgtggggtcaactggcctaaactgtatcacttaacagatgagcagactgaggtggggacagggagggtggctgctcaggacacaggaggcccgggctgtcttctggctgtagtgctgaggtcctgctatcagagccagcccctggcttggcagggtttgaagatctgagccaaaagcagtagccacttattggcctgaggaaggggctggcctcgtgtggtaggtatggggagctaggaagagcaggggaggcctggggtcatgcctttgtcatcctgctttccaggggacaggctgcagtcaaaggcttggtgggcccaactcttctggttccaggcagagacaagccccaaataagctggacttctgaggacccctggcctccagcagaccctcagcctcagggagatgggggacaagaggtagagagaaggtggggatgagagatggacagagggacaaataagagatgagagacaaataaggaatcagagccatgggaagatgagaaacaggctgagtgccgcggctcatgcctgtaatcccagcactttaggaggcaaaggtaggaggatcacttgaggtcaggagttggagaccagcctgggcaacataactagatcctgcctctacaaaaataaaaataaaaattagctgggcgtggtggctcacacctgcaatctcggcactttggaggctgaggcgggaggatcatttgagctcagaagttttgggttgcagtgagctgcaatcgctccatcacactccagcctaggtaacagagcaaaaccttgtctcaaaaacaaacaaacaaaaaaaccgaaagaaacaaagatgagaaacagagacaaaaggagcaaaaaacagaaagcccatctgggggactgaacccctgggttcagctttgggagtacaggccaggactctcacccagtactcctgacaccctccacctttcccttccccctgtgccaagagcctctgtaatccccagggcagggggcacccacagttggcctgggtggggtacaggtggatcaaggaccgtgaggctgcacccatgaagcctggggcacctgagaagtagcacacacatggccagatttcagctgggacctcctgggaagctggacacccgcctcaccctctggcctgccaagctggccaggcccttcacaaaccctgacatctggcatgaggtgggctgctgctgggaaactcagcccagaacaggacagaacggctcctgggtcctgcaggaccagggctcaacctctgggccagacacttggggcctgcgaaatcaggctgtggccgcctccctgctgcacctgtcaccattccctcagccccatgctgctctggtccaactactcacagctccctacacacagaggcccattctctgccacctgccctgcacacatgctgttctgatgatccggaatactcgcccccacctcccacacactcacccctggctggctgacttccatagtgaagagtaagaacacagaacctagcgcacccccacccggcccagtcccgggttccaggcctagccctactgctgcccggtgccccgccgtatgacctcaggcagcctctcccattttctaagcctcaggaaatgttccaacaaaagtggactgggtgctcatgaggggccaagcactttaatcaaaccaaataggttcagtccctgtcctgctggccttcccatcaggtgagggcagatgcgggcctaaccccgatcagggtgagctttaggaagagcatgcctggggtgggggttgggaggggttgcagcctcctcctctgtgaatgcagttaatatcaaggtacagctcacacggttgtagtggggatgcacggagagcaggtgaggaaaatgccagcacagtgaggctcaatcactcggctatgttgattgccatgattatggctgtcaactgtcacagtgccaaaccacctccagccccagtaatctcaaacattctgctcctagaacccaggaacttcttctactcttccctccagcctacatgtgtcctccatattccctaaacatgcctggcaagctcccacctcagggtctctgcatttgttgtttccctggtctggaccaacccttcttcaaatatcctcaaggctccctccctccagtccttcctcccttcaggcctcacttcgaatgtcacctgctcagggaagccttcactgccccctccctaaaatgtcattcctgtccccaacatttcagatccccctctcctgctatgtatttgctccacagcgcttgccaccactgggcacgtgagacagttatttgtcaagtttatggcccggctatttactaaaatgccagctccgtttttttctttttctttttttttgagacagagtctcgctctgtcatccaggctggaatgcagtggtgtggtattggctcactgcaacaacctccgcctcctgggttcaagagattatcctgcctcagcctcctgagtaggtgggattacaggggcctgccaccatgcccagctaatttctgtatttttagtagagtcggggtttcgccatgttggccaggctggtctcgaactcctgacctcaagtgatccacccacctcggcctcccaaagtgctaggattacgggtgtgagccaccgcgcccggccagctccatttttttctgtcttgttcaccattctgcccccagagcctagaacatggactagaacataggtgttcaatatgcactgagcctggtctctcactttttcaggcccagagaggtcaaatacttccccaagatcacacagtgagcagatagaagcagagaggccagtggaaaggaagttggagaaaccagtttggcaagtctcctcccctacctccaggtctggaggagataaagggccttgattgcagatttggggcaccaggctgtctgcagactctgattcaggcatggctgttcttcagagagtgaagggcacttggggaaaccagaaatggacaaatatgcaattgatcgtggtggagtggggaaacagcaatccctggggaggctcagaatgcctgggaatgatttgggctgtctgaaagtaggtagggttcacaggagcaggcagagctggacactaaagagggaggcccttgaatccttatccccaattcccaggtggggagtttgaggaccagagaggtgaggcggatcccccacagcaaaggtcagactactgttaacaacagggaggcgccaggcacagtggctcacgcctgtaatcccagcactgtgggaggccgaggtgggcggatcacaaggtcaagagatcgagaccaccctggctaacacagtgaaaccccatctctactgaaaatacagaaaattagccgggcatggtggcgggcgcctgtagtcccagctactcaggaggctgaggcaggagaatggcgtgaacccgggaggaggagcttgcagtgagccgagatcacgccactgcactccagcctgggcaacagagtgagactccatctcaaaacaaataaaacaaaacaaaacaaaaaacaacaaaaaaacccacacaacaacagggagtgcctactgaatgccagtggacgatctcatttccacttcctaacacgaaggggcagataaactttaacttgcaaggaaaccaaggggaaacagagacggaaagtggcttggaccaggtcatacagctgaataacagagtcaggatgttaaccctggcctacccccaggagagcaggaggttttaagtccataggctgggtgtcttgggtataggcctgaagaaaccatagcggcatggaccaggtgcccaagtcaggtgtgaaaaatcacatacagagaatggagtggtctaggacccagtgaggaaatgcaaatggtccgtggccatgccgccttttaaggaagagacggcatggaacccaggccagtgagggcagaaagctaaggtgctagtgaccccaggcccactccaggcaagggctgcatgtggtgcttggtggctgccccacagaaaaaggaaggatgtcaggatatttgacaaacaaagcttcattccatggtgacacccaggtagaggtgcctcccagtcacctgaaccaggagttctcaaaggcacttccttaactcctggggatatagggccctcctgaggccaaacagtaaaattcctagggctcacgtaggagtcacaaaagtgggtgtagggggggtgcttgctggagcatatacagtgagcaaagcaggaagaagctagggagaaaccgtggcctgagggaaagggacagagagggagaggtgaactccaacttatgatctggtctggggaatatgggggttccagtcccaagtcctaaggaaggggccaatacatggatgtgagggaggggcaagagctagagttggggcttatgtacaggggagcttacagtggggtacattcagtcccctcactgcctgggatccaggaatatggggcaaggactgatgctcaccactggagggttggggagaggatatcggtctgtagccactgaagctatcactaggatggggttttgggggaagggtgtggggggtaccgtgcagctggaagcccctgagttagggttccctgggcagaggggctgacattcccaggttagggaggtgaggtcattgtttgcagcccagggcctgggctagggcacagaggaggtactaggatgtagattccagatctggggaacccaggatgaggtgtgacttttaggggcctgagggcagtgcttacagctgaagggcagctttgggcttggaccgggtcctggggggatgagggggtggggttctaagtctaggagcactcttcacaaccgagaatgccccggggctaggattccgtatctgcgggtccgatgggagctccgtttgtcgcccagggagctcatggtaatttcttgatctggggagtgtctctgcagccaggaaaccccggggccaaggttctggcttgggttcggaagggacactggggtggggtccccgaacttgctatttgcaagttagacacccgggctggagttccgcatctgggcccgaggttgggactccagtctggggtcgctgtccgcagccggggctggtgaccgcaggcctggaggggggcccagaggtcttacctggcgagtagagcgcagccagctcgcgggccccggcgtgctgcgcgccccagcggcaacaagacgcctcgtcctcgtccagctccagctgctggcccggccagttctcggcgcccgccatggccactcgcccgatcggcccggtgcgctctgctggcggcggcggcggcagggccgcggaaccgcggcgagatcacgccgcccaatgaccgcccagcgccgggcgcggcggcggcgcgggcggggtcctcgcccggccgcgcgtcacagccaatcggggctcgcgccggagccgcgcaggccaatcggacgtcgctgagccgcagccaaccgccgcgagccggaggctgggacgcagctggacgcagctgggcgcggaagcttggggcggaggcgcgtgcccgccttcccagctcagccccggcagggctcccggctccagcccactgggagctcgcggcgcgtcgccgcccagctaggcttcggttcacgggcccatgcaatgggccgaggcagggcccagaaatgggcatttcttgagccggcagcgttaagcgcccactgtgtgcaaggaacgcgagggcagggcgccgggctggggccgaggccaggaagcatttggcgggtgctctgtacgatgctccctagcgaggccgatggagagtgggctggtttatcaagccctactgtgtgcagaggtttcgggtgccatgtgttcatcagctgtgtgccagctctgtgctgtgcgcccaaagaggagaaacgtcgagcctgccccgcatcctccccagctcatgttctcccggtggcgaggacagtaaactaatgaaaatgacaactagggtcactatgagatttgctgagcgcttaatatctgtcaggtgctggaccaagagctagacgagcaacatttatttgactcttaaacaccaatggtattgcctcctcagagagccccaccaccaccaccctgctcaaaggtgccccctcctccagtcactgtgacatcaccctgttttgtcttcacagcgcttctggtggggattgagcttgcagtccctgtctctcctatcagagagcaagctcctgagggcagagaacagctttgtttacagcagggcccccgtgccaggatcggggctggaacatggtagaagctcaataaatgcttgatgaatgaattaaggctcagccagatgcgtctaatacttcggcagataaatgacagcagcagggatttaccccaggtctaaccgacaacaaagtatgcaataatttctcatagaaattccatacaggcagccgggcgcggtggctcacgccggtaatcccagcactttgggaggccaaggcgggcggatcatgaggtcaggagatcgagaccatcctggctaacacggtgaaaccccgtctctactaaaaatacaaaaaattagctgggcgcggtggcgggcgcctgtagtcccagctactcgggaggctgagacaggagaatggcgtgaacccgggaggcggagcttgcagtgagccgagatcgcgccactgcactccagcctgggcgacagagggagactccgtctcaaaaaaaaaaaaaaaaaattccatacaggctggacgcggtggctcaggcctgtaatcccagcactttgggaggccgaggccagtggatcacctaaggccaggagtttgagaccagcctggacaacatggtaaaaccttgtctctactaaaaatacaaaaattaggcaagctacttatcccagatacttggaaggctgaggcaggagaatcacttgaacctgggaggtggaggttgcagtgagccgagatggcgccactgcactccaacctgggtgacaagagtgagacttggtctcaaaaaaaaaaaaaatccatacagtgagatcacataggagcctccctagaggctgtggaaggtcctgaaaggtgctgggggagcagagagggaaggtaagatccccttccagaatccaggttctctgagggtttaagtcctggattcctgcactaccagtcaccccagggctgtttcctgagtgttcctaccatagacagccactgtccccacccaggcctatgctccctccgtttctttcccacacctgctcccaggaaggaaaagccaccttccagtggcagggatgggttgcaacccaagtcctggtgaattccggtgaagctggctggttttgcatcagtattaacagcacagttaatccaacagttggattttttaacccaggagcttaaggcttgggtggggggcggcggacgggggggggggggcgcggttggtggctttggtgggggctggatgtcagatttcaggtaaataccttctaaagctctctgctcgtatcccacagcctccaaacagggtagggtggctggttactgctgctgtccagagaccctcacagtggccagcaccagatggttgatggacagactgcctgagataactcattccttcattcattcactgaacatgtttattaaacaccaacctgtcccagggaaacagcagggaatgtgacagaatccctgctttcttgggaggtgggggtgaaggttagggaagtcctgtttaagaaggtgacattggatccaagacctaaaggatatgggggagacagttacttaaaatgagctgggaagtcccttccctgtggggttttgagtagaggaatgacatgatctgacttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgacttttttttttttttgagacggagtctcactctgtcgccaggctggagtgcagtggcacaatctcgtctcactgcaacctctgccccccgggttcaagcgatcctcctgcctcagcatcctgagtagctgggactacaggcacgcgccaccacacccagctaatttttgtatttttagtagagaccgggtttcaccgtgttggccaggatggtctcggtctcttgacctcgtgatctgcccacctcagccttccaaagtgctgggattacaggcgtgagccaccccacccgccttttttttttttttttttttttgagacagggtctcactctgtcacctgggctggagtgcagcagtggcacaatcttggctcactgcagccttgacttcccaggcttaagggattctcccacctcagtctcccaagtagctgggactacaggtgctcgccaccatgcctggctaacttttgtattgttggtagagatggggttttgccatgttgcccaggctggtctcaaactcctgggctaaagccatcctcccacctcagcttcccaaagtgctgggattataggcatgagccactgtgcccagcctatatcttttgtttcatgagatataaatctttttttttttttttttgagacagagtctcgctctgtcacccaggctggagtgcagtggcgtgatctcggctcactgcaaactttgccttccggtttcaagcgattctcctgcctcagcctcctgagtagctgaaattacaggcgcccacaatccctggctgatttttgtatttttagtagagatggggtttcaccatgttggccaggctggtctcgaactcctgacctcgtgatccgtccgtgttggcctcccaaagtgctgagattacaggcatgagccaccatgccccaccaagagatataaatttcataccttttaaagtataaagtgaaccatattaaattccgtggtttttagtatattcacacagttgtgtaatcatcacgactatctagttccagaacattttaagtacccccaaaagaaaccccatatccattagcagttactccctcacttccctctttccccagcccctggtaaccattaatctactttctgcttctaaggacttgcttctactggacatttcaatataatggaatcatataatctataattatatgaagccttttttgtctggcttctttcacttagcataatgttttcaaggttcatccatgttgtagcacatgtcagaactgcacttttttattcttccagtagctcagattacaggcatgcgccatcacgcccagctaatttttttgtatttagtagagacggggtttcaccatgttagtcaggctgattgtgaactcctgacctcaggtgatacacctgcctcggcctcccaaagtgctgggattacaggcatgcgccaccgcgcccggccacgtatatcttttttggagaaatatctattaaaatcctttgccttggccggatgtggtggctcatgcctgtaatcccagctacttgggagactgaggcaggagaatcatttgatcctgggaggcgagtgatccgagtgagctgagaccacgccattgcactctagcctgggcagcaagagcgaaactccatatcaaaaacaaacaaacaaaaaatcaaatcctttgccttttttcaaattcagttattggtatttttcttgaattgtaagagttcttgatatagtatggctattaatcccttatcatatataggatttacgacaattttctctcattctgttggttgtcttttaacttccttgataatgttctttgacatacactttttttttttttttttaaatagggtctcattcttttgtccaggctggagtgcagtggtgtgatcatggctcactgcagccttgaactcttgggttcaggtgattctcccacctcagtcatccaagtagctgggattacaggcagattacaggcatgggccaccacactcagttaattttttgtattttttttttttgagtggagtcttactctgttgccctggctggagcgcagtggtgtgatcccagctcactacaacctccgcctcttgggttcaagcgattctcctgcctcagcctctcaaatagctgggattacagatgtgctccaccacaccagctaattttttatatttttagtagagatgaggtttcaccatgttggtcaggctagtctcgaactcctgacctcatgtgatccaaccaccttggcctcccaaagtgctgggattacaggcgtgagccacggcacccagcccagacttccctttttaaaaaaattttttcttcctcacagggtctctgtatttgtctccctggctggaatgcagtggcaccatcatggctcactgtagcctcaacctcttaggctcaaacaatcctcctacctcagcctcccaagtagcttggatcacaggcacacaccaccatgcctggctaatttattttttgtagagatggggtctcactatgttgcccaggctggtcttgaactcctgggctcaagcaaacctcctacttcagcctcccaaagtgctgggattacaggcgtgagccactgcgcttggcctccgagtggtacatttgttaattgataaacctatattgacactccattatcacccaaagtcaatagctggcattacgattcactcttggtgtacattctgtgggcttgggcaaatgtgtaatgacatggatccaccatcatagttatcagacagagtagtttcactgccctaaaaatcctctattgcagatgtattttaatgatttggctgaatatgtgggctgctaagaagtgggctttgagcccacaggaatttaaaaaaaacccaggccatagcctggcagaaggaccagggggcctcagagagtataccaggctgtgagaagagcctcagaggcaagcagggatggccatgtggtcaggatgtcgggggctcctgagaggctgtgtgtgcccagcagagccacctgttccctgatccagtcactgagcacatctcctcacccccagcagggcttcctacccagcagaaagtgccccaggcagtgctctggccctgttgcgggctttaggccaacaccctcagtgtgtccacctcctgacaagggacaagagtgtggacaggaaggcttccttccctgggggtggggggtgtcctggagggactgatcagaaccagatgttgcctgtctggactgtggcacagctgtccccaaacttcctcttttccacaaaaggttcttttcgaaacatgtgagacatgggcatgtggatatctgttcctggctgccgacatccattcctgctccttcatagaaataataccctgaattggctgggtacggtggctcacgcctgtaatcccagcactttgggaggccaaggcaggcggatcatgaggtcaggacatcgagaccatgctggctaacatggtgaaaccccgtccctactaaaaatacaaaaaaagtagccgggtgtggtggcacgtgcctgtagtcccagctactcgggaggctggggcaggagaatcgctgaacccgggaggtgtaggttgcagtgagccaagatcacactccagcctgggtgacagagtgagactccatctcaaaaaagaaaaaaaaaaatgccctgaagttttggaggaatctctcttgctgcccctgttctcagcccctgaatttagcacaagccaagctacattgtccagtcccctgggatgcagtgattggttcagggatgagcatgtgacttcagatggtctatgacagtggacttcaggatcctggtatggaattgggatgtgaataagaaagcaagtctcatcagaatctgctggcagccatgggggcatcatcctcagggtgagtgcaacattagaggaagcaaaaaggagagaccaagagaaaccaggtccttgctgagacctttaagtgcctggatcaagcttcacctgaaagcagccctacctttccagtcagacagacttaggttaagtctcagctccaccacttgtgtgctgtgtgaccatgggcaaattatttactctctcaggatgtcagtttcctcctgtaaaaatggggatcctagcagagtgccagcttcatagggttgttatgaagataagttaatacatacatagttgttagaagagtgcctggtatattgtaaaccctcaataaattttattttattttatttttttgagacagagtctcactctgtcatccgggctggagtgcaatggctcgatctcggctcactgcaacctccgcctctggggtacaagtgattctcctgcctcagcctctcaagtagctgggattacaggtgcctgtcaccacgcccagctaatttttgtattcttagtagagatggggttttgccatgttggccaggctggtctcaaactcctgacctcaagtgacccacctgcctcggcctcccaaagtgctgggattataggtgtgagccactacacccgccttcaataaattttagctattactgttagcactgagccactggaacaaaccttacctgaactgaaactttcctttgaacttcactgatataggaatccagtggattctgtttttgtttgtttgtttgtttgttttttgagatggagttttgctcttgttgcttaggttggagtgcaatggtgtgatctcggctcacggcaacctctgcctcctgggttcaagcgattctcctgcctcagcctcctgactagctgggattacaggcatgcaccaccacgcccagctaattttgtattttttagtagagacggggtttctccatgttgttcaggctggtcttgaactcctgacctcaggtgatccacctgccttggcctcccaaagtgctaggattacaggcatgagccaccgtgcctggcctggattctgtttttattttgctatattttttcttgcttgcagagtgtggggcctgagatcagggaaggatcagcgagaaaggtgtggggaactgtgtttgaaggtggctattgctctgtggcaggcagtttgcatacaacttgctatttggccccattttccagaaaaggaaactgaggttcagagaagttaagttgtccaatgtttcgtttttttttttttttttttttgagatggagtcttgctctgccacccaggctggaacgcagtggcgtgatcttggctcactgcaacctccgcctctggggttcatgccattctcttgcctcagcctcccaagtagctgggacgacaggcgcccaccaccacacccggctaatttttttgtatgtttagtagggacggggtttcaccgtgttagccatgatggtctcaatctcctgacctcgtgatccgcccgcctcggcctcccaaggtgctgggattacaggtgtgagccactgcacctggccaacttctccagtgtttttaccaaggagaaaaggtaaggtaaggtgccgggtgtggtggctcacacctgtaatcccagcactttgggaggccgaggcgggtggattacttgaggccaggagttcgagaccagcctggctaacatgggaaaccccatctctactaaaaacacaaaaattagctgggcgtggtggcacgtgcctgtgcctgtaatctcaactactggggaggctgtggcaggagaatggcttgaacccgggaggcggaggttgcagtgagccgagatcacaccactgcactccagcctgggcgacagagcaagactccgtctcaaaaaacaaaacaaaacaaagataagggagggaagctggacactgggtatggcaagagtaaacgccaggagatgtgactgtacctggtgtgcatgcagggaatgggagtcattaggaatccagaggaattagcggggaataaaaggccaggaggccaggaagggcggagtccagctccgtatcggtggtggttgaagctatctttgtgttatggccacatcaggggttcccttgcatcaatcttcttatctgtgagggggacatagaggtgcatttgtttggattagatttgactataagccacagatatcccaaagttatagtggcttaaacatggcagacacacacacacacacacacactacacacacacacacacacacgaacatggcagacatttcttttcctttcacataggtataggggaccagaggtagtgtggcagaatccacaatcaccaggccccttctatctggtcactccaccatctggtcggtcaaccaacaggtggcttccacctcagggcccaagaaggttgctcatgctgcagccgttttgtcatattccagccagcaggaaggggcaaagaaggcaacacttccctgctttgatcccactggttagaacttggtcttagtcacatggcactctctgctgtacaggaggctggagaatgcagttgtcctctgcggagaccaacttaaaagctggggttctattaataataagaaaggaaaatgatattattaatagttgatactcggaagcttctgccacacacatggcaggcacgagtccttctttttggcctccagtgtatgaactgctttcctaggctctctagccattgtggtgttcctgagagttccccaattatttccctagtagattacttgtttcttgcctgtcatcgtgagccctcatagtgaatggcataggggacaagatcagaaatgcctgatcaacaataacggtgagcatttattgagcacgtactgcacgccaggccatgttataaccttacttcagcctcccgagtagctgggattacaggcatgcgccaccacgcctggctaactttgtatttttagtagagacggggtttctccatgttggtcaggctggtctcgaactcccaacctccggtgacccgctcgcttcggcctcccaaagtgctgggattacaggcctgagagccaccgcacccggccggacctggttcattttaaaattgttgtcttaatcttagttgcttaactgcttgcaattctgtgtgttggctggtggttcctctgtgggcttcccctgggcttgtgcatgcggctgcttctggctttcagctgtgctggctgggctaaggtggcctcattcatggtgacatgggattcagatgggatccagatgggattcagatagcagctgattgttggctggggcacctctgtactgcatctgggctctcatcatccagaaggttagactggcttctgtacgtggtgttttcagcacagcatccaggagccctaggcccagatgtcccataaagtctctttctcccatttattctatctcaaagcaagtcaaacaccagcccagggcttccaggaaactgctcctcgctccttgttggcccacagacttcatttgtactcactagcagagggataagattactctttgactcatccggccctccaaggcagggcagggaatggggtcacttacctaaggcacctgggttgcctggggaagggggcaagtgcagggagagggtggttacagagggacacaatagacaataggaccatcaccacccactgtttatgttcggtggaatttctttccaggcattttacaaatatacgcaagagatcttcctgcctgccacacttatactgagaacctttttctggaagcctcttgggactgtgccctaattgtgtctagatccagggcacaatcatacaatgatgtttttccttttcctgggagcaggtgggaatgacagattaaaacttgctttaaaaactagaacaaaacataggtgagtttctaaaaaaatgcctttaaaaataataattcaattttttttcaaatttacagaaagttgcaagaatagtacaataaactctcaataccctaattatcaacattttgctacacgtgatttatccttctttctctccatgtgtaccattttttcggaaccatttgagagtcagttacagacataatgcctttttaccctaaattcttcagtgtgtatttcttaagaacaaagacattatcttataggaactctatagtttttaaaatcagaaaatgtcacattggtgcaatgctataatttaacttcttttctttcttttctttttttttttttttttttgagatggagtttcgctcttgttgcccaggctggagtgcaatggcgtgatcttggctcaccgctacctccgcctcccaggttaaagcaattctcctgcctcagcctcccgagtagctgggactacaggcacacgccaccacacccagttaatttttgtattttttttttttagtagagatggggttcaccatgttggccaggatggtctcgatctcctgacctcgtcatctgtctgcctcggcctcccaaagcagtgggattacaggtgtgagtcactgcgcctggcctataatttaatttctatcgttcagattcaaatctcgttatttatcccaattaggaactgagacccttttttttttctctgagtctgcttgcaagggacatctcttattcttaaactagtgactatcaatgtcattgcaccccttctagggaggtaaaatgtccttctgcccaaagagaagaaagtcaataacacataaaacctgtttaaagaatctgtgcttagaaatcctcctcgtaggccaggcgcggtggctcatgcctgtaatcccagcactttgggaggccgaggcaggtggatcacctgaggtcaggagttcaagactagcctgggcaacatggtgaaaccccgtctttactaaaaatacaaaaattggctgggcgcggtggcgcatgcctataatcctggctactcgggaggctgaggcaggagaatcacttgagcacaggaggcagaggttgcagagagctgagactgcgccactgcactccagcttgcgcgacacagcgagactctgtctaaaaaaaaaaagaaaagaaaaagaaatcctcctcatcctcataggctctgtacagttacagcaatggttctcagttgggggtgattttgactcccaggggacatttggcaatgtctggagaaatttttggttgtcacaactggaggtggtgatttactggcatctattgggtagaagccacggatgctgctaaacatcctacagaggacggttcccccgctgcctgacaacaaagaatgacccagtccaggatgtcaatggggccaaggttagaaatcctgacctgtaagtaaactgaagaggcatgcctttttctgttgcaatggagctcccgtggatctacaattcaccccagcaattccatttccccccacctatgtcacaaaatcccacctctgtaggcacagggaggtccagccaagtgtgtttaggatcgctggaaactggaaccaacctgcatgcccgttaggaggagacagatcaagcacgtagtcacgctgcgctgtgttgcttccctccgcttcttttgctcctgggtaaatagggcgggggaggtgagattggaaggatgccaggaatcttgggcccagctgctgctttatgacttagggatataactgcttctgactcatgcgtgcttggctctttgtgattatgtgctgagacacgtcagcgggaggctgccccggaatgtctccccatgcgaatcgagggtggggcctctgctgagtcacctctggctcctagaagcctggctcagggtcagctcatttgaaaagcggctgccttttcttcttttctcttctcttctctttttttttctctctctctttcattcacattatagcttgagtcagaacttcattcctttttaaggctgaaggaccacattttgcttgtttgttcatgtgatcgatgatgatggacacttaggttgtttccactttttagctatcgtaaacactgttgctaatggaatatgggtgtacaaatatttcttcaagatcttgctttcaattcttttgggtatatacccagaagtggaactgctgcatcatatggtaatttctgtgtttaatttgttgaagaactgccatactgttttccaggttggctgttccatttttaaattttatttatttatttattgtttatttgtttatttttttgagacggagttttgctcttgttgtccaggctggagtgcagtggcgtgatcttggcttattgcaacctccgcctcccaggttcaagccattctcctgcctcaggtacccaagtagctgggattacaggtgtgcgccaccatgcccagctaatttttgtattctagtagagacaaggtttcaccatgttggccaggctgatcttgaactcttgacctcaagtgatccacctgcctcagcctcccaaagtgctaggattataggcgtgagcctccacgtccggcctggctgttccattttatattccaacagtgcacaagggttccaatttctctacatcatcaccaacacttattattattattattattttggagatggagttttgctttgtcacccaggctggagtgcggtggcgctatctcagttcactgcaacctccgcctcccaggttcaagcaaatctcctgcctcagcctcccgagtagctgggactacaggtgagtgccaccacgcccggctgattttttgtatttttagcagaggtggggtttcaccttgttggccaggctggtcttgaactcctgacctcaggtgatctgcccaccttggcctcccaaagtgatgggattacaggcaggagccaccaagcctggcctgttttgtagttttcattgtacaagtttttcactttttggattaattcctaaggattttcttctttttgatattattgtaaatgaaattgtttttataatttttgtttcagatcactcactgtcagtgtagagaaaagtaactgatttttgtgtgctgactttgtatcttgctactttgctgcattcatttattaattctaacagttttttcttagtttgtgaaatctttagggtttctacatataagatcatatcattggagagcagagattattttacttcttcctttccgtttggatgcctttgatttctttttctttttttttttgagatggagtctcactctttcgcccaggctggagtgcagtggctcgatctcggctcactgcaagctccacctcccgggttcacgccattctcctgcctcagcctctcgagtagctgggactacaggcacccgccaccgcgcccagctaatttttctgtatttttagtagagacggggtttcaccgtattagccaggatggtctcgatctcctgacctcgtgatccacccgcgtcggcctcccaaagtgctgggattacaggcgtgagccactgcgcctggcctgatttctttttcattcctaattgctctggctagaactaccagtactatgttgactagaagtcaacatagggtttttttttttttgagacagggtctcactctgtcacccaggctggagtgcagtggtgcgatctcagctcactgcaacctccacctcccgggttcaagcgatccacccagcctcccaagtagctgggacaacaggcacctgccgccacgcttggttaatttttttttgtagagatgaggtttcaccatgttgcccaggctggtcttgaactcttgagctcaagtggtccgcccaccttggactcccaaagtgctgggattacaggcatgtgccactgtgtccagccttgggcagccattttggaccataagatgaaaactgccagttgtcttcaacaaaaagagcgcaagatagcaaaagactgggttcctgacaccgtaaagcaactatgcagctctggatcactttcattcagattaatatgagagaggaaaacaaactactttttgactaggaggcagttgttatttgaacctttcttacagcatggagcctgtatcccaccattgtagtttgtctaatgaataaatggatgattgaataaccaaagaagcagtcagatccaggcccccatacagattcatgcacaaagactctgccttagcctaggtgggagcaacgtccaggtgcagtagaaatattcatggctggaggctagttctttctgacacagggtctcgctctgttgcccaggctggagtgcagtggtgtgatcacggctcactgctgccttgacctcttgggctccagcagtcctctcacctcagcctcctgagtagctggaactacagatgtgtgccaccacagctggagatatatatatgtattttttatagagacatggtctcactatgttgcccaggctgatctcaaactccaggattcaagtgatctgcccaccttggtctccaaaagtgctaggactgcaggtgtgtaccaccgtgcctggctgattttttttctgtattttttttaacgacaaggtctcactctaccaggctggtctcgaactctttggctcaagtgatttgcccaccttggccttccaaagtgctgggattacaggtgtaagccaccgcgcctggcccagaggagctagtactactagttctaaatctggcctttccactagctagctgtgtgcccctgagccacccatgtgccctctctgggtctcacatttctcagttgtaaacccggcttagcaaatctttaaatctatgcaatttaaagttatttttgctcttttgcaattgcatttctaggaatccattcccagggaaattctcaccacatagcacatgaacacaggtgccaggatgcagctgcaccttcctttgtggagcaaaaacttggaaatatccttaaaagtgattaagtaaatcagagtatgaactgtgctctggagtgcaagaccgcggactatggctttctggattctctggtgacacctgctggcacaaagggatactgcagcccagcttggttacgtattgggaatttctagaagaagagaggttcggggcaattgtgtgagggtggtttgggaaggcacagagcagggagagatttggaaggaaggtcaaggcaaggaggtggcctgggtgtggaggttgcaagcatagacttgggttcaaattccagcttcactacttactagctgggtgagcctgggtggatttgggactttctctgagcctcactttcttcttctgtaaaataaggattctgggccaggtgcggtggctcatgcctttaatcccagaactttgggaggctgaggcgggcagatcacaaggtcaagagttcgagaccagcctggccaacatggtgaaaccccatctctactaagaatacaaaaattagctgggtgtggtggcgtgtgcctgtaatcccagctactcgggaggctgaggcaagagaatcacttgaacctgggaggcagaggttgcagtgagctgagatcacgccactgcactccagcctgggagacagagcaagactctgtctcaaaaaaaataaaataaaataaggatcctaaggcccgtgttacagattattggtgagggctgggtgaaagaactaatttatttaataatttattgaaacaacatttcaataaagatgtcagtgactgacaatctcatctaggtgccagggatacagcaggggatgaggcctgggtcctgccctcctggagcttacagtctagtgcagagaacacaacaaaccaataagcatgcatgtgatataatctcaggtattatttttatttatttatttatttttgagacagagtctcagtttgtcacccaggttggagtgcactggtgccatctcagtcactgcagcctccacctcctgggttccagtgattctcatgccttggcctgccaagtagctgggactacaggtacacaccaccatgtcggctaacttttgtattttagtagtcggctaatttttgtattttagtagagatggggtttttccatgtcgcccaggctagtctcgaactcctggcctcaagtaatttacccacctcggcctcccagtggcgggattacaggcgtgaaccaccgtatccagcctaatttcaggtatttatgacactacaaacgaaaataaagcaggaggcgtgctggtgtgggtggaggcattgttacaagtggggtgtgtgaggagggcatctctgaggaggcttgagcagagccagaggagccgtgtcgtgtgtgtgtatggaatgcatgagaaatgctagtggaagagcctcacacataggaaagggccaataaatggtgggtcatcatcttattacacacagcagagggaacgaaaggaagagggattggaatccgtttcccagggtctgcggcagtcacagagagtgacagaagattccctgggctggcaggtggagcagcagccctgctcatggtgtggggggtggggagccctggacctgaggagacccagctctgggtggccttgggtgagccactctctgggcctcagtttcctcatttggaaaacagggccgataatgcccaccttgtgaaactggggggtgtcacaggctgaatgatgacctcctccaaataattatgttgagattctaacccccagtacctcagaatgttactgtatttggaaataaggcctttaaaggggtaattaagtggccaggcacagcggctcacgcctgtaatcccagcactttgggaggtggaggtgggcagattacttgaggtcaggaattcgagaccagcctggccaacatggtgaaaccctatctctaggaaaaatacaaaaattagctgggcatggtggtgaacatctgtaatcctagctacccggcaggctgaggcaggagaattgctggaagccgggaggcgggagttgcagtgagccgagatcccgccactgcactccagcctgggtcacagagtgaagctccctcttgaaaaaaaaaaaaaggtaattaagtaaaaatgaggtcattagggtggaccctaatccaatataatcgttgtcttcataggaagaggaaatgtggacacagacacaaacagagggagggccatgtgagcccagagcaagaaggcggccatctacaagccccggagcgaggctgcgggagaagccagccccgctcacaccttgacaacaatctctgttgattaaaccacacagtctgcagtcctctattacggtgagccctgccagctgagatggggttgacgtgggaatacagctgggcacacaggaggccctcagtggaggctggtttctttggcccagtgccacatggagcccgtccactggctgagctgggggcctgattgtggccactcaacgtctctgtaaagctcagggtctgccttgagatcctgcacttaccacggagtggccctgccttggggacccatctcacctcacttctgccctcctttctggttcatgactcagccatccactaacctcccgtggtagcactgtggccactctgtaaacgacagcaccactggtgtctcattgggggccagtctggaagagggagaccaccctaggcatttcagacagaagggatggaatacaggcattgcttacacagaggacggacgagccgagatgcagaaaggccaggtgaagcattggccacagctggaggcgctccaccctaggccagcgggacagaaggaagctgggtccgagaagccagggcttggagccacagtgggggctgcctggtaggagttgaccagggagggagggtctgtcgggcgggggcgggggctctttgccttccgatccaagctccgccctctgcagctctgctctgtgtatcccagagctgaccctgcggcgcctttcccaggctcgcgtccggtgagttcctattggccaacgggaggccccggtcggggagcgccccgggacaggcccctgtgcctcccgctttgcggagtgacgcaggccctgggctacagcaaccttaccagcccctccagcttagaggtggcagtggctctctgcggctgcgatttctttctcggagcgtcctccccatcccgttcggcctctgcctccaccgtcgtctctgtaacccgttccctgtgggagagtctctgttgcggtgttcaggggtttcggttttctggctgaacagtgattaacgcgagggaaggcgctgacggcaaggtggcaggtgaccagcccagcaggccgcccagcccttcccttcctacagacagaagcactgaggcctgcagaggggacaggcaggtgggcgtgggggatcgggggcagccctggagtcagacaggccttgttttgtcccaggaagaacattccaacacagaccacaacacctatggacctggaaaacattgtgctcagtgaaagaagccagacacagaaggacaatgttgtatgaggtacctgggatgggcagattctgagagatggaaaatagaatagagattacctggagagaggggggaattgttgaatgaggacagagtttgtgttggggatgatggaaaagttttggatacagagagttatgacgagtatacagcattgtgaattttttttcttttctttgttttttgtgacaaggtcttattctgttgcccaggctggactgcagtggtgcaatcctagctcactgcagcttcgacctcccgtgctcaagtgattttcccacctcagcctcccgagtagctgggactacaggtgcgtgccaccacgcctggctgatttttcttgtatttttttgtagagatgggggtatcgctatgttgcccaggctggtcttgaacacttgggctcaagtaattctcccgccttggcctcccaaagtgctgggattacaggtgtgagccactgtgcctagtgtgaatgcatttaatgccactgaattgtacacttaataatggtgaaaaatataaatattctgttaaatattttaccacaataaaaaaatgtgtgacagttgtcagaatcaaaatggtgtcactaatgtttttttttttttttttttttttttttttgagatggagtctcgctctgttgcccaggagggagtgcagtggtgcgatctcggctcactgcaagctccgcctcccagcttcacaccattctcctgcctcagcctcttggagtagctgggactgcaggcacccgccaccacgcccagctaattttttgcatttttagtagagacggggtttcatcgtggtctcgatctcctgacctcgtaatccgccctcctcagcctcccaaagtgctgggattacaaacgtgagccaccgcgcctggcctggtgtcactaatgttaagaaaaccttcacaaatagaggcagaccatgaagagaggggtctcattcttatatgcctgataaagaaagactttaagaactacaacccttggcggggtgcagtggctcatgtttgtaatcccagcactttgggaagctgaggcaggtggaatacctggggtcatgagttcgagaccagcctggccaaaatggtgtaacactgtctctattaaaaatacaaaaaaaattagccaggcgtggtggcaggcgcctgtaatcccagctactcaggagactgagtcaggagaatcgcttgaacctgggaggtgaaggttgcagtgagcagagatagcaccactgcattccagcctgggcaacagagtgagactctgtctcaaaaaattaaaaaaaaaaaaaaaaaagaagccgggtgcggtggctcacgcctgtaatcccagcactttgggaggccaaggtggatggatcacatgaggttgagagtttgagaccagcctgaccaacatggagaaaccccgcctctactaaaaatacaaaattagccaggtgtggtggtgcatgcctgtaatcccagctactcgggaggctgagacaggagaatcgcttgaacccgggagatggaggttgcgatgagctgatagtgtcattgcactccagcccaggcaacaagagcaaaactctgtctcaaaaaagaaaatatttatttttagagacaaggtcttgctctgtcaccgaggctggagtgcagtcatagctcactggagccttgaagtcctgggctcaggcagtcctcctgcctcacctcccaagtatctgagactacaggcaggcaccactatgtccagttaatttttaaattttttcatagagatggagtctcactatgttgcacaggctggtcagtctagacaattttaaattaaatatgtaactcacattaacaggtcacattatttatttatttatttatttatttattgacacagggtctcgctctgttgtccaagctggagtacagtggcacaatttcggctcacagcaacctctgcctcccgggttcaagcgattcccctgtctccgcctcccgagtagctgggattacaggcgcccaccaccacgcccggctaatttttgtatttttagtagggacagggtttcaccatgttggccaggctggtcttgaactcctggcctcgtgatccacccgccttggcctctcaaagtgctgggattacaggcatgagccaccatgcccaaccgcagacatctttttgttttgtttttttttctttttttttttctttggagatggtgtctcgctctgttgcccaggagggagtgcagtggcatgatacctgctcactatagcctcgaactcctggattcaagcgatcctcccacctcagcctcctgagtagctgggcctacaaatgtgcaacaccacgcctggctaattaaaaaggtgacagagagaccctgtctcaaaaagcaaacaaacaaaaaacgacacatgtgcgtgtgtgtgtgtgtgtgtgtgtgtctgtggagagagagagagagaaagaaggagaatatgatacatcaaatgtagtaaaatgaaaacatttgggaaatatttgaagtatttgtaacttttctctaagtctgaaagtatttcaaaattaaaaaaaaatttaaaaggtgaatagtgccaggtgtgttggtgcacgcctgaaatcccagcactttgggaggccaaggcaggtagatcacctgaggtcaggagttcgagaccagcctggccaacatggagaaactccgtgtctactaaaaatacaaaaattagccaggcatggtggtgggcacttgtagtcccagctactcgggaggctgaggcacgagaattgcttgaatctaggaggtggaggttgcagtgagctgagattgcaccactgcactccagcctgggcgacagagcaagactctgtctcaaaaaaaaaaaaaaaaaaaaatggtgaatagtaccaagcggtggtggaagatatgggatataaaacccttgggcacagctggtgtgagtggagacgggacagcctttctgtagagcacctggtacttagtcaaattagtccccccatcccctacaacctactctcaagccaaagtcccagagacatcctcacaccagccctagagggtgcaaggaggtggcagctcaccttatctgtggtggggcaggttgggggtcacttgggtgtctaccccagggactgggcggctgagactggggactgctcatagaaaggaccgtggatgagccacagctacaaaacccttcacacaagtgttcatgccacaaagtagccacatgtgttttgcagggacacattccagcaaaaagacacaaagtgacagaatggctgcctttgagtgggggtgagaagaggtggatggcaggtaccagaagagaagggaataaatatatgaagaaatacaaccccctcgggcagtgcctggcacagcataaatgcccaggaaaaagaggcccagttgcttacgttcccggcgacagggccgggaccagcgccggcttcctggtgaaggaggccaccctttcctcttgaggggtctgagtatgcatgtcagcacccggtgggcacccagcacccagctgaccaggggccttcacctctgtgggggttaccggcctggccctgagaactggatgaaagctggaataattctttctgtaataaagcaaacgcaaccacgttcaacctttcccttcatttcagaggcttcccgcacctgatgcctcccacagcctcaggctgagtccccaggtgctccagtgggggtggcaaagctgagcactgagttggtttccatagttttcatcattaaaatgtttaaatgactaggccgagcacagtggcttctcagcattttgggaagccgaggtaggcagatcgcttgagcccatgagtttgagaccagcctgggaaacatggcaaaatcctgtctctacaaaatgcaaaaaaattagccaggtgtggtggtgtgtgcctgtagtcccagctacttgggaggctgaaatgtgaggattgcttgagcctggggaggctgagattgcagtgagccgtgattgtgccactgcactctagcctgggtgacagagtggcagaccctgtctccaaaaaaaaaaaaaaaaaaattagcctggcatggtggtgcgtgcctgtggtcccagctacttgggaggcagaggagggaagggcacctgagtctgggggtgttgaggctgcagtgagctgtgatggtgccgacgtacttgagcctgggctacagagatcttatctaaagaaaagcctaaatgaatgtgtggtgaggagcaggcttgagttattttcatgatgagctcctcaggatagattctcaaaagtggcattggtggggctctacctctgtttattcattaatctgttttatttttatatttatttatttatttcagttatttttttgagatggagtttcactctgtcacccaggctggagtgcagtggcacgatctcggttcactgcaacatccctctcccaggttcaagcaattctcctacctcagcctcacaagtaactgggattacaggcgtgcgccaccacattcagctaatttttagtagagacgcagtttcaccatgttggccaggctggtcttgaactcctgacctcaagtgatccacccgccttggcctcccaaagtgctgggattacaggtggcagtcaccatggctggcttgttttatttttaacatttaattgggtaagctgcagatacccctcaagatgtcagtgtgcatgtcaagatgtcagtgtgcacgtcattaactagagtcaaatatttgtttctctgtctgtaaagcttacatttggtgaactgcacctttaggtgtacttttgattattattattatttttttgagatggagttttgctctgtcaccaaggctgagtctagtgttgcgatctctgctcactgcaacctctgcctccagggttcaagtgattcttctgcctcagcctcctgagcagttgggattacaggcgcctgccactgcaccaggctaatttttgtatttttagtagagatggggtttcaccatgttggccaggctggtcttgagctcctgacctcaagtgattcacccgccccagcctcccaaagtgctgggattacaggggtgagccactgcgcccagccacttttgattacttttgacaaatgcatccacctgcactgcccaaactccctccaagatgttaaacatgcagtgggttgaattgtgtcccccaagaagatatgttcaagtcctaacccctgggacctgtgaatgtgaccttatttggaaataggggcttgcagatgaacccaacttaagatgagatcattctggattgtgggggctctaaatccaatgactggtgtttatataagagaaaggagagggagatttggaggtgaacacacagagggaagaaggcactggaagaaggccgttggaagattaaggcagagattggggtgaggcagctagagccaaggaacatggtggatggcgggcaagcaccatggaagaggcaaggagggattcttccccagagcctccagagggagcaggaccctggtttcaggggagaataaatttctgttgttttgggtttgtggtatcttatcatggcggccttaggaaactcacacgaaacacacaccatcaccccagcgagcacccttgtcccctcctcagttgtgctctcccccaactggcaaccaccgtgctgatattttcctcatgggtgagttctgcctgttctagagctctaaacagatgggatcacacaggaagttcttggcatctggcatctttcactcaaacaagatttcagagattgttgcagctatcagtgctggcacgcctataattaaagtccatttacttgaagaggaagtaaattttgaatttgaggaggggagtaggcagtaagctttctttttttttttttttttgagaccgagtttcactctttttgcccaggctggagtgcaatggtgcgatctcggctcaccgcaacctctgcctcccgggttcaagcgattctcctgcctcagcctcccaagtagctgggattataggcatgcaccaccacaccgggctaatttttgtatttttaatatttttgtattttgtatttttagtagagacgggggtttcaccatgttggtcaggctggtctcgaactcctgacctcaggtgatctgcccgcctgggcctcccaaaatgctgggattacaggcgtgagccaccgcgcctggcctgtaagctttctctttaaagctgggcttgaggccccctctcccgggggtctctggccctcaggaaccccagtctgaagctgtttcccagttcagaggttgcagagatcggaggcggggctcccgcgccaccttgtggccattctaggcagcgcaacccatgatgcctgtggcggggcgtgggggtggggtggggtgggttggggaaggtgggttgggcaaatgtgtattttcctggtttgggccctcaagtcactgagcacctactcagcacctgcatgattccactgtatgtgtgtgtggacagagatgaccaagattgcgcagaccctagaggggttcccaggagagggagactacacaacactaactccagtagggtggatggagtgaggcccagaggcctgaagtccagctggagcctggaggaggggagagtaacggacttgggcattcagggaacgtttccctgggcatttcgacagctggggatggaaaggaagactgttacaggcaggggaacagcacaaccaaggtgtggaagcaggaccgggcaacattctggacccaaccaatcataaggtcatacgtgtccatggcaaacattttttttttttctttttagagacaaggtcttgctccatcacccaggctggagtgcagtgacacagtcatggctcactgcagccttgacctctcgggcccaagagatcctcctgcctcaatctcctgaatgtctgggactgcagatgcgcaccaccatacctggctaattttggatttttttgtatagacgggggggtctcgctatgttgaccggcttgtcttgaactcctggcctcaagtgatcctcctgctttggcctctcaaagtgctgggattataggcgtgagccaccacgctaggccccatggtgaattgagttttttttttttttgagacagggtcttgttctgttgcccaggctggagtgcagtggctcaatcttggctcactgcagcctctgctccccttcctgggctcaagtgattctcctgcctcagcctcctgagtagctgggattacagggtcgtgccactgcgcctggctaatttttgtatttttagtagagatagggtttcaccatgttggccaggccggtcttgaactcctgacctgaaatgatccacccgcctcggcctcccaaagtgctgggattacaggcgtgagccaccgcgcctggctggcttaagtcttaagcagcagcttccacttttgtgttctgggggaggccagcagctgtgtaagaagtctgtgctggttgcaaaaagtgcaaggtttaaaaaaaaaaaaaaaaaaaaaaaagactgtgctgaggagaccacatggaaagggcaagagaggccaggaggagaggctacttgaagggacaacttgcagcatgtgcagaggccacatggggagaaagaaactgccagagggagcactgaggaatgaactaaggcagcagacacatggtccagccagccatccgccactcgggccagccgtgaggtgccacacgtggagcacagaagccactgtggacgcttggagcagagataagccgtcccctcatgctctgtcctaattcctcacctacaggatcgtgagcaaatatactggtggttattttaagcccttaaaaaacagaattactggccgggcgtggtagctcacacctgtaatcccaacactttgggcggccgaggtgggtggatcacttgaggtcaggagttcaagactagcctggcctacatggcaaaaccctgtctctactaaaaatacaaaaattttttattttgtatttttagggcgtggtggcacacacctgtaatccagctatttgggaggctaaggcatgagagctgcttgaacctgggaagtggaatttgcagtgagctgagatctgagatcatgccactgcactccagcctgggcaacaaagtgagactctgttttgaaaaaaaaaaaaaaaaaaggcattactatataatccagtaaccccaccactgggtatatatcccatggaaatgaatctagtgtgttgaagaaatatctgcgcttgcacatatcctatggaaatgaatctagtatgttgaagaaatatctgcgcttgcacggttattgcagcgttattcactaagttttgaggtgcagtgttacatggtggcagccagaacccccggccctgggctactactgttgctggtttcttatgacccttccagcatgagcctctgcatcctcaaatacatgaagctgggtgcggtggcgcacgtctgcagtcccagctactcaggaggctgaggtgggaggatcgccagacccaggaatttgtgtgctatgatctccctgtgaacagccactgcagtccagcctgggtgatacagtgagaccctgtttctaaacagataaacaaaccaaaaagaatacgtgagtacatttccactcctcccctcatttatgtggggttcgcacaccacacatccggcctgctcttggcttttattttttttccaattaatgatagatcttggagattgttctagatgtgtactgttcaatatagtagtcgctagtccaggaggtgatttaaatgtattttaaaagattaaatttttatgtattttttaaaagtagagcactcctcctgcctcagcctcccaagtagctgggactacaggcacacaccaccatgaccggctaatttttttttttttttttttaagatggagtctcactctgttgcccaggctggagtgcagtggcatgatctcggctcactgcaacctctgctgcccgggttcaagtgattctcttgcctcagcctcctgagtagctgggattataggcacctgccactgtgcctggctaatttttgtgggtttttttttttagtagagatggggtttcaccatcttggccaggctggtcttgaactcctgacctcatgatccacccgccttggcctcccaaagtgctgggattacaggtgtgagccactgcacccagccttaatttaaatttaaatacaattcaataaaattaaaaattcagttcctcaagtacactagccacatttcaggaattcaatagacacacatggctgatagctgccgtatgatacaacccagatagagaacatgtccatcattctagaaggttctcttggacagtgctggtctaagtcctctcccatggagctacctcattcttcttagtgttctttggtaatgacagccactgacgttacctcacaagcttttgctattgcaaagcatttgctgttctccatttttctttaagcaaatgtgagtgtcttggtggcataaatgccttgcatttctgggtccagtgacatttcccattttgtttttttcctttttttatattttgttttattattttttaaattatactttaagttttagggtacatgtgcacaatgtgcaggttagttacatatgtatacatgtgccatgttggtgtgctgcacccagtaactcgtcatttaacattaggtatatctccaaatgctatccctacccccttcccccaccccacaacaggccccggtgtgtgatgttccccttcctgtgtccatgtgttctcattgttcaatttccacctatgagtgagaatatgccgtgtttggttttttttgtccttgcgatagtttgctgagaatgatggtttccagcttcatccatgtcactacaaaggacatgaactctcattttttatggctgcgacatttcccattttgatgggcatggccagattagaactggaggttacgccacttcgcacaaagactgaagctgtaagagtgcctgtttttccacaccatcaacactgcgtgtcattcacattttaaaaacgttttagctaatggcaaaggttttcaagacaaacgtgactttaccaggcccctgccctgcctgttgcctctcaagtcacaatgccagtggacatctttctctgtccacaggtgaagatccatcttttgtttgtttgttagaaatgagaggccgggcgtggtggctcatgcctgtaatcccagcactttgggaggccgaggcgggtggatcaggaggtcaggagatcgagaccacggtgaaactccgtctctactaaaaatacaaaaaattagctgggcgcagtggcgggcgcctgtagtcccagctacttgggaggctgaggcagaatggcgtgaaccaggaaggcggagcttgcagtgagccgagatcgcgccactgcactccagcctgggcgacagagcgagactccgtctcaaaaaaaaaaaaaaaaaaaaaaaaaaaaagagatcttactgtattgcccaggctggtcttgaactcctgggctcaagggatcctcctgcctcggcctcccaaagtgctgggattacaggtgtgaaccactgcgcctggcccacgttggccttttttttcaaattgtaaaatacgcagaacataaaacttaccatattaaccattttaagtgcacagtttggtgccattaaggacattcacgctgttgggtaatcgtcaccaccatccatctccagaactctttccatcttcccaaagatggaactctatatccattaaacaagaacttcctcctacctcagctcctggcaaccactgttctattttctgtctttatgaatctgactactcaaggcacttcatgtaagtggtatcatgcagtatttgtccttttgtgactggcttatttcacttagcacaatatccttaaggttcatccgtgttgtagcctgtgtcagaatctccttactttttaaggctaaataacattctattgtacagacacatcacattttgtccattcgtccatcgatggacacgggtggcttccacctctttttttttttttttttttttttttaagtcggcgtcttgctctgtcacctaggctggagtgcagtggtgcgatctcagctcactgcaacctctacctcccaggttcaagcgattctcctgtctcagcctcccaagtagcagggattacaggcacccgccaccacacccagctaattgcttccaccttttggctattgtgaagaaggctgctatgaacgtgagtgtacaaatatctcttcaagatcttgctttcaattcgtttggatacacacccagaaataaaattgctgggtcatttggtaattctatttttaattttttgaggaacagccataccatttcccacagtagctacacaagcattccagtttctacacatccttcccaacgcagcagccagcctaatgggcgtaaggtggtatctcattgtgttttattccttttatttttagttgacacataattgtacatgttcatgggttacaaaatgatatttcaatacatgtatacaacgtgtaataatcaaatctgggtaattaggatatccattacctcaagcgtttatcatttctttgtgtcgggaacattcaaaatcctctcttctcattgcgttttgtttgttttttagatggagtctcactcagttgcccaggctggggtgcagtggcgtgatcttggcttgctgcaacctccacctcccaggttcaagtgattctcctgcctcagcctcccaagtagctgggactatacgcacgtaccatcacgcccagctaatttttgtatttttagtagagacggggtttcaccgtgtcggccaggctggtctccaactcttgacctcaggtgatccaccaaagtgttgcgcctcattgcagttttggtttgtatttccttaatggttagtgatgttgagtatcttatcatgtgattattagccattcacagttttctctggagaaatgtttattcaagtcctttgcccatttttaattgagttgtttttattgctgttgagttgtaacagttctttatgtattctggatatgaaccccttatcagatatatgatttgcaaatattttctcccattccatgtttccatgttccatttttttttttttggaggcagagtcttgctttgtcacccaggttggagtgcagaggcacaatttcggctcactgcaacctccgcctcccgggttcaagtgattctcatgtctcagcctcctgaatagctgggattacagatgcacgccaccatgcctggccatttttttttttttaatttttagtagagatggggtttcaccatgttggccaggctggtctcagactcctgacctcaagtaatccacccacctcggcctcccaaagtgctaggattgcaggcatgagccgctgtgcctggccagcccccactatttctatgacacaaattcctgctactctccgtcatcaccacaactacgtgctcctacctcagggcctttgcacttgctgttccctttgtgtggtccaaggtcccccagatacctgcttcaccacattcaggtttttgcttaaatgtcacctcagtgaggtcttccctgactactctaacataaagttaaaatcaactcccccagcttgggcaatataatgagacctgatctctacaaaacattaaaaaatcagctgggtgtggtggcatgcccctgtggtcccagctacttgggaggttgaggtgggaggatcacctgagcccaagaagcagaggctgcagtgagcagagatcgtgccactgcactccagcagtgagaccctgtctcaaaaaacaaacaaacaaaaaaccccagaaaacaaaaaatcaaatctcccagaactcctgctctgctcccctgctgtattttcctccatagtgctgaccagaatctaatacaatctatactttaatcattgatcttgtttagtgcttgtcttcccccaggagaatttcagctccacgagaacaggaattgcttgtcttgtccatgaatgtgtctttagggccagaattacagcatgtgccaaggaacattcgataaatgtgaaggttgagcactgttttctgttcgttggacactctggttcctctcggcggcctgctgatgccctgtgtgcatctatcacatccatggcaccggcctttcctgatcccagagcaagggcgcccagcggatcttcacgcatgtgaatggctcctgcagtcccagaacctgccacctgggggcagtatatactcaggcaagtttcactaccggtcctgagcacctcccgtctccaaaatcctggatctcagaacctcggagcctggcagcccttggggatctatctctgccagccccacttggcagatggggaaactgaggcctcagagaggaggcatgatggggaaaatctcaaacattggaatcagggaatctggcttttaagtctggctcttgtacccattcacaagggtacaagggggatttggagggggaagtaggaagttctaatcctcttcgggcctcagtttccccatctgcctgctttgtggggtgaaagggacatctgattaactctaatgtgtcggggaaggccagcagtgaggggtaacagcaggcccagaatcccagatagaatattatcacctcattttatataccagggactgaggcccagaggggacaccagacacggccggagagccacagcatggaaggcacagggcagcatgaaaggccatccccctgccatccccctgccccacgcccactagagacacccccccattcatgttctgatggttcacctctccgccatattttcccacctgctggctgatttctaagcccttttgcagaacactctctgtcaaagcagccacgtggatctccccttggcaaatcgcctcagttttctcctcttgaaaatgggatagggaaaagctgcagagatggggaggaggaattgtgaaaagcagtttgggggcagaggaggacgtgtgtcccaggtaggaaagtgcctgttccctccccgcccccgcctggctcctgcccaccaccatgtggccacgtgggcccagcccacagcttcaggttttaaaagaggagctggaaatttgaattttgatgtgaaatctcctgatttttaaatgttggcaataaattcacttaaacacacacacatcaagcaaaacgctatggggtcaaattgaacacatctgtggtctcgatttggccactggctgccagtttgagatcctttccggctctaggttctgagggcaggtgactgggagaggtggcgccagggggatcctggtttcctgtgcccacacagccactcacgtactctgggcctctgggccgtggtggttcaagctcccaccatccccacttcttggggaaaggctgaacagtactggggtgggggtgggggagcagcaggcggggcctgttgagcaagagccttgtaaaaacaagggcttacgtcatcctagcttgcagcttccctgcaggacacctgggtcggcaccggggtgggacctgcgctgagaagggatgggtcatccccagcagggggtggagggtggggaagggtggcaagcatgttccaccccagaggccagagggcctagacccctgctggggctgagtctggtctttgggggctggcctgcaaggtccgagtaacaccttaacgcactgtgtgaccccaggtctacccttctctgtgcctcagttcttctatccagaagatgggactcacattgccaggcctgttatgacaaacccaagagggaaagtcagactggaaagattttattccttctcatcctttcatgtgacctggagcagacacacttagctcttctgggcctcagtttcctcatctataaagtggagataatgataagactgtggcctggcgcagcggctcacacctgtaatctcagcactttgggaggctgaggcaagagggccacttgaggccaggcgttcgagaaaagcctgagcaacagagtgagacatatccatctctacaaaacattgaaaaatatgaaaaaagaagaagaaaaaagacctgcctcctacaaattatcagtaggattaaatgagttaatacatgcaaagagcttggaatgtggttcagagaaggtggaagtttggcctaagaacacacagcaaatcctccaattagcttcagttcccccatatctccctgcatctcttcagaatccagaaagggaacgtgggcgagtgctttggttcagagaggggagccattttgcctaaggtcacacagcccagctaacgaggaacctctccttcttctcagcctcctccatttattcactcaccattcatcgagcaccttctatgtaccaggctctgttctaggcaccagggacacagtagtgaaggccgtggggacagacagcaagactggcaggcaagataattctgattataatgagaatggtgacggaaatgaagcaggggtgtgagaggagtgactgagggcctagacttcccatgggaaggtcagggagggtttcccggaggaggcagcttttgggctgagacctgaggagctgccttgggcagaggtggggtgacagtgttcttggtgcacagggaacagcaaatgcattccttcactggtaaatgttgagcgtgctgtgctcaggagtccctcgtgggccagccctccccaagtggcagcctgcagggagactgaggtagacagctaggataatggtggctggcgatagggaaggaaattcactagcaggtgggacagggagggcctctcagaagccgtggcctctagctcagccctgagtgtcccattttgcagtgaggaagggctggccgggtggccctagggaagctgccgcacccctctgggccttgatccctccccaacccagaggctgctgggaagacccagaaagccagcaggctgggccagtgttttatcccctccctccctgcctcctacccaccaagggtgcccagagatgtcatttctccagctcttgggggcggaggtcaccccagctcagcagataacaccaaaggttgagcaatgcccgcctgcccgctggggccagggctggggtcagtgggctggggatcagccccgggcaggctgggagctcctgcctaggtggcctgggctaggagtggcagagaggtgggcccagggagctgccccaatggcctaggaatgggtccgggagggcaaagggccctctaacctgagcctacccagcagaggcgggcaagtggtcagaaggccttgggcctgtgttcaagtccaggcgggccgttgtcgctttcccgtctgtgaaatggcagcagcaaaagcatcttcctggtggggtgaaaaaagttgaacctcggggtgcaggcccaccgtaagcacagggcagggacttggtaaaaacttatctttctctttccttctctttcctgcataccaccccctcccgtgaggcctcgcttaagtccctccctagcaacttcagaaacagaagtttttggcctctgggactggcaataggtcttagggctcagatgagggcatttcatttgggatgaatgggggacatgcggccatgtgaccttggtatgccacgccatgctctctctgggcctccactggcacaatccgtgggggtcccgttctctctgatgtgcagcccacaacgtaagccttaggtttgggagtctggtgggaacaatgccaccaccactgacagtagcgacacccttcatggattgcagctgggagaagtgaagtgactcacccaaggtcacacagtgtggcagggccgagcaccccccgcccctgccccatcccagggcccaggtcgggtggcgcagcgcggggcaagagaagacccgggcgtgtccaagcctcgagcaggcggcaggtgtggtgggcggggctaggggcggggctccgtggaccagggtccagccccaagcggggcgcgatcctgcccggtcgcgccgacccccggggtcctcatattgtctgtggcttaagaggggagtcgtcacaggcgtcaagtcttctttctaaagccggggacctggggaggaggtgggagtttacgggaggaagggccacggagatgggtcgcttctcctggagctagagctgcgggctggggtctccagggttcggcccggggagccgaccctggtcggccgtcggggctctgctcggccctcctgaaacctccgcctcctccagcagggggcgggccggggccgcgtctcggggggaaggcgatcaggtcgccccctcctccgattcccccgccttccaggacagcctccagcccagaggggcggtccgggggcggggtcgcaccgccccctctcgctcccaatcccggggcggccgggcgggggtgggcagggggcgtgaggccgcccctgcgtcccgggggccccccgaaaacgcgctccgggtgcccggtccctccgctgcgccctgccgccgtcctcccgggggtctcgggcggccgcggccgtgtccttcgcgtcccggcggcgcggcgggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatggttacaaagccttttgggggcagtaattggcttttgttttttatttttttactttattttggatttgtaggattttgtttttgcgtttctggtgtgtagggggttgtgtgtggggggctgctgttatttttggaggttttggtggttgggtgggggtgttgcagctggtttttctgcctcctctgctactccccctcccacacacacagggtctgcttgagatggggttccagccccgggggaaaggggagaagagtaatgggtcaggcattcaggctgactcagagcccctaggcgccgggacgggtggctgggaaccctgcttgagaagagattccggagcctctggctggtcccgagtgtcaggcttgggtttggaagggctgggaggtctgtgacccctgccctgtgtttggggactaggtaggcaggcctgtgactgtaggaggagggggttcaggtcttggtcctgctgagcccgagtcagggcagatgcttttggtcagtgtagtggggtgggttgtttaaaacacagtttgtgtatacatgtgtattttaaagaggggagcctgggtgtgtgggcgagtctgtgtttgtgtgtccctggccagcaggaggggagaggccaggccaggtggagagaggtgggggaggggttcccacactttgattacctttcctgaggatgggaggctcatcacttgctctctttgcccagacttggacactgagcccacctcacctgcctgctcaaggtggctgagcccaggcacaaacgtggggctgctagccctgattccctgggacaggctcctcttccctgcccactgatccctttgccccttccggcttctcaccgcaccccctactcccatccagccctggatggcattcctgagagttgaggatgtagatggatgtgagtggatacatgtacagcgtcccacagtgcctggcacgcaagaagtgttatataagcgcttgctcttgttattattttttgctgggaagctgctggcatttggcaccccagtctccagtgcagcgccagtgtggccagtacttgccaggggccggcatctggtaaacactggacctgccccatcccatttagacctcacaataacctttgggaaggtggggattgttatgacgcctgtttttagaggtggggagcagctttgggctgtccgatccctatgggcaagacactggttgggggttgccctgccctgaggaattcaggggcagcaggcatcgtagcctggtttgccaaggacctggggcggtctgggatctcaggagcagttgctgataccgtggttcgcgaatgggaaatgctttgcccctccttttccttttgggggcctggttgtgctttccctgtgggagcctgggatgtggggaacagacagcgacactcatcccccaccgccacaaagcggaggattcctataagctccacctccctaatgccagtgtctcctgatggtggctcgagggctatgcagattgctggacacagataacctcacttcaacctgggacctgcagcgtggccctgaccacgtcccctcccagccctgggcaactggacaactggccgggcatgccttcaaagcctcgaagtcagttcagtcccaagccccactggtctcgatggtttctgtcagtagcagcgacagcaatgtgggcttgacctcaaggatttacttgctgaaggcagaggctgaggggctggacctagggaaggagggaggtggagagggtcgaaattgaggaacaaatctcaaatccctgctccctcctttgtcaccaagagttggctggtggccactgctcacccaaatgaggtgagagggaagcagcctggccagacggtgcccctcttccgcccccgtctgccccacagcttcgcttctgtttccccagtgctgtcctggaaccagcgttgagtcagttcttcacacactcacatcttgctctcatccacagtaccccacagaaggtgctagacccatttctaaaagcacacattgaggtccacagaagtgaggtttgtgctcaaggtgggctaggtggagcaggttacaaaaccatccgactcccaagtctatggggaaagtttggggctgggagcctggtttgtaatcccagttcctgtttaaaatcccaggctcttcttggagggctccttgcctgacctcaagttcaggcactccaagccccagaactgcaaacatcagtttcacagtttggaagcaacagaaagtgaatttgaacctgaaccccttgggctgcctctaaggagggctgggagaagcagttcacaggttgagggctttgacggtggcttggtatgggagcactgtggacggagctgtgcccaaaggacttggggagatgtcatagttagggcaacaccaaccccacagttcaccaagctgcaagggtgaagggctcgcagggaggaaccagtccattccgacatccagaaacaggagggggtgggatggggtgaggcgagcccaggaggccagggacgagccttgaggaatcatgataatagcaggtgtgagacaagggcttagatgtgcaaagcaccactccaagcccttggcacagagggaggtgctgggtccttagatatgtgggagaaagccggtcatgttaaccacagacccatttagtgtgtttgaccactgaggctagctgggaggtgggagcctggaaccccaactaatgtttgctcaggacaagagagttcacaaaacaagacacattcacacctcataatcttatgcaattgtcccacggcctggtgattttagcaaggagataagtggatgtcagaaatgaacgctcgagacactgctgggtgccggttccacactgacactgtgctccttggtttaatcaactcattagccttttggaggctgcagcttttgttactagcattttgctgctgtgcaaaccagcttagagaggtgaactgacctgtcttaagtttgcacagctaagaatggcagaagctggagtgggagtgagaaggggaactgctccttctgaacacctgaagaatatttccctgcaggctgggcgaggtggctcacgcctgtaattccaacattttgggaggctgaggacggcagatcatttgaggtcaggagtttgagaccaaccccgggcaaaatggtctctactaaaaaaatacaaaaattagcctagtgtggcggtgggtgcctgtagtcccagctactcaggaggctgagacatgagtatcacttgaatcacagaggcggaggttgcagtgagccaaggtcgcaccactgcactccaacctgggcgacagagcgagcgtgcctctgtctcaaaaaaaaaaaaaaagaatattcccctgccttccaagttttgtccagacctctctgagactgttttctcccagtttctcagtcgtttttttgcccagttatatttttcatttatttgacaaacatttattgagcacccgctgtgtgctaggccccttactgggtgttggggacatgtggtggccaagatggaggtgataattttcagggagacacagatgctaagtatccagtgactggaacaagataatggcagatggagtcaagggctctgcaggaaggaaagtggggcagaggtgagtgggagcggtcctgcgaggcccctcctaggaagtggcatctgagcagagacccctgagcccagggagtcaggagtatggtgggctgcagtttactggatgctcactttgcacctgctggtgtcctgcatgccttattcttaaaatcccaatgatgtaggtgcttttttttttttttttttttttaaaggagtctcactctgtcacccaggctgtagtgcagtggcatgatcccggctcactgcaagatccgcctcctggattcaagcacttctcctgcttcagcttcccaagtagctggcattacaggcttgctccaccatgcccggctaatttttgtgtttttcataaagatggggtttcaccatgttggccaggctggtctcgaactcctgacctcaagtaatctgcccatctcagtctcccaaaatgctgggattacaggcctgagccactgcacccggccatgggtgctacttattactccccctccccagatggggaaaatgaggcacagaaaggtgaagtcaccggtccaagagctggtgagtggctgatgtgaggtttgaattctcaccttgcatttgaacctgagaggccttctctgcctgttttcccccatggccctgagcctctcctttgctgttttcctgtcctgcccttccaccccctcctgagttctttctcagcttggccaatctcctgcgtggcctgtgatggcgtcccagcagtccccgctccctgtgggatttttgatggtgcattggccggggcagggtagtgagggaggcctgggctgggcagacccaggagaggccagagtgggctggggaagccaggggctttctgggctggtggtgttagcccctcccaggtgtcttccgagacagaaaggaaagagttccattttacagagaggagacccgaggctctgagaggggacagttcctgtcccaagagcagcaaggttgggatttgaatccaggcctgcctgagccccaagctcagccacttttctgtctggttgactgctctggggaagagacacgggaagaacacaattagacacctctgaggggtaggatgcttgagcaaaagagctctgggccttgtcccttggttgcagagtgaccttggttgaggcacttagccttgctgaacctgggcttcctcacctgtgagcacggagtacagatatcacccagtgtcgagcaagcacccattgtgagcccaagatggtccctgacccccggagctgtcattgtggtagaggagacaatgtgtggctagcagattggcaagcccattgcagattgtgataaaggccctgaagaaaataaggtgggggaagtggaggagggtgattgggggggaacgcgtagggagccttccaggctgggggaacagcacacgcaagggccccgaggcagggcccagctccgtgtgaggagaagagcctggagccagcatggctggagcagaggcagcaaggggaggagtggggaagaagaggacaggggtggggcagggtgggggcacagggctcctcatgcaggggtggagtaggggaggggaggatgggggcacagggttcctcatgcaggggtggagcgggggaggggaggataggggcacagggttcctcatgcaggggtggaatgggggaggggaggatgggggcacagggttcctcatgcatgggtggagtgggggagggaaggatgggggggcacagggttcctcatgcaggggtggagtgggggagggaagaatatgggggcacagggctccgcatgcaggggtggagtgggggaggggaggatgggggcacagggttcctcatgcatgggtggaatgggggagggaaggatggggagggcacagtgttcctcatgcagggctggagtgggggaggggaggatggagaaagcggggaggggtaggccacatctttcatgcagggtgttggaggctgggcgggctgtgaggtggctttgaggatgagagagtgggtgtccctgccaggtgtggcacccagaaaggccttgacaagcctgtggagggaatgaaataggctcctgggccttcgggatgaggtaaagtgcagtcggtgaagggcacagggaggcctgcccgggcccaggagacctcgtaggcgaggagcctgtgacccagggcctggagccacggggagcagttcatcgggcaggaatgaggggagggctcaccaggaggggcgctggaggagccagggccgggagccaagagagggagagttctttgggtagccctgactgcaggggagagggcaccaacccttgtggggagagaggcaaggctggagagggaggggtcttcagggtgggattggtgagggactggggacaggcaggagacaggacctctgcgggggtgtttgctttttatttgatttcccaagtaatgcatgattgtgatgggaggatcagagactgcagagtataaataaaagaaggaaataaagagcactactcagaaataaacccattaacacttgctgtgtggccttgggcaagttacttcacctctctgtgcctccattttcttgtttattaagtggaataattaatagtacctgcctcataaggttgttgtgaagcttaagtgagataacacaacaaatttaaagcagtgccacacacagtaggtattagctgtcatcattattcatatcatcattaccattttggtgggttaggagcttagatgctagaattggaatgctggtgttctgaattcaacattttcttttttttttttcccccttgagacgaagtcttgctctgtcatccaggctggagtgcagttgcgtgatctcagctcaccgcaatatccgcctcctgggttcaagcaattctcctgcctcaacctcctaagtagctgggattacaggtgcccgccaccacacccggctaatttttgtatttttggtagagattgggtttcaccatgttgtccaggctggtctcgaactgacctcgtgatctgcccgcctcagcctcccaaagcgctgggattataggcgtgagccaccgcgcctggcccaaatccaccattttctagctctgtagtttgaggcaagtgaatgcatcttgctggacctcagttcccccatctgtaataagaagatcataaaattcctcacagtgttttgcaaagatttgacaggttaactcacacagggtaagttgttaacttccagaattttcattccatgtgtatttttcctcattgtggctaaagtggccgatccaatactcattcctctccctctttcttaccaatgagatccttctattttgggggggcaagtaccctactaagagactacagtttccagcttctcttgcagctagggatgaccagtgagattaaatagaagctgtaggtgggacttctgggaaagctctttaaagggggttgactcggctgtgaggcacattcccttttgtgttccttctctgccacctcccagcccctgcttctttctacttcctgcctggaactcagatgtgatggccagagctccaggggccatcctgaatcatgaggcaaactctgaagcatggaagccacatgctgaggatggtgaatccgaaagacaaaaggcactggggttcttgatggtggtagaacagccgcaccagtctttacctgctttgctctgggcttgtttacatgagagaaagaaatctctgcttactgaggtctctgtcgtttgggcttcctgttactggcagctgagtctatttctaactgatatatttgccagaacggaatcaacctgtgtgagctctttcacgacctgcattttttcatcatgcaccagtgcttccttgttacggacactattgcacatgagcacagaaatgcacgctttgcttaggaaaaagaatttccatcagatgtggtggaaggatttctttttattcattttaattacagaagtaatgcacaaagacctcctgtcatgaaaatatcctgcctgtcctcaagtgtctctctctcatgactctgaaatttcagtgtgcctcagcccaggcttgaaccaagcccttgaaatggacagaaatttctctgctgacctcagtgagctccgcattttgtagccctagcctgcatatgtgatccactaagggactcctccgtttggaaacagagatggtcaggtcctgctgcagctcacagagcctgttggcagctgcgctgggaccagatgccccatgccaccctgaataacccttctgacccatgctgcccgccaccacctgctccactgaggccttggcctgccagggctgggaggcacctttgccagccttcctggggccagcccagctgagatctctgggaggtgagtctggaggccagggagccgggccgggtgaacttttatttttatagctgtcatcagatccctgccctagccctggagccctggcagggacaggggtggccaaggaggaggaagactcctcagagaggctggtgggtgggagtcagcaggctgtggaggagagagaactggggtgggggtcagggcagcctggggcacctgactccagccaggcctcagtcctctcatgccacatggcaccagtcatcaagctcgcctggctgaccctcttgtggggtggtgagggacaaagggacaacagggaccctttcctgcttttattcttgcaggtcagatgcagagctaattatgctttccagttcttaggacacgattgtcatcagtccttgcaaagcctgcattgcgctttagtctattttcccgtgcatcacatttttttctctttctttcttagtgaaatatacacacacagcaatgtgcacataacacagatatacagctctgtgaattttcctggtgttgacccaccagtgtccagatcaagaagagatcattccagcacccctgaagccttttgtgtcccttctagccacccctcttccacacctaagggtaatcattattctgatttctaacagcaaacattaattttgcctgtttctatgcttttatagaaatgaaatcacacaatagatgctgtttatgtctggcttcttttattaagtattgtaactaacattcattcaagttgttgtgtgtatcagtatttatgcctttttattactgagcaaaatgacattacatggacacaccacaatggatttacccattcgatccctcatggacattcaggttgttaccagttttgagctctttagaattgggctgagatgaatatttgagggatcatgtcttttttttttttttttttttttcttgagacagacttgtgctgtctcccaggctggagtgcagtggtgcaatattggctcactgcagcctctgtctcccaggttcaagtgattctcgtgctcagcctcccgagtagctgggattacaggtgcccaccaccacacctggctaattttttgtaattttagtagagatgggcttccaccatgtttgccaggctggtctcgaactcctgacttcaggtgatccactcgccttggcctttcaaactgctgggattacaggcgtgagccaccgcacccagcgaggggacatgtcttttgatgaacatattcacatatttcacttagaagtggcttgctaagccatcagaaatctaaaaatatatgttttaattcctgttaatggtattgaaacttagctctcattctgttttttacttttttactgtgtatttttaaaaaactttttagtttgagaaacgtctcaaattggttctcttgaattatttgagaataaattgctgacctgttgccctatcaccccttaatgttttgatacatagtttctacaaaccagggcattttcctagatagctacaatataaccatcataatcaggaaattaacaggatacaccatgactgtctaccaagacccattcaggtttcaccagttgccctgataacatccagtaagggaatccagtttgggatcatactttgtgtttatttttaattttattttattttgagacagggtctcactctgtcacccaggctggagtacagtggtgtgatcatagctcactgcagccccaactacctgggctcaagcgatcctcccacttcagcctcctgagtagctagaactacaggcatgtgccaccctgcctggcaaatttttgtattttttgtagacacagggtttcactatgttgcccaggctggtctggaactcctgggctcaagcaattctcccaccctggcctcccagagtgttgggattacaggcatgagccaccgcgcccggccacatgttttgtttagttccacatctctctagttgccttgaaggtagaacagttccttagtctttccttgaccttcatgaccttgacacttttgaggatacagggcagctgttgtacagcattacagcatgtctttccctgtgggtttgtctgatgcttcattgtggtgagattcaggttctgcagctctggcagaaaaatcaaagaagcgatgttatgttcttctcctcgtcccattgctgatggtgcactctttgatgacttgattgaggagatagctgccagacttcgcatctgtagggttactttccccgctctttgtagttaatcagcatttgagaggaggcacgctgaaactgtgtgaatttcttgaatgtcatcagactttcaattattcatttatttctgtcagtatagattcatagttttctattttattcagtgggttgtggtatatcatcatcattgttaacttatttatatgcttaaattgtcccagatttggctcctgggagccacttttaactagcttctgtgtcaccatcattctttgagcattttcttactttctggcacagtgaggtactataagctcatctggtattttttctgcccccagctctggaatcagccacttctcccaggagccctggttccttttagtagagaatggaatttagaagccaaaatctcaggacaaagtgctcattgctgttggggtgtctccactgcctgactctctcagtggacagagttaaggactgtatatatgtatatatagagacacatatttacagctgtgttatttctgtatctaactattatctgtctatcatctatcatctatttagaaaaatgagtgtacactgataactgcagttcccattcagcatcacagagtttattctaattttctctttccatatttgaaactctcttttccatcagtgagaaaataggcttccattattcttaatatatttgtttatttgacccatcccctatatgtaaccagtttgctgtcactgtccccccacctctgttccatgattggtcaccctccttaccctgttcagtctctggccccacactatgccacccttcttatggatggcctcagatcaacttcaccatggcctctatacatttttcctttcaatttgaatacataatatgtgctcattgttcaaaattcaaaaggtgtgaatggatttgcaatgaaaagtctgtctccctcccactcctgcccccacattcccagatccctctcccagaggttactgaagtttccagcagctttttcttatttcaaatggtctatgtgagtgcacccaaacacacacacacacacacacgatatttatgcacactgtagcacattttttacactgacctgtgctttgcttttctcactcaacaatgtatcttggagcttgttcatatcagtactatagagctgccacattccttttaatggttgtataatattccattggatggatgtaccataattatttaaccagtctctttctgatggacatttagattgtttccagtctttttctatttcacacaatgctgcaacagacaattctatccaataggtcacattttacatgagtgcagcatatattcctggaagaataggcttgagagatgcctccaggttgctctgtgtccctctgattcattactttttatgctgatgcataacattcctctgtatgtatctgccacattttaaggaaccactgcccttgtggtggacaatgattttgcctctaagtccccacagccataaacactgttctgacaagcattgttgaatgtacctctgtcacagggcaggttgtgtggatactgaaatggagtttggagtgcaagatgtttgtgggggtcaacacctgagaaatggagggggtgcaagaaggactgggcagatgaagtcatccagcagcgatgcaggcctgcagagccctgagcagtcttgggagcaccggagaggaacttgcttgttgggtgccctgtgttgggcaaaatggccagacctttacaccctgccttggtctgtctggctttcgggctgccctgggaaggatggctggggcgagatggctctctgcagctgggacagctgttggtggctggagttcatcacctcatcatactccctgcagctggttctcccctgaaggagacctaggtggtacatctttgtgtttatcagccccctaatggtcttctcagagtgcctctggtgtatttacccaggagcgggattgcagagtcttaatgtcactaatagggccagatatccctggtctcagccaccccacaaggatcagagatctgcatttttgaggtagtgagattgtgatcatggaatgaactgaggctgactctctaaggccccctgccctatgccgggccgttcctcctcatcgtccctcgttccttcgtgatctccctatagggctcatgagttggatggatgtgagtctaaatctcagctttgtcacttagatgtttgacctggagttagtgacctcttcttcctgagcctcagtttcctcatctatgcaataggtcttgtcacatccttgacttttgtgcattgtgggtcttggtgaaaagtaagccctcagtacatgacagaccatatatcaggaacacagcatcacttctgctgtatccctgcaaatatatatcagacacggagaccgaatctaatcacgggaaacatccgagagatctgaagtgaggagcactttgggaggccaaggtgggtggatcacaaggataagagatagagacctggccaacatggtgaaaccatctctactaaaaatacaaaaattagccaggcatggtggcctgcacctatagtcccagctacttgggaggctgaggcaggagaattgcttgaacccgggaggcggaggttgcagtgagctgagcctagattgcaccacagcactccagcctggcaacagagcgagattccgtctcaaaaaaaaaaaaaaaaaaaaaaatagctggcctgcatcctcgaacatgtcaaggtcatgtgggtcaaggagagactgagaaaggaactgtttcaggccaaaagagcctatatacaactaaaggaagctacatgcgtgcgatcttgggacatgatagggtccccatcacattagggccccaggtctttgtgtttctaaggctggagctcgagctacctcaggctcaggatgggggacacttccccttaagcaatgagaaggagagaggctgacttggagagaacagggagtcagggagcttgggctggattgttattccccaagaagagttgcaactggactttcgcttcagtaatgtttaaaagaaaaatgctaatctagatagggactgccattcattcattcattcattcatttatattcctcttaacaacttgtgactttgggcatgtggcttaacttctcggttcctcagtttcctgtttacaaaataatgatggtaataatagtacctatctcacaagatgtggagaggattaatggagatgataggtgcaaagtgcttagaatactgcctggcatatagtaaatgctcaataaatatcaattatcatcacaaggaatttactccacaattcatttactgagaatgtgcaacatgccagagttagttgtcactctccacctggaactagaaccacggaaaaccttagatcccataaaaccagagcctagcaaagatgacaggatcttagtgtgtcactaccctgcccatcagtctggctgccaatgatggtttaagatcccacgccccctacaatttgagcccaaggcctcctcctgacagccatgtgaatgccccacgcctcagttccccagatgttgtgacagcctcaaacactctccaacggcactgatttgaacccttgtaaacgcagaaaaaaacaagtcttaggcggcaaaaccccatttgtgcaatgtggactcccttcctcaagtcctgggtgatgctgaagggtctgaatctgccttttctttcccgcctgttgggccctggtagaaagtagcagctgggccagggttggtggctcacgcctgtaatcccagcactttgagaggccaaggcaggtggatcactggaggtcaggagtttgagaccagactggccaacatggcaaaaccccgtctctactaaaaatacaaaaattagctgggtgtggaggcacgcacctgtaatcccagctacttgggaggctgaggcaggagaatgggttgaacccaggaggcggaggtcgcatgagccgagatcacgccactgcactccagcctgggtgacagagcaagactctgtcccaaaaaaagaaaagaaacttcaggatatccttcagctatattgtttatatttttccccactttgtcttttcccccatttgtatttttttcttttgcctgaattatttgagaggcagctgtagacatgacatcactttatccccaaaccctccaggcatgagccaccatgcccagcccatgcacactatagattaatgttaaaagcattatgctgagggaaagaagccagacacaaaagacgactttctgtgtgattcctctgatatgaagttcaagaacaggtaagatgaatctagaaggcacaaaagtggttccttctgtggggtagaggagtcattgcctgcagtgggacatgaggaagacttctgggatctgcaaaattcctatgttttaccccaggtggtagttccatgaatttatccatatataagaattcaggccaggcatagtggctcacacctgtaaccccagcactttgggaggccgaggtgggaggatcacttgagcccaggagttccagaccagcctgggcaatgtagggagacacagtctctacaaaaaataaataatattagctagatatggtggtatacacctgtagtcccagttactcaggaggctgaggtgggaggatcgcttgaacccaggaagtcaaggctgtagtgagccatggttgtggcactgcactccagcctgagtgacagagcaagaccctgtctcaacaacaacaacaacaacaacaacaacaaagaagagttcattgagctgtctgtttatgcgctttactgtacatatgttaaacgccagcatcaaagtagaaacctaaaatcaatgaactcatgctgcacattgaacataggagagtcaggtgggcagggagtagggattggggtgaaagggaataaatgaatacaactagagggcagcctgtgtgggcaatcatgataacatgttgcgaattgaggcatcagataacgtcaccctgcacacctgaggttcaaaaagaaaagccaaaaaagacccaggagctcagagggggagtgtaccttgtctgaggtcacacagctggtgggtggcagaggcaggatttgaacctgggtctgaggaaccccagagtgtgctccttacccagtgctctggcctggactctccgggctggacagctctgctgtgctcccagaggtccctagggtctggcaggggatggcgaaatgactgcttggcaaagaccattgcagctcagagctcacagctccaagtcgggaggggagtcagtggagcaaagggtggctcccatccctggagccttccctccctggcctagggtggctctgccaccctccgtccacctcccgccggcctttgccttccttcctgggccagcgtgtggactctggagccctgcagggttgggtgtgaatcccagttcttcttctttctggctctgcaacctggggtgagtggcctactttgtacctccgtttccactttcagagcctgcctatgacagcatttacttaatagcattggtgagcagagtcgaggagtcaaaagtgtgcagaactcaacaccatgccggcatgtgctaattgtccaataatggcagctgctattgctgttgttgatgttattgctccttgggagaggggagcccctgttgctctaaggccttacaaacaccaacatgtgaaaacagctggcatggaatggaaagttctagagaaaggagctttctgactgcctgaaggttatcagaaaactttctatgctggtttttgtgaaagctcttggtaagctagggtagaaccagggtggcttcatgggagtaccatctaggcaattccacagagccccttgtttggaagggcccccacttggtttacaggtctgctgttgtcatcttgaaattctctctctcttcttttttttagatagagtcttgctctgttgtccaggctggagtgcagtggtgtgatcatgactcactgcagcctcaacctcccaagctcaagtgatcctcccgcctcagcctcctgattatctgggattacatgcacatgccaccatgcccgggtaatttttatttatttttatttttattttttgagacagagtctcactctgttgcccgggctggagtgcagtggcgccatctctgctcactgcaacctctgcctcctgggctcaagcgattctcttgcctcctgaatagctgggatttcagacacccatcaccacgcctggctaattttatacatatatatatatatatatatatatatatatatatatatatatatattttttttttttttttttttttgtttttttttgagacagagtctcactctgtcaccaggctggagtgcagtggcaagatctcggctcactgcaaactccacctcccaggttctaagtgattctcctgcctcagcctcctgagtagctgggactacaggtgagtgccaccatgcccagctaatttttgtatttttagtagagacagggtttcaccgtattggccaggatggtcttgatctcttgaccttatgatccacccgccttgtcctcccaaagtgctgggattacaggcgtgagccaccatgcctggccaatttttatatctttagtatagatggggtttcaccatgttggccaggctgcgtcttgaactcctgacgtcaaataatctgcccacctcggcctcccagagtgttgggttacaggcatgagccactgtgcgcagcaatttttatttttatttatttatttattttgagacggagttttgttcttgcccaggctggagtgcaatggcacggtcttggctcactgcaacctccgcctcctgggttcaagtgattctcctgtcttagcctcccaagtagctgggattacaggcgcctgccaccacgcctggctaattttttatacttttagtagagacggggtttcaccatgttggccaggctgacctcgaactcctgacctcaggcagtccgcccgcctcagcttcccaaagctcaggggttggaggcatgagccactgcccccagccctggtaatttttaaaattttattttttgtagatattggagtagggaggagtctctctatgttgctctggttggtcttaaactcttgggctcaaacaaccctcctgccttactctcccacagtgttggtattacaagcatgagctgccgcacctggccttgaaattcttaatgatttgtgaacgagggccctgcatcttgatgtggccagtcctggctgtactgtggcatccggcatggtcacctagtactttcacctgagttgtctcctgagtgctcaggaacactctttgagggcagttgtcctcatcgttaacctcactgacctcagtttccttacctgggaaacgggaggaagtgcattgtgccaggccacagagaaacaatgggtgaaccttggtcttctggccctcagattctatcagtgggaaacttgggcaagtaagggctaggcatgcctacgtgtgtgcccctggagcacagaggaggttctcagtagctacaacttgctctttgattccctggctggcctctctttttgccctaaattttttttattaaaaaaattttttaagacacaaggagacagggcattagaggaaagagctaatacatccaacccaggtgatgggttgatgggtgcagcaaaccaccatggcacatgtttacctatgtaacaaacctgcacatcctgctcatgtaccccggaacttaataaataaataaataaataaataaagagactgagtcttgctatgttgcccaggctggagtacagtggcacaatcatagctctttgcagcctcaaacccctgggctcaagtgatcctcctgcttgatcccaaagtgctgggattataggcgtgaaccaccgtggctggctgtctttttgcctttttactaagaaattttgatttaaattgataatagtaatacaggtatccattctcttaacacatgataacatttccaatcaagctgaagtcagttctggaccatctggccagggctggctccttttcactctgtcagcgtggttttataattttggggtttgaacttccagatctttgtgtatgcatttctttcatctctgtgtgaatgtggcttttccttccttcctttctttctgttatatcttttaaaatgtgaacttttacagaagtctaagcagggtacagaagatacatttttaccacctgaacacaccagtgtgagcagcacttggataaaaaagcagaactttttttttttttttgagacagggtctcactctgtcactgtagactggagtgcagtggcgagatctcggctcaccacaacctctgtctcgcaggctcaagcgattctcctgcctcagccccctgagtagctgggattacaggtgtgcaccactactgcccggctaatttttgtatttttagtagagacagggtttcaccatgttggccaggctggtcttgaactcctaacttcagatgatccacctgccttggcctcccaaagtgctggtattacaggtgtgaactaccacacctggcctgaaacagaacaaacatttttaatcactgaaaaatgtttctgtctaggacaactgctctcctgacttctaacagattacattgttttgcctgttctacaacttcatatcaatggaatcattcagagtatttgcttttgtgtctggcttcttttgctcagttaaacttttaaagttcctctatgcagtactgtacagcttcattctcactactgtgttgtgttccactgtccactgtgtgactataccatagtccagtctactgttggtagacagttgggttatttcaaggttttggttgttgtgaataaagctgccatggacattcttctttgtgtcttttttctttttcttttttttattttattttacgagttgggatcctgctttgttgccaaggctggagtgcattggtgctatcacagctcactgcagccttgaactcctgggctcaagtgatcctctcatctcagcctcccgagtagctgggatcatggctatgagccactgcacccagctcttgtttgtgtcatttggtggatgccagctcttgtttctatcaagtttatacccgaggcatcatcactggacacatcattcacgtgtgttgagtttctgcatatttccaaacagtttccaaagcatttcgctactgctgtcctccatatttctggcccatctcgctccttttttttttttttttttttttttcagatggagtcttactctgttgctcaggctggagtgaggtggcaccatctcagctcactgcaacctccgcctcctgggttcaagcgattctcctgcctcagccttctgagtacctgggactacaggtgtgtgtcaccacacccggctaatttttttgttgttgtatttttagaagagatggggttttgccaggtatccgggctggtctcgaactcctgacttcaagtgatctgcctgcctcagcctcccaaagtgctgggattacaggcgtaagccaccatgcctggccccatcccttgattctgagtacacctggagaggtcagtctttttaatatgagctatttggccatgtgtgtagtaatatctcattgtggtttcatttgcatttccggatgatcgttctttttaatgccttggcgacctcacaccagccatctcaatgggacttgttcctgtccttccgtgatgttcttgagagccgtccacatggtgcgtttgccagtttcctcctttggaaggtggcaaggtcttcccacttgataaggacgtctcctgtgactttgcctctgccccatatttctagtccatctctttccttgactctgagacctttctgtaagcggggactccatgatgttcacacacttggtgcccggtaaataaacagctagtaaatggactgacggaagcaaaggggaagaaaaacaaaaaaaaccctcctcccccaaaccccaatttggttaattgaggggttccactggggtgatttttggtcaattggagtttgcttgtgaaaccggtaagagcatggacaatcaaccataaggtagcaacacgcactgagcccagcactttccagagaattatcacactgtggatgtcacaaggatgttgggagggtctagctggccggtgggatcagctacccctcaggcctccgatattttcctgaggttccacaaccgggaagtggctgggtaaggttcctagacccagggcctctgatcctacttgccacgatgtttccatcttgttctgtgctgtgtctgcaactcacagcctggcacacaaaagactctcaaagatgtgctccaggaatgactttgatgagcacacaccacacaccaggtgctgtgctaagcccggggatacagaagagaataaggcggccccaagccccaccttcatggcgggtccattattggggtgggggatacaggtggtccgatgatgagtgctagggaggaaaataaagaaggggagggagaggagagtgtgtgtgtgtttgtgtgtgtgcatgcaagagggagagaatcagagagagagtgcgtgagtgtgaggaagagaaggatgtttcacttaaccacagaggtcagggaatgcctggctgagggaaggtgctattgggtggggtggggcgggggagccatgaggtctctggggaaagagggaatggcatggcaagtgcaaaggctctgagatgggaccatgctgtctatgttcaagggaccgcaaggaggccagtaggggaggtgccattgtgagtgatggggagagaagtaggatgggagctgggaggtggtgtgtgtgtgtggcaggggtgggtggggttctgagcagggcggggatatgcctgacttcttcctcctagggttacagggtgggtgatgtcggccaaggggaggagagaacaaaatgaagcagttggtggaaagtatgcagcctgtggtctggtacacagtaagcactcaataagtagcagagtatgtgtgggttttggatgagtgaccgctaagctttttttttgacacagggccttgctatgtcacttaggctggagtgcagaggcacaatcatagcacattgaagcctctacctcctgggctcaagtgatcgatcctcctgccttgaccttccgaagtgctgggattacagatatgagccaccacacctggctggagtgacctgctaagttttaatgggattcctggtgggttgggtgatacctgaggggacctgcctacttgggactcgccccatggagggctcagtgacctcagatgagctggaggtggggaggtggtgggcaggcgaatgggaggaggaactggttgggggcaggcacacagtgtcccgactgggagggcaggcctttccgggctccccaccagctcccctcaatctctgtgtgtggtccacaggcaggacccccatttgggctctgtttatgtgtgattacaatctgtggtctgtctctcccataggtgctaagttccctggacaggaacccatctgttgtatgggtggctgtgtcctcagctcttagaatggcactgggcacatagcaggtgctcagtgactactggatggagggtgaagggtgggtgattttgtctacgagcagagagatgggtagacggatggatggttggatggctgggtggtgatgtgagcagcactgagatggaggagagatggatgggtgggtaggtgggtgggtggaaaattgggtgggtggatagataaatggaccagtagctgacaggagcctggaccagggtggggtagaattcagtagaaaacttctggcccaagagttagaagatgggggttcgagtccagtcttgctactgagtaataacaaggtctgtggaaacctggacttgttctattgttgctctttgcctctgcttccccattattggtttttcaacttcattattccttttattgtattggatagatccccttttattcaatccctggatgtttctgaagcctcactgcaagaacagagtgaaagggagctgcagaggagatggggggcagggcccagccctgggcagcccccgggagtcctgcaagccaggggcacagcttgaacacttagcctgactgttcaccattttgccacagcttcctcctctgagtctttcctctccagggttcctccagtgaagcctctgcttccagtggtttggagcagtcccagaaatctgcactgttaacaagcctgcctcatcgttctgaacttatttctggttaagattcaccgacaccttctaggactgctggatcctatagttcagcagcaccatgtgagtgcgtgtgtgcatgtgtgtgagcacgtttgcatgcatgtaggggacatggggtgggtggatggttgcaaggacactttctgtgtttaatgtgagattttatgtattaaaacaagactggaaacaactgcagtgttcatgagtggggccggttaagtgccatgaggccagtccgctccactccttgggggatcctgcaggcattacaaataagggaaaaggttctgataagacacgatctccaagacatccttacatgaaacagcaggtgcaaacggtgcctattgtttcaccacttgtgttaaaacatacatgcaagaagagaagtgtgggtattcgtggacaattctggaagaacacacaagaatctgagaccagggtggtccctggggagggaaactggggggctgggggtgggagggagaatgatggcattttctgaatccctgccggagtcctaggttcaaattctgcctgtgatcagcagcgtggctacccctaagccggtggtgagcactctttgagcctggtttccccgtgtgtaaatggggctgtgtttgcagtgtggggctgggctggcgtgcagggcccagacactctgctcctgttttggcttctgtttcccaggaggctcctggtcaggcctcaccttctagcagccccacttggcccagggagggtgggtccccggggagggggtggcccggtccagggtggggctgagctggaaaaaccggcaggttgggagcagtctgtgcaggcaccatcttcactccccagcctggaggctgtggggacactcactcccaccccacgcccctgggaggctgggaccagagagagagagagagagaaagagaaagagacaggtaacgagggcgatacagagaaagggagagacaagaaaggaaagagacagagggagacattcagaagcagagattcaggctgagagagacaaagattcagagtcaggaggaagggggcagtggagctcgggtgggggtgggggcaaggttgcctctggccaggtgcctgggactggacgaggcatgggggcactggggggtggggtggggatgtccatgcacccactgaccatgggacaggggtgcagggagctggagcccccccatcaggacatctcccacacctctgagctccagctgcaggtctgagtgctcctgggaatcctccggggcctctcacttcttgcccctccaggcctccctggggatgtgaacctggcagctgcctctccagggggccctcccagagcagagctgggagggtctaaagtgcagtcgagctaattagtgttaggcaccgagataatcgcagcttggaatgttccttaggaggtcctggttggggcaggcagcctgggggccatgagggtgcctgggattggcccagtaggtctgctggctcctagaaccctgagtattggagtgggagatttaggaagcctggatctttgggtcttagggcttgcagtctctcagtcctctccaggccatcctgtgtagcagccaaagtgacccactggactccattctgaccatgtccaccccagcccctgcctgaagccttcagtggctccccatggcccttaaactgaaatccacctgcctctcctcagcctaggggaggctggtgatgagctcttgatcctgcctcatcactctgacttatttctatttctggaacattccatacttggcccacctcagaacctttgcatatgctgtgtcccccagcatgccccctcatccaagagctctcaggcctcagctatacatcacctcactggggaggcccctgattcctggcttgcctggtctccctggatgcaccacgtagctcccaccccctgcttcccagggctcagcgctctctgttctcatagtggcattcctcattcaatgtctgcttcctccacccatggagtggcagctccatgagggcagactccgggtctgcttagtcaccgtggtgtcccctaggacctgacatgcagcaggtactccaccagtgagctactgaccaccaaggaagtggactggacatttcttgcagtgtggactccttctacgttatgaagggaccctactgagccctgggcttcccctgtgcccctcccactgccccagccccagccccagccccataagctcctgcgtcttgagactccaccaggtggccctggctgtgatgtcgcaaggaatcactggccagaatctggttgagattatctcctggctgggcatggcccacgtctccacgcagggctgggaccacaggccgccgcctcagggtccctaagtgtcccactgtgcctcttgtcttcagctgcagataacagcattggtccaaggtggccttgcctcagctgcaagtgcccgtgctagggacgcgctaggtggcctcagggaagtccttgtctctctctgggtctccaggtcacacagagtagggtcccaccccacatgggaaagcaaaaaactgggtagaaatggggtctctggttgggagaccttggaggaaaaataacagtgcttctcaagggggggtgaagtgagaaagtggttggtgacacatgaggggatccccacgtgtccccagctggggggcacagacagtccagggtgactgacctgccccaagttccctgaatgcctgaggtttaccagtgtcctggggcccaatgaggcaggtgtggaagtgtcctcgtagcatggtggaaagagttggcaagtgaggccttgagccgtttctagggcactgatcccatggtgcctcagtttccttcttgtgaagcaggtacaataagagtttctacttcacggggatactgtcctgagctcacagaaggcaattgatcactgccactattattgcctcctaaagtcttgtctcaccctgtctccacctctctgtgcctcctgccccacctggcctgggtgattaacccgagtgagtgcagcagcctccgactgctctcctgctcttagtctcagccctacatctattctccacatgctgccagacagagtctaagaaacacgggctggctgagcgcagtggctcatgcctgtaatcccaacacttcgggaggctgaggcaggcagatcacctgaggccaggagttcgagaccagcctggccaagatggtgaaaccccatctctattaaaactacaagaattagatgggtgtgatggcacacgcctgtaatcccagctacttgggaggctgaggcatgagaattgcttgaacccaggaggcagaggttgcagtgagccgagattgtgccactgcactccagcctgggggacagagcgagaacttatctaaacaaacaaacaaacaaaaaaacatgagctgggtcacgctcctcccctgctccacagcctccagggctcctactgccttcagaataaagattggcctccttatccagacccacaggtgctgcacagtggcggccccctcccctgatctctggccactctcactgtcacttgccctgctagagccaccttggttttctttccattgcacccagctcccacctgccacagggccttggcacactttgctttctctactggaacactttcgtttctcctcttcacctagttaatgccagatctcagatcaggtggacctctggtagcaggtgctgtggggattccccagagcctctttggtgggatctgcatgcatcttcctgctgccacacagtgttggctgctgtgggctcccagctggggccccttaaagctggagtcctgcctcgctgagcaggagctgcctcccatcccccaaacagaggtggacacagccagtgaccaatgagaccaggactcaggcctcttactttgaggtgggaggagtgtggtggtgcaattcacgttccagagctccccgggggatcaggccaagtgagactcagcggaggccatatcctggcttagctcccaccttgccctgtcctgcttctcgcacccttctcccaaaagcatgtcctcagtgaatcacgtgcatgccagtccccaagtcaggctcctcttctgggcaacctgacctaagatgccttccctgccctccctgtccccctttctggtctcttctccatggatctctccttgcagccctgactatggctgtgtttttacacttgcttggatgattatttgattgaaatctgtcccccaccccagaatgtaaggcagggatcatgttccttctgtgttcccagcgcccatcgtgggcttggcacatagtaggtgctcaatccatatttgttgaatgactgaatgaatcatagctgggtgagtcagagctgggcactatcaaggccccagtttcttcctatctcatggttctgccgtctccactcagcccagctcctcatggtgccacgatggctgccaaagctcctgccatctcttcctcatacagccaagcaggaaaggccctcacatgtcctgttaagaatgaagaaaccattcccagaagccccttggcagacttccccatctcactggccacagatgcattccatgtccagcctctgccaattgctgcaagtggggaaggggacctaatcagcatctgtgcctcgaatgtcgtgggtggagtccacccacacccactgagcggggatctggctgcctacgagcgcagacccctgaacttgggtcattttgactattcctagggctgtgggtcccccacctgtccttcctccctggggagcccttgggtggtggaggtgagaagggggcggtgctgggtgagggtttcaagcaaatgaggcggccagacaccttcacctcagtaaacatttacagagccaggaatgcagaggaggtggtgagcccagcagatgagtgtgtggggaagacaccacctaggccagaggtacagatagtgagacagggagacatgggggtgagatggagagacacagagagacaccctgaaagaactgatgtgagagacacagagggaaagagagaggctgagaaataaagaggggagagacccagagacagaggctttgccgggcaagcttttgcatcaggcctggagcaggcagaggccctcttccagtgggcgtggtgaccgcacctcgttctctttggctgaaagtcccaggcaagccccttttccagactgggccttggatcctcctgtgtcaaatggagctgtgtccacacactgggcctaacatggacctgtggcctcctgtgacccagaaacagccttgtgtggtggaagggaattgtcacccccagtggaagggggaggcagtgcccaggggcatggcgagagggtggaagggggatctggaccacggagtgcatgtttctaaagcctgtgtcctgtctgtgccccacagggccagtgtggggccaggaggggtgagggtggggcatgggggtacccttaggggtggtgctggccgccagctctgtgtgccagtgacgagtgttctggtcataagaatggctgctgggtttgaatgctccccaggtgccaggcaccaaccccaccagggtggtgctgcttaatttctatttagtttggacttcccatttacaaacgaggaaactacatctcagcgtggcagcgacttcctaacaacggggtgtaggctttggggtcggaaaggtctgggtccgagtccccgctccatccctgacaggctgggggacctaggcagtcatttcctcctcctaagcatcagtttccccatttgtaaagtggggaaataagtttaagggtgacatggggatcggatgaggtgctgccagagggttcttagcacagggccgggtacacaggaagcactggatgaacgttaaccgggccattggatacaagcttttaagtaatttaaaataattcctttaatggctctccttattttttttattttttttttaagggaaagagctgaggtccagggaggggaagggacttgcccaaagtcattggccaggtggagggtctgaggtttgaaccctgtgggccctgaggccctctataccacccacgatggctcaggcctggatggcctgtttgcgactcaatcctcatgggttgagaagatgcccatagcctggcctgatagccctctggcctgacatcagctacaaccaccagttggggcagttgcaaaatccctcaccctttgcctgtcgataaagggtgcccattgcaaaactcagcggagaaattattaagggttgtgtcatcctgtggccaggccctgggtgcctctttcctgcccggaagcctgggtagggccgactgctcactctctccctccatggccctgacccgagagagaatggggtgggggtcagcagggagcttgcagggaatgcggacgacagaccccagcactggggccgtcatagtccctgattcttaggaaatggcagctccatccttctgggtgctcaggcccaaacctcgggttgtcccttcatttcctctcttgccctgcattcgataactggccaggaaatcctgtcagcgccacctttaaaacatccagaacctgcgtaggttttcccctccgcttccacagctgaattcaaggccaccattctctctcctgcagtagcctccttgctgctttcactgctgtcatcgtcacgccccacttcccccgtgcagccaaagggatgctgttagaaccccactcagatcccatctttcctctgtttagaaccttccttggctccagctgcagagcaaaacctgaggtctttcccaggatcacagggccctgtctgatctggcccccatggcctttctgacctcatcctccctcctttcttacttgctcactcactccagccacaccgggccccttgctattcctccaacacactgggcatgacctaactagggcctttgcacttgctgttcctgctgcctggaatgcagttccttcagctctttcccccagctggatgtgccactttattcagatctcatcgcaatgtcacctcctcagggaagccttccccggctacctgctgaactgtcacctccaccatcactccagccctttcatctttcttccctacttgccatcatgttatacatctgttatttgtttggtcaatgcctgtctatctctttagtatgtcaccttccacactgcagggactgctgtctgtggtgatcacgatgctttctgagcactcagcacagggccccgcacacagtaggggctccacagagatttgttcaatcagtgaatgggcgcgcaggaggggtggctgttggcccagatgatgcttcagcaaacatcacaagtgtcctttctctggctgatggctcgaggctggtgcccagaacaggctgctgtggagacggcttccctgaccaccctgtcaagtagctccgactgcccaacccacacccatgctctccagtcccctcgccccacacttcccacagtctcaacttgttttgcttctgtatttttcatgggcccctcctcccccgagaatggagctctctgagaacagggtgtcctctgttggccccactgtcatccccctgagtgtccagtgcaggacccggcaccccatgggaagtgtttcatggcaggttgatcagggtttgcatcggatgccccatctgccgggctagttctggctgggagggtgttaggaggagatgctgtgctcggacctgcgaagtcacgggggagatggggacccacttgggccttaattataacacatcccataatgatatggtgttataatacgcacacaaagtgtcctaatctgatattatatctgggttttgtacaatagatacaatcggctggctgcagtttgctaattcattctcgacctatctccacgctccacctagatgactatcggcttccttaattaagtggaaggcaagctctgcaggcgatgcttgcagtcccagcaccgacgagtccggcctggccctcccataagctgggataatagctactcccacatggggcgaggctggttctgccttcttcatcccaacctcctgtcccagtcttgggcgtgacaggcctgctccaaggcctggtaagccacaaacgccaaccaccaagggctcaaaccggcggcctgtgggccgggccggcctcgagatgtgttgggtttggcctgcatggtgcttttgctgcaagttaaaatgagttgccaactatgaaaaatcagaatgtcgtacacaaacatccagattcccggcttctcttgggaaatgggaagatgcagggactcgggttcatagtcctgggtgctggggctggggagtggctgtcccctctagacaggacatgaccacagttgtctcctgccagtttcacttttatgtccctgcccgatcttgtaggcagttgagtttgcaatccctgctctgggctttaacaatcagttaccccttggcaagatgggacagtgaggctcagaagaggcaagtgacaatggtcattgcacagcgagctggaactcaggtcacaatcattcaacaggtctttattgagctcccactgtgtactaagccctggagacaaagaccacaacagatatagttcttgccttctggggggtgacagtctgttgttccacaggcataccatccacccttattgctggaggcaataggatctgttagagacaggtcctttatgatccctcagagtaggtggaagcagattccccatagcttctgggccccatccaggccagagaatggactctgaaaggtgcaaggggagtggaagcagccatcttggaaggaagctcttggcaagtgttcttactagagggggatgtccctaatctcctacctgggctcccagagagcaggaaggatgagcaaggtgggctcagaggggtcgcaggtgggggtggtgggggacaggaggggaacagagaaggcacagtggcatcagctagacagagcatggggactttcccatcctggttgaaccaagggtgaatcaattaggtccttctaagacaagaagtggagggcaagatgctgaaatacccaagctgcccacctactagtccaggagaaagggctttgctcagccagtctgggaggaagtgtttgtcctcttgcctcccactccactgcaccacccctggcccggaggagaaagtgcagcctggaacctctgtccccagtgcctcaatgctggacccagcttgggccattgcagaccagctggccttccaggagccacatctgaagagcatcaagcagcccacatgctccgtggccagctccccactgacgcggggggatgaataacagtcccagccatcatgtgcatttgctaaaaataaactgacatactttttgcattgggaaacaatgtggattccaaacattctcaaagggcagagaggggaaaaaaggaagaatggaaatcaagttttcgagcttagcaattaattagtgcctgtaaacaaatgactcatgatctttcctgactatttttctttccattttgcgtggattttcgcagggactcagggaagaatgccaaatgagccaagctgataggcaagacaggacccagatgggactgtcttgagggggcgttgtccagttggagagtgtgaggaagagcatcaggtggaagaacaacatgtgcgatggctatgaggactaaaagatcttggcatgtccaaggaacactgaggaggcccatgtggctggagtagaatgggtgaaggggtgaggtcagatagatccacgggacttggaacatacagacccttagtggtgtattaaggcatttatatttgatctagaagacagtgggagccatgagagggttttaaaccaggaaagaacatcatctgatttatataatggtgtcatgtaaaaaacagatgatcaggccagacacagtggctcacacttgtaatcccagcattttgggaagccgaggtgggtggatcacctgggtcatgagttcaagaccagcctggccaacatagcgaaaccctgtctctactaaaaatacaaaaattagctgggcatggtggcaggcacctgtaatcccagctactcaggaggctgaggcaggagaatcacttgcaccccggaggtggaggttgcagtgagtggagatcgtgccattgcactccagcctgggcaacagaacaagattctgtctcaaaaaaaaaaaaatcagaaaaatatattctacatgttctctgttgtttagatgcttctgatacttagatttcctcaacaaatgattatctaattgttatgtttcttaggggtttacacatgtaatgtttgtttcctctccttagaacatcagccctatgataacagggaccttgtcggtcttgtttacttctgtgtcctcagtgcctagaccactgctttgcacacagtaggagctcagcaagggcttttcaagagaatgaacactctgtgcaatgtcagaggcctcattccaccttacagggcagggaggtcttccaaggccagtctggatggtccccaggagaggcaggttttatttagttcaaaataagaagaagttttatggctggaacatcgattctgcaaggaattgaaccccctggtaatggggtcattccagctgggcccatgctatcagtcccacaatggccctctctgatttaagacagtctctgtgctgctcatagagtccactcaaagatctatgaggttggcatgtggctatgcccattgtgcagacagagaaactgaggccagggagtggtgacatgctcaaggtcacatggttacaagtggaagagcctggcttggaatccaggtctgactataaagtctgtgtttttaactccttctctgagccattgacatgggttccaatgcctgctccaccacttagatgccgtgtgacctggggcaagtcactttgctttctgagcctcagtgttttgctccatttaatgggaatgcggccccttgcctctcagggctgctgggggtggcagggaggtctgagccggcacacagatgttcgaatcacgtgcatccctcttccctgccaagctccttcctgggtccttctgccactggcccccgtcctgggctgccgaccccgccttaggccagaagctccttggagtccaccctccagttctccccccgcccactgggtgttgagtcactcatgccatgagcttcttgccctctgcctgtgttttcttcctccttttcttggtaaaaccactgccttttctgattgctaaagctcctcctagggagcaggtgggtggcaggggagaccccaccatcccacagaaccgtctccaccgcttccccatccctcccactctcaccacgccaggctgaggtcactgagcacgaggcctggatggcagacatggtcaaggttgggggtttaattaatcatcagggagcaggcagggctctggctggtccagggccccttgtctgggtataggctggtgggtagactaggggaggtcaaagtaaatattctgggaatgacgttgcttgcagcccatggcaaacacaaacatggaaaagcctatggggatgtgcagtaatggggatggggtggcagaggcggggatggggtggcagagacagggatgagtcttgagaggcttcatggaggaggtgtgtctggagccaggtttgtagatgggagatgaaggacatgggtgctggggccagctaccctgggcttgaatctcagctctgcacctttcccactgtgtgaacttggtcaggttcatgtccctctctgaacctcagtttcctcattttgaaaatggagatgattggctgggcatggtggctcacgcctgtaatcccagcactttggaaggctgaggtggccagatcacctgaggccaggagttcgagaccagcctggccaatatggtgaaaccccatctctactaaatacaaaaattagctgggcatggtggtacacacctgtagtcccagcttctcgggtggctgaggcacaagaatcacttgaacccaggaggcagaggttgcagtgagccgagatcacgccactgcagtccagcctgggtgacagactaagactctgtctcaaaaaaaaaaaaaaaaaaagaaaagaaaatggagatgataatatttacatccccctcacagggtgtggtgatgactgagagatgatgcagatgaagtatatagagcagggccaggcatatagctggtgcacaatacatgctagctattttcattcttactagtggcatagtagaaagcactggaattttagcttcagacagacctgggtgtacatttcagtgttctgcatctccctgttcttgagcaagctcctcgcctgtttgagcctcagtgttctcacctggacttggagatggtttcacttcatgaggtttgtggtgaggatgaggcatgaaattcctgtagattgctcagcacagtgctgggcacacggtaggcactcgctaaggagtggttggcatccactggtctatggcccagtggttaaggcaagggtttgtatatcaggcagacctgggtctgagtcctggctctgcccccatgggctgccgtgaggattatatagagctctagatgtaaagtacccagtttggttcctggtacctaacaggtgtgtggacagtgggaataaaatcaggatctttgtgactctgaagaccagtgttaggccaccccgacatcctgggtgggaaggtgactttcttccattgaaaggtggggaaggctctggccctttcacggtaaggaaacagtttcagagaggcgacatcactagcctaggtgggcacctgggtctgcttgtccgtagagcttgtctttccaaaaggggaaatctctgggttgagggtgtcccatggggccccttgagtgtcactgtgcatgctgctggaacagcctttttttttaagagggtcttactctgtcacccaggctggagtgcagtggcgcaaccacagctcactgcctcctcaacttcctgggctcaagtgatcctcccacctcagcctcccgagtagcttgggacgacaagactgcatcatccgcctggctaatttttaatttaattttttgtagagacagggtcttgctatgctgcctgggctggtctcgatcagtgatcctcctgcctcggcctcccacagtgctgggattacaggcgtgagcctccacaccctgcctggaacacccttttagtggttaatgaaagcaggtgacacataccgtgaagaaggcaactcttggcatgaggttctgggacccagcagtgttcagggcccgccaccccagactggggaccagggcatggctttgtatgtatgggaggtggcttggggtcttggggttggggcagaccccaagaggcctggcctgggcctttttccctctatccaaccagccccacagcactctgtccaattgtttatttcttgttactgttgggcgttttgaggcatttcttccaactgtccagaatccgaacctccttcctatgtgtggagaattttctgctgtatgaggcagatgttctgtctcccacaaaggaggctgtgaacatgagcctcagattctgccccctgtggccagagcatggacaattagctcggccatctaggtgcactgtcctgggcccctggggagtccattcagggtccatccagaggcttcatttatgcacgtcacgtccttctcctgctcagaatcctcccatagctccccattgtcctcaggatagacttcaactcctgcccgtgtcccgcaagatttgacgtgatggagctccactgaccgcccctcctctccctttcacccctccaaccacaggaacctccctcagctaaagtcaatatgccgagctggtacctgcttcagggcctgtacgtttgttgtttcttctgttactatatctcatttcacaggtgaggaaatggggctggaggaggggagaaggaaacagggcgtggtggaaggagaactccaactgaggttgggctggccttggcctgggcctcagccttgtggtaatcacaatccacgccagagactgcctcctccaggaagtcaaaacagatcctttttgtagacggatccctctccttgcctctgctcagcctgacttaggcattctctcgggcatttgggtgtgtgtgtgtggaggtgacattgcccccacaggggtggaaattaattcttatggggtaaaaaacatcttaatttttttatgtataaagcgaagataggccgggtgcggtggctcatgcctgtaatcccagcactttgggaggccgaggcaggtggatcatttgaggtcaggagttcaagaccagcctggccagcatggtgaaaccctgtctctactaaaaatacaaaaattagctgggtgtggtggcaggtgcctgtaatcccagctactcgggaggctgaggcaggagaatcgcttgaactcaggaggcggaggttgcagtgagcagaggtggctccactgcactccagcctgggtgacagagcgagactccatctcaaaaataaataaataaataaataaaaataaactcaccttaacttgatttgaatccacgcaatacctcaactgaattcaactcaacagaactccactcattgtgtttagttgaactcgactcagcttaatgtgtctccactcaaccctcctttgctcagtttgacacaacccagctcatcagcacgactgacatcagccctgcgcccctccactcagcagagcgcagttcaggtgaaaactcacctctacctgactcaactcaacccaactaactctgcttaactcacctcacctccgctcagctcagctgacctcagttcacctcagtttacttcagctcagcgccactcactgcaatcccacccacctcagctcagctcaagtcaatcctgctctgttgaatgctcagctcagctccacccagctcctcaacacacctcatctcaacttttacaagtttttttttttttttttttttgagatggagtttcgctcttgttgcccaggctgaagggcaatggctcgatctaggctcactgcaacctccgcctcccaggttcaagtgattctcctgcctcagcctcccgagtagctgggattacaggcatgtgccaccacgcccggctaattttgtatttttagtagagacagggtttctccatgttagtcaggctggtctcgaactcccagcctcaggtgatctgtccaccttgggctcccaaagtgttgggattacaggcgtgagccaacgcacctggccaagtttttatttatttgttacctttttagagatagggtcttgctctgtcacccaggttggagtacaatggcaagaacatagctcactgcagcctcgacttcccgggctcaaggaatcctcttgcctcagcttcttgagtagctgggactacaggtacatgccaccatgcctggttaattttcaaattttatttgttgtagggatagggtctcactatgttgtccaggctggtctcaaactcctagcctcaagtgattctcctgccttggcctcctcccacagtgctgggattacaggcttgagccactgcacctggctaaagtcagtttaagttaagtgtattcactcgactcacctcaactctctcgactcacagtagacccccactgtgattgccacctgccttccccagacagcctccaagccttgcagagaaggagttagcctccaggtgttcccagtttagctggggaccctgacatgtcctttcagctggtgctgtcatatgggaaacacagggcaccgcatgagcagtctgtggcagccccagaaagccccagatggttccccacagaaggaagagtcagcgcaggcagaacagtgggaggaagggtgtcctgggcagagggaacagcacgtgcaaagtggccgaggcagggtggatggaaccctctgagacccagaggttgctccagctggagggaggagtggagaatgaggatggtgtaagtgtggccgggggacaggcacaatcccccagggaggacctggcctggacagggggagacactgcagtactgagcagagaagtgtcattttaaacaccttcctggctgctgggggacgcatagagctcagaggtgagactggacttattgtgtagggacagagccgagaaatccagcgctagggggctggtggggagcagacaggtggggagcttaaggagagagtttaggaaattaaccataaaaatgaccagaaattgagcacttattctggtccagtccttgtttccttaccttacaggtatcaatgaatttaatcctcacaacgattccatgaggtaggtattattatcaaccctattttgtagatgaggaaactgaggcccagagaggccaagacatcctaaggagcggaactgggacctgaacacaggctttggtgctccagaggcctcaggagcagccggacatcttatgcaaaatgcccatggcaggtgcctcctggaggccggcccctgccccccagcacacagtaggtgctcagggccttctttctctgtttgtgggatttaaatcatcatcaccacttgagttgggagtgcccgtccactattcaaagggagaaactgaggcccaaggaaggatttgagacacgggtaggaacatattctacagacaggcaggtggtatcactggggtcttcttcagccattgggaattttttttttttttttttttggagaaagagtctcgctctgttgcccaggctagagtgcagtggtatgatctcggctcactgcaacctccgcctcctgggttcaagtgattctcctgtctcagcctcccgagtagctgggactacaggcacacacccccgtgtctggctaatttttgtatttttagtagaggcagggtttcgccatgttggccaggctggtctcaagctcctggcctcaagtgatccacccacctgggcctcccagagtgctgggcagtggcagggttacaggtgtgggccactgtgcctggccatcattgggattttgattcaacgtgtgtgcattgaacggccctgtgtgctgctgtggggagaggatcccaccttcgtccctccaatgctgagaattctcccgtggctgccctccgtcccgaggatgcaatctgggctcctcactgtgccccaagaagctctgctggatctgccccagcctcccctgcctccctggcctcacctcccatgactctgccttcttgcccctgcaccagcctcctccagcagcagtctcccaccccaggacctttgcacgtgctgtccctctgcctggaacactctcctcatgacagccccatctcctccatgggtcctcaactctaaagttgcctcacttcctcagtgtggcccccccgagcacctgaactgaagccccccagttcttatgtatcacatcacctcattgttttgcttttatttttcaatgttctgcttccttgctggaattttcctgtctatttcctgcctcctgcaggggacagagctactgtaggcaggatccctgtgggtcttgttccctgctgtatcccacagcccagcacacagtaggtgcttaataaacattcgtgggatgaatgaatgaatgaatgagtgaaggaatggatggaaagagcttaaaaatgtaggtgtggagaggaggactggcaggcctgggcccaggctggggctgaggcctcctctcctgggtctccctgcccggaggaggggcccctgccagggcaggagggtgggtgttgggggcagggagcagggctgggcgagccttctctgttccactgttttcatcctttcggtaattatgggctcagacactcctcgatgccttcccagaataatagccgggcctgttatcagtggcatctctgggaccttctcacaaacagtcattaatcaagtctcactgccaccctgccctccctcttggttgaagccgaggcacagagaggtaaggccattttcctagtgccacacagctgacgcagggaggatgggctgttttgccctgaaccctaaggtgcagggtaggggctccttctccctgttccacgtgggagaagtctctgagcctgccatgactggggggccctgcccccaatttcaggcccccagccctccttgaggcctcaggggcctcccaaggtggcctcttaatcattgccagttaattaaggaggttaagcagctccccggggccgaggcaggcctgcccagggagagaggtggcagggcccggactgcatctcacactgaggcccctgcttcccagcctgagtctggcatgggcgttgtgtctctgtggtgcccatcaccggacctgggggtctctgggggaggcgtggggcctccgatggggccatagagttccattgcttgggcagtgccccctccccttcttcgggggtgtgtgggaggtgctggcatcacttaatgaggcctccgcggctgccaaggagagctggaggagttgaaacaggttctgggtggggtgagtttcgtgggctgggcagaatccatggctccatgccatgtgggcgctccccagggcagtgggggtgggcaggtgtgggacccccaaatggcccctgtgtccagccctctgccctgatgggtgggagcagaggaagcttgggaggggattgtggagatgacagaggatgacagacaggaatggaggttcacatcccaccctcctaggccccccactgcccagcctgtggggaccacaccaagacccaccatgctggcagcatctggggctccggagacattgctaatgtgtgctctgacacagacttgggcctcggtcttctgacctgagaaataggggtggttggatgggataatcttgggctcggagctttagtttcggaatgacccatctatagcagagctgcctgacttgctgtgcgaccttaggcaagtcgctttcttcctctgggcctgtgcagctccggctgtgaccccgtggtggtggggtggacgcagtgatccttatctccgctgaggttgccagtgcttcgcaaggggcacctagactgctttctccaggattcttccagcaaggaaatcattcagtgcatctctcccggccctggggaagcaccgaggctctggattcaggccagggaggtttagaaggaagctccccaaggccaggctgtgggtcctggggtctggagggcagcccttctgtgttactgaatcctcggggccacttcaggctcaggtgaggctggatcaaggcgggacccagagcccatgggggccccgtgggttctttgtctttcccactgttttttcaggtcacttttatggatatataatttatatacagcacgattcaccctttcgtggtgtgcagttctatgaatcttgagaaacgtatacagttgtataaccagcaccatcaagatacacaatattccatcacagcaaaaagttccttggtgcctcctttgttatcaatccctttcctactcccagcctctggcaactaccgatctcccccaactttttattttgaaaaatttcagacttggagaaaaatgccaaaacttcacaatgggccaccaagtgtcccttcccccagaatccccgactgcgaacacctggccccatgtgcattcttggtcttcctctgtgtgatttttgctgagctgtttgagagtaagttgcagacatccttacccttcaccctaattacttcagcgtgtgcctccgaaggacaagagtgttctcccacgtaaccatagtgccaagatcactcctgagaaatttagcattgattcaattacattacctagtctccaggccatgttcaaatgacttggactgctccaaagtgccctttataaccatttttcatctgttttttttctttatttttcctggtaccaagggttaggccctgcctttggtggcacatctctttagtgtccttttatctgggacatggaacattctcccggctcttgcttgactccttttttttttttttttttttgagacggagtctcgctctgttgcccaggctggagtgcagtggtgcgatcccggctcactgcattgcttgactttttttaaaaaccactctcatggtttcctataccaggaactgccaggggaattccctggggatgtgagtgccaggaaacgggggctgctgacttgggggacatgggatgttcttagggttttttctgaaaagtcttgtttaaaagtaaagtggcagtagaaggagagagagacttgggttcattggctcaacttttaagaatgctgaaaattcaaagcaaaaagagacactacccaatttgcaattgagaggcatctctagtcctgtggttgaggttcaaatcccagctctgcctccccttggctgtgagcccttggtcaggtaacttcacttctagagcctctgtttcctcatctgtgcgatgaggataatagcagtctgtccaccttgccctgttgttgtcaggaaatgaatcaatgcatttagtgcgtgaatagtagcaacttcatttgctaatttgctgatagtatttttagacatttctctctatagttacagatatatgtgggatatacttacagagacagctcatggatatatgtgaatcatgcattatataaattaggccatcttcttttctctcaatactttatcacaagcattttcctatatccacaaatggagcacttgcgcatcgtgtataactttaactcattttgtccatagataataccatgtggcaccaaataccaaaggtacaacaagcgtgcagtgaaaagccagtctccctcttacatttgtcttcaccctctcagctcctcactgtgacagtcttttgtgttgcttttcagaagggttctgtgaacatgtgggcaaaagcatgtatttgctttgctttcttacagatatcagaggactctacacactagttctgtgccttgtgattttcagcaacagtagatcttgatgatatcagtacgtagagagcaccctcctttttcaaggctgtgtggcgttccatggtggacacagagcaggatgtaaacagccagttccttagtgatggtggcttgcaggcttttgccatgacaaattgcaactgtgttcttgtgcaagtatatccatagggtacatcctagaagtggaattgctgcatcaacggggatcacgaggtcaggagatcgagaccatcctgggtaacacagttaaaccccatctctactaaaaatacaaaaaaagaaaaaaattagccaggcttggtggtgggtgcctgtaatcccagctacttgggaggctgaggcaggagaatggtgtgaactcgggaggcggagcttgcagtaagctaagatggcgccactgcactccagcctgggcgacagagtgagactccttctaaaaaaaaagttatatatattttgaattttgacccaccatcatttttattttatttatgattattattatttttgagaccgggtgtcactctgttgcccaggctggaatgctgtggcacaatcttggctcactgcaacctctgcctcctgggctcaagccatcttcctacctcagcttcccgagtagctggactacaggtgtgagccatcacgcccagccaatttttgtattttttgtagagatggggttttgccatgttgcccaggctggtcttgaactcctgagctcatgcaatctgcccacctcggcctcccaaagtgctgggattacaggcgtgagccactgtgccggctgccaccatcatttgtaatagctgcacagatcctagtgtatttaacagtaccctactggtggacatttaggtggttccaacttgcccttcctataaacaatgccacaatgcacatctttgtgcagccgcctttgtgtgcaggacagtcagcttatggggaattcccgggatcaacaggaagtaccaagaaggggaaactgaaccgcaggggccagcatgaccccaaggcctgtgggtatggatggtggctggactggttggatgggtatggatggtggctggactggctagaggcttctgggctctccctgtccccggtgtggccaaagggtcctagagtactggactcctctagatcctcactgctcaaggtgtggcctgggagccacagcattgaccctacctgggagtctattagaaatgcagggtctgggtcccccctaccccaaaaccctgttaaatcaggaccaacattttctttctttcttttttgagacgggctctccctctgctgcccaggctggagtgcagtggcgtgatctctgctcaccgcaacctctgcctcctggttcaagcaactctcctgcctcagcctcccgagtaactgagattacacgtgcacgtcaccatccctggctaatttttgtatttttagtagagacaggtttcgccatgttggccaggctggtctcaaactcctgatctcaagtgatccacctgcctcagcctcccaaccaaagtgctgggattacaggcatgagccacagcgcccagcctaggatggacatttttacaagtctgcaagggattcaccagcacagctgaaaatgagaagagctgccctaaaacaaacctagacactccaagactggagagaatggctcagccttgggtctggggcgggcctgaggtcacacctggcttcaccgcctgctggctgtgtgatggaatgcaagccggccaacctctctgtgcctcggttttctcatctttaaaacaaggaatgagaggatccctcctctcacagggaggttgtgagaatcaagcatgatcgttcacagaaaagcgtttagcacagtgtccgcacttagcaaatgctcacccaaccctgtgattttgatggttatggaggctcacgttacggaaggcgatgcgggagtcagatctgtctgagttttggtttctgctctctccatctctgtcactgtcactctccccgtgtctctccagccctgttgtctcttcatatccgcttatttctctctgttccgccaccgcccgcttcctctgtctcggtctccttcttcctgtctctcagggtctttgtcctcatttccacctggccataggagctttgcaagcatctgtgaaaatgctaaacatcgggaaaaatggagctaactacaatgataaaagtgcaaactaaaaattaacaatactagaaaagcaaaactatactattataaaaactcaaaaacagtaacaaaaattatgtttttggtaggtcgtggggcttttccagcccatttgatgggtagtggcttggagctgcagggctgcggggccctgctgggggttgcctctctttcctgttttttttttttttttttttgagacagcgtatcattctgtcacccaggctggagtgcaatagcgcaatctctactcactgcaacctctgactcccaggttcaagcgattctcctgcctcagcctcccgagtagctggtactacaggcctgcaccaccacaccagctaatttttgtatttttagtggagatggggtttcaccatgttggccaggctggtctcgaactcctgacctcaagtgatctacccgccttggcctaccaaagtgctgggattacaggcgtgagccaccacgcccagcctctttcctgtttctttggaccccttgcagccttgaacctaaacagagctgagtgattcagtggagatctggcctcagctggtcactgatccccttctctgtcctttcctcactgcatggccctgggaaggcacagccactgatctatgttcttccaactcatttactaagtgcctacaacaccaggccctgggacacaacaccgaacaagatagacacaatctccgccttttggtgcttatgttctaggacggtgtgcatgtgacagatgatatggatatgagtgaataaacatgcggaacaattgtatggtgctaagttgtggttgtgtgatagagaaaggcgtggggctgctttgcactggggatgagggtggggatctgggaggatgactctggccgaatttagagactagaatgatgagaaggagctgggcctgggaatagctggaagaaggacattccaggcagagggaactgcaagtgcaaaggctctgaggcagggacaaacttgggggtcagtcatgattgggagatcttggaggaggaaaagatctcaagagaaagacagtctttctttgctgagtgtctcaagcaagttacttgccctctctaagccttagtttccccctgtgtaaaatgggaatgttaaagacacaatcccaagagatgagtgagttttaaatccagtggtgggccagaatttctatactggagggtcttaggggatggttgggctatggggtgatttgtcttgaatttgtgggcttagcagcactactctttttacttggtttacttgggcggctttggggggtgatgatggagattatttgtggttgcaagtgatgccccaatttccccatggccgagcccctgatttcaggagttaatagcctacagcactcggcacagtgcctggcacagagcaagtagacaggaatggggagggcattccaggtgggaggaaaggcgtggagatgggaatgtttaaggcgtgttaggggaagagtgaggagaccagcctggctggtggggacgggtgagtgagaggctggaaagacgggttgaggaccaggatgagacctcgaatggcatgcaaaggagggtggccacagcccggaggcaggaggaagccactgtgagctctggagcaggagaagccgtggaaataggctttgtttctggtttgattctcaatatttttaatgttttactattcaaaaaaatttaaaggataagaacagaagtttccacgcagctatcactcaactgcctggaaacttatgttcttctgtgttcttttcttccttaaaaggaaccaccccaatataggggatccccccatatccctgcccagaaggatctctcttagaagtcactgcaacctgtgagctgagattgcaccaccgcactccagtctgggcgacggagcaagactccgtctcaaaaaacaaaacaaaacaaaacaaaaaacaaaaaataaacaacaaaaaaaccagtcactgcaacctggatttgatgctcgtgatttccctgtgtgtctttatccttctcttgttggtttgatgaaggtatccacctggtttgatggaggtgtaaatgcacacagtaaaacacacagatctttttttttttttttttgagacggagtctcgtcctgtcgcccaggatagagtgcagtggcacgattttggctcattgcaacctctgcctcccaggttcaagcgattctcctgcctcagcctcctgagtacctgggactacaggcccgtgccaccacgcctggctatttttttgtatttttagtagagaaggggtttcactgtgttagccaggatggtctccatctcctgacctcgaaatgcacaaatcttaattgtagtttgatggtcatgggatcacaccagatcaagatgtagaacattcctagcctccaggggctcccttcaaaggtaactactggtctgattcctattacgatagattggttttgcctattcttgaacttcatataagtgagcccattcagtctgtgctcttttgtatcaggcactttcacttaaactcatccaatgaggtctatccaagttttgtgtctgttttcacggctgtggagtattccattgtctaactagaccacagtttgttgaatcaccctatggtcaacagagatgggggttgtttccagtttccactattttgaatagtgctgctgtgaaccttctcttacacatccgacagtagacataagcaggcatttcccttagtctatatccaggaatggaattgctagatgatgagatatgcacatgcttggtttttgtagctatggccagtttcccaaagcagttgtaggacatctttagacttttacacacacacacacacacacacacacacacacacacacacacacagacacacagacacacgtggaatccctgagggattcggggagctgctttgggttgtgggtgggattgtacagatggcgtcccttgtacatttgcttctgcatcctgctttttttccacccgatgttctgttctggagttccgtccccgttggcggagtggcttgggtgcatctattggttgtccctgtgggctttgtcgtggggacagaccacagtgctcttcctcaggcttctgctcctggacatttagcttattcccgactgggactctctttttggcttttcatgaatatccgttatgcgttgggtgaggccagctaggactggccgaggtgcagggtggacattgggtctatcgtggtgggagatggggacgaggggctggtggcacagatggtttcaagggacttttagggaacttggttatggtgggggaagaaagaaacaagacgggggccttgggggccagaagcccaggtttaaatccctggtcccccctcctagctgtgtgaccttgggcatgtgactttgcggcttggagcctcagttacctcatctgtaatttgggaacatcaaccctgcctgataagacggttgtgagggttgagtgagcacagacattcagtggacctggctaggatttgaacccctttattaactgattgacctcgggcaagttgcttcacctgaacctcagtttcctcatctgtaaaatggggatgataataatacctgcctcccagcaattttatgatgatgaaatgagatttcggacataaagcacttactagatgctcaatacctggcggtctcttgttattattactattgcggttgacttctctgcctttccctccagaaggtgggtggctaaacagcaggaattggtcttttgtccccaccttcctcctgtggctcccacacaggacagaggtgagggtcatctgcatccagggtgtagacctcgagtgagccctgcccggctgggagcctcagttctctcctgtaacaggggctcatggcagtgcctacctgaccaggtggcttcccaaggggcacacgatcttgttggggagaagagctggtcaggagggacctgtggacgggagacattttccgagcaatgttgtggctgatgccatctgggggtcctcccagagatgggcgggggatgttgggctgagcccctgaggaaggaagacatggcgtgggagtgtaagaagggagaagaggaatgattccagccctgctgacctcctgaggggaggtttcagctgcagggatgccagagccgcttgctgcagcggggacactcaggccacagcgagaggaaggctggagtcctgggttcccaacttgccgctgatgtccttgtgctgtgtgaccctgggtgcctgtcactcttaccctgtgccttggccttcgttcattgtgagaatctcagacttgctctctcttctgctgggtttcccggcccccgcagaccccctggcctggcccctctgccctcatggaggccgaggccagggcccagggccagggctgcgcaccttgacaacgcgcccacgccgggcacaaaggcccattgttcgggcccacgttggcggggaagcgggcggggagcagccgcctttcacccaacccgcttgtggtcggcggggactgaggagcgattcacagaggcccccgccccctgtccgggcatccagccaggatgcctcccaggcaggcacccttgccaagctgggcctgtgctacccagaactgggcctcagtttccccagctgagaaaagggaagcagagcagctctgatagtggggtagagcttgctgtttggcctcattgccctgagatccactgctctgtgccttccccaggcacagatcagctgcccctgacatgccagaggaggccacgggatctggggctttggggcctgacaagtctgggtttggattcatgctggatgattttgggtgagtctgttcagctcatgagcctttgttctcccgcctgtaaaagggggcttggagtccatgatcctcagaggtaaaatgagagaaatgacacctcagggcggcattcattcattcattcattcattcattcattcattcattccaaaaggtgtactggctgtcaactctgtacaggaccagctatagaatgttcagtgtcgtgtgcaaaattaaacgtgatggtccttgttcaaaattaagaatttcaagaggtaacggcattaatccaagcatggggccctgtgtgaaggcatgcgttgcaggtctgtgaggctcactctgcctgtgtgccagccgttatcccaggcaccaggaccaggcactgggccccactaatgagagagggaaaaatttctgttgtcatggagctcataacctggcagggggacctagagtccctgaaccttcccaaggccaggtgccccaggaggcctgctcctcctgggcctgctgaccaggccagcggggtgagcggaggcacccaagcttccttcgaggctccgatgtcagtgaccaccacatctggctgggcacccacaataataatggcttacatttgcataagactctgcccgggctgatccaggaccctttctcggatgaactcagcatcttcgtggcaaccctatgaggaaggcgaggcagcatggctcaccctttgtatggatggagaaactgaggctcaggctcactggaccattcagccagcaaatggcagaggcaggatttgaacccaggctgtctggtgccagggtcttcatttcctcattccatcctctgtggatggggacagcggtgagcgaggtggtttatgctggcaacagaggccctgctggggattgaggctgggaagggtgcgggtgtgctggtggcccgccagctgccacctgggttggccctgctgtgtggccctgagtcacagcgctgtgtcctgggaagctggttgtgctccgggcacccgtggggcctgagtcacagcagagcacaccctaccttcctgcctacctcccacctgggcccagggacaggcaggccctctgagcaggttcttaggcaggcagtcacatctctgcccaacgtcaggggcaagaaagaggcacctgtgtgtggctccagaagcacattcctgcttcctgtcactgagcccaaatccatccttccaagctaccctttggatggattagctggcaggtaaagtactgagctccccgtcactgggagcattcaaagcaggatagcctgtcaggggtgctgagaagtgttcctgaatcaggtagggcctgctgctggagtatgtgaattccaatgccctaaacatgtgcttatgtgctaatttttgaatagctatggtgagcaaatgctacaaaatccaaaagtagaaaggggtatggaatgaaaggcaattcctcactctctcctttccccagcctctgactccccctccttagaggcagccactgttaacctgctattttggccagagttaatttatgtacatacaaacaaatatctatgttgtccttgcctccctcccacccttccacacaaatggtagccaatatgtttcttacagtgttctgctcctcatttttttttttttttaattatttgacaacttatcctggagactgttctagatcagcacacagagctgcctcattcttcttacctagccacatggtattctggccccttcccttttaaaatctataactgatttgattaaaggaattttcaaccctgaattctacatattgggatctgcactgtcctttgctctggtggtggcctgagaacattttcaaaatttggctggagactataagctctttccacatccgtggggatttttgtgttctgtttttagttgactaaggcgagggcagcttttcattcacagctctccacgccaggcaggcactggtaatccactggtgagccccacgggcatcagctcatctgccgacagtgtggccaggctgtgggaggagtatgtggtggcagggagcccagaagaaagggcttcctgtgtttgtttaagtaaggggttagtgatggctcctcagaggtgggactatttgggcagggccttaagggatgcataggagttcctacgaggagaagtatggagatgggcttgccagacagaggaaactgcatgataagcgaaactgcctggtagatgcagaaactcctaccagcatccacttactgaacacctactaagtgccaggcactgtactacgtactttacaagtcattgctgcatttcaactcttgacagttgtaggctattactagtcccattttacagataggttagttgaggttagataggttagaaaagcccagtaacttgctcacagcaacacagctacaaatatcgaagcctgggtttgaacccaggcgacttgggctcttggccattctactatcccacaagggtcaaagggtagatggcgaggtcccgaatgctagatcttgacctttcaaccttcccagctcgggtcctgcccctgctcagaggcccttagttgttccccactactccaggactcatcggcctgagctgccctctccctccagccagggtgggcacctggggcagcatcagcctttctgggtctggctgggtgtgctgggtgctgcaggaggagccacacatggtactaatggagccagggagcaattaggggggcatataccctggcctgtgcccactgaccggttttggatgtagttggagatggaactggccctctaggctttgtcccctggaggcctagggactctgtcttcagggcagtgctggctgtcactttggcccagcccctctggcttcctggttgtgagcagcctctggacccagagaactgttctcccgtgtaccctgttgggcactgggcctggggctttttaaacctcatggattctgcaacgtgggaattcatccctccatttggcagatgaaaaaaagaaggttcagaaaggtgaaacgacttgttcaaggccacacagcgaggaaagggcagagccaggacaggaatccagaccctgagtttgactcataaccaccctccactcctgcctccgtgcaagaggattttccaacctgtctgctgcttggcaggggcttaatcaacctccctctctctctctctctcctggtcttcaggaaaggggcaatgagcccattgccacggggtacggcggagcttggatgctgcacccaggactgaaagggggacctgtgggcggcctctgcctctccccgcgcagcgtcaggacacaggcccacattccctcctggcttctccctgaagggagagagaataatagttggttcaaatgtcaggcctgctccgtgctggtggggagactggttgagcaggtccgcaggagggacggagggaggaaattattaataattgcaaagcaaccagccacactacaggccttgagttgtgtctgcgtttgtctttggaggtgtggagttgggggtgctgatcctggggacccagcccaggggtcaggacagcctggggaccagctgcagcttcccagaagcctgtgtgggtaggggagatgatgggggcacagagtcagccacctacccctggcaaggtgggacacatcccagcctccccatcttccactgactcagggaaggatctgtcaacatctaggggagggaggaaagagcctactacgtaccttcaggaagcttctcattaggtgatggatttaatcctcacaacaaccagatgaggttggccttgctattatctccagttggggaaactgaagcacagagggtctaagggtctaattgtacagatttgaatccaggaggtctgagtgcagctggatagtcctttgctgggatgggaggatccccattccctgggaacagccacacccattcccagaacatcaccacgatccctgctgccttcccttggaggacaggagttggtgtgaagcttctctgagcctcagttccctcatctatggaataggagccagagttcctccctccagggtcagaaggcagctagctgataaggggagcaggtaaggaggtgaagggtcggtttgctggctgctgcctccacctcccttccagaaccagtcaccagtgacagtcccttcatcaagaccctttctttcctcccttctccagcacccacggtgaggtctgaccaacagccgcaaccatagtggcgctttgctgagtcttccttgagctccctgtgtgcctaacgcagagcttctcccctccccggggctttggaaaatctgctctgaaatgtcttgtgagtgatcagtttacgcttcaacaggaaaatgagttgaatggtggaacttgaggcagggttttggggaatggacagtgggagttctgggagtctagagccagcctctgggcttggggttagcagggccgaggcatgcccagatcgcatgccatcaagccccaggaccagccgcatctgtggggtacctccagggcgtccccctccttggcctgccctgatgggctgataagacctagcctcggaggaggaggcagctgtaattacaggccttagtggtggcgggcaggcaagtcatgaggtgggggtgactcagacgattgctccacggacagggtggaggcgggggccacccatctgcccctcacccagctggcctgagatgggtctgggcacccagggagcggcccggccagggtcccatccttgggcctgtgacccaggcccctgtgccacttggcatccacgaagctggcattgcactggacttgggactggctgggttttcccctttcttcgtcccaggcaatagcttctgggaagtaggagtcagtgctcagaggcaccaatgggaggatcatcaggactggaccgagagagccgcagactcgggggagagtaccgggagtcccagaccacagaaagacagaacctcagccatgtgcagactctgagaaccagcagatgacggtttctagaaccaaatattttcaggttcaaggattcagggactagtagatctgtagaattatcgatttataagatcacggacctggttgcaattggttccagagaattcatatatccattgagatagagatttaaaaaaaaatcacagcagctgatgagttcaggagtaaattaccttggtgtcttcaacttgctcccacatggatcaggcaagaaaagcccccccaaaagtagaaatatgcatctttctcatttaacctagctagagggaaggcccgcagactgaagaattaacaactggtaaattgaggcaatcattgtactaatcatttgactgtctatgggcttaaaaattgtcaaaataaaaagccaggaaatagtaataaagaaaaggaaatgtgggtcaggcatggtggctcacgcctgtaattccagcactttaggaggctgaggcggtaggatcgcgtgagcccaggagattgagaccagcctgagcaatatattgagacctcgtttctatgggaagaaaaaaaaaagcaaaagaaaatgaaatgtgaataccaaccaggacattacaaattatgcaacttggtaatctataatattatgactttccaaatctatgcatctgttattctcttcattcactcattgtatattttatttatacacttttgcagagtacctacgtggtcacaaggagaaactgttctaaggctttacaaatgttaactcgtttaattcttatgacatttctaagggcattatgaatagtaactcattgaattcttacaactggatgaggtaggtgctgttatgatgcacgttttacagataaggaaactgaggcagtgagaggtggagtaacttgcttaaacggtgctcactgtgttattaagcctctactgtgtaccaggtgctgtgctagacagagcagtgaacaggacagactttgtccacaccctgggggaacttggcagaggagacagataataaacaagcatgattgtttataagttcaaagcggaaaataagcctgctgctttgatggaaggtgggggtatggggtccccaagattgagcgaacaggtgaggctcttctgaaaaggtggccttttgctgagacctgaagtacgaggagaaccctggatttgagagacatgactgtcatttgcctgggctgtgccctctgcctggactgccctcctgcttccggcttctctatgccaaccttgccttcactggtccaggtctggctgggcggcacctcctctggaggtgggaggtgaactgggggcttccccagccccagagggaatctgtcctccccctggtcttttctatcctcctggttcccagagcagaccttaaataagggaagcctccatgtgactcagcggcaccacctgtgccaggctctgtgctgggatctcacccaaccccgagtggggagcatagttttctcctggggaggagatagaggctcagagaggttaagagacttgcccaaggatgcacagctaacaagtgttcaaaggaaaatccacactcaggactacaggctgtcttttggtgactggtttacctgctcacctgcctgcctaccctgggcacctctcgagggcaggtcctgggtgctggagtcagttctgtgtaccagcatcgcccagccctgggtctggcctacatgggatgattttcccttcaccaggctgagagcatgagacatgaaggactaggccagggccctgggggctagctctaccccaaggggaaggtggacacgggcctgagcccctaggctcccagacagaccctgtgctggctcccgccctctgtcccccttcttccctggcccaaactggcatggtgccttccctggctctcttaggctgctctgcccagggctgagagggatgcaggggcccagatccctatccccagcagacaataacctctggggccactgagcagatggggaaactgagtctcagctgagtcaagcctgacacagtgggggtggggtcagggtccaggaatcttgtgggttcacaagcacaggcacagaggcgggaggcatgtgcacatggacacgcttgctgtgtacatgaggctgatgtgagccaatgaggacacaccattggtgcagatggcactgggaacacagccgcccacacacgcccatgtgcacacgtgtgcataaacaaccgtgagtgccttcctggtttaaatcccactctacttcttagtcttgctgagataccgcacttccctgggcctcagtgttcagatctaggaaatgggggcatagattgaagcctgggtaggctcgagcctggtttagccatcctggccccttttctgcatggggcccggggacctgccctggaggtttgaggagagggttcagtgcggtggtcttccccatgccgcagtggacattgggagcccccttggggcaaatggcctgtgtcactcaccactgggctggcccggactctgctccccaggctggttcctggcactgactggcataaggccaggctgcctgggtactcagctcccatgctggccacaggggctccaccaggcgttgggacagagaggtgtctagaaagttctgccttagacaaggggtgcctgtgtgcatgaggggcaggctccgctcagctcccctccccgtgactctcttgctgggggacttcgtagggtggaaggagcccaacaccagcgtccccaggctggattcaaggccagctccacgctctggggctctgaggcctgggagcctcggtcttctcatgtgcaaaatgaagagcatcaacccacctgccgcagggacaaaacaacagcatagtggctggcacacagtaggtgctcaacaaatgccagctgtctagctgcagactacggtcacagtttcattcattcatccactcattttgttatttatgtatttgagaccgggtcttgctctgtcatccaggctggagtgtagtggcgtgatcacggctcgttgcagcctcgacctcccaggctcaagcaatcctcccacacttagcctcccgagtagctgggattacaggcgtgtgccaacacacctggctaatttttcgcatacaaaatcccttctcgacgaaaaatactcctgggctcaagcgaactcctgggctcaagcgatccaccctccttggcctcccaaagtgctgggattacaggcatgagccagtgtgcttggccccatcattgatttaacctgtatttattgagaccctactatgtgtcaggccctgaggggagtgttgggatcacatcacagaacaaagcggacagaatccccgccttcccagagctgacagtctagtgggagagatgggcattgaatgagtaaacagcatcatttgagattgtggtaaaggaaatgaagcagagagctgggatgcggggtgaccagcaggacagccagggagggcctccaagaagcaggcatgacctaagagaagggtgctgggggtggatgagtggtaaaggtaagggccctgaggtgggaacaagctaggtgggtcaaagaacagtagggaggccaccgtggctggaatagggagagtgaaagggagagggctggagagaaggggagggagtggaccctgcggggcttcgaaggcaggagtgaggaatttgaatttcattccaagggtaattattatgaacaaagaccaaagttatgaatgactacgagacacaaaatgcaaactcactgtgattcacttccagcccagaacttgggcactttggatcaggaaacttaaagaaaagcacctgcacacacaacttctctgtggctagttttgtttatttcttgtagagatggggtctcactacattacccaggctggtctcgaactcctggactcaagcaatactcccactttagcctcaagtgctgggatgacagatgtgaaccactggccaggctatgacgttcattttagaaagaaatacaaaggtaacaggcctttgccatttgttgaatgtaaattcagagcgttacacacaaatgcgagtttgttagttgcaaaggcagtcacggtctctgacttcagtgctggttgtgagagtgaggtgagctggggagggggcatgatatcaccagcccggatttcaacagtgcaatgccaattggggaaggcttgggagatcagctggtccaccccactgactcccagatgaggaaactgaggtccagacgaggggaagtgagtggccaaaggtgacactgtgagtcagaggcagatgcgggacttgaacccaggtcccctgactcctaacccagactttctgagaaatgagtgtcttgccacgtgcttcccctttgccctttcctcctggacagtgtcagctgtccttggggccaggaaggagacatggaggccaggggtttctggtggaccccaccacagggcttctcatctgaggcaccgctgggatgttaagccggatggtgctttgaggtagaggctgccctgtgctaggccttcaggccatttttcagacaggatcgggacttggagaccagggcccagggatgccgcttgaggtgacagaactggaaaagatgaagggaagaaaggaatgtaacccacattgaataatgaagcctgacgctttaaccctacaatggccattgctggatgttgacgtaaacaataggtgtctacaggatgaattagccaaacgacaactccggtgtgagcagaacgggctcattgggtcaagacacaattccaccacagaacgggtttcacaaaggaccatgtcccatcaactcagcaatgaaaccatcgtggtctggaaacctgagatcaggacccacagaatgactggcggaatgacagaccaaatgtggaagatgttccaaccaggtgtgaaaaagtcattctgtgaattatgagagtgtgggaaaaacatactcactggaaaaaaaatccagttgttaagatagattgtttatttatttatttatttttatttttttgagacagagtctctctctgtttcccaggctggagtacggtggtgtgatcttagctcactgtaacctccgcctcctgggttcaagcaattctcctgcctcagcctctcgagtaggtaggactacaggcgcagtgccaccatgcctggctaatttttgtgtttttagtagagacggggttttgccatgttggccagactggtctcaaactcctgatctcaggtgatctacctgcctcagcctcccaaactgttgggattacaggcgtgagccactgcccccaaccaaaatagagtttatttatttattttttcttttgggatggagtctagctctgtcatccaggctggagtgcagtggcgtgatctcaactcactgcaacctctgcctcccaggttcaagtggttctcctgcctcagcctcccaagtagctgggattacaggcacaagccaccgcgcccggctaatttttgtattataagtagagatggggtttcaccattttgaccaggctggtctcgaactcctgacgtcaagtgatccacccgcctcagcctcccaaagtgttgggattacaggcatgagccaccgtgctcggccgatagactttatttttaagagaagttttaaatgtacagaataactgaaaagattgtaccttatgaccagtttctcctattattcatgtgtcacattaatttggtaggtttgttaccatttttaaattttaagtcttttgaggcagggtcttcctctgttgctgaggttggagtggcacaatcatagcgcaccgtagccttgagctcctgggctcgagtaatcttcccattttagcctcccaagtagctgaaactataggcatgggctgccatgctcagctgacttttgtatttttttttgtaaagacagggtcttgctatgttgtccaggctggtctcaaactcctggcttcaagggatcccaagtactgggatgacaggcatgagccactgcgctccacctttatgttataattaatgcaccagcgttgatacattgtcgtgagctagagtcccatagcttattccgactgccttaatctttccctaatgtccttcttctgtccccggagtccatctagggtatcacgtgacatttaattgtcatgtccctttaggcttctcttgtcataacaatttctcagacttcccttgtttttgatgaccttgacggttttgaggagttctggtcaggtattttgtaggatatccctctattggaatttgttttttttttgtatgaccacattagggttataggtttgggggaagaagatctcagaggtaaaatgtcattttatcacagcgtatcaagtgtacttactgttaatgtgacttccaactgttgctgttgacattgatcacctagcctgagtagtatttgtgaagtttctccaccatcaagttgctattttttcctttttccacactgtactctttggcaagacgctgctgtgtgcagcctgcgcctgaggtgtgaggagttatctcccctcctttccactggagcatctatgtaaattatttggaatttttctgcatgagagatttgcctcttcattcctatccatttattcaatattttatttatatcagtacagactcacggatatttactttatttatactttgggttataatccaaggttgctttatttattttcttgctcaaattctgctaactttggccattgggagctctttcaactggctcctgcccccttccacagacccctatcagtgtagttttcttgaagtcctttcatattttctggcactacaagttgttccacattcaacttatatatttcctgctgcagtcttagaatcagccatttctctaaagagtcctggttctttttattagagaacggtataagaaaccaagatctgggtgccgggtgtgctcatggctgctggggtatcatttcttttagcccttttcagctgatggagcaaagaaatatctgtgtgtatactaacctgtgtataaacacacagttatcaatatttccatgtgtaactagttatattcatgtttagctaaacatgagtttatattgatgtctccagaatccattatatgtgatgaatttaatcaattaatttttttttaaatatagggtcttgctttcttactcaggctggagtgcagtggcatgatcacagctcaccgcagcctccaactcctaggctcaagcaatcctcccacctcagcctcctgaatagctagtactacaggcaagcactaccacatctggctgattttaaaatatttttgtagtgatggagtctcactatgttgcccaggctggtctctaactcctcgcctcaagtgatctttctgccttggcctcccaaagtcctgggattacaagtgtgagccactatgcctatcctataatatgatttgaaatagtggtgcaacactaaattcataaccttatttattactacctgaacacttattatctgacaagtactttctaagtgctcaccacacatgatctcctttggactgcatgacagctctagacactggttctctgttcatccccattttacagatgaggaaatgcagacacagataagctatatatcttgcccaaagtttctcttctaataagtggtgaagtagaattcaaacccaggttcagtcgtgtcaaacattaaaatgtatctatatttcacattaaatagaattcatatacagctaagagaaaaaggtcaccttatggttgactggttgacgtagtattataatcacagtatttcgcttcgatgttctgatttccctgggagccaataaatttgtgttttaattctcaaagttttctgcctgaggctgtgttgttgctaatggccagtggatgaaagagctcttaggctgttcccagtccgtccagctgccatgttgactcaccgtcagtccctccctccagctagcccccatgggaaattcacaaggaagcagggtcttctggggaaaatgtcccaggcagctcagatccccggagggtcaatgagggagggacaggatgtgtaaggggaggaagtggggggtgcgagaacggccttggtgctctgccccctaggtgttcccagtgtgaatctggtctgacctgctgtgcttcttctgcccgggcttcttgaaggaggcctaccctgaccccaagagtggcctctgggtgacccaaccaaaggcccctcctgcttcttctcacataaggtcccctcctctcaaacccaaggcccagcctcttccacctcctccaggaagccttctctgtctaccccactctcaataatatccttgttccccgaaataaatatcaatcctggaccaaacgtctcacactagcagccctcagatgtactttttaggcctgtatcatgttttctaaacttttaatttgactcccagcattgaaaagcaagagatttcacctaaaaatgtgaacacacaccctctcttacaaatgtggaaagcctggcatcccctggccctcgttccttctggtgagcccagccctgcgcctggcacacagcctgggtgcaccagccacagccttcttggagcactggcttcagaggcacgcaggcccgatttgcccttcctggccatgggacatggcaaaaaatgcttcttgtgcagcctcaatttccccatttggaaccagggcttaaaacaaaacctccttcatggggttgttgggaagaagaaatgaactaataggtggagcgggcttagcacgggccaggcattcagaagcctggattaatgatatttcgttttcttgttttcctttttgttttcttgctttggtatctctcatttcctcatggtcctatccttccccactcagtctgtctgttcgtccatccatctgccattctacaaatgcctactgtgttccgggcacatggaggatccagttgttcccctcggaaaacccctcttcctggtctgcctgagcagagagccatttcatccacacatgcattcattcactcattcattcaaatgctcactgaataccgactgtgtgccaggaattgttcggaacatcaaggaaacagcactgaacgaaacagacaaaaatctctgctgtcctggggctgatgttctactggtggcagacagaccataaaccaattataatgtgaggtagcactaagtgctgggaagaaaaatcacagatgtggcgggggcagctgcttggtcaggaaggcctctctatgagcagggagggggccgtgtggctggctccaggataagaacattccacgaagagggaaccagtgcaaaggccctgaggcgggtgcgggcctggagtgtttgggggcagagcgtgagtggaggggtgtgagttacgtatttccgtgatgttagaattcctctcctccctgtcattctcttccccctcctctgctttctctctctctctcattttttttaaaacaatgagtctcttaattttgttatcagatacacaaggacaattcataaaaatagaaataatatctgggaagcggtgggcatgccattggcacacaggagtggcgatggctattcttaccatttcttctcatttctggcaggaatgaatcacttacttccaacgtttcctaaagaggcaatgggctcctgggccctttctcactcgggagggcctttcctctgccccatcattctgagggtttctggaaggtgagtgcgtaagatgtgtgtgtctgtgtgtgtgtgtctgtgtctgtgtgtgtgtcttgccaaagaagggtgctgttgcctcttccccttcgctcccctcatctcctcttttctatcttctgcccctttggtggaaagaagcatccaagcgtggggagccttgtttcggggccactgagaacttgctgagctgagcttgctgaagcttacgatagcgaggccagggtgggatgtggctcattgtgtcagaaaagaggttcatagaactcttgagaatgggagtcctagaaatagggccctaggcccatctgaagtcttctcacttgtccccagagcttcaggctccttcctgtccccccaccttcctggatgctgcctggtctagccccatcatcctgcctgcgccattgcagtcacctcctgcctggggcccctgcttctgccctgggccaccctgcctgttcctcacacgcagccagaggaccctgccagaaccaactcagaccctgtcccacccctgctcagagccctcccagggatcccaccccactcagaggccctgtgaggtcctgcgaggccctgcgtgttggctcctatctcctctctgagctcacctctcccactcaccgccttgccctctgcccccttgcccagccacactggcctccctgctacgtgacaggctcctactctagcttttggaccctactgcacccctcccaccccagggacctctgcccctcctcttggggtcagctgggcagcctgccctgtactccctaaccccctccaaccccaggagtggggcttcttgatgccagcctccaagccctttatcacgtgtccatgggcagtgttctgaggtgtcagccctagaaaggttggctggatctgggtgcactgtggtgccccagtgcctggaacagtgttggctgcctggaacagtattggtgcacaatatgcagtaggcattcaattagtgcttgctgaatgagggagcctcagcgttttaaaatcagaccttgaaaacgttgcaaagttcttagaatcccaggcttgaagaattggagactgggaggcagtgaggctgggtgagtctggaaggctgcgggcccatctgccccatcctggtcggctgtgtgtgtgtctctctttttgaatctgtctctgtctttttctctctctgtcactgtctctttctgtctctgtcttgtttacctccttctcattgtttctctgtgtgttgtctgtctctgtttctgtctctctcttttctctgcctcttctctcctctcctctccccacagcttccttccctgcccccctcctcctttcttcctctcctgtctcctcccatcctctccccttctcctttcctctctctctttccactgttttttctcttcctttctccccactgtccctctctgtatctctcgtttctctgtctcggtcatccgtgtgtctctcctccttgctgtcatcttctgtccctgcctccatgggcacccagccagcttctgctgtggagcgtttttctgcctctctgtcctccatctgccccacccaggggccctatccaattgtcacaaaggctagcccatggccagtcctgtgaggggctggtgctgggcgtggaagctcttcttgaccttcttacttgtggcatgactcgaaaagttgcgaacctttctgctctctgagctctgatttccttgtctagccaaagagaataacaatttctggtacttccttgatttctatgctaagtacatttattatttcactggctcgtggtgaagcttggagaagtttatgggtggggaacctcaccaacaaaacctccatggcagcagaagcaggccttgccaggagctgaccatgtgctgacctgggctgggcatgttccctggctggggcatggccgctgtctgtcctgggctcagcacacagtggtctctttctgcccagccaggcctcctttcagaaacttgaactcattaggctgcctccagccacagggcctttgcaggggctgttccttctgtctgggatgctcttccttctatctttgacctggttaaactggggccttcttattcttctgatttgggctcaaacatcccctcttccaggaagccctccctgatgacacccccccaagtcaggtcaccttgttaaccactttctatcccttaccacagttataattatttatttgctctcagtccccacagggctccccaccccatcttctgggcttaaggctccccaggagggaagttgagaggtccaggcccatgagtcagcagagcttggcttcccctcttagcactttctttggggcggttggggcctggcctcctccaagggggactaaattcaggggtgactaggtggtggggaggtggccaagtcctctctccgccccctaccccagctgcccagcatcagacaacttctctctgcttctgtgccaacacctgcctgagccactgttgacacactcacctcccccaccccagctccattgccaccttctcctggggaagccagagggagcttttcataatctaaatctgacctccaacggccgtgctccaaacccttccatggctccccgttactctctgaataaagccccagcccctcagccggcctccacgccctctgtggcctggcctggcctcttccccttcatgtcccagcagcccccagctcccagcagctccctgcccccaggtcttcgtgcttgttgtcccaccaaatggatgaaagccacctgttcactccctcacctccttcaagcccagacatcaccttcctagcgaggccttccctgacagcgcttcttaaaattgcagactccccaccatctttcccctgcttccctcctttatttctccctagaaccccagcctctgggaataggccatagagtttatggattcattttgtttttcgtctgtctcccagactagaatgtcagttccccacgggcaggtgccattgtttctcctcttccttactgtgtcctaaggaaggagtgagcgaggcctgtgtggctgtggggtcagatgggcttgggttcaagttctggctcattcactgcctcactttctctccttaagagctgagtaaactcttgtgtgtaaagtgtctagtgcctacacgtgtctagaggaaaaaaagccaaaatgagaactcgtcactcatgatttcggggagatgggtgatgctgcttaggcctggccacaccctggtgttgttacccggccattgaaaagtatgacccgcagccctcccaggacccttctgtttcgtttgtttgcttttaagtattatttgttacacaagcatttttttccctctagattttatttttaatgaaaaaattcaagggaaattagtgtatgtaatattccacccttgttttaaacaggaggtggaagatacatgtgtatgtttttaaattgaggaaaaattcacataacataaaagtaaccatttaaatgaaccattggccattttaaagtgaacaattcagtggcatttagttcattcataatgtagtacaaccatcacctctatctagttccaaaacattttgtcccctcccctcccctcccctcccctcccctcccctcatctctcctctcctccccttcccttcccttcttttttattttccagtctcattctgttgcccaggctggagtacagtggtgtgatctcagcttagggcagcctcaacctccccaggctcaggtgatcctcccacctcagcctcctagatagctgggactaaatgcacatgctgccacgcccagctaattttttgtattttttgtagaggtgcggttttgtcatgctgcccaggctggtctcaaactcctgggctcaagtgatctgcctgcctcggcctcccaaagtgctgggattacaggcatgagtcactgtgctaggccccaaaacattttcaatcacccaaaggagaccatgtacccattaaacagtcactcctcattcctgcctccccccagttcctggcaaccgtcagtcttctttctgtctctatgggtttatctatactggagacttcatataaacagtatcatacaatatatgaccttttgtgtctaacttctttcaattagcctaatgtttttgaggttcttccacgttgtggcatgcatcagtacttcatttttttttaatttttaattttaatttttttgagatggagtctcactctgtcgcccaggctggagtgcagtgggatgatctcagctcactgcaacctccatctcccgggttcaagtgattctcctgcctcagcctcccgagtagctgggattacaggcatgtgccaccacgtctagctaatttttgtatttttagtagagacggggtttcaccatgttggccaggctggtctcgaactcctgacctcgggtgatcacctgccctgacctcccaaagtactgggattacgggcgtgagccactgcgccccaccagtacttcatttttaaaaaatgatcaaatactgttgtatggctagatcacattttgcatatctattcatcgactgatggacagttgggttgtttccaccttttggctactgtgactagtgctgctatggtaattggtatacaagggcttgtttcgtgtgtgtgtgtgtgtgtgtgtgtgtgtatgtgtgtgtatatatatatatatttttttttttttttttttgagagactgtctcgctctgtcacccaggctggagtgcagtggcatgatctcggctcactgcaacctctgcctcccgggttcaagcgattcctgtgcctcagcctcctgaatagctgggattacagacgtgcgacaccatgcccagctaatttttgtatttttggtagaggactgggtttcaccatgttggccaggctggtctcaagcttctggccacaagtgatccgcccacctcagcctcccaaaatgctgggattacaggtatgggccaccgctcctggccttgtgtgggtattcttgagtgaaaaatacaagatgcagaaaaggatgcccaatgtgattctgatttgtaaaaggaatgacagataaagaaaccctttgtccgggcagacagtctgtatgggattttcattcttacagaaaaataggtaagaatccattctcaatggtcaccaagggaaaaaaagaaggcttttgcagaaaagtaaaaatgaaaaaccacaacagtgcacacacagtggctccatgcgggcatgtgagacacactagactgagtgattgtatgtgcagatgtgaaaaaaacagcaaacaacaaaatcagccccgaaactagtctctctaggaggggctgggcaggagcctggtcagatggagaaactgaagttgggaagaggggagggaactcctaggagagagtgatctccaaaaactgctccccacccctcctttttaactccctccccaaataccaggtcccattggagccaaatttcctcagtgttttggaatctcagacccgcaggcaggagacagattcttccccatggaggatgcggttgggtttttaagctcctgtagattgagcacttactacctgctaagtgtttcacctaccttatggcctgagtcctctcccagcccctgaggaaaagctattgttcccttatttatttattgttattgttactttttatttatttacttattttttagatggagtcccgctctgttgcccatgctggagtgcagtgtcgcgatctgggttcgctgcaacctccgcctcccaggttcaagtgattctcctgcctcagcctcctgagtagctacgattacaggtgcccaccaccacgcctggctaattttgtctttttagcagagacagcgtttcaccatgttggtcaggctggtctcaaactcctgacctcaagtgatcttcccacctcggcctcccaaagtgctgggattacaggcgtgagctgccgtgctcagctgctcccccatttttttcgttcaggaaagcaaagttcagagaggagtaggtttctgtgcagggcgtgtggcagagctggacttgaactcagggcggaatccttagccatggtgccccctgccacatggttcggctttccttcatctctgctccccaagatgcctggctccagctgaagatccagggttcccaggttcctcttctggggacaggtcctccttcagcctgacctgagctctgccacttccaccggcatgaactgtagcaacaatttggctacccgggcctcattctctccatctggaaaatgggcacagcatgtgcctttctgcacagtgaggtcatgaaggattgatgaggcaacacgcaaggagcgtaagcctagggcctggcacccaggaggccaccccagtgggccctgctgggtttccgatttcccctgtgacacctcctgggggccggatccccagcgggaggagggatgaggcctggggggcctggctctggcacaatgcagagcattgagctcatgccagccttggctttgggtttggacaaatacagtaatctgggcaggactcacacaaagacctgggggccaggtcaggcgaggggcgtcaggttacccctgtgggctgcagccacacaggcggcttggggggtgtattttttttccctaaagattatcattaaatgagccctcaccgaggcctcagcaggcaggtttcattacaggaaaaactgaggtataggggtttgcaggcctaacgggacacgctgtcactgtgataggaacagcattagcaataataacagctgtccttccggactggttcccaagggctaggccctaggtgaataataagccttttctcgatcctttctgcagcccgagaggaaagccccatgctatccccatttcatagatgggaaaactgaggcttgaggacactttgcggcctccaagggctgttctcttcattcctccagcagagtggatatgagacggtgcagggtctggaatgtctgggcagaaggaagagctggagcaaaggcctggaggctggagagcgctgtcggggggcaagtggggcagtgtcccactgcggggtttcatctcagctctgccatgtcttggctacgtgacctctgacaccctactgggcctctttgatcccagactcacctgtagaatgggtgtgtgagaagaaaaccttctggagcggggtgttgaggagagaacagtgcctgacacatcataataataatgctgaatagatgttattttcattcctaaccacttcctccaggaagcccatcctgacctctagctcccaaagtcacctggacttcctccatcacagaccttgccacagtgtgagaaactgcctcatccacacaccagcttctcacctccacccagaccctctgattgggactcccctgaagactgtgtccccagagcccagaaagagtccagcacagagcagctgagggggcaggtgctggtgaacagtgtcaatgagcccctgctactcaccaagcccttcacacacgggtccttcatttaatgtctttcttctcctagatagaaccttggctttgccaagaccggtatagttgctgctcaagaaatatgtgaggaaattgttgagatgaaccagcactcaggggaagggaggctttctgaggctggggccttagcaggtggagctcctgggataataataataagaaagatgcctggacgcggtgactcacacctggaatcccagcaatttgggaggctaaggcaggcagatcacttcaggccaggagttcaagaccagcctggtcaacatggtgaaacctggtctctactaaaaatacaaaaaattagctgggcctggtggtgtgagcctatagtcctagcttctcgggaggctgaggctggagggtcaatgattgaacctgggaggtggagcttgtagtgagccgagatcgcgccactgccactgcactccaggctgggcaacacagtgagactctgcctccaaaaagaaagacaacaataatcattagtctttactctgctccaggcaccaggctgagtcttctcagttcatctccccagcagattagttctattattgtttccatttcacagatgggaaaatcaaggcacagggaggggaggtggcttactccaggtcacacagttagtgagaggcagaggcaggatcaaagccaagcctgtttgactgaggagcccgccccgagaccttaaccacacaacccctccctagaaggaaggtgccactactggacacattttggagatggaaaccaaggctaagagagtcaggatggcctgcccatgtctggacacagaaactgaggttaagcaggagatgcccgaggcggggtccctgtctcctaggccagcaccctgaagaaggggtgggagacaaccccccaccccccaagctgtcccctgcttgttggagtttctggtcaataccctggcctctgttacccagcccagcacccaagacgctgcctcttccgcctgcctggagtctcgggtgccttcacaatcggattctctgtctctgcagctgctttccatttgagccctttgtgctgaaaataaaaaaaatgaaaagaaaacttggcaccacccctctgctttgcttcctggggaggaaggaggatcccagctacttctttccctcattctggggcccagagatacccacagcctgcccgaggtcacacagcagggttggagccgggaccctggccttagactccccttccagtgctctacccactctggccactgcctctgatgttcctggctcttcctctaggcccgtgaggagcagagaaattaggatgaatgttcccgagccctaccacatgctgggcactctgccatcctgggctcacgaaaccctcatgacagccctgtgaggtcccgtcatcccatttaaccaacaaggaagctgaggctcagagaggggaagcgcccaaggtcacacagctgggatgtggcagagctggggttccagctcctgttcccattgctggacagctgccacatctggcacccaatttaggaccccgcggggaggcccaagccccgggggtggcgggggatcctagaggaaagtggcaaggccaggaccctggagcagagccaggtaggaacaatgggttctcagagaccaaggtggcagggcggggcggctgctgagcaggggcggcagggcgaggtggcgggcggggcccaggagacttcatgctcccgcctcctactccagctccctgtttgggatctggggacgctccaagcacctcagcttctcaacctggacagacccacggctccagcaggaggcagggccagccctgtgtataaccataaatataatgggcaataatcagatttcacgcttaccgagccctactacaggccagacactgggtcaagggtccttcctgggtcatcacaatcagcctaggaggtgcaattaggattagtggctttttacagatgcggaaacagaggtccagggagctactcagcacctgctgtgccaggacaaagaactttgggaagtggggccctcagagggtgggtaccctgttcccagaggcaggaaagttgaggtggactggactcagtggggctcagtgggacaccgtggggagtcagtgctctctgggggcgagatgaattagagggagcccttttggttttttagaatctgaacatggggcgggggaagcagagatgtggggagcagatgaagcctccctggcactgctgggaggattaaaggacttgatggacacccagggcttggaaatgtacctggtagagagtaggtgctcagggaacaactcctgtttgcagaaacagcaactcacacttagggagcctgctgtgcatctgaaccccgtgcttgggtgtttctgacccccttccagctctcatccctcctctctccattttctcccctgtctcaggttcattcctatgtttcctcttgccccaattaggccatcttctatgactgcaacagtaaaaatattaattaaatcttataacatgaagtctaacgtggggccattccagtgttccagggcaggctccctgcgctctaggtaggcatctcttcacttctctttcttcatgggccccagtgcctgctgtggctcaagacatcacgtcccacatgatcacatcctaactaggaagagatgaacagaaaaggggactttctcctccaggatctcacttttttttttttttttttttttgagacagagtcttgctctgttgcccaggctggagtgcaatggcacgatctcggcttactgcaacctccgcctcctgggttcaagcgattctcctacctcagcctcccacatagctgggattacaggcgtgggccaccactcccagctaattttttgtatttttagtagagatgaattttcaccatgttggccaggctggtctcaaactcctgacttcaggtgatccacccacctcagcctcccaaaagtgctaggattacaggcgtgagccaccgtgcccagccaacaatttttcttacatgtcccagtggatgtcccctggtgtctcatggaatgatgggctcacatgtccacatttgaaccagaaaggaattcccgtggctgactcaggccaattagggttcagcctgtctggctgctccaaagagatgtgggctccgaaggtgatgggggcacggctgggctggccaccagctggagtctcactgacggcctaagtggcacagtgggcctgggtttgctcggccttctctggctggtcctcttggcagcgtctgccccctgggtaactgccccctccttgagcacagtcttccccagcctcttgatggcggcttgctggtctcgctggttctcctcttacttccctgcccgttcctccttgggccttgaaaacgacccctctcctgccttcatctgacccttgccccgtgagctcagctgtgcggggtccctcgtgcctttatgcgggctctgtcagtctgtccatgggtgtcccaggggcgcaccccactgggagacatggatgtctttcccagctgagaagacagcactgccacccacccagtgggccaggcctcagaccccagagttgtccttaactcctctctctctaaccccaacattcaatcctcagcaaattccatcggctctgcctgtggactgaatccagaactcgacaagtcttccctcctctgtctggtcattgctcgcctgcctgggcagaatctccgccctggactccccacccaccccacacagccctccacactcagccagagggctcctgttggaacccaagtcaggtcacaccattgcctcactccaaaccctactcctacctccctcagagagaaagacagtccctgctctggtcccaaggacagccctgcatggccttccccctccccacctcccctcccctcttccctgcccgcagtgacctccctcctcctgctagaacacatagagctttgccccacctctcctgggtgctctttttctggatctttccatgatcagccccatcccctcactcgggcctgtgcacctcagagaggcctcccagaccatccctgaaagtagccctgcccacccctaccacacctgccaaaggtcagcttcggcaagtggggactgtgtcttattcagcatggggccagcacagggcagtgcgcagaacgcagcagctggcgccgggctccgtgggtcctcccacagatgcagtccatagggatggtgtctgggtcccaaggtgacccctgggctgaggtcaccacctttcctcttccaggatcactgcctggatgacggtgggtgtcccagtggtggggagagcagctccgagcctccatcatgcccagagcaatgggcactggagcctggaaccttctttccgtatcacagaacctccaggagtctggaaggagacagttgcaaggaatggaatttaggaacttttggtccatgctcggtgttccctttgggggtatcttgtccgatggttattgtttttgtttccccttttcctgagctgtggtgcctattgttcaaacagaggaccccaagcgatggcctgcctcactcaggcgcaagcacccgagctgtctggcaaggtggcaatccaccacggccaacttccccttggggattccgcaggaaggacgtggcccctccaaccgaggcggatgtacggtctctccatagattccgcctgcgtaatcccatggccgcttcagctgggtctcatggggccaccctgtggcctgcgttcaaggaccacatcgtagcaacaggtctgcgttaaagctggaatcgcacccagcagactcggcctggggggatccaccagcccacatctcgctctcccgatacagccacctggcaattggctcttctctctccaaggctgtatttgttctttttgctgagtgtgtgcaggtgaattctcgttagttaaagcgcctgcgcggtggccgccctgaatacaaaaaagatcaaggggatgctgtcctggtaggtataaggagtgggggccccccacctttaccacttctccaggtgacccgagggtctgtccttagaataccaccaggctcagtggaacccagtttgaaagcccacgatcgaggtctgtccctttggtctccatctgggaaagtgaggcgagagatgagggagggggcattttgaggaccagaaatgtcgtggcagaaacagccagcctggagaagggagtctgggcagggcaggacccaaaggctcgagcaggatgtgtctggtgaggttgtctgggggaagtgacttgcctgtccccttcgttcattcttcaacattcattcattcattcattcattcaacacacaatgaagcacccactgagctgggggtgacaatgatccctgcctacaagaagctcccaggccggtgggggacatgaacacccttcaaaatgtcaatttgtggctgtgacaagtacaaggtgatctgagggtcagtaaagggggaaggaggttgatgtggttagggtgttcgggaaagcttcctagaagctgagctgggaactgaagggtgagtagaggccaggcagatgagaaagggaggaacgaatattccagcaagtggacacagcacatgcaagggccctgctgtgaaatggagcagagtaggagaggctaataggctcgcagctccacgtggcggacagttcgcagtgaggggcagatgtggagaggaaggtgaggtgggggctggacaggctcccagtgaaagcagcccagtctctatgccaaaggcagaggggttcttgggaggatctgagccagcagcaccagcttcttcctgaatactccagggcttggggccaggggtggtcatctggactcgatcctcagtgggataggagacagggtcacctggcacttccgcccacctctgccttcctggtctgggtataacaatcactgtctcttcgtctttcatgatttatctcactgaacccccacccacagaccaacacctgcaggtgccaggggttgaacccacttgtcagatggggaaactgagtctgtgagatgttctcatggccccacccacttccttctgctcagagaaaagaggaacggggaactgatgcccctggtcagctgggaagagtctgggcagggaatggggagggtggggccctcgggggcctgcattcgggatgggcaggggccctgcttccgtttaaccacagccctgtgacatgccccaaaagggaagcagcagccgcctgtcctcacccctccgtgccctagggagggggctggggatgcccaggggtggggagcaggagtctggggaggcctcaccctcccaccccaggcctcgagtctgggttcttacagaactctggggtcagctgaacccagctggtgacctccatcaagtcccaagaagaccttggcttcctattctgtaaatggaggatcagtctctctggaatgttctcagattagcacacagtgggtcctcactgaatggctagccagcagttgttggttgaataagctaaaagtgtttttctccctgaaaggagtagccaattagataaggaacccatgtatatgacattccacaaatatttattgagcacctattagatttcaggcattgtcctggtactgtggagcaatgaacaaacaagacaaaaatgcccccgtcacctttggagcccacatctctttggagctgccctgcctttcctggtttgtggcagacatcactaattgatcatctttcctgctgcaaccagaattctctccaacaccgtgcaccactcagagactgacatatggtggggaacagcctgtcatccccagggagggatggcacgtggggacttggaaggtctcagtgagaatcttctagctgatttaagcagcttcctctcagtctctttcaacaaatatttattgagcacctactttgtgtccagtactgtgccaggcattggggatacagcagtgaccagggtggacattacccttaccctcgtggagctgatgttctggtgagaaagacaagtaaacaaataagcagacacttccagacacagatactacaaacacatgccagaggcatatggtggagggtgacagggaaggagtctggggtaggttggggttgggggttctggagggagggtatttattgagacctcactgagatgcagccaccaaaggaaaatatgggggaaggtgtcacaggcagcacagcaaaggcataggcccggagtggggaatgaggttgatagatttaagggacaggaaggaaatagtgttgctggcggggcatgaatgtaggggagagaagcaggagagggtggtggagaccaggctggggccatacatccagggctcggggccaggggtgggctctgaatcacatctccaatgggatgggcagtcactggagggtcaaagcagggaagagacttgggcgggatcccatttcagatccctctggctgtgtgaagcagggacacccagccggagatggccgcagatgtccaggcgagcgaggatggcaacttggacgggggcgatgccagtgaatgtggggagagatggccaggcctggcgggaggcccagggctctgcattcagtttcatttttccttttacacaatcccccccggccccgggcactctgggtcactggactttccctggcactgccggtggggcccacaacctgctggcaatctggcctctccgagtcccagctggttccctgccctgtcctggacccttcctctccaggaacaggcccagctccagttcctctgtcactgtttcccaccacctcctgccccaggtctgcctgggccctgctgatctcctaattctgcctctgctccagcaccccctgctccagccctgctggctgcctgggagccggcagatgcttcctctgagctgccttttccagatcaagtttgcatccaaggaagcgagcctgagactcccagccagctgggggagacaagttcgagggaagtaccccaaggtagcttgccagagggcagcctcgctcttgggcagatttttcctctggtccagtttgttgttggatggagcaggcagatctaccttccccactgactcaggccttgggtgctcggatggagactgtggccgaagagctgtgttgagcagggctctgaggctgcatctatgatactaggaaggagactcattattgattagtgatgcctgctgtggacccaggatggaggataggggccacgctggcctcataggtgtgtctgcggcacccagtaggtcctcaggtctgcactcccctgttgtacctctaaatcttcaagtataacaaatgctgtttgaaaataccttatgatggtgggccgaggtgggaggatcgcttgaggccgggagttccagaccaggctgggcaacagagtgagaacccatctctagaggggaaaaaaaaagaactagctgagtgtagtggtgcacgcctgtagtcccagttacttgagaggctgaggtgggagaattgcttgagcccaggagattgaggctgaagtgggctatgactgtgccactccactccagcctgggcaacagggcaagaccccccatctgtcttaaaaaaaaaaaaaggagaaaaagagagagagaaaataccccatggccttggtttccttatctgtgaaatggggatgatgatgacaagcccccagagggcttccccgcaccctggcagtgactgacacagaggccctgagagctgcgtgttccagagtcatgcagctggtacatggccgagctggtggggtttgaaccctgggtgcctgagtcagggagaacaggcggaacagttgggccagggaggggaaggtgctgcccagagctcccagtgaccttggaccccacttctcctttctgcccagtgtgctcggcacacaggaagcctggcggggcctcccttgcccatcctgtctgcagccgggtggacacggggtcccggcgtcacccaccgccacccaggcctcctccttcctgtgttgtgcaagacgaggcgtcccctgtgtggaatgggcaggcagctctggcgatgggtggacgggtgaatgggggcctctcaggcggggtcactgcccgcggttacctctagcaggcctggcctaagcctccgccccttcctcctccttctcctcctcctctgtttccccaaagttcaggcagccttaagcaagaggctgtgggacccaggaaactggggaggttgtccagccaccatcttgtccccacagagcagacctaggcttgcgcagtcttggagaggtcctaaacaacaacaacaacaaaactataataataatgataatagctgttatagtggagtggcttctatgcaccaggcatgctctcatttaaccacaaatacataaaacgcacctcctatgtgccacgtgtgattctcagacctttacctcatgtcccatcgaatccccggcaacccttgtgaaacagttttttttttgtttttttttaatgattcctttcttcagagtagaaaactgaggctctgagagatgaagctacttgccaaggtcacgcagcacagtcacatcctactgaacatcatcctgttctctggggtgagtgctgtcctggaagttggggggctcagaagctgttggtgcccacctgggaggtcgcccttgcagctgctatcctgaatctcttgcccaagggcttcctctggccacaagagtgtgggaagcaagtgagagacccctgccagtagaggtggggtctgtttgtccccccactcagcttccttgcttctggctcaggggacagtgggaaggtactttctgcgagttgtcccagaggcctctagggggttgggctcctgttgcccactgaggagacctgctcatctaccttccttgtgtcacttcctcactccttcccagtgtttctagaatcacctcccaaatatcccacttgcacccaaaaccttgtcttgggtcagcttctgggagccgacctaagccagcagctataatgctcagggcttaagagctttggaatcagatggacctgagtgtgaatcccgcccctgccacttaacctgagtgtgaacttgggagcctgccccacctctcggaacctcagttcctccatctatgaaaagggaacttacgtgcagaaaaccaagtgactatgagggggatggggcagtgtgagatgacgggaccagagcacgttcctggctgcagaggccacaagtcacgctgtctctgagaggtatggggacaggggcgcagaggaagaatgatcgcgagtcctcagccctgtttggctgacgggggacagggatgggtgggaaagaggtacagcgtttttccaccttccccacccatcacccctgagattccaaatgaacatcgggaccaaccccgggagcccagcggatgttcagggtagggcaaagaacaggtgccaagtttgctccctggggtgtgagactgggcagcctcaagagctgcattggtaggactttcaccaggtagacagcaggcacctcgcccctgcagatcacagcttccagggccacctgtccacagaatcccttcactgatctgtgcttgaggcaggggtgtgtggactgggagtccttcttttactctgggtggggcctcatgctcagagggagctctgtctacccccaccacaaacctgcagtttccctgctacagcgatggcaacctcagccacctggctgcccaggcccccaacctgggttctccctcttgttcccatggtcagcccatcagcaaactcatccacatgtccaagggtccacccccactaccctgccctgccctggtccagctaggatgtttgcagtcgtctcctcattggtctccctgcctcctctctcgccttcctaagccagaggaattctgtaagagctcaagttagatcctatcccttctctgctcagaaccctctatggctcccaactcactcagagcagaagcccacagggcctgcaggatctctgccctggccccgcctgacctcactgcctctcccttctctgttcacccacagccacggtggcctcatctctctgccataaacttgccaattatcctgctgctgcctcattgacttcgcacccactcttccctctggaacagaggacactctcgccagctctccccatggcggatccttgtctagggtcaggcctctgctccaaagtcacccctggggacaccttctctgaccagcccctcattcctatggcctcatgctgtttttatttcttcctaggacttagcacgtatcctagaaattaacctgctggtatatcctgtttcttgtctgtctctttccagtggaatgtcaccatcgcccaggtggggatttttgtgtgttttgttcactgctgtacacccagcccccagcacagcgcctgtccaggacaagtgcccagtaaacacttgggaagcaatgcaagcgtgcgtgcatggataagtatttctttggcagatgagggggctaaggttcagagaaggccctgggggtctcagactcatagcccagtgctctttctgctgacacgccctggtctctggggcagtttgttgcctgttcagcaacaaagagggtgtgcctcgttaggggtcctgcgtgcgaatcgcagtccctgcgtgtcttggctggaggtcaccaccctctctgctccagggcctgtaattaccacttaccctggtcaatgggtccgagagattacccttgtaggcagggctgtggccagggtgctcacctggcccccagcaggtcccatgggcactgtctggccgggcttcatggctgacattccaggtacatttctagccctgggctgccatgggcagagggtggggagagggtcgtgggcttcaggctggacaaaccagtcagccttcccagctgggccgcctgaccacccacttcctgtggggctccttgaggcctggagggtggagggggtctctgttcaacccccacccatgccctcttcccttctctccctcggcaggtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgtgggccagcccacatcagtccacagcaaagtcctctctaagggatctctgttgcttggagaataaaccctcggattccttccttggctctcggggcctcctctctgacctccctctgtctcctctcccagccttcctcctcactcaccctccagccatgctggcttcctccttgctcctgaaacagcctgaggcccacactgccccgggccctttgcactggctgtttcctctgcctggaacacttctcctaggcatccacagggctccctcccacaactccttcgggtgcccacatgggaagccatccctgaccacccccccgacttccttctgagcaaggtagggtctttctacctagtcatgagggcagggatttttgtctgttgtgttctctgtgtgcccccagtgccatcccagtgcctggcagatggtaagtgctcgacacacattggctgactgcctgaatgaacaactctatgagccgatggcagataaggacactgaggtcctctggggtaggtgaccagcccaaggccacacagctggtctgagattaggccaggagaggagcccgggttggtcacatcctggagttggcgtcttggaaactgcatcaggagaataacaaagatgagacgcaggctctaacaagtggataccagtgactctcgccccgccagccccagccctgcagccttgggcccttccaggagtcatggtctgcctgcctggggcattccaggcttcgacccaggtcctgcactttctattttgagcctcttagtcctgaggactgtgtgttcccagcaggcggcgcgggccagaggctgagcctgggtgtggctgtcaccctatctggggccagagacccagattcccgggcccttaacctgttggctgctgagggctctggcataagccctgttccctgcttgattgtctccccttcaagcccctgccctggtatcgtatcggcccatctcaccttggattatatccctgtttggccccatttgaatcctggctctgcccctttccagcaatgtgaccttgggcaagtcacttcatctctctgggtctcagtttcttcatctgggaaatggggacaataagagtacctgtctctggccatgtgtggtgactcatgcctgtaaccccagcgctttgggaagccgaggcgagagaattgcttgagaccaggagtttgagatcagccctgggcaacatagtgagacccctgtctctacaaaattctaaaaaaattagccgggtgtggtggtgtgtgcctgtagtcccagctattctagaggctgaggcgggaggattgcttgagcccaggagtttgaggctgcagtgagctatgattatgcccctgcacatcagcctgggtgatagattgaggccccatctctaaaaataacaatactaataataaataaaaatgaaaatgagtacctgtcttctggggttgcagaggagattcaatgtgatgaaattgatgagagtgccctgcagggagccggaaactcagggagcatcgataatgagtcccccaccatcagcagctggcttaaatataaaaactgtcatggcctctggagaaatgacaagaattcgaaggagcttccctgcactggccaccctacaccctacacccttacttcctcccctcaacttgcctggatttatcgacccccactaccccactggttgccttctctccacctggcacatttcgtatgaatttgcttgttggttcttgcctatctccccagtagaacattagctccttcaggacagggacttttgtctaccttatgcacctagtgcaatgcctggcacacagtcggtgcttaataaatgtttcttaaaagaaccaataaatgaatagtgacctctccggggagaggagccctgagctcacctcctgcccccagcccagggctcttaggtgcttgttggtgtcaggcccaggcccccctctcatcaagcagccaataaaactgccctggttggcgttctcatttcacagatggagagactgagcccagagagggagagtcacctgtctgatgtcacacagaggtcagcatctgggctgggattccagcccaggaccatgtggggtggggggcagtggatcaatcttttcctggagggagtcaatggtgatggtgggaatgggtcaggggtgctggcaaggagggtccaaggcccccaggagggagggaggcatgggagatgagtttgtccctcttgagttctgtctctctctgtgtctctctgtttctgcctctttctgtctccttgtatttctcagtccctgtcttcgtctatacctctttctctcttccttgtgtatctgacccactgcccaggaggggatgcaggcagagacccctggcttgggtcctggagttggggcccacgaggggattgacatctggggttgagctgggaatctgaagccagaccctgcagccagggacagcattccagtctcggctccacactccagggatagccttggaacgccaggcagttcagagagcctgaggtctggtcttggagacctgggttccaatcccagctttgccacattccagccatgtggccttgggcccttagcctttgttcctgtaaaatgggaccactgagagcccgatctcagggttttatgaggaggaacgatgagagggctgtgctgggcttcctgaagccctgtgtggcctggaaagcactcaatagatgataactcagtgtaatgatttcttctagcagatggggaaagcgagagttaaagaggcccgatcatttcactcactcattcctcaaacgttattaagcacctgctatgcaccaggtgctttgttttgtatccattaactcagggttcagcaaactacagcctccaggccaaatctggttcacagcctgtttttataaataaagttttattggcacacagtatgcccattcatttacatattgtccacagctgcctttaccctacaactgcaatgttgagcagttgtgagagagaccttaaaacccacaaagctgaacatatgaactctctggacatttacagtaaagtttgctaatccctggattagcccattacaaccctggaggaaggacatgtcataagcttgattttatggattaggaactgaggtccgagcgcagtgtctgccacaaggttgggtctccatacgtaatatctgggtcttattcctcctcttctgccccatggggagctgccaactcctgttccctttccctatcctgcatggatcataagtggataatttgaatcccgcagaggaaggaatgctgtttgaaggtcaggtcaatggaaagagtcctattttcaggtcaatttggaccttgccaaagcctcttccttctggtgaccttagctgagaggtctgccactagcaggtgcttcatgaacagttgctgaacaagtggtgtgcatcatgctcccgctgtgaacttcagcttgcttgaaggcggattcctccaggtaattgcaggagaccccacggccggccacacaccaccgttgggatgaaagatggcctcgagccatcggtgggagaacaccctgggcagggagatgctttctagagctccacggaagtgggggaggggatctcactgcccgccaagcatgccctggagtctttgtcccttcctccctcatgctggaggcctgcaggtacctggcttgagacgttgcctggccctcaaaacacccaggttccccccaagctcctccccagcctcctccctgctgaccttggggagctcccggtttgccctcagcccttttctggaggccccagaatcaccaagaggtaatcctgcctgctgcctggaggaggcgatgtgggagactcaggaacctggggtgtcccccagccagggggcgggcgttgtgatccggcgctgctgagcactgcagtgccttccctgatggccttgtgtgccgctccctgaccctcccgtagagcagccttcccatactgctgggtgacacttgcgtaaatcatttcacctcttggctctgtaaaacgggactggggtggtccctaccccttcagggtgtcgtgagaatgaaaggcatcaagtgggcaaagcgcttggcatggccctgaaccatggtgggcatttgtcacacacgctcatggacttattcctgggtccctaggataccctggagctcctccccaggttggacctgctgctagcatgagagggaagaagggggacacagacaccaaagacagttctcgtcctcatctaaatgctggcgacttccaagggcacctccccaaggcctcccctgagcctagactcaggggtctccacccacctgtctctgtccctgctgggatgaccaggagaagcctcaaacccaggttggccaggactccattcctgatctgccccccgaagccagtcctgcctctactgatggctcctgcatcctccaggtggtcccccaaacctgggagtctcccctgccttcttcttctcacttgctcccacatctgatcgctcatcacatcctgtcgactccaccttcaaggtagacccggagtctgccctcgtctccccacctccacggcccccgcttcggccacggccaccagcaccaccgcctggactggtgcagtcacttcctcctggcttccttttctccctcagcccctcacagtctgttctccacacacgaccagagggacctgtcagaagggacctataccttccagcacagaccctcccagggatcccagctctctgagtgaaagctccctgtggcccgtgaggccgggtgcgaccctggccccccagcaaaccctccacttgtctgatgacctcgctgcctctctccctcgcgtactcccttccagccctgatagcttcctgctgttcctcaagaagccctgggtctttccacctcaaggtctttgcaggtccctggagcccttgtccaccatggatgtccacggctccctcacctccttcaggtctgagctcggatgccactctcgacagccaccttctctgacccttcccctggcttaagtagcctctgcctgctcgacaatctctccctctacgcccctgaccatcccgtgttcttttttcatagggggaggggaaaggcactcccaggagagtggacagtgtgggccagggcctggacgtgtgggcagcaagagggtgggtgaggggagagtggtggagcctgggtggctgagcttcagggggaggcatcctccaggcaggagtgagcaggccagggtcaccctgactccgtcagccactggttgtgtgacttcagggagctctctctggacccaagaacctgcaactgctgttggagacccactaagtggacctgtcatctgacagagggggaaactgagtctccaaagctgctgctgtgacctgctgaaagggtcagcccagggatagggacaaaccaggggcttctagcagtcacttgcacctcagtgtgagtgagctccctggattcttggctgtctggtagcccctagaccccatggggcttgggaggcagagtgatggcagggctgagcctggggtggagtcagggctgtgtcaagtcccggcccagcctctgtcccggcccctggctccctgcagggtgctggattgcacaatcataccacccacagctgtgaccaaggcaggtgacacacgctttctgggagccacccttgggccgtgcagcctcgtcacacacacagggccaccgatggcatggatgcaccccggcacatcctgactgcgaggagtgactgctcctcacactgccacttccgggctgtgtgactctgggcaagtcacttcccctctctgagcctcttttcctcttctgtaagaggaggtaatatagtgcctgctcccctggctgttggagggattgactctgcccccgccatgctggccctctggctggtcctcaaatgcaccgggcatgccccacccagggcctccacctgcgcccttccctttgcttgggccggcccttgcacctccttcaagtctctgctcaaacgtcgcagctcatgaggcctttcctgcccctgacactccctccttactgaattcctccctgcatctctcagtgctacctgactcatcatggttcctgcttgttttgtctacccgctcctgggtggcagctccatctttgtctctcttggtcatcactgtgtccccagatcccaacaaagcacctcgtacaagaaagtgctcagtccatagttgcagaataaatgaatgaatgaatgaatgaatgaatgaatggaaagtgcttagctccacgcccgacccttagtaagcacctgaaacccaatgccgtgtggtggtgttagctttggctcccgatttctagccccatccaatcccaccctcatcagcccggcgcccgtgctttctctgcctggccagcttcctgctgcctgcacagtctcctccctgggtcaggacgacctctgagggaatcgtgggcctgcacggctggctccctctggctctgcctccagctcctcttacatctcccgggggcagaggcttctgggaaacaggctttgaagctcccctgggtcagacccgctggggccttccttaggcattgcctgatgtgaccccattagtgaacaaatggggacagtgagacctagagaggggcagccatgtccgatgtcaggcttcggggctcccaaaacatccagggaagcttccaggactctggcttctttgttgtttttggaacagagctgagctcaggtgcctgttttctagatgacaaaactgaaccccgttacaggctttggagccaggtttgaatctcagtcctcttacttcctggctgtgtgatcgaggtttgtcacttggtccctctgaggctcagcttccttgtctgcaaaatggcaccctaatggtacccaactcacggaggtgtttggggggacaaggtcagccatcctgcaggcaggtggggtctctggcctctcccacggggtcctgggactcctggctccggaacccccaaggcccagcccctccagggcccgcatggttccctccttgctgggataatttacagtcccagggccatagctgctgttgctttatttttttcccttccccgacttctcccttcctcaccctggcctcacttctccagaaccagcttgtttttgttttctgtttttacggctccataaatgagtcacgggtctgatttgatttaatttcgttgtaattgttatcttttcaagcttgtttttttccactcggttactcacgagaccacaaaaacctaaacaggacggggccttccccagcccggcctcctggtcccccgggactccgggccagggtcagcagctcctggagactgaggtggggtctgtggagcttctgtggggagggacttggtgtccccagcaggactgggtatcccgagtcccgggctgcagctctgttgctggacagccttgagagaattgttcgagctttctgatttccccagcatcctccttagcaggctttagaacagggaaccaaaacccaggcacctctgggccagaaggtgaaaggatgagtaaggtggcctggtgctggctccggtgaactggagagaacaggctctcctcaggggacggtggcctctgagccagcaggcggcccggatcttcccatttagtaagagaagccagaagtctgagattgtatgtgaaaagtcctgatttttaaatgttggccaacgagtcaaattaaaaacaaataaacaaaacctgactctgtggatatctgtggccccgtgggccacctctggtctagaaggttccaattctagctgcggcagccgtgttctcagtccttccacccttctgcctgagcagtcccctctgcctgaaactctctccttcttcctcctcatctcagtcactctcattctctgaacctcggtgtgtctcctgttcgcagctcagaagagatgacatctgcttcatccatgttcgccttcccaaggcgcctagttgttcccaattcacttttgtttctatgctttctcttccatggagggtctgtcttgtttgagaccgccttcgtagtgggggaaattagccccttagttgttaaaagtcataacacatatcctgcctgtcttatcattcatttctaaaatggggcacgatacttctttggtcatttaaaaaccgaagacgcgaggccgacgcctccagggatgtgcgctgggcggtaggagccaggtgtggggccaaggagtgggggcggaggaggaagccaggtccccagccagggggctgagggctgctcctccaaagcttgggtatggacatgtgaccagggcccaccaatcacatgcagccatgccagatttatgaatcagaagttggaaatgttgggggctgattgcttaggactccgttctggggtgggtggggctgcagcccggctatttttccagaagctgcagtgggccagttctgggggcagtgaccagggctcagcggtggccacagtgcagatggaatcattttgcagaaatgaccctccccgtgattatgtcaggaatgtcaagtacaatgaaaagaacactgcattgtgcagtcatgcaatttggtttaaatatgtttaaatgtatccacgcttgctttagtgtgttcattctaagaatctgtgtgcaccacagcaattatatgataattgtgttaggtcaaagagaaaatcaatttattttcacaatttttatcccccacgtggcaagacagtgacctagtcaaatctctctaaggtcattcttttttttttttttaagacagagtcttgctctgttgcccaggctggagtgcagtggcacaatctcggctcactgcaagctccgcctcacgggttcacgccattctcctgcctcagcctcccaagtagctggcactacaggcgcatgccgccacgccgggctaattttttttttgtatttttagtagagacggggtttcactgtgttagccaggatggtctcgatctcctgacctcgtgatctggctgcctcagcctcccaaagtgctgggattacaggcatgagccactgcgtccggccattctctaaggtcattcttcattatgatgctttggctctggttcttggtgaataactcactttacatggctttttcctgagccaaattgtccatctttattttctgagctgtggccggaggtctccagaagccccctcccagcgcctccctgggtgtgtctcatgctgcaaagggcatggcgatctgcaggctggtgctgcactcctggagtcctgatggctgtgaagccctgggacccatgcaagctgagctctgtcacccaccaccacctgtggcctcagccttcccaaactcctggctcagcccctgcctcaccttctctttcacctacttgtcatcccctctttaagcgaggccttgggtgagacccctgggcaatgctctgggcctcaaatggaagctccatggatgcttcagatgcttcagatcatggagtcctggaactactgaattttttcctccaggacgaaggaatcaccagccctcagcagactaaacctttgcaactctaaaattcaaatgcacaggagacctggtagaccaagtcatgtgcttgtttgggaagcatttattgagcatctagtatgtgctaaagtactagggagacagcaggaaacaaaatggactaaccctttgactttatggctcttaggttttgggagggggagacagcaaagaaatgacaaataagtgaaagacatagcatgtcccatagtgagaccactgggaaaaggggctgagtctgcaggaattgaaggggctggccacacagatgtctgggacagagcattccagatcgtaggaaaagcagatgcaaaggccctgaggttggaacaagcttgcattgtgggggaaagtgaaggagagccagagatcatccaggccctgagggcctcaggaggaggaggagtttgaattttattgcaagtgaggcgggagcattggagggctctgggcacaggagggagatggcctgactcaggttctaacaccaggttcctcagcttcggcaccattaacatttggggctggatgctgctctgtagtggggtcgtcttgtgcagtgtaggatgttaagcagcgtccccggcctctgcccactggagaggttgccagtcgcacctcctccccaaacccagctgtgacaactaaaattatttccagacattgcggaatgtgtcctgggtgcaggatctctctggctgcaaatggggcaagtggactgtggggggccaggatgttgtgatgagagcagagaacccagcagagatgactcccctagtctaggacaaaaggagggcgatggcagcagaggtgggagaagggactggattctgtttggaaggcaaagccagcaggatttgttggattgggcgagggagatgttggagtggataggtggatgcaggcgctatcgtttgctgagatggggaactggtttgaggggccaacttcataggtctagggcagggcccagaacctggcgtggtcacaacctggcctcagggggtgctgagtttttcacactgtgcttcaaagaatttaagtgtccagaggatgtacactggggaagggtctcttctaccggtgcagatgggaacaagtgggcaggcggcctttccttgccagcagaccaggagactctaagatgctttttcaagggagtcagaggatcagcctcattggaggactggttccaaaaggcagcctcacagccaggcgcgatagctcatgcctgtaatcccagcactctgggaggctgagatgggaggattgtgtgagcctaagagttagagactagcctgggcaacatggcgaaaccctgtctctaaaagaaaataaataaataataataaaaattagaataaaataaaagaagggattctgagactgaaaaaagccaaactcaggtgctgccagggctgggcaagcagcactcatggtgaagtggtgggagaggggtgcaggcctgtctaaaggggtggacgctgctcagtttctgccagtgtcgccccgtgggaagccgggactgacagtttttcatgagaagctgtaaatctagatcggggtgtccaaccttttggcttccctgggccacacataaaatacactaacactaacgatagctgatgagctaaaaagaaaaaatcgcaaacaaaatctcatgttttaagaaacattatgaatttgtgtggggccgtattcatagccatcctgggccacatgtggcctgttgttcgcgggttggacaagcttgatctagattgctatatgaaacctgttgatatttaaatgttagggcaaatatcaggccaggtttggcctgaaggccgtgagtttgaggcctctgtgatactgcagcccttctattttgcaggtaaggagctggcggggagagttagcacagctgcctccgagcctggcagatggtcctggatcggggctggacggggtgacttggagaggtggtgcttggactcaactgtgaagaagggtcagattcccacaaaaaagaggagagggcattgcagggggcggaggagtgtgagcgagcatgtgtggcgggaatatggaagactgttttccaggtggagggaggtaagaagacggggaactggaaaaagagttgaaggagacgggttgatgaggatgatggggaatacacggacacggaaggtcagactggacccaaaagagggttggaaaaatcacccaaacacttcaataatattagtaacttcacttctgaaattgtgtggcaacaagcagcgcgtttattttaccacttacttcgggttcttggcaaccctgcgtacaccagggaacgcttgcccaacaagaaacattctcactcgcagattgtttacaaacgcctcgaaaatttttgtaatatttttgtaaatattaaattagaaatttaatatagaattataaagtgtgagtgggttaattaaagattttaaaatttcaacttagcaggtttttctttttcttttttttgagacagggtcgcgcctagcaggctggagtgcagtggtacaatctcagctcactgcaacctccacatcccgggttcaagtgattctcccacatcggcctcctgagtagctgggactacaggcatgcaccaccacacctggctaagttttgtattttttgatagagacagggtttcaccatgttggccaggctggtctccaactcctgactgcaagtgatccacctgcctcggcctcccaaagtgctgggattacagtagtgagccaccacacctggccagcagatttctttaagtattttagaggcaatattttttccccaaaatctcccttgtgcaaattttctacctcacagctgccaaaatttgaggtggtggacaaaaatagttgatatataatgatagaaagacgtaagtgaggtatatatatagagagagtctagaaagagttcgctttcaaaggggaggatcagggcagtctccctggaggaggaggttttgaatacgtgcgttgaagggtgggtgaaatccagaccaggcaggtgggttagggaaagtgagggcatgccgggtgaagggccctgtgtgtgcacaagggtgaggtgggaatgatgagtgtgagagtttgtaccaagggggctggggctggggtgccaagaaccaaagagccatgataaggcctgtctggggctcagccaaactggggagtagtacacgagaagaggaatggggagccctagagggttttaagtaggggaggaacgtggagtccatagcaaggcagagtggctggtggggaggtggggaggatgccatggcaaccattcacgccaagcctcagccccgaccctcaaggaggcaggcaaggctgagcttccctttccagattgtttgtgggtgcaaaagggcagcaaagaatgtgggtgccttgtccttctgcccatggtctagtgtccttcccctcaccccagtcccagtggagccatcataggtgaaatataagaacaagtcacctgcgttcagtggctgcagaatacctggcctcgcacagaaggctgcggggatttctgctcattcattcttcccacctgccgcatgagggaggtgctatgtccattttacagaggacactgagtcccagagaggctaagcggcatgcccgaggttacacagccaagaaggggcacagcaagattcaacccaaaagtctgcactccagccactgccctatcatgacactcacgagctcccaccaagtctggctccagtgtttccagtaccataatcatccccatttaccagatgggtaaactgaggctctgagaggtggagtcacttgcctgaggccatacagcaggaagggtaaaagtaaagatttgaatccctgggtctagtcgactctggagcctgctgttctcccaccatacacctcagctgctcgccctcctgggcatctgtttcctcatctgatgaacaggggtgacggcgatgcctccctggcaaggtccgcagaggatcccgggtggtgtatgtcaatcacccagctcagtgcctggcactcagtggatgctttaaacgtgatgcctgtgtttattcgtataaaggtggctgaatattaaatgggtggatttatggaaggcacttatggtaatgccctgtacataatagatgctcaagaaacactagaagcagttactatgattataggatcgaccacaggggacagcccagtaacccctcaaagttgcttccttcccaagttgccttccatttatttctcccttcatccaacacactggccttagggtccaggttaggatttgggggcttggggggcttaggttacaatttgaggtgatttgtccccccctgcccatcagtcagagtgatgctgagagcactggatgataagaccagaattctaggtccgcgccccggacctgctgtgtgatctctggcaactgccttgccctctctgggccttggtttctcctttcatctgcagagcctgggccaggctgccctgggaggtgccagccccgaatggggccgggggcagttcctgtgtccccttggccaccagcctccatctcctgcctcttgagctgcaggcccgcccggctcagctgtgacgacgaaccagccaatctgtttactgaactggctgaccccttccgggaactcggcccaagcttcccagaactcgggtattaatgacccggagccacatgacggagcatgacacagcacttttgggcacaaggcagggcccagaggggtgcgtgggggccgcagcccagcccccaagccccgccagcgggtgagtcacctgggccccctgcagcttcctgatcccggccactcagctgtcctccccacccccaggatatccccagttgtcagggctgccctgggacccctcgacctttgcactagggacttagcagccgtcttgggtgatcagggctgccttctgggattacagatggggacagtgaggcctgcaggactggagtgaatgaacagtgagctctgagtaaacgtccactgtgcgggaggcactgtgcaaatacgtcacgttagtctcgcagcgatgcaacacagtggcgtagtttaatccccatatgatagatggggaaactgaggctcagagcgggaatgaattctcccaagggcatgcaacaagagcactctgtttgactggaaataatttcctttcgtctcctcagcagccgacaagggaggtgccatgtggactgtttcacagctggagaaactgaggcacagaggggctgagtcacctgcctaacgcactgagcagtctggctccaggacctgtgctctgaaccagcacctggcacatagctggcaccgacatggtctccgtgcactgccatggatgagagcaatgctggctgcggtgtcgggcggagctgggttccaatgctgacttcacctttctcaggctgcacagcctggagcacgtggctgcaccctaccgtgcgtcagtttcctcacctgtgaagggtgatcgtggtggtcctgatcttgcagaactgcagtgagggctgtgagtgtggggtgtctcaactgcacctggacacgcagaaggcactctgtgaacactgactttcattggcccaggcctctgaatccatgacagttcaatctctgaaccccacagcttcctccttcaccctttgccgccccagggcaaggtgagggcggtggtttttatgggcctgggaaccagacaggctcgggctcagagggggcgcctgctgctggcgggagtggggcctcctggttcccactccctgattttgggctgggggccggtggtgggcaggggtggggcagcactttgatgttcttcccttcattccaccaccactgcttgagcacctactgtatgccaggctccaggggacccagcagtgaacaaggtctctgccctcactatggtggaggagaggatggaggagataaacatcggtgagcaaatgcttgaagaggcgagaggatttcaccagagagaagggccgtgatgggaatcagcaggggtgtttgggagctgagtgggtcagagagggcttttctgaggcggtgatgtggagcagatgcctgaaggagaagaaggaccagacctggggaagagatttccagcagagggaaactcaccacagcacgtgcaaaggccctgagggtgggaatgggtttgggaagttccaggaaaggcaaggaggctgaaggggtgtgaggaggggacagcagcaggacatggtgctggagggccagcaggggttggaccatgcagggcttggtgggctgagtgagcagccgcggctgggacttgggcaggagcctatgtgagagatggcaagactgcctgagatcgcattcagaacttctacccatctcacagatgagctcagtgaggcccgagccagcttcccctagaaggtcagtggctggacaggcatgagaatcgagggagttcaactcccccggagaagccagaagccagaacacaggccgtggaggagagggtcccacattcatccctgcagccccgagagctgtgggctgtggggctgcctggatggcttcctggcggaggaggtgacctccaagctgtggctggggcagaagggctgggagagcgttcccagtaggggaagcagcacacagacaggcccagaggtggcggtgaggtgcaggcgttgtctgggaaattcatcactgcttgggagtcaggaaagtgaccgggtgaggaagtgttattgtcagggtctccctttcagaaggccttggggccaaggggaggagctggaattgccttccaccgcgtgcagaccccaggctggatcccaggactgcccagggacaggcacacgtctgccctcatgtggcccacagtccaggggcagggactgtctggagagattagggccatggggggcaggagggcggaggggcagacctcccatcctagttccaatctcagtgctgtgacacactccctgtgtgacttggggcaagtcactttacctctctgagcctctgtgtcctcatccataaataccacctggaaagatattctcagaactcagtgagatcattcgctcattcgtccactcatttattccttggattttttttagcgcttcctatatgccaggtcctgggctgggtgctggggacacagcagtgacaaaaatccctgcccttgtagggctgatggaagaggtagtgtaaagcagtgagtggttaagaacacagacattggagccaggggccttgggttaactcctggcccactgcttatttgctgtgtggttttgggtgagacactttacctctttgcatcctacctgtaagatgccacgtcataggattgctgaaaggacaaatgagttaatatatgtaatgtgtttagcacacagcctggtacatagtaggtgctcaattgtgcttgaatgagctgagatgtgcaataagcaaacagaagaggggtgagtggatgagacagtgtctgacagtgggaagtaaaagtgaccagctcttagcaacaagtaggcatacagtaggtgctcaataagtgtttctcctcctttgtctccttccgagtccatcttggaccttagcccataggggacttaagggcctgaggtttggaatctgcgtggaaggcgggaagtcgtctttgctgatccagaaacccagagctgagctttggggttggcaagagcagagacgcccccagcacccctgcccctcacgctccctgcaccctgtccccagcatcatgtgcagcctgggtggctgcggcgagctggggcctgcccaacgggtccccagtaatgacactcattacacaggtgtctggcagcggggggaagcgaaggccccaggggccgcattcacatggcacccagccagcccaccccaggcccttcctcgtcctttataagtctggtgcccagggcaggcgggcaggctggggagaggagctggcgaagggccagctggcgcccagtgaaaggagggaaagttgagaggtctgggtgccaagcactggtgtggaggccaggggaggtgggcacggggggcgcgtgtgtgtgcacacgtgtgtgtcagggtgttttggagggggcgggatgcagtgaatctgtgtccaggtctatgcatccccctggcctgtgtgtggagatgagagggtctgtgtagatgaagcattgatggtcccccaggtgggtgcaaaatctcccatgcccgtttcatttgttctttaacctacactgtgaggtgggtaccaggctgggtccagcctggacctggtgatgtcagagccagtcccagggcagccctagactctgccgtctaagagctccaaatccagggacagacagacgccaggcagaggatcaggacatcccagtgaagactttgatggagaaaaacaaggcagggggctgacagggatcaataggatggggtcagaggcctcactggaaggtgagcttggctggaggcctggaggacgagccgccatggcaagatctgcaggaagagagttctgggcaggaggaatggcaagtgcaaaggcctcgatgcagggctcagcttggcctgtgtgaaggggcgagtgaggaggggactgggggccggggcaggtccagagctcatggccaaagtcaggagtgtgcatcttctgagcgcagtgggaaggttggcacatggtaggtacacagatgggggctccactggggtgaatgggtttgatgagagccgggaccgggccctctgggtgtgggaacgattggctttcagagctacagacaggaacgtgggctgctcaattgtatttgaacctattctcctgggttcaaacccctcctggatcctggaacctgttattaagccggctgcaccccagggcaccggcctttatatccagacagggccctggcccccaagacgggggtggacgggtgatactggtgaaccccatgcctgccccaccccctgccaggcccctcggcagggccaagtctgcttctgagagcaatgagcatctctccttttacagatggggaaactgaagcccagagaaggaatgggtatgtcctgggttcttgtggcagagtgctgggggcagcacccagaaagcctccgtcacagctcatatctcttcctacttcatccccgcccacagcgggctcctcctaataggactctggcagggtagcagctggtgtccaggcagagctagagggaagagctgggtccaatttgagaagcctctgttaattgggtcctataggaagaactgttaacactgtgagtttcccatcaccagaggtgtgcaaatagacctggataacagcccttcacctgcttagagattacagagaggttcaggcggatgggagaccacttgccttctagctgtgtgattccacaggacctcggaacaatccttagctcaagcctcagttttcccgactgtaaaattgttttttgtaataatcagagtgacctcattaaaaggacaactttgttgataaaattctcctgcatttatccaggcctcgcttggttccccagtgctaagagacagctctagccctcaccatggcccgcacatcctgtagccctggtccctggggccttccctcccaccccctgattctccccttcctctctctgctgcaaccacagacttcctccctgttgttcctctcctacctcagggcgtttgcagatgctgtgagcattggatgtcgggcggagggctttccctaatttcaatctcccaccagtcctatcaggtaaataggagatccattttacagatgaggaaactgagtctcagagagctgaagttaaagacacacagctttttgtgaatccactgagtcaggatttgagctcaggccatctggaatctaacaccactctcttttcttcattccttatgtgacttgttttcattttcaaaactttgctcaacagttgccttctccaggaagccttccctgactaccctctccatccaccctcccatgaccttcctgagtttcacctttgctgcactgctcacactgtctctcaattatctccctttttttcttctcaacagctttactggggtgtaacaaacacacgataaactgcgcatattccagtgttcatgtggatgagtttggacatatgcacacacttccgaaaccaccagcacaatcaagacagcagacatatccatcgcccccaagggtgtccttgtgtctttttgtcattcatccctcccggccgccccatccacactcccatcgcctgccgactgtggctgatctgctttctgcggctgtggattagtttgcgttctctacaattttctgtaagtggaatcatgtggtgtattctttactgggcttcttttcctcaacattatgattttgagagttacccacgttcctgtgaccattctctttttttatgtatctgccctgtccccctcagactgtgagttccatggggcgaggactttgtcatatttacctctgcgtccccagcactcagcacagggctgggcacacaggaagtgcctaataagtgttgactgacgggaaggaggatgaggacatgcccaaatgggggaacagcgggcacatttgcatggcagtgaggagcccaaagccggattaagaaaaaacagcccctggaatcatctggaggcctcgtggccccatcagataagcatatctgctcatccccatggctgtctctgaggagcaaagatctggattgcacaagggctgggcctgggctgaggaggcgctagtggtccctttatcttgcgtgggcattcggcgctgtgttctagaactgcacagcccacgcaccccggcaggcagaggcctgggctccggcagcgggtgggcaggtgggaggcaggaagaagtggccacccagccctccccaaaccagttggactcctttgcagagattactgcaggcgctttgggagctggctaagggagagtgggaggcaggaggaaaaagcaggaggaggggaggaatcatttaatgagcaaatattatagggaatttccagttcatgccccatcaggctgggcaggaacacagtgggattactcaggcggtttccaggtaccagcctcaacctcgaaggttcagtgtggctcagatgcctctaggtcttcatcgctggctagaaacccaactagccagggtgagaaagtggcggtgagttacatcctgagacaaagcctgcaaccaaagtcgagtctaagcatgcgcttcctgcatcaatctttgctgagatgaccttattgcccatttcccagacagaaaaactgaggctgggagttgtggcattggctaaggccacacaggggtcactgcgcagtagggacagcttaaaagccaaggccattttggagtgactccttcaacaagggccacattcttttgataaatacttattgggcacctactgtgtgccacacactatgctcagctctgcaggttaaaaaaaaaaatggaggccggtcacggtggctgacgccggtaatcccagcactttgggaggccgaggagggcagatcacgaggtcaggagatcgagaccatcctggccaacatggtgaaaccccgtctctactaaaatacaaaaaattaactgggcatagtggcacgcacctgtagttccagatacttgggaggctgaggcaggagaatctcttgaccccgggaggcggaggttgcagtgagccgagatcgcaccactgcactccagcctgctgacagagcaagactccgtctgaagaaaaaaaacgtggagtctttgggcatatattgtgcattgcatcttatctacagatgaacacaatttttgaggtcagagatgttttgtggaactttgttttcttctttgtggaaacaagaagtttggaccagactagcatttcccaaatctattttatcatttatccattttgaggacacagatctgagggacacagagtctctgggggtactaataggagtgacaagggggaaagtgttccattagccattgggtttgggaattcctgggtgaacatttgccacaggtgttctcagtcttggatgctccaaagagctcaatgagcatctaggtggttaggtcctgtgagttaccctctgggatatctaagggagtttgttcactgtttttctgacttcatgagtcctgtttggatgctgcttcctccaaggagccttctctgaatccctagaaggacctgagtccccttctgtgaaggcacctgcctggagctccctttgacttctgaatattttccatcttgggttgtagctgtctgtttccatcacttgattgtgagcttctcaagggcagggccagccgtgattcacttcttggttctggtatagagaacagaatgggtggatggagcatttaatgggtgaaaagatgagtgatgacttgatggatgggtggatagtcaaatggataatttaatggctgggtacatgtgtggagataagggaactgtttatgaatggataaaatggatgaagaaatagatcaatgaaagaatagatgaatcaatgaatgagataattaacaattgaattaatggatgagtgaacacatgaatgaagaaattagtggataaatggagagatggatgatggatggttgaataaataaacaagtgctggattttaaattgtgtgatggatggagcgggtgatttcattgttgaatactgtgaattactgatggatgaatgaatagataaatatataattaaatgaatgaattaatacataaagtgatggatgacttaatagatggctagatgaataaacagataaagggataaatgggtagatggattggtgattccatgagtgaatgggtgggtgtatggatgggcaaatggttggatggatagatgaaagagtgggtggatggatgagtgagtggacagaagaatgggtaaatggatagatgaatggatgggtgggtgggtggataggagaatggataggtagataaatgaatggattggtgggtaggagggtggataatagaatagatggatgggtaggatggatggatggatggatggataggagaatggataggtagaaaaatgaatggattggtgggtgggagggtggataatagaatagatggatgggtaggtggatagatggatgggtaggtggatagatggatggatgagtgggtggacggataggcgaatggatgggtagataaatgaatagattggtgggtaggagggtggataagagaatagatggatggataggtggatggatggatggaaagatggatggatggttagattgattggtggatgaatagatgaatgggtggatgagtggatggggaaataggatggaggagtacatggatggtggatgagagaatgaatggatggataggtaagttggatggatatacaggtgaatgcatgctatgtcataagatcggaactgaggtcaggaggcaggaaaattcctgtgttcctccctgatgcagcagtatcaagtttttgaagtttgaaagcttagtgaaaactttgagtcaaatctccagaaaattgcatatagacacaaaatgttagcaactttatgggagtggtggtcatggagcctaagagccacctacagacccaaggtgaggaatcccagtgcagtcttatgtattatttttactctctgagccctgatcttggagaggaacccaggcccagtggagggaaggcagctgagatggggacaggtagtttcctaaaggagaagacacttatgtattcattcattcattgcacaacattgctgtgacctttctggatgcctgggagaagataaaggtgcctctcataagtggcaagtgtttggagcttgaagtcagacagattgcatttttaatctcatctctgatatgtactggctgggtgaccttgggaaacttacttcacctctatagaccttctcttcttcatgtataaatagggacagcaataatgcctaccctattgggttgtgaatatgtcaacaggtatgtaaaacatgtagcccagtgctcagtgcatagtaaatgctcaataaatgtcagttcttctttttcttcttgcatgactactgttgtcttgcactgggcctatgcaagatgctgctgagcccgagatatccaaggcatcatcctggccttttgaagtgtccgcagtccatcagggaacacagacaagtaagcagaggtttccattcgcacagggtgttggggctgagatagggaatcctaagacctcatgttcagggtcatctgatcctcagcatccattcctattaatatctctttctagcaagaggctgcagagactggaaggctacacgccgcattccccagccttctttgcagcaggggctctgaacgctctgcaggtcccgccaggcagatgccttcctgtgagagtcaggaagtgggggccgccttgttttttcctgggctctctttctgctggtgagcatggtcatgggatggattttcttgcagcaaccttggcgtccggttaccactcttggggagtctagaggtaggggtggtggtggtggcttcctcatctccagatggctggatggtgctgtgatacgttctcaaagtctacagctcctctgtggcctcctgattccccaccatcctgagtggctggcagctctcctgaaggtccagttctgctgtgtggtgctggtgcctctccagcccttctagcaatgttgtgagtgttcaattccctgtgttggatcctttctgcttaaaatgcctggaaggaatgctgtctctaaaatccaaaacaaacacaaaatttggaagggtttctggttgccataactgtagtttgactcacacatggtgggaggcggggagcactgtaggacctcagcaggtacctaaaccagacttagggggtcagagaaggtttacgaagctcatgacatgtaaactgaatcctgaagggcatatatggagtagtcagacaaagagttgagtgggaagaacacaccaggcagaaggaatagcccgtgcacggctgggcacagtggctcacacctgtaatcccagcactttgggaggccgaggcgggcagatcacctgaggtcacgagtttgagatcagcctggccaacatggtgaaaccccatctctactaaaaataaaaaaattagctgggctgtggtggtgcatgcctgtactcccagctattcgagaggttgaggcaggagaatctcttgaacccgggaggtggaggttgcagttagccaagatcgtgccattgcactccagcctgggcaacagagtgagacccaatctcaaaaaaaaaaaaaaaaaaaaaaggaacagcctatgcaaaggttcagagatcagaaaagacatcgtggagaagtgggtagttcgggctggctggaacatacaaattgtaagggagaggtcagaggctttaaggctggccaaggtgctacacttcctttgaaaataatggggagcttctgatagtaaacagcagaaaatagtaggtgtctttcaggctcctgcaggaggctgaatttgagggagaggaagtatcgttgcagggaaagtagcgaggtggcaaggaattgcagccacctgagtgagaggtgatgagattgacctggcatggcagcctcagaggaggggagggtggatggatttgagggaggttgaggacgagactcccaggctttggtgaccaattgggttggaggcatggcggcgggaggctttatggatgatgctcatgtttctggctttggacgctgaacagttgtgcagccttccaaaagaagggagacaggcagagggacagtttgggggaagttgctgaacttgctttgggcatactgatttggaggatgcctgggggccatccaggaggaggcatcggggaagtgtacagacatgtggtcagaggctgagacaacagattggatatggacaaccacccacgactttggagaaaatgagtgaaatattcattcaacaaatagcacaggggagcctgagacacactatctgttcatgtctgaatacctggcagtgggccaagggcctggctgcttgttcaataagccaggaggaagcgctggagcaagacttggagggtgggctgggttctaccaggaagagacaggatgagggcccagtggtcaagtgcgtgaggcctgggtttaagtccagctcctctgtgtgttgattgcaggggcctgggccagatgttttccctccctgagcctgtttcatctgaaaattggttataagggacatggtgaagcttcaaagttgtgcttgtggaagcaggtagcttggagcatggagcggacttttgggggacaacttgggacacagagagtcacccacttcctggtgtggcagagccacgggggatggggagagagaaattaggatccgcctgaaaaacatccacagctgtgtcccatgtgagaaaggagacctcggctcccgcccaggctccctttcaccccccagcctgctggagctggcgggcgggggaatcatctccatggagtggaggaggggaccagatgacagaaaacttctccacgtcccttggagctgctggagctgggtcctggccaccgtcccaacccatagctcctgactcggggtcaggctgagatttgctccttctctgcctgctccattcagctgcagcgaacagaggctgcaaactggaggcctcaggggcccaatctggcgcccaagcctgtggggctttcctcagcccacatagaatttttaaatgaatgaagccaatatttaagaatctgtgggtactacataaaaacctgtgttttgattccctctggaaaatcagggcacggagcatccgatcatattgggccctgttctctagggaccaccatcaaccggagctgagaggtgactgtcttcagacaaggcatgtgccccagtccccaccactccctcttgtctctctgatgctgaggccaaggaatagtagctatttatcatcttaccccagcccactctgctcattttaaattcctgcctggtccctggtgacacagttttcaaccccagagccagtctctttttcctctaaaaccacccagactttggccctggttctaggcctgaattggcttcccaagaaccccagtctctgagctcctcagggtcatggtttacctttccttctgccccacaaggcccagcaccacccccgggggacgatgacgggctgagacttggctggtgttggggggccggctgggcctgtgggaggcagacccacatgtgctctgagatgtgtcagctgggcctggtcacactctctgcggctcatccctgaggcatgtggaaccaggcgctgtgctcgtggcccagccagggtggtaggcggggccaggcccgggacatggtgtatgtcaaggccacgcacaacaggcctgatgttccagccgcaaacacattggttggaaagaggaaaggaggagggagaggcagagccgctttaaagacagtacccaaaatacagaggcagaaagagccgaactcacactgtaagttgctgtgtgaccttgggcacgtcacctcacctctctgagcctctagcttaagatagaactaaggacagaccccagcttgcagcctcgtgggcatatgcagtggtacagtggctgatgtggggcctaatgcctagaagggcagcctggaatggaggcaaaaatcacagactttggggccagatgaggttgccacttgtgagctgggtgaccctgggcaggtcgcttctccatctgcatccccagggaaggtcctcaccaagttattctgccaaaaaaagaatccattcaccgaacaaatatttattgggcaattcctgtgggtcaggcgctggggacatggcaggacataggacggtcaaaggtctctgcccccgtggagttcacacttgtggagagagcaggcaatacacaagataaataagttgcatattgcatttgagaagatccatgctagggagagaaatgaagcaggaaaaggagatgggatttcaatgggcggggcaggaacagcctggtgagcaggtgacagctgacaacgatctgtaggaggtgagggagggagccgcggggaggggagagtgttccaggcagtgggaacggtgcacaggccctgagtgggggctgtggctgttgtgtttggggtgtagcaaagaggccagtgtgtggaacagggtgagcgagggagagagactaggaggacgtgagggccaagaggccgtggggggcggatcctgcagggccacgtgggctgttaaaggactttggctttttctctgcaggacatgggagtcatggagggttctgagcatagaagggacgtggtctgacttcagttttcatggatccctctggctgcagtggagaatgggctggaggggccagggccaggacagaggcaggggggatagtggggaggtgatggcaatagtccaccctctgtttagtgatcctggtccttccccgctctaaagccttcctgacttcccatcgcctctggacaaagctcaaactccttagcgtgacattcaaggcccgcttacctgactctagctgctccctgccccggctcctcactctccacagcatcccaaccagatatccttccttccctgctccacatgcggtccacctttgcccgtgctgtttcctctgccaggaatgcccttcctgtccccctttgtgacccagttcatgtaaggctgagtcccacaagctaggagatagaaaaggaaggaatagaggaaaggctgttcctggggagggtcagggagggccaggtttcggctcccctcttcttcctggaattcatcctccatggcctccgcagctgagggcaggctcaggagctgggagtggggctgtagcccacacgaccatgctgtgtgaccttgggcaagtcacccaccctctctgggccttggcttttctgctctgtaaaatggggaggatcctggagctcctcatggtggttctgtgcacccaagggctgtggcaactgtgggaataatggcatcctggggaagacataactgcacttccttgcccagccacgacaggccagctcagggtggccctgagctgatgctaggggtagcttgcaggaggggtgccctctgaagccctgagcatctccagttcagtcacccctgagtgacctgagcacctacagtgtgtccagccccagcactgtgcttgagcacggacagaggccagacagcctggtttcaaatcccagctctgtcacttcctagctgtgtgatctgggcaagtaatgtaacccagctgggccttggtttctcacctgtgacatggggacagtaagagtgctctcctcctgggaagctcaaagaagccagtgtgctcctataaataccatgctcagtgcgtggaggaagcagcttatcaaggccaactagcattttttttattattattattattattattattatcaccactgtcatttcctggctttgtggcctcaggcatcacttgcttcactgtgcctcagttttctcctctgtgagatggggtaatagtcccaccttcgaagagttgccatgaggactgagcctgacgcatgtaaatgagcctggagcagagtaggtactctgtgatttttgtttgtttgtttgtttgagatagggtctcgctctgttgcccaggctggagtgtggtggcaagatcttggctcactgcaacctctgcctcccaggttcaagcgattctcccacctcagcctcccaggtagctgggactacaggcgtgcgccaccatgggcggctaatttttgtatttgtagtggagacggggtttcaccatgttggccaggctggtcttaaaactcctgacctcaagtgatctgcccgcctcggcctcccaaagtgctgggattacaggcgtgagccaccgcgcctggcctcagtctgtaatttcttaagaaaaacatttcaaatgcagaatttattttattcactaccataagtcatcactgatatatgaatagtccctatgaaatcctttgttattcctctagtcagacaaatgctcgtttggtttaatctgacttaacaaattaacgagatgaggaagaaaattccaggccttgggacattcactgaagcccaaccaggcaccaagagacacatgtccttctagtccttctaatgaagagtggaggaagatcaacacgatccttatttacacttcaagtcattatgactctgcagctgggtgaccttgggcaagtcccttcccttctcagaccctgagtctcttctttcctaaaataagtgtgatagcttcctacctgccctgtctagctcacaggattatggtctggctccaagacatcacggctatcatttattaagtccctcctgtatgcaaagtccctcttcctgaccaccctgcctccttccaggagggaactggatgctgcttgttttcaggacaggacagtgaggctggggaggtggcggaggatgctgcccagggagaggaggaagtagggggctggggctggctgggctgacgcagctgtgatgtcagacacccgccacaggcagccggcccagtgctaactgtgcgctctctgctggtctggcctggcgcctgccccctcctccccccgccaccccccttaaccccttcccggcctcctcttcccagacggccatcccccaggcccagccttgcccacaagattcccagatttcacaactggggctggcgctgaatcatgtacagtaagtccggggagagaaactcccggctgcctggcgtccccgggacaggacagctgccaagcctgccctccctcccaggggcccaccggcagccagggatcatcccctctgggcccctgaccagctagggggtgatgggcgagacacacaacctcccttggctgtgccagggatcaagggaccgtgtggtttccagggaaccttcaggctctggagggataggggcaggccagggtggtgggagaggggtcgaagtggccttgtattcaaccacggcctgccaccaaatcactggtgacctggagcagtccctaactgtaactctaagttacggtttccttatctggaaagtggggataatcacagccctgacctcacaggtggctggaaggactctgagaagatctgtgtacagtgcttaccgcaggaagcgcccaataaatattattattattgttgtgacgtcgagctggtcatgacacgctttaagaccctggagaaatcatccagttctttggaggacgtctcccctgaaacacccacccctcccgctgtgatacaaattacatcttatcttttcaaaacttcttcagtacatcagcaaacatttattgagcaccactgtgttccgtgcctgctaccaggtcctggagatacagcagtggacaaaacagaaagacatttaaaagccctctgttctcgtggagcctgtattctagctgaggagaatcagacatttgaggtcatttcagtaagtgagcagggctccaaaggaaataaagcagaaggtgcgatggagagagcctgggaggtcccctctgatggggtgacatttgaacagaagccccaacaaagaggagaagcccacgtgcaaaggcagggggtgggaaacggtgctccaggcagagggaaccgcaggtgctaaggccaggctgtgggatcctcttgttgaaggctcagcaagggcagtgtggctggagcagagggagtgagtgaggggcagaggggtgggaggtgagcttagtggggcccccaccctggagcagctctcctaatgccaggctcttcctgaaagtggccacctggtgcctgacttctacctgtaggggcagccacctgacaagggcccagcttcttcccatccggggtcccaaggccccggagctgcctgctcacagtagaaagcctcattcccaggaaccccacggagggccaggctccccgcccctgccctttgctcaggctgccgctgggactcccctgcccctcccggaggatgtgaccctccctgcctctcagccgctcagagtgtgggcatctgcatctcggagtctcagtgtgcccacctgtgagatgggcaccatgttgcctcagggagggagtaaaaggaggaagggagctctggccttagtatctgtcccctgaaccctggaagaaggaaaacatcggggctcactggggaccaggctgtgcgttcatagctggacggagagctcaggcgtgtgtatgtgcgtgtgtgcatgtgtgtgcatctgcgtgtgtgtgcatgtgtgtgtgtgcacgtatggggtgggggagacgggggtggcatcaagacccaggagccacaagagtgaggaagagggaaggggtgggcttccagggacagggggcagtcagagcctggttctggcgcccaagtggggattggggcagggggaataagaggcctgccctccctcctgggggcccagcggcagccagggatgatttcctgggatgttttaaaaatcatttatttctagaaaagtctttcatcatttcccttcaggtcacggaggctgagatggctgacggggtaggtggctgtggcctgatgtgtcacttttggcctcaaactgaggcaatggggacgaagtggctgcgaggcgcagtatctggcatatgtgtgagaaacaaccacagtgccctggggaggggccacgtcctcaccccgcaccgccagggtctcagcgtgtctcccaaaggtcatgtgggcctttaagaggtggttgggtcctgagagctctgcccttatgaatggattagtatcattattgcaggagtggcttcatgatggagagagtggatttgtcatgaaagtgagttcggccattccttgctgtctcacgtgccacctcttgccatgggatgccctcgccatgggatgacagcaagaaggcccttgcttgagtgagcccctccatcttcggctctccggcctccaggactgttagaaatacatctctgttctttgtaaattacccaggctgtagtactctgttatagcaacacaaaacagactaagacactactatgtagatgaagaaacaggcccaagaggtgaggagtgttgtccaggtcttctggccagaggagcggcagagatgggatttcaaccctgggactgtgtggcttgtgaccactcctagcttcagccctgcccggtgctgaggggtttggggccagaacgatggccagatgtttgggcacactgggccctacccacctggaaagaggctggcctggggttgaatgagaaccagaagtgactcaggctaggacccctctgcaccctccctcaggccgtgggtaattacctgcccaggttaatagcgcccacttcccgccacctttcatcaaggctcctggagctgccaggcagtaattaaccctcacagcacccttctgaagtcagcactggaggcagacgtgtgatgaaacacgtttattacaggtaggtaaactgaggcagaacccattgcagcctgggagcctagcctgttgttcccctgtgactcagcagctcaatcaatctctgctttcttcccacaggaagcaccagttagcccagatgcttctcatctttggagttgagctgcaggctggagacctggaaggccctcgcagcgcctgctcccatcctctcacctcacgaaagcgcaggaatgtgggtttggagccaatgaaaagtactggaatctggctctgctctgtgaccctggacaagtcactgcccctctctgggcttcagtttcctccttggtaacacagaatgattatacctaccccttgggtttgttgacctgaatctacccctcagtcattgcctttccttcttgctgcagccacactggccccttgacagttccttgaacacaacaagccctttcccacctcagggcctttgcatgtgcagtgccagatgcctggaatgtccttccttccaatctccccatggccggctcattctcatctttcttggctcaaatgttacctccccaacctagacagcaccgctgccacctcttcaccccgtcttactcttcttcaagcacttctggaggtatcttgctatttatcttgtttatatctttttcagctccatgagggcaggggattttgtctgtttcattcacaatgtgttcccagagctcagcacagtgtcaggcacacactaggtgagtaagaaacaattgcttcctctacctcttcccctgctagccccaagttcagctaactggctgtgtgaccctggggattgcttttcacctctctggtcccttattctcccttgtggacaaaggatggcctgggcatgagtttcttcaaggactcgggtagcagtgaaatccctgggaccctagcctcagtacctccccaggcaatggggtagagagcaagaaggcaggtgagcaaggaccagcctccgccacgcagacaccctctttccggcttctctgtcctcctactttgccctgggtttgtggacttactctgggcagatctccacgaccaaccaccccctcccttggcatgtctgtcagcacccttgggggaaagaatttggaaaggggagggagaaaaagaaagcagggtgcgaggggctggttcccacacctgtgtaaataatttgtcatcttaaaatgctcaagtatgctcacctttaatgcctggttcttgggcttattttccttggcaaggcccccacgggagtggaatttcggccaaagggagcccagttgtcatcttctaaacatgttcccaggccgggggccggggagggctctggctgatgctccacttccgtccccagaagtgctggaacgttcctgggatctagggagctgactccagtcctggaagctgtcccagaattctggaatgttggaattcaaacggcctcctgcccattttccggaggaggaacataagacccagagaggggaaggggttggcctgaggtcatacaatgtgcagagacgagctagagtttgctgggagaaggtgcgggtgtgtggacaagtcagcatctatctcccattttcaggtaacagcacctcgacttcctactgaagaaccccctcttcccttttctcagtccatgaggctgggggtgcccagaggcctctgtctccaggggtggacatgtgaccgggtcttgctctagtgattggtccagggatgggcacatgactgagcctgcccaatgaaacttgatcttgggacttcagggttggccatgatttgtgaaggagatgccattttccattggatggacagtgagcaagtgaacgcttagagaagaagaggacaaaacaagggaaaagcctgcctgacaggaagcagcacagagctggacaggctttgaactcctggatcccactgtacctgaaattaggcaccttcaactttctagttatgtgagccactgtctttcccatttttggctgaaaacagttgggactggctttctgtcccttgcatacagaaggtgctgactgacccctgccccatggaagaagatactccaggcagaggaaatagtgtgtatagacacccctaagcgaatgccaagcggggcactcatgtaccaagaagaaggaggaggaggcacctgggagctgagcttaagagttagtcgggtggtcaaggtgggagaagggggtatctttagcagagggaacaaccattgcaaaagcttggaggggtgactagttagtgaagatcaactgtgtgctgagctcgtgttgggtggcaagggacacagacgaaaagggcacggtggaacccagctacttctcacctgctccagcgcagtgcaggcttgtctgcttttggagccgagcctggacacctccgtgtccttcccccggcagagtgctgccagcacgctgtctcagactctccagcatctcctggttgatgtgcatcatggggaccacacaagattattttataggctgcacaggcaaagcataaaatcacctcgggtcacatagcgagagttattctctctgcaaattctttacagtctttcctttatatccagaagagtctctgtgtggtgctaacttgcctcgaagaccaaataattgctagtctccctttgtgaaaaggagagcaggtgtcaggctcattcatgtctcaggcacacaattgtatctagctagacttttcaaaatgtcctatagagctgcagcacatatgaatgaggtgtccagctggtcccaaacctgtaatcggcaccccagtgagcagactggacatccccacccccacagctgccctttctcccctccactcatgttccctctagggccaccacgatcccgacttgtatcaccacagatgagtttcacatgtttttgaattttacatcttatctgttttctgttcctatacaagtttgccttttttgaattccatataagtgggattctacaatgtgttatctcaatttgagtctgttttttttttcctgctcagcatgatgtttttgagatgcatatatgcggttttgtgtatctgtagatggttcttttttattgcagaataatgttccagggtatggatgtaccaaagcttgttcatccattcaccagctgagggatatttggactgtttccagttttcagccattataaataaagccactagaaacatttgcaaacaggtttttatgtgaacataaatttttgtttatcttgggtaaatttctaggagtggaattgctgggccaggtggccaagtgtatgtttcactttatcagaaaccgctgagctgttttccaaggtgtctgtaccatttttcatccctaccagcaatgtatgaaagtgtcagttgcttcgtattctcaccagcacttggtggtgttagttttttgtgtgtgtacatgtgttttacttttagtcattcaaataggtgataatagtatctcattgtggtgttagtttgcatttccctaatgactaatgatgttgaacatctttgtatgtgtttctttgccatccgtatattttctttggtgtagtatctgttcaaactttatgtcagttaaaaaaaaagacccaattgttttcttcttaatagatttggagagttctttatatatattctggatactagtcaagcctttgtgaaatatgtgatttgcaaatattttctcctgttctgtggcttgtctttttattctttcaataggtagactttaataacatcgttttgttttctttttaagtatttttctggttatctttgatttgtggcatgtattctttggtttttcaattttagtgataacaccaaatgttttcttttaaaatgaatttatttaagtaaaaacgtcagtaaatttgaagaaacacattaaataaggaatagtagaagtggacagtagacagcataaaaatcgtgaaggcagtttccaatttgcataaccaaagtgtgggcagctccgattcgttcgtcaacaaatactgatggagcccccactgtccaccaggctctgagccaggtgctggggacacagcaccaagcgagatagttgtttgctcttttaatgctggtttttctccagtgagtctctcttcatctttcaaaagccaatttgaatgacccttccttcatccagaccttccctggaatgtttgtcacactctactgcaaatttctatttctgtatctcccaggcaaggggcatgtcgggcagcctctggtagggttgtagagagcttggtgcatagatatctcaataaatagcctctcacatagtacaagctatgatgaggtgctgaagaccagttgctgattcaattggttgaaactagccaggcctgatgaaggggcctgaggaccttccctgctgcagtctggctgaccccaagcaaaccaaagtctctccccttggcctcccctcccacataaagataccaagagaaaaagcctcccaaacccactgccttcagcctctgctatttgcttcccatccagtgcccatggatgcctttcctgcaagacacagtattcacacagacacttaccaggcatctttgttctgacctgccccaggaccaccactttcaccttggcctcttaccaccattcccctgttcctccactccagcacaccagccagtgtttgcccctccaacatgcccagctcattcccacccctgggcctttgcactagctcttccctagttctttgccttctctagctctccacattcagttctgaacttcactgaccctcctcagaggctctctaggctatgctaccaaagccctctctcctctttttttttttttttttttttttttttttgagacagggtcttactctgtcacctaggctggagtgcagtggtataatcatagctcactgcagcctccatctcccaggctcaagtgatcctcctgcctcagcctcctgaatagctgagactacaggtgtgtgccatcatgcccagctatatacatatatttttaaagtagggatatactcactcactgagctcagtatgtagctcaggctggtctcaaactcctgagctcaaacaatcctcccacctcggccctccaagtgctaggattacaggcgtgagccactgtgctcagacaccccatgtatttttgatcccttcattctgtttctgtcctttgtagcatggaatgctctcatttccgagtttatttgtgtgtttgtttgtttctcgccgtgtcccctgttggagtggcagttccatgagggatttgggtctgtccttctctctatctccccagtgcctagcacagtgttcagcacacagtcggtactcaatcagaatttgttgaatctatgagtgaatgaatgaatgagctcatgagctctcccttctccagatgcactcacggcaaagttgaacccatctatctgcccatgcgtcaggctagttgtcctgtgggcccctcctgggtgggtactgagggatgcccactgggtccagccaggcctgtgtcttgtcagctgcccaggctaagggactttccattgtccttggagttggcctgtggaaagttgttctcaggacctcgtgagcctggggccatggatggggctaaaggtaactgcaaggtatagggacccggcgtgaaattccatcagttaacactgtaagtgaggctttccagctccctttcgtcctccctgtgatgccaaggggagggagaaactccacgtggggcttgtgtgtcttgagcaccttcctaccacctgctttttcttcggaagaaacagagcagatcccaagtacaagccgtcatcggcaatagtagctggctttgtttcacttttttgtatatttcaccaattgtcttccatttgcagcaagtgccttagattgggtgcctgcaagcagaccttaacagaataaactgaaggcaagtagcctatttgggagatgcctccagaaagcactggtagggaagtgagatcagggaggaagggctgccaatctcaagagcgctaccaagccagtaaccacttaggcagctggggctcggtcctgctgtggcacgctgggagcccatgtagtaacggagttagccccccaggggcggagatcgggtggtcagggagctggggaagggacatgtcagctcctgcctatcattgcttgacagctgccgcttggagtgttagttcccagcacatccagcctgccccatgagcaaagctcacaggtgaaggggacaggtgctgcaggtggaatcctgtctgtgttcaccggagaaaagggagaggaggtatgggcagggcacagacaacaaaggcctcacagtcaacactggttcctcatttaaagccaggataaaatgagttcatttaaaattaagttttcgcaaacatttaaaaagcgaattgatggaaagagtaggtaatacctgcaggtgaaatgtgaacatggcaaatgctgctatttttcaaggcgtccaaagcctttaataggcaaacagtgttcttcacgacccacaagaatggcgtgtttggggcggtgaaaacactctccctttcctcccagcatgccaggctcatgctcactcctaacactgcccaggacccctgggagtcctggaaatgggccatgaggcttggaggcagaagccctgtgtgacttggggtttgtcccttaacatctctgggcctgtctgttaaaaggggatgttctcaagtcacataaaagagtaaatgtgcaaaaatagtcaaagcaatgctgaaagaagaactaagagagaggacttgtccgtccagacattagaatatatgacaaaggcatagaaataaaacagtttggtattggcatctaagtggacaaatacatcacgggaacagaatagcatccaggaattaacccggctatcacctggcctacctccactcatagatgtgaaaggatttagaaaagggaagagattggcaggcatgggattctctggattatgttatgtctgggctggtgaagaagcttccaacaggctccccatctgcagccctcccctctaacctaccagccatggcaccagggacactcactgtcatgagctgcactcacccccgctctgctctggaaatatcagagcctcccacgcaagatgggttagaccacagttgtcaccattcctccttttgcacttctctttgattcttctgattaacccaaggagaaagtctcaggcgggcgcggctggacttgaatacctctcccacgtttgctcgtctccctttatgaggcagagctggccttaagctcagggccttcagcaggcaggagaatggagcaagaatttggtaacgttcttttgtgattgttgttttaaggttactttctctttacagaaatgaaaagttgtttcctccttctgatagtaacacaaattttccttttaaaataattttttctaatccatattacaatgagaatgaacctccaaaacatgatgctaagtgaaaaaagccagacacagaggtctttttttttttttttttttttttttgagacaggttcttgctctgttgcccaggctggagtgcagtggtgtgatctcggctcattgcaacatctgcctcccaggctcaatgattctctcacctcagcctccccagtagctggtactacaggtgcgtgccaccacacctggctaatttttgtattttttgtagaggcagggtctccctattttgcacaggctggtctcaaactcctgggctgaagaaatccttccgcctcagtctcccaaagtgctgggactacaggcgtgggccaccatgcctggccagaaggtcacatattgtatgattccctttccaggaaatctccaaaataggtacatccattgagaccagtgaagaatggtggttgttaggggaatggggagcggctgctttatggtcacagggtctccttttggggtgatgaaaatgttttgtgattagctagaggtgatggttgcagaacacaatgcaaaaatgccaccgaaatgttcactttaaaatgcttaatatgatgctatgtgaacttcgtctcagtaagttatttttttaaaaaaccagtggagtaaaccaaaaaatcaatttacttaagaaaaggtatgaatggctttaaagatggcttttaagtgacgtgtgggagacagtggctaaggggatgattctcacccatcgtgagcctgggaccatggatggggccagaggtagctgcaaggtacagggacccggcgtgaaattccatcagttaacactgtaggtgaggctttccagctccctttcgtcctccctgtgatgccaaggggagggagaaactccacgtggggcttgtgtgtcttgaacacacattggcttataccttgctcaggcctggaaggccctctgctcactgacggaatcctatgcatccctgggaacccagctcaagcctcacctctacgggaagcccttcctgattacacaggtggtcaggcggggtcagtcctgcagcccttcagacccggttgtgaatcccagtcttgccacttactagtgggaggagtctcttaacttagacatattgtttgactaagagggcctcagtttccttatctggaaaatgggggcttatgatagctcttatctcactaggttgagctcctacatagaaagttttaggacagaacctggggagatgtagctgcccttcattcacacttcagtctgacactgatcacatcacagttgcattccttttcctcctgtctcctacactgtgggcaagggctcagcctttgtgatctctgtatcatgttgctgtacagaactcacacacagtaggcacccaagaagggcgggttggctgacgtgcagaggaactcccagaattccacctcttctctcacctccacggtccccaccctggtccagaccctgcatggcttacctggactattgtggtctcctcctccctggtttcctggcttctgtcctgaatcctccacctccaatccattccccacatgcagccagagagatcccgtgagaatctaagtcagatctcgtcccttctctgcctggaaacttcccacagctctcaccttgcttagaggaaaagccaaagtccttcccgtggctcatccactgtgggacatgccccaggtcctctctgctctctgttcctcctccccaaggcctcatccctacgacagtctccttgttgttgctccgacactccaggctccacctcagaacctcgcatctgccgttctggtttcctggagcacccattaccccacacggcccgctgctcacttcctcacctcctccaggcctctgctcaaatagcacctgctagggaagcttccccctgcttcccaggttttgctggactccaaagctcttttcttcccagaggcaaagcccttggctggggtcctgggcccagcccggtgactcaggcggagaagatgctcccaggcctcccgctggatttggggcccagggtcagccatgggggtaggcggtacctaggctgtacctggcgcagaggcctctgcctgcccctgccgtgggaggcagccctgccctgcacacacgggcttccaggctgcgggtgggaaagccccacatcctcctctgcttacctgactccagctgactcagacccccagccctggccagaggggagccgcagctgctccgccccttgatgggaagcagagctgtggctgtgagggcctggctgggccagacactgactcacctctctctatcccgcccctgcgctgggagccacgcctccctctggccagaacctcttggccttctgctgtgggagctgccccaggcggagtcttcccgaggggtgccttcttctgcctctgggggcctttctgttccttcaaggcccagtttgagggccatctcctgctaggaaacatcaaatgccctctggccagaaggggaaaaggatatgggagaggtaaaataatgataataataccagcaacagtaatgaaaacaactgttatacaagaataatagcagctagccatgctcactgtgtgccaggcactgtgctaaacacttcacattttaactcattcaatcctcacaatagtcctatgaggtaggaactctcatttcccaaggcacagagtggtcagtatccagcccaaggctaccagccagccagtgggaggaagggatgtgaatctaggcagctggacattgagtcgcattctcacccccagctctgagaaccgagtggaggcccccgaggctggaacgcagggagctgggagggaggggagccaggtcctgggctctgttccagtgcccgtccccacagtgggattttaagtctccccaggcagaggccagccccctctctccaggggaagaacctcccagagggagggccctgccgcagcacaggctggtgcttgttccctccattggagtggagctcagagcagagggtctgggcagtctaccaacattgcccagccccaagtgatgccagcccctgctctgggcagccaccaaacaggaattcacacaggtagggcagggaccatggcgtgggcacttaacccattcaccctgccagccacactgtgaagtggggacagtacaaacatccgttttacagaggaggagactaaggctcagggtggcaggacttgctcaaggccacagaggcagaacatggtaggagcgaattcaaacccaggattgttctgatgccacacggtcagagtcccttctactgggtggtgacacagcatctcagtgaagaacagggcagggtgggaaggagacgcaggaaaaagcctggagcctcagttcacatcaccctctccctctggccttccactaacctgaactcaccagtccatcttttcattcctttacccatacctccacctacctactcatccacacattcatccgccatccaaacatctctccatctgtccttccattattccatctatcctttccatccaactctcagccatccctccacccatcaagacttccctccacctgtccttctattcatccacccatccattcttctattcctcctgccttctatctattcaaccttccattcatccatctgtccatcagttcaaatatcatctatccacctctccttccttccaacctccaatccatccatccaaccgtccgcccacccattcatccatccactcatccacccacacatccatccatccattcatccgcccacccacccactcatcctcacatccatctacacatccattcatccatacagcccacaaatgtctatttgaatgacagctgtgatgcccaagccttggggttgccgtgccttgagccaggagaaacatgcctaattaggtttctgtttatttgttgttccaagaaggctaattgtgggctttgtaaacagccctttgatggctgaggagttactttaggaggacagttaaataaacaatcactgggtagaaaacagttagtgctggtacacggcgggtccggagtcatggcctgccttacagaggaggggtgagactgagttccagacagtgcagagctttgagtcagagtgatgggaatgctggcagtaacagctcatctgtgttgggtgcctactgtgtgccagatgctgtgccaaggggccctcacagcaactccaggtgatggcaaccattatggcaccaatttatgggtagggagactgaggctggggaagaggaagctgtgtgtccaggttcgcatgtctgagaagtagcacagccatgacactgatctagacctgtctctgtgcaataataatgataataataacaaataattacatggtacttactatgtgcccggcactgttctaagagccttctttacctgtaccctatgaggtcagaactaaacatcatccctgttttacagatgagaaaactgaggttggagacatgaagcaacttgctgagaatttgtaaaaattaattatctgggcctaaagtcttactcttgatcatgttattcagtggaatgcactttctatgcatttaactcagatccagccatacatgatctgccagacagttttaaaaaaataattgttcttgtactttatatctctaaaaatactacaaaattataacttatgtgttttttattacttgctgctgaggttggtaaaatgtttctgtaaagagccagataataaatgttttaggatttgtgggccagaccctctttattgcaactacttaactctgccgtggtgcaggaaaacagccacagactgtatgtcagtgaatgtctgtgacagtgtgccaataaaactttatttacaaaaacaggtggtgggtcaggttgggctcaaaggctgtagcttgccagcccctgactttgcagtacgcatgtatttgtatttaccaaaccatgttctctgcccttttatgaatgagataaaagcttttcaagcatgatttcaaccaggccatttcacctccaggccatttgctcaccacatgccctatacactgtttagcagtttgcccactattggcaattttggaaggaatttgcaaattacttgaattaacctgatttcttcatttgcaatatcagtaaattaatgacacctgtgaggggcactcaacttggccgtcaccccagcagggacactgaggttgcttcactccaaatctgtaaactttaagcttgataaaaaaaattgaaaagtgaaagtgaggagttctgtggctggggttctattactgttttctattggtgacaagaacaaggaaatgaaaggatgatatgggaggggtattacaaaatgtactcagggctagtgggaagagaacggagtagtgtcagaaagatcccttttccccgttatccccaccttcttcccatcagtgttcatttcccaacctcagaaaagttgtgagcctgggtaaaacagtatgtggccactccagagttaaaagacaaatggtaacctaggtaaaaatatttgaaacataaatgtagacaatgaatttatttccacaatatataaagagttcctgcagaacaataagaaaaaaaccacaaacccactagaataatgggtagtggatgtgaataggcaatttacataaaatacagatggcaaataaacatgaaagatgttcaaccatgctggtaatcaggcaaatgcaaattaaaacaacaatgcgagaacatttcccatgcctcaggttgacatgaatgagattggtgatgtaaagtgttaaggagactgggaaacggtcacaccgatatactgccggtggcagtgtaaattgaaacagcctctccggaagacaattttcacagtagccagtaaaactgtaagttcacatttttgggggaaacactgcagttccttgatgtggcatctcccttagtgaaacatccacacacaggcacagggagtatggtcaagatggtcactgggagcaacctaaatatccatcagttgaggaagggttaaacaccctgcagtggtctgaggctccccatcttttgaagcacagtctgcacacctccatcactgatgttgaacctgctaggtgctcactcttccaagcatcccttgcagctagggggtggtcacgtgacccaggtgccaccgatcagacgtgctcactgagacctggaagcagggatagttcaggggcagcagagagggcccaccgatccagtgttgtgtgtgatttggggtactgtccctgctgaccttaagcctggttctgcaatcctcccaggctcctcaaatcccttattttattttgaactttcactgaagtatagcacacatagagaaaaatgcataggtcgtaagcgataacttcatgagccttcataagtgagtacacttgtgtaaccagcccttcatcaagaaacagaatattccagttcccttaagcttcccttaatgccctcttccagtcacgacttccccgaggctaaccaaggcgagttgtgtctatttctagtgctttatataaatggaatcaaatgatgtgtgcttgtttgtgtctggcctctttcccttaatgttcaagtctttgagattcacccatgctgttgagtgtggttgcagatctttcattctcattgttaggcaaaattccatagttggagcagtgtctgagtgtgtctctgttctttcattcattcttctactgatggacatttgggtactttctagttaggggagatttatgaatagggctgctatgaatatttatatgtgtccttcttggtgaaaatctgtctgcactactattgagtgtagtcctctcattgggtcttatggcaagtgtatgtttcaccttattaagttgccagtgtcttctgaagtgcttgcaccattttgcatttctaccagtcatgtatgagggttttttctaaatgctccgtattttcatccactcttggtattttccatatttttcattttagccattctagtgggtgtacagtggttatctcatcaaagttttcatttgcatttccctgctgagcaaggatgttgatcacctctgtgtgtttattgatcctttgggtatccccttttgtgaaatgcctactcgagtcttggccatttttgtttattggattgattgttcttcccctcataaagtactttgaatagactgcttctctgtttaaattactgtatcagccagggctttccagagaaacaaaacctaacaggatgcgtgtgtgtatatctatttatatttaattcaatttttaaagggattgactcatgcaattgtagaagctggcaaatgtgaaatttgtagggcaagccggcagactggggactcaggcaagacttctatgatacacacttaaggcagaattccttctaccaaaaacttggattttgctctcaaggccttgaactgattgaatgaggcccacacacattatcgagcccatctacaaaatatcttttatttttatttgtatttatttatttatttttttgagatggagtctcactctgttgcccaggttggaatgcagtggtgcaatctcagctccctgtaacccccacttcccgggttcaagtgattctcatgcctcagcctcccgagtagctgggattacaggcgtcccccaccatgccgggctaattttttggtgtttttagtagagatggggtttcgccatgttggccaggctggtctcgacttcctgactcaagtgatctgccttccttgacctcccaaagtgttgagattacaggtgtgagccaccatgcgtggctcagaatatcttttttttttttttttttttttttgagacagagtcttgctgggttgcccaggttggaatgcagtggtgcaatctcagctcactgcaacctccgcccctcaggttcaagtgattctcctgcctcagcctcccaagtagctgggactacaggtgcctgccaccatgcctggcaaattttttttttgtatttttagtagagatggggtttcactatgttggccaggttggtctcgaactcctgacctcatgatccgcccgccttggcctctcaaagtgctgggattacaggtgtaagccaccagcccagcacagaatatctttatagcaacatctagactcatgtttgaccaaacaactggacactgtaacctggtcaagttgacacgtaaaatttaactaccacaattacccagagctgtttatgttgctctcaactcttagctctatctaatctactgtgaacatacatgcacactcacacacatgcacacactaccaacaacagtggtagacatttcattgtaagtgcacagaagtaaatatggaaggatgctaaactcattacatgacccccttggggaatgtccaggatggacatcaaaggggattttaactacaagctgtaactgtaaaaaatatttttaagaatataataatgggttaattgtataattaaaattaatatttaagtggcaaaacttttaaaagaaaaccaaaggagtcgttaagtccccattattcattcagcaaatatttactgagcacctactttgcaatagttgttggagacactggataagacagatccagtctctatcttggtggagctgacatcatagtcgagaagacaggcaataaagaagcaaacagggaaatagcagatgatttcagaaagtgttcaggagtattctgaaagcaagcaagccatgtgcaggggcacagtatgaatggggacagggttatgttggtgtgggaagtcagggaaggcctccctgcagtgatatttgagctgagccctgaaagaggagaaggagctggaagagcacactgaaagaggacaaggagctggaagagtggggaccaactcggtacatgcaaaggtcctgtattagtccattctcacactgctaataaagacatacccaagatttggtaatttacaaagaaaaagaactttaatggacttacagttccacttataggtctggggaggcctcacaatcatggcagaaggtgaaggaggagaaaaggcacgtcttacatggtggcaggcaagagatcattgcaggggaactgccctttataaaaccatcagctctcttgagacttattcactatcatgagaaccgaatgggaaagacccaaccccatgattcaattacctcccacggaatccctcccactacacatggggattatgggagctacaaatcaagatgagatatggatggggacacagccaaatcatatcaggtcctgaggcaggaatggaccagatgagctgggatgagaacccaagcaagcttctgacttggaaaccgaggctcagagagggatacacacaactcaaggccacagcactggacgtggtataactgaacgagaatccagctgtgtgctggtgcagagctgcctgtacaggaaggaggcctctgagctgctcaaagggctctatctgcactcccccacagaaatccccttatgatcagagccaaacattggagacccagcccccaggcttgtgccagccttgccctgccagccaaggccagtatccccactgaggggcatctgagggctctgtacactttgcctctgagttgaggatcaatagaagctaccactgctgttttacctaattatataacagtggccagggaggaaggtgtcagggatagacgctttaccggcaccatcccatcaaatcctgctaagaactccatgaaggggtattattattcccattttgcagttgggaacactgagactcagagagatcaaatgccttgacttcagaatctgtatttttttttttttttgagacagggtctggctctgttgcccaggctggagtgcagtgacatgatctcagctcactgcaatctctacctcctgggctcaagccatcctcccacctcagcctcctgagtagctgggattacagatacataccacctaaccaggctaatttttgctttttttttttttttttttttttgtggagagggtgtttctccatgttgcccaggctggtctcaaactcctgagctcaagagatctgcctgcctcagcctcccaaagtgctaggattataggcatgagctactgcgcctgcccagagcctgcattctttacctttacagtctagaccctgctcctatagatccccaggaaagagcaagaccatcttttttaaatgccagagcctcagataggaaaggatgatctcacccaggacttcattatacagataagaagaccaaggtccaaagaaggagaggaaccatcctctgactatacagagctgggtctcctgctcccagagcccctccagctttaccccctgctcccctccccttccttccattcatgatgacctcactggtctctaggctgtcgctccaacatgctgagctcaatcctgcctcagggcccttgtacttattcccctgccagatctagcctatcatttcttgtcttcattgaccactccatctatagtggctctgcgtgttgctttcctacctaggtttatttttattcctagcatttatcaccttctgtcattatattacgtatttatatagtttctttttgtccactacctgcctagaatattagaaccatgagagcagagactttgttcacagctgtatccccagtgcccaacccagggcctggcctccatgatgctcaatatgtgcttgtgggatggatagatgggtggatgaatggatggatgaataaatgggtggagaaatggatgtatgatatgagggaggaagggtgggatagatggatgaatggatgggtagattaatgagtggatggatagatggatggatgaatgaatggatggatggatggatggatggatggatggatagatggttggatggatgtttggatggaggggtgggtggatagatgagtggatggatggatggatggatggatggatggatggatggatggacagctgaatggacggatagatggttggatggatatttggatggacgggtgggtggatagatgggtgggtggatggatggagggaatgaggagtggatagatggatgaatggatgggtagatgggtgggtggatgaatggatcaagggagtgagagagggaagggatggatggatagatggatagaagggtatactaatgggtggatgaaagggttgacggatggaaggaatgatgggcggatgggtgggtgagtggatgggtagatgggtgggtggatagatggtgggcggatggacatttctcccagcgtcgcttcccatccctgtgctgtgggtctctcacgtggctgccctgacttgcctcccctggccccaagcccgagcagggagctctgggggcttccacatgattgggcaggatttctatttctcaccctcctctgaggctgggcagacaaaagcctttgttcttcctccctgcctggccctgctccagccagggtgggaagttgctggcaagtcagcaacttaactttgctgcaactgaactgaactttgaggcgtaacctgtcaagcgagccccggaggcttctgcggtccacaggggaggggcatgatggaggcatggtggggagcaccatggccaggcacagagatgatccctatctgggtggacccccaagtctcccagagtagattcattttttgaagcaaggaggggaagctaatagatgaagctggctctgggctctctgtggacagctggggacggtgtttctttttgtcctccagagttgttctgcagggtgaggggtaagaaagggggccgctactaagtgctcacggtggtcctgtgagggggtgtcacggtcaccattgcacagaggggaaaactgaggctcaaagagactaagtaacacgcccccaggatcacccggctagagtatggaaggcaaggtatggacctggacagtgtggctcagataaaaatttctcatgtcccatgtcaccccgtcacacttggcataagagccacagttcttccctaacactgccttgctggatgaactcaggtaagcctctttccctctccgggtcttagtttctctcctctgtaaaatgagaggcttggctgggccctaatttagatattgcaggattctctgggttactgggatcactgggttcaacttccataataatatgaagtctcaaagaaattctcaaattctctcacagtcctgtggccacacccgggacccacaggcccattagacagagcagcaaactaagaccctgactggcaccatcatttcctccagagccctagagtgtgatgggatcgctgtgtctccgcctgaaccctgtctggagttccaggtgtccgctttcccccaaggctgggcactgcacgggagagagagtcagagaaagcagaatcttgggcaggcgctgctgacccattgggtgggaggtctaagaatcaaggctgcaggatgggggatgaggtgggggggcccttttctctggagtgggaccctcccttggaagccaaactgaatggtcaaccattactctgctgggctgtcactaaccactcaaaaccagtggccacttgccaatcttctgtctttgtccagggcagaattgaatcttgttcaaataaactcaaaggccaggtagttcactgaagcaatgactggagaatttggcactctccagcctgccagccctacccaaacatcctcaaggtatctgcataaccagctcattgccctgcctactccaaccagagaatgtgggaagaagcccaggacctctgtgcggtggtggaggcccgcttggctgctcctgacctgtgtctctggcctcttcagcctttcctccaaattccactctgtgcacaagctgctggtcacctccctgcacatgctgtgtggcttctggcctcgggacctctgcacatgcagtctcctccactgagttctcccagaaacaggccctcagacacgaatttgagtgcaaggagtatattttgggtggtgatctcaggaagcacccatagcaggttgggtaatcaaaatagggaagaaagaaaataaaataaatgttattaaaccaatcaccgctgtgggcaactagacctcagacccaccagggaactctgggagacagcgaagagcatgcgcttcagtcattccaacccagttgcaagggaagagatcatgtatcttccgacttcccccagtcgtgagctgcgggctaattccaggggctagttccaactctctggaacttctagctgagcgtgcacccatggccaaatgaaagcacttaagcagacatctgcagtgagcgagagtgggcatctgtctaggggacgcgggccgggcagcaacagcatctgctacaaatgtttcctggttcctgaccttttgcaacctgactcctacctactcttcaaagcccatctcagatgtcaccccctcggggaagccttccctgaccctcctaaatcagtcaatcacttcatgagtttctaatatctgcatgaatcacagtggattgtaattgcctgtcccacaggggagtgaacaacttaaggtcaaaggttttacatcttgggcgttaagaacatgcatgtcacgcagtcttgagttctgctctcctggcccctctgaacaaactgtggtctcctatctgtccccagggcctggttgttattgggccctcagtgaacgtccagataaagggattggaatggcaatttcagctcattgacttttcctctttcccctgaactttcctggtatttccatgatggatgttgtggttcagctaatgggtcccgattctaaatcctcttcagaatcactaggatagcatttaaaaaactttgggggctggagccccatccccctgagattcagattccgttactgggatcactggcttcacctttcataataatatgaagtctcaaagaaattcccaaattctcaaccggacaagggcatgcagggagtgagtttgtcatgaagtcctacggggagagggccagagggcaggcagcctggagtccatgctgggagacaaatgtggaggaagcagaaattagaaattaaaagaaatgaactggacatatgggcagccacatggttagagcttaaaaacaaacatagaaaaaagggaacatggtggagcaatgttttattacaatacgatgtaaatggctgagaaccacaatgagactgtgccgtccttaggaaggggctgtcagactcagctgcccactagatttgcctggtaacccttaaagattcctatgcccatgcctacccccaaagccactgcagtggaatctctggggcgagatccagtatttttaaaatgcgaagtctgggctgagaactgcagaacacgggagaacagctatctcaattctttgtcctcagaggggaattcatcctgtaataatgttacaagggtaaatggaaaaccaactatatgccaggcactgtgctcagagctttgcacacattacctacccttgtggggagagttcttttataatccctacttcatagatggggaaactgaggcacagagtggtgaagtcggtgaccaaggactcacagctattcagtagcagagcaggcttgtcctcagtacccggggctgcaagtctggcaaaggagtccttggcacctccctcctgtgtgctccaaaattgctctctctgacgccctttgactcacttggttcagcaaccgcaaggagttgttgtttcccataaattcctcatggtctttttttttttttttttttaaacctcagcgcacaggcaaaccccacatcatgaaggctgatcggcttttgaaggcgagaccttcattctaaaggtcacagctgtatgagccgtgtttattagagcttattttaaattgctccctcaaccctgtgaaaggcgggaagtcttaaaattacttctccccaaaactggcgccacccaaccctggaagttctctgacttgtttcataaggaattattaattatgatttgtttttataattgtccacttggagtcttggatgacacacgctcagacttgcccatccttttttaaaagaaggaatcaaaagttcatggaaatcagttatatttaatgagtggaattacttgggctcagtcctggattaactgtgtgaccttgggcaaaccccttccctctctgagcctctgtttttctagctgtaggaggaagagtgtggattaatatctctcataggatttagaatatgtatttcctgccagtcgccatggctcacgcctgttatcccagcactttgggaggccgaggtgggaggatcatttgaggccaggagtttgagagaagcctggccaacatggggaaaccctgtctctactaaaaatgcaaaacttagccaggcgtgttggcgcatgcctgtaatcctagctacttgggaggctgaggcacaggaatcatttgaacctgggaggcaaaagtttcagtgaaccgagatcatgtcactacactccagcctgggcaacagagcaagaccttgtctcaaaaaacaaacaaacaaacaaaatatgtatatgtgtgtgtgtgtgtgtatatatatatatatacacacacacacacacacacacacacatatgtatatttcccagaccataaatatgccaggggtatatgaagaggttttaagttgtacatggatggacattttataagttgtattttttatttcaattcttaaaatttcatagtattacaacatttcatttgtaaatgcagacatttcttattgttaggatggtcaatgaggaggaggagctctgcttcatgcagtcagtcactcaggaatctgacagatgggggctcagtcatctgcaacaggtagcttccaaggtctccctgaggatcaacatccagccagctgccagaagaggtgatagaggagaaacccatgctcaaccagctcagccgagaatgacgtacacatcagttcccctcacatttcactggatagaatttatcacatggttccacctagatgcaaaggcagttgggaaatgtagtctcctgggtgggtgactgcttacctacaacacttaggaggaggagtatgagtctttggtggatccttggtcatctctgtctcagtattctctttttatttttattttattttactttatttatttattttttgagacagaatcttgctctgactcccaggctggcatgcagatagtaccatctcagctcactgcaacctcagcctcctggtttaagcacttccccctgcctcaggctcctcagtagctgggattacagaggtgcaccaccagttaatttttgtgtttttagtagagacgaagtttcgccatgttggccaggctagtctcaaactcctgacctcaagtgatccacccaccctggccttccaaagtgctgggattacagacgtgagccaccacacctggccagtaagttggcagcagtgggattcaaacccatgcctctgaagagactggagtcttaatacagtgccttagaccgctcggccaccctacctccgtggaaaatattattctctctttaaataaataagttgaaggacagagatttgccacctcacttctcaatgaattaaaatacaatatacaattttctataggtgggagggctcatttgatgcaatgctaaggtttactgttcagctgtggtaatcaagacagtctggttggcagagggacagatgcatgcaacagtggaacagagtagagaacccaagaatagacacgcacaaatgtgcccaaaagatttttgacaaagatgcaaaagcagttcaatggaagataaaaagccttttcaacagatcgtgctggggcaatttgacatccacacgcaagaaacaaagcacattgacctaaacctcacacgttatacaaaacttcactcaaaatggatcatagacttaaagataaaacataaagctataaaacatttagaaaaaagcaggagaaaatcagtcttcagaatctaaggctaggcaaagaattactagatgtgaaaaccaaaagcacaattcataaaaggaaaaaaattgataaatcggacctcatcaaagttgaaaacttttaacccatgagaggcccaattaagaggaggaaaagacaagctacagattaggagaatatatttgcaaactgcatatctgacaaagaactagtacctagaattcttaaaacttgacggaattctcgagaactctcaaaagtcagcagttaaaaaaatccaaatagaaaatgagcaaaagacacaaacaaatatttcactgaaaagaacatgcagatggaaataaacacatgaaaaaatgttcaacatcattagccattagggaaatgcaaattaaggccacaatcggatattgctacacacctatcagaatgaccaaaataaaaaacgatgggaactttcgcattcaatcactggtgaggaatggagacactagaacactcatacattcctgatgggaatgtaaaacggtaccgtattctggaaaacagttttttaaaaactgccttatgacttggcagttgcaatcctggacataaaaatgaaaacttatgtttgtgcaaaaacttatgctcaaatcttcatagcagctctcttcataataggcaaaaactggtaaaccacccggaagcctgtctatggttttttttaactaaaaaaagctgtgttatatccatactatggactgctacttgcaatacaaaggaataaaatattgataacacacaatttgaataaatcttcagagaattatgctgagtgaaaaaaaccagtcctcaaaggttacataaactatatgattccatttatgtaacattcttgaaaccacacaattatagaaatggagaacagattagtggttgccatggctcgggggcagggttgggggtgggagatgggtttggttatacaagggcaatgagggatcctcgtggtgatagaaatgtctgtatcttgactatatcactgtcaatatctttattgtgactgttaacattgggggaaactggaaagggtatatggactctctctgtttatttcttacaactgcatgtaaatctataataatctcaaaagaatacattttaaaaagaatatattatacaattttctatacccagacactactaaatataattatatctttggtaacacagacacactgttctcagataacggaagtagtgcggtgattatgtgtgtgacttgacaatgggatgggctgggttcaaatctcagctaccagtcccttcacctccttgggcctcagtttccacacctgcaggtgctgagcaatgagaggaactgtctcgtggggttgctggggggacacgatgacgtgattcatgagacatgcagagcacaatgctcacttgcagtggctgcccagtaaatgaaattgccacttttccgggctgtagaaaaggctacaggtagaggcaggcagaggattggacccgagagcatcctctgagagctctagattgggatcatgtctcaccagccagggggtttgttttgacttctttcttgcagggaagtgtctgctgagtggtccattccactcccctgagtttggcctggtcgcttcttgtctgccctctggaccccggtgggtgcaaactttcatgggtgtctctccacctggagcctgtggttgggactgctcaggtggggacacagcctggggggtgatcctctgtaaggcaaaatggagcaggagtggaacccatgcctactgcatacctattgtgtgccttgtgacttacgtgctgcagctcacggaattctcccaacaactttgagcagtaggtgctataatcactcctgcgtgatccagagaaaaccgagacttggtgaggggaatggacttgtccaaggttgtgcaactagtaggtggcagagctgagatctgagccctggtctgtctgatttaaatccagaatcattttcactgttgataataacctcaccacttattaagtatctactagagtaatcaatatgctagctctttccattgaggtatgatcacctttccattttagagaagaggaaataggggttaggcaaggtgcattgccaagatggacaacagctctcaaaaaacagccaaccttgcagccaacgggcagctttcttgtgtgcccccaaccccacctgtagctccagcccagctcagccaagatcactcaagctttgggacttttaaatgctgagtcagcaaacagcccctaccttgagatactctgcctaggcagactgtggttgtttgcacttcagcttcaggcctccagggtcagctgagatagcaagaccttcccctgggggctggatggggtcattgggagccactgagagaccctttccccacttggcctggcagacagagtggcagttggaagaggctcgaggtggctgtggtggtaacaacttccttttgagtaataacatttactgaaaagcaattctgcttttagcaccagaagttcaccatccttgcaagcaggcgcctaagaataccttcattcaaccacagttcagagattcacagacttccttttgcactccctccaggagagtttcacatttggtgttgagggaaaaccaaataccacaattattggagggggtgggaggggtgttgagagggaggtgatgcgaaggaggccaggtggcatcaaccacagcccccaaggcctcacaggcagcctctgggcagcggctcagcctctcgccctcagttactggaaagacagcggacgagctcataatgaaaccgacaggctgacaatttatcttccttttacaagaaaaagaaagtgattgtccttcaaacaagcatgactttggaagccagggacttaccctggccactctgcaaattagagacagagccaggctgctccagaggccccgagcccctgcctgtcacccccaattagcgctggagttctttaggctcgttttttctattgcccaaaatccagtctactggggcataatggggacttatggaaagaaaaaaatccaatctgcacttgggaggggatagccttaaatgttaggcactcaccgcaggcagctgggggtggctgagggcaagggagaaggcatgggtggggaaggaggggatgtgccaggcagagccaggaggctccaaaaagcagctctaaaaagctctccccctcccagcaatccagcctcctgactcacgccagacacagaggcagctgatgggatgggaagaggctggctttgggagccacagggatgtgggggcaaactccagctctgccacttgctggctgtgtgaccttgggtgggtaacttcacctctctgagactcagtttcctcacctttaagatgaggatgagtataggaggtcaggacatgaccttcctgtgctcaaaaccctcccacggctcccacctcacttggcagaaagtcaaagatctctgtggcctaccaggccctacaagatctttcccatgcttcccttataacctcatctctctctctctgtctctttttttttttttttttttaagacagggtctcactttgtcacccaggctggagtgcagtggtgccaacacatctcactacagcctcaacctcctgggctcaagtcatcctctcacctcagcctcccagataggtaggactacagacacatgcctccacggccagctaatttttgtattttttgtagtagagatggggttttgccatgttgcccaggctggtctcgaactcctgagctcaagtgatctgcccaccttggccttccaaagtgcttgggattacaggtgtgagtcaccgcgcctggcccatctcctcttactcactctctctggttccctctacccctgccacactgggctcctctttgttcctccaacatgctaagcacacgcctacctcggggcttttgcacacactgtttccgctgccttcagcatccttcctccagatagccacagggcttcttccctctcctgatctgggtgtctgcttaaatgaccccgggggtcctgctctgacccccggcccttccaaattgctcccctggccttacctcttcaccctgcgtgaatgttttcccataacactgaccactacttgacacaataatttagggggttcataactccccattggccagactgtaagctcccagcaggcagaggccagttctccactgtcctccattaaatctcagagcctggcacatagggggcactcatccagcattgaatgaacagatgcagggttttgtggtgagaagggaagaaggacgtgtgtggcgggttcagcaccagcccagggtgcgtgctcactgtcacttcttctctcctctgcccagcaccagccccatgtcatgtgcttgttgaattcctacaatggaaggatgcattttacagatgcaggaatgagaccacagagcccaagcgactgtctcagcccgcagcggggcaaggctttgaattctggtctgcgggtctcttggcctccaggacaatggtgacagtgtccagtctgacttggggtctgggtgagagaaatggctggtggggccatcagactcttgagaagaggccctggctttgaggatctccagccgacatctgggcttaggactggggttcacgccccgtcctcctgtcccacagtcccacattctgccccaaagcagaatgcaagccccatcaaggaggctcagggtttccagagaggggcttcctcaactttctgttgctggaaagttctgtcccagaaagggcagacgcttgaggagctcctggatccggcagaaggctctgagactaggagacccctggtgtcctcgctccccggcaccccgccagttctcgaatacaagggactttccagagaagtcagcctcctggctgcctccaagcctgcccaggcctgcaggcccaggtctccatgaagctcagtcctgcctcggtttccctgtttttaatttcttggagaggccaaggagtttggaggtgaacagcctcatacgagcactaatttcccctaggcctggggcataggaattttggagccataaacaggcttctcacagcccccatgatgagtcctccccacactccatccaccctggactctgggctgagctgggcaaggagctggtctggggtgggctgggtgttgcctgtgggtgcggctcagagctgggggcgctacctctgcccttctgtcccccatcagagctgccccagctgtatgagaacccctcccacaatggctacaacagagggcacgcaagtgagacgccaggaagaactgcttcagcttcgttatcctcaaaggtgttcgtacccatcaagcctcctagagcagacctccatgacagctgcccatgggacaggtccactctggagatatgtttagtttggtccttaaagtatttttttttaatgtgaatcaattgccaacatctgacatgccaggagatttcacataaagtccttttctctggcttctcttgaaaaatgggaagatgtggccatactgggcccacattcctactggacacaggaggcctgggagtggggttgcgggaggccctttcttagtggcacatagtaggtactttcctgttcacccagtccctgcatgccccactttcctcatatcatttccttgccagggtcttgaagtatgagtaggagtgcgccagaaaagggcagtggaaaagcgttccagcaaaggggaacagcgtgagtcggtgagatgcatctgttcaagattcactcgacaaatatgtattgatacttactgtatacacagggacatacagcaagaaaccaaacaaatcaaaatctctgccctctggttctcagctagaggtggttttgttccccatgggacacttggttatgtctggagatgtgtgtggttgtcacagctgggtggagggagggtgctatcagcatctagtggggagaggccaaggaggctgctgaaccaatcctacaaagcccagggcagccttcaggtgcagaatgatctggccccaaatgtcagtcaagccaaggtcgagggaccctggtccgggggcacagacaccaaataggacaagccaatgaactcaaaccgtgaagccagcagctgatgagcactttcggattaaatgagccggagcatggtgagagggatgcagaggggtgtggctgctcaaacaggtgccgtctgcacaggggcaggtcctgaaaagattgtggcactgctggcagggtggccctggcattgtaggtgttcactgagtggcactttcttttttccaccctgcctaatcttcatgacgtccttgctgtggagcagggatctgtgttcctgaccgggcatcgcaagccgttaagaggctgacccagggctcctgaccactcagtcagtgtccttgtgctgcctggaggtagtgatggtctctgaattgcctcctgtcattcagtcagtcaacaaacatctaacaggagcccattggggcatagggggagggagcaacttagggtgaactgctcagcttacaacatgtggtaggtacgcaggaaagactggtgaaaggaatgaaaagaaagaataagtgaataagcaagcctcaggccattaagacaatgatcatggccagcattgattgagtgcctactgtgtggcaggctcatcctaaaccctccatgtgagagtcttacagaaggaacacctctgaaaggggggccaacgaccatccccactttcaaggtgagaagactgaggggaagagaggtgatgtcaactgcccgaggcctagcaagagaatggcaaggctgtcgccggagcctgggcctaccagatcccagggtgcacctgctgcctcagtgttgtgtatgctgtggctcaaatcgttatgccaccggccctgtgagggaggtgctagcattatcccatgttacagatgaggaaaccaagtctcagagacaggaagtgacttgcccaaggtcacacggcatgtgtgtttgaatctagatttcacgttttcagccaccaaaccctgcccctcgtaagccctggccgctctgtgaggaggatgcgtaagtcccaaggggttggggagggaaagtgggccagggagctaagccctccagggtctgcaggaccaggcaggaggctctgaaggaggcagggtccctggtgggcagatgggagcaggtgggcctggggagccgccagccttccgcccccacgtgcaggcatgcccgccaggagggcctgtggagaggccgccccgcggtgtgtgccaggctgacaatggctccttgtgtctgtgccgacggtgggagaggggaggtattgtttgccaggacaccttcccgccaaggctggctgcaggcggtccttgtcctaggacgcttggcacggggctgttccgggcgccagagggaagtgtgtgtgtgcatgtgtgtggctgggtgttctgggccacgttggtgctggctgcggctccctgggtgtgcctgtgcacgtgtgtgtggggtgagggcatgtgtgtctatctgagtgtgcccatgcacgtcttgcacacccatggccagtgtgtctgaatagtcttgtggcttggggcttccatgtgtctccctgggcgtggctgtggctgtgactttacgtctggcaccgtgtgtctctctgtacctctggaccacgtgtggctctgagcacctttggtttgcgtgcccatgtatgtctcagcctgtccctctgcttgtgtctccatctccctcggggtctgtctgtggagcatcttgatcccaagggggcaagaaagcctctgtttcagagtgcgggctgagttccattcgtggctgataggtgagggagggggcttcaggcagagggaatggtgggtgcccaagctggggggcaggatggagttggcagatctgcaagagcagccaggaggctgggtggccgcagtgaagtgagtggaggtgagaggacaccaggggccacctgcaggccagagtccaaagtgaggggcagccatcagaggatctggatgggaccatgacatggtctgtttcatggcaacgcctttggctgcaggtgaaaaatgggttgtagggcaagcctgagaggtgttgggagtcgctgtggccagtgttaggaagcagttccacagcgccacctcaaggaacccccactccatggcaggggttgcaacttccccattttgcagaggtggaaactgaggcccagggaggagaaatgcctcccaaggcctgcagcctgggagctggcccaatgctaaagccaaccctccacctcctccatcttggctgcctgctcctctgcaagtcgctctgcatcttgaggctctggtgacgcctgtgctaaagtcagagaacctggagtcctcgtcaggtcaggaaccaggactctggagccagatgacttgggttcgaatcctgcctctgtagctgtgtgaccttgggcaaatcacttagcctctctgcaccccagtgacctcattggccaaatgggagtgcttgttcatcattacctccaaagtgctgtgccactagatcccacctgtgacagccgcatctcctatccctgctttatttttctccaaaacactcatcaccttctagcatactacatcttgtatttacttccgatgacactggagtgtccgttccacggcattttgggttttttgttcatgagtagtgtctagaacagggtcctgcacatagttggtgctcaggactattttgttgcaagaaccaggtaatacatgtgacatatgggaacacagcctggcacgtagtgggtggaatggaggtgtctgctgttgtcattaagttgggagtaggcacttggaagcaggacagcccagtcaatcctgattaggaatgggtgtcccatctccttttctgcacatccttcttgccttcaggacctgctcagcccactctgggccagacatcttttatattggtctctgaaaatagggagactctggcaggtgctatgagctgctggtttcaagccttatgagggatcagtgacccggtttccccacctgaccacagctgatccagaggcttcgatggtctctgctctctcaggactctcctctgtatattcccctatatatatattccccctgaccaccccactgccccagatcttcccagtccctctgtcggtaaatacagttggcagctctggcaaaaatgtcctgccaatggtacaacgagtcgttggtgaatatttaggaagcccagcgggtttgtcaaggaagcagcttcctgagcataaatatttctaagaaagaatgaaaggaggggcctcggcctcagagatcagtgggtggtgtgctgacctcccaaggtcatcatgtccagtcctctgctgcatggtcattgcttctggtgtcccattggcacctggcatcctggtttcctgagaagggtcaggagctgcagggggaatccaggcccaggcggagaacaacctgctctgtcctctcacttccttcctgcttttcttccagactcccatccctggctgggacatgctgcagttgtcagcagctgcacaggagaagcaggttgggggctgaccagggtagccatggcttccttgaggacccactgtggtgtgggggctttgctcagcgtaactggataaacttggtatcggccctcccctcctgcagctgccaaggttcaggcctcttctcccattcctctctccaccccacatttattgagcacctactatgtgcccagccctcggagacaatgaaaagacctctgccctacctttgccctggttctgatgtccagtatctgtcctgggacagttgtgacagctgctcaattgtccctttcagtctctccctgtcccagcccttccccttccacaacggctgagttcatcttcagaaagtgcaactccagatcttgcttctgctctgctctaaaaccatcaatggctccccgctgcgacctggagaaagtccaaacggcccggctgggtgagcctggtcctgctccatctaccccaactgccctctgcagcttcgttccccacgtcgccagccacgaggatgacccctagtttttcgaacacacctggcccctcccacctccttacccttgctcaagccattcctgccagcccagtgccctttctcagccaacctctcgtgtctgtagccttttgtttgtttctttctttcaggacacatcacacagtgctttgaattgcacttatttatatcttcttttcctcccagagggcaggaagttgccagattcatttctgggcttggcgccaggctcaaagtaggtccttgttagattcgctggctgagctggtgaggatgctgtatttgcgcgggtctggggccacccagcacatgtgtcccttcttctggagaccacgttgagtttcccctgtggtgcctccacccccttggtcttgtgaattaggagagttgaccccatccatcctcagggctgcaggcctggccagtcaggcccctggccacatggattggttcaggggtaagcacacgatccaatcagggccaagaaattaaaccggcgactttggaatgggaaagacgttgccgccttgaggtggctgagctcgttgtaggatgtcagcctggagcagctgaggcactgtgccaccctgagaaacagagaccgcctgagaatgccagtgacatggggcaaagcagagccaagaggcgcagacagcccccagacgaaaatcgtcagcggtgctcctggatccagctgtatctgaagcagacatggctctctcattctccctttttaaaacccaccttgggttgggtttccattgcctgcagctacaagaaatcctgacaaatagctgagccttctgaatatacatctcatcaccttactgtccgcactgccatgaccccatgcgaaattctctcatgaggaacccctttgaatatccaaagctgggggaggcgtctcttcctccacagagctagtttcttttctcactcatgggcaatatgagcaatgatcgctggttctggttgcctcaagctccttttggaataaggaaaagagcaagtggaataacctaaaggactaaaatgggctcgagttcccaggggctaaggctgggccctcagccccactactgttcagcatggacaggcacacagcagatgcttctcggccattcactgcttgacagtgcaaggcaagctttctcaacctgggccctcgggcattctggactggctgcttctctgtgaaatacgccaggtttggttaggagcgagttgcccagtctgtgttctactgacatttagtgccaaataactcctggttgggggctgtcccatgcattgcaggacttgtttagcagtgtccctggcctcactacccgctagatgccagtagcacctccttccctgagttgtgacagccacacatatctccagacgttgccaaacattccttgcagggcaaaatcaccccctggttgagaatatctgctgtaagcaaagtgtgtctcacaggacctggcacatagcaagtgctcaataaatatcagcaaagatggttcggtgacgatgatgctaaagatgatcactgaggaaatttggggcctcagtgagatccagatttggctgacttaagtgggaaggaaatttattagaggaacatgagtgagcttacagaatttatgagaaagcggaagagtcagttcaaaacaacccagaaacggaggcagttcagtaggtcccgacagcaagaagcagatatgctgatagcggcaatgagctattcccgtttcagccatccccccacttcctccttcctaacagaacctattttgctcattttgcacaagaaatccctgcccccacccctcccatgggctccaggaagatgggcctcagccaagcctcaggggactgattcccgttgctctaagtcagccacagtgtcccccaccccaacaaggccagtgattgatttaggctggacatggaatgtgattttagccaatgagatgtgttgagaaatttgttagaggcttctgggaaaggtttccttgctcttcgagatagaggtttatttcactttgtataatccaggttttcttctttttgaaggctgaataatgttctgtggtttttttttttttttttttttttttttttttgagacagtttcgctcttgttgcccaggctggagtgcaatggcgcgatcttggctcactgcaacctctacctcccgggttcaagcaggccccatatgtgtggcctgtgcagaaagagactggcagcctggaggggtgagacctgggtggaaatgaagaattcaaccaaagcaagtaaagaaactgccagaagcttgagcccccgagaagctcccgatgtctgggggtaatcccaggatctccatctttttttttttttgagacggagtttcgctcttgttgcccaggctagagtgcaatggcacgatctcggctcactgcaacctctgcctcccgggttcaagcaattctcatgtctcagcctcctgagtagctgggactacaggcgtctgccaccacacccagctaatttttgtatttttagtggagacgaggtttcaccgtgttggacaggctggtctcaaactcctgacctcaaatgatccaccggcctcagcctcccaaagtgctgggattacaggcgtgagccaccacacccggccggatctccatcttttaaaaaacatgactttcttctctgggcaggtgggaggctgagggacacctcagcgttaagccaaaaacagccgaggcagcattcatgcctcctccttccaaaggcccccatgtctccaggggttgggagcctccagctctaggctgcggggatcccctctgccattcaggcccagcccctctacactgggccctgagcatgtacctggctcccccagtgtacccgagggccttgctgtcaccggatggattgagcaactcaaccgagtgtgcattttccagctcaggctaaccaccattcagtcacttcccctcacgttcatagaccagttggttccttgtcatttctcaggggacaccatgacccttcttgtgaactctccatgatgcaggcgagaatctgagtcacccagagctagcaacctgattcacctttgtcccccaaacccctggcctggctctcagatgaaaacaaataataataataataatgaatatagccactaattcctacagtgtcctgagagctttacaggtacctgcactgactttcaggtaggtacatgcttgtccccatttcctagatgaggagactgagtcccagagaaggtgagtaacttgcttataagggaagaaggagtcgtgatctgaagctaagcaatagggtggatacattcaagcatgtttggttagacatttagcaaaacacctttgctgaaaaaaaagttttgaaaaaaagttatgaaaaaaaaagattggaaactctatttttaaatgtatcaccagcttgggaggccaaggtgggcggatcacctgaggtcaggaattcgagaccagcctggccaacatggtgaaaccccgtctctactaaaaatacaaaaaaaaaaaaaaaaaattagccaggcgtggtggcagacacctgtaatcccagttactccagaggctgaagcaggagaatcacttgtacccaggagatggaggttgcggtgagctgagatcacaccattgcactccagcctgggcaagaagagtgaaactccgtctcaaaaaaataaaaataaaaataaataaatgtatcaccagctccatccattcatcagacacatgtttccatagtagataccttgtgcctggaaggttcttcttacgagggacatgggagtgaacaaacaggtaaggtcccctcccccctggaacttgtagtccagtgaacacaatcaatccatttaggacttgaacatttgaaattgagacttccctgtacctataattatcagaactgtatgagatcctgaggtggaaagatggtgacttctgtgggcttttttgctcaaacacaattctttaagaaagagacctgcatctcgggctgcccaccgcagtgtgaggatgtgagaaagacccagggacctcacagaccatgtgatgtcacagaaggcacaggactgccaggtgcagtgggtcacactgtaatcccagcactttgggaggcaaacatgggggtgtcgcttgaggtcaggagttcaagaccagcctgagcaacacagcaagactctgtctctgcaaaaaaccaaaaaccaaaaccacagggcggggaggtcagaccagctgcctggaatcccagcccagaccctcaccagcatgtgacccaggacgggccacgtgctgtctcctcaggaagcctcaattttctcatctggagacagggacaatgaatcccttccaggatcactgtgaaaagacaggttgagcatctctaattcgcaaatctgaaatccgaaatgctcccaaatctgaaactttctgagtgcggacctgatgccgtaagtgaaagcccgcggttttctgttgtcgctgttgtttcacggctgagccccctatctgctgatatcgctgttctgcttggtcgccctgaactccttattttcccactgtattaatgctatgtcatactttttaccatggagtacttatgtgtgagtaagtgtgagacaatgattgcttattgatagcatataaattcagagtcaggaataagggtgatgccaaacaaccacagattgtccacgtgggtaactgagataggtgtgggacgcctttctttctgttggtgcgatgcacacaaaatttgtttcatgcacaaaattattaaaaattatgtacaattgcattcaggctgtgtgtataaggtttgtatgaaacataagtaaaggtcatgttcagatttgggtcccatccctaagatatctcattgtgtatatgcaaatattccaaaatttggaaaatataaaaatccaaaagacttctggtcctaagcattttggataagggatcccttagacggtaccctgtgtcaatgtgggatatactatgtaggaaaatgtattcgtggttcaacccccagtcggcctgagggaaagtcgattccagaaaggccaagtgatgaaagttcttcatctttgtggacctcatctgggctcaaacacatattacagacctcagtgtcaaaggagccctgaagtcccttcaacaagggttggctgggtgaggactgtggcggcctggagggtagctgcgactcagcctccacggggaacgcatcccagtcatgccaaaaagccatcttcctcaagagaagccagagatccagattttgatagaaactctcccaatttttaggccaggcgcagtggctcacacctgccagcactttcggaggctaaggcgggcagatcacctgcggtcaggagttcaagaccagcctagccaacacggtgaaaccctgtctctactaaaaatacaaaaaaaaaaaaaaaaattagccaggtgtggtggcctgtgatcccagctattcgggaggctgaggcaggggaatcccttgaatccaggaggcagaggttgcagtgagctgagatcatgccactgcactcctgcctggacaacagagagagactgagtctcaaaaaaataaaaataaaaaaataagaaactgtcccagtttttaaacgtttgccactaatgacggcaaagcattggcctgccaccttgcaccttctgggatggcaaatgatcaaaaacacagacactagcaaatgttggtgggggtgtgagcagctagaactctcatatcttgctggcgggattgtaaagaggtacagccgatttggaaaacagtccagcagttccccaaaagtgtagattgagttaccacatgacccagacattccacttctaggtatatacccaagagatacagaagtatatgtctgcgcaaaaacttacacacaaatgttcacagcagcacaattcattacagctgcacagtgaaaacagctccaatggccatcactggatgaatgggtgaaccccatgtggtgggtccatacaatgggatattagttggcaataaaaataatgaacgacaaactcatgctacagtgtgaatgaacctcgaaaacgtggtgctgagtgaaagaagccagacacaaaaggccacatagggcacgattccattcctaggaaatgcccagaagtggcagatctgtagaaacagcaagtagattggtggtttggggaggctgggatgagggcatatggggagtaggcatgggatacggggcgttttggggaggtggtgaaaatgttctaaaattgattgtggtgatggttgcacaactctgtgaatgtacttaaaaccattgaattgtacatttttacagcgcgaattttatggtaggtgaattatattttgatagagctgttaaaatacaaaagtgctggcctaacagagccccttggtgggttagagtcaaccactggccacgctttttccattccttgattccagaggttatcctcagttatccggaaacttcagccacctggaacaccggttcctgcgcatgaggcgggactgtcccagaaggcagagtttccccatggggcccagcagtgacagagaaacaccctggaatgggaggtgaggggtgttgctgctgacacttgcctttttgcttttttgtaaaaatcagccattaaatgtaggcagagaaaggctctgtaggtaacttctagccccagacaagaaggaagtggagtgggtgagctggtgggaaaacagtggtgggcagaggccaggtgaggccgtgcagatcctgggtggcctgagaggaggttcagcaggacaagcgctgacctgaacgctggctggttttgccccttcgcccatcagccagtggcttagcagctactgcatgtcaggcactgtgctgggtggtgggagaatgtcacatgggagcgtcttaggaacatccacacaggggaaggagctggagagaatctgggaagacctctccggggaggtgacatttcagctgagacttgaatgaagtgacatccggggcaggggatctgcgtgggggacaggaactgcaagtgcacaggctgtagcgtgcctggccccagagaaagaggctgcggagctgcagccaaggggaagagggagacagggtcggttaggaggtcagggaaaccacgagggaggtcccagaccaggcagggccttgcgggctgttgtgaggactttgactttgctctaaaagagctgggagccatgcaaagctctgagcagagagtcctgacctgacctcggttctaatagtagccctccagcccaaggggagaatgggttggggtaggggcggagcagggaggccaggtgactgcgggaggccagaggggagcagggaacaatggctggtccagggtggtgcaggatgaggtgggagaagatagtcgttgttttctctcactgcacaatgtacctgctgtgcagagatacagggcaggtgaaaccggagattccacacatatattagacacacacacgcacacacacatacactctcatatatgtcctgtgtagatatggatcctatgcacatatttcacacacactcatatatgtccacatagatgtagattctatatgtatattatacacacacatatatattctaccttcatataggttctacacatatattacacacatttatattttgcatacatatagatttggcacatatattagacacacattcgatattcatatagattacctatagaatacctacttatttgcattctatttgtatgtgtggattcgagacatattatacacacacatatagactgcatacatagagatttgacacatgtactatacacacacactcatagactctacatacacatagatttgtcacacatattataaaccaagttgaccctgagttctggcagccagggtctgtgaacttggctcttggaaggggctcagctctggagttagggagtgcaggatctgctgcttagagctgtgggattcaggctttgcttctctgaacctcattttcctcatctttaaaatgggatgacaatacctgccttgcagggttgttgggaagtcttggtgagatcaccatttatgcaaagcagctgatctgctcgggaagactatttaatagcagtcatcacactaataacgaggtgtgttttggggccaagcaaaccccacggagcaccttcctggaacacaggtgtgcaccacgcctacacgccctctctcctgctcagccagaatgggaaaaggagtaggcctggggcctctgtttgggaaggatggaccaagaactccaatggaaacctatgagtcagcaacaggcataaaacagttaatgggtgcgccgcttcagctacagtaatgatggggagatggaagcctagataacatccagaaggcaggtggattagtcagggctgtctcagttgcaaggaacaaaaatccaactaaaaccagtttaggtgaaagataatttattgggtcacataaaaaaattccagggaggcttgcttcaggcatagctagatccaggtgtttgaatgatattgttttccacgtctctctggaagactgagttaatcaatatatatgaagcaccaactaccacacctaatgctcagtaaatactagctatcattttattactacaactgctgctgctactgccactgtgactacgactcccactgatactaatatgaccctatcagcccagcgacccagagggaagctccagcactctttctcaaccattcctatcaaagcccccagactggctctcattggctgtgactggatcatgtggccatctctcaccctgccccgtggcccatggccaggtcctcagtcacaacgacatccttgaagctgggggtgggtcagctttgctcaaactccatggactgagagtgatagagcgagactccttaatggaatatcagaaagacagagagtggagactggccaggtccagccatccttcatgtgggccctggcggggccatctctgctgcctgcctgtcccccacatggaggttggctgtgcctgtccagtcatcctcttacatgctaggtagtctcccatccttcccatcacttgggagtcctgaggcctagaattttccacaatgttactttcattgcacaagaggcctctggagttgaacggacttaggtttgatactcagtttcattgcttagttagcttcacctccctgtgcctcagtttcccccatttgtgaaatgtggataatgattctcacttccttaattcagcagatattttatggaacactatttctggtacttagtggctaccacctgctttaacactttcattttgactcgcaacaaccctgagagttcaatataaccatccatttttacacatgaggaaactgaggcacagagaggcacagtcacttgtccaaggtcccctaccaagaaggagaggcagagctgggatttgaacccaggggtgatcaagctcaatggctgtccatgtcgcccgtgcttcacctgaggaggctggcgaggtgtatcctctttcacctgcctcagttttcctcatctgtgaaacggcctcatggctttggagcaaacagaatgacagataaaagggacaaatgacacagggctctccatttgtttaacaagtacttattgagaacctactgtgtgcagggcaccaagccaggctgtggagaaaacagaagcgggtgacaggatgggagaggttccagaagccgctaggaggagaaggcagttgagctgtgacctggggcaggtggatgggcctccctgggaagatctgggtgtgggaagcgcctgccaggcagggggcacctcaagtgcaaaggccctgaggtgtggacaggtgagagaagaccaggacaagccccgctgttgccgtcgtctggaaaccaaggcacaaagagaggaggggacggagccaaggccacgcagctggcagaggtggagctgggatgttaggggaggaacagaggtcacgacctctgcaagcttcatcccccacccctcacccccagccagaatcttccagaggggtggcctccccttcctgagccaccccagctgttgcggaggctgctgctgtcctggttcccttgtttaattacaaacaacatttttcgccctcacttaattatgcaacagacgcccgtggatctgccaccatctggccccactttctggcttgagacgacgagtcgcagtgacttcgagggctgagaggggagcaagcgggaggcacctcggccaggagggcaccgagcttggcatggcctcagctctgtgatgtacctggccacatctctgagtcctcatctgcagaattgggacaattgagggctggcgcaagggtctgtgagacaagagctgcttggcaaagaggagccctcagccctaaagggggcctcgaggggccaggatgccatccccgggaggcagagttagcccctcctgtgtctcaaaagtagagtagagagggttcaattccaccttccggcaagctgcgtgggcagcagagttcccattccgcagatgggaagaatgaggctccaagaggctcagggacttgcctgaggccctggcatctgagtgtgggagtgggttcatggctccaaagtcctccatttccacatgagtgtcttgcaaactgcaatttttcttgggctgtcagttatgaggggaacagccctcccctggtttatcccccgggagcttggtgtggggctctgtgtgtggccctgcgtcagctatgaagtcctggttgatttgaagccaaaactggcccttccagctggggaggggagcaagtgtgaattattttcaatgccctaattaataataatagtaatattcactgacaattactaaatactgactatgcaccaggtactttccatgaattatctcattttcaaatgatcaccagccttctgagggaggcgctgctgtgcccaccccaccggtgaggagcccaaggcactgaacacggggttgcgtaggtaggattcgaacccaggccctgcagacagcagagactggcgctgctgagagtcgactgtggaacacggggctttttctggctctgtccttttctggcctttctttaagaggcagcaccagcagctggattccactttgagttgcagtgtgtcctggggttggaactctgggaaaatcccaacagcaagcatcccgggctgcctcctgcaggtgcatgggttgaagacatctatgcagaggctggacttgtccaggaaggggtgggaggcatagatatcagggccttcggccccccaggagccatgaggtgcaaagagatgcctgcaaggccccttgcctaggctgcctcgccagctagaagcttctgagccactctccagtcctctgcttatcattcccatcaaactcatgagctgggcctggcggacacaccccctcaacacctcactccagctcctggcctgacctggccccagcctcgcctcctcctcatctccctgcaccgccctcacccctaggatccattctccacacaggattagggggagcctgctaggacccaaggctgacagtgcccctcccttggtgaaacacttttgagggctccccactgctcttggactaaccccctaagtcttgttgcagcctccgtggccttgcatggtgtctctcagtaatctctgcacttgccggcctcccctctgtctccagaacctactcagacagtttccacctcaggacctttgcattctctgtgccctttgcctcgacttctctgccactggatcatacagccgtatcatcctagtccacactgtggccagagcaagcttcctgaaccctgcatctcagcaggtcctctgctgcctaagtcttctcttgggctgaacaccccatccccaaatccaaagccctggatggggctgaggctgcctgcgccccctccagcctcctctcctgagcttcttttagtgcccccaaaggcctgcctttgtgccagggtttctcagcctcgggctggaccattctccattgcagggctgtcctgtgctctgaaggacactaagcagcgtccaaggccttggtccactggatgccagcagcaccttccccagttgtgaaaactaacatctccagaccaccaaatgttcccggggagaacaaaatcaccgcagtcgggaccccctgggcgaggcttttgtccctgctgtgctctcttttggggacactccccaccagccctctgcacccaccctgctcagccctctgtgtatttcacaacccttagatgccacctgcgaggaaccttcccagcccaggcaggtcaggaggcttctgggtgctcccacaatgccttatactcatcatcggagacctgatgatgccatcttgtaattgtcagggggcatgttggcccacccctcaccccgcccctggggatgtcagctccacaagggcgggctccatgtctgctctgtcctccaccgcgtgacacgcacaagcaccgagcacagggcctggcgcgaaggggatgctcagttcacatttcaccatctctccacttgtctctgcctctgtcctcattcatcacaaacacaccccaagtccacacatgtgtgggtgccgcgagtgctgacaagaatcagacgtggttcctgccctcagcccactcacactagcgggcaacacaacacagtaggggagccacaggggacctggcagctccaaagaggcatctgatccaaactatggggaagaagggagggtcaagatgggcttcctgggggaggtgacgtctggatgactgaaaggatgaaaaggaggatcagcaaaaatagtgccaggatacggggtacccaacgtagtgaatgtcctaaatgccactgacttgttcactttaaaatgtttaatcgcatgtcacatgaatttcacctcaattattacaaataaaaaaatagtgcaaatagagggactagaatgtgtaaatgtctggtggacagaaactgaaggtcatttcactggagctgcaggtcaaaggagcagatattggaagtggtgatgagacaggagagctggccaggggccctgtggccacagagaggagtctgggctttttcttgagtgagtgggagtcacagaaggtcgtaggcagaggaaggaatgtggagaagagagtgggtgaggctggaagcaggaagagcagagaaggggcgatggccacagtccacgggtgagagggaggagcctggcccagggcttggccagggaggtgaggagatgtggttggatataggagatatttagggcataaacccgacagttacgatggtgtagatgtggaaggtgagaggggagcatcacggacaatgtccgtgttgcctcagtcaggaacccatccaggacctgcccccatgtcccccaagagccttctatgcgggggcaggtgcagggacccagctctgtgcttccctcctcaggggctctgcctcccccaaggctctgtaaggggtggtcttggcactcccatgaccttctgtgtgacctctggctaatctcttggcctctctgggcctgtttctggggcatctttgtctactcttccgggaggagtgagaggcactccgcccaggcagaggaccttgaagaacctgtcctgcagggtgaggccctcacccgcccctcctggggtactcagcaggtgaggggacacctggtgcacagcctgggcaagagacccagctccaccacgccctgcacggctgactggcctctgctcacctgagggacgctggggtccaatcctccaatcccaggggctgtgcccccaggcccagcctgggattctgagcctcacactctggccaggcctgggggatgaacaccctccgtcagcagcctggggtcaagggcatgagggctggagccagggccttggggcaaatcccagctctgccccttcctgctgagctgccttacgcaagtgactcaacctctctgatgcccaaagaaagagatctgtcatggaggctacatcccacacaagtggggcttttccacacggggtgggtatgagtcccggttcacacactggcactgtggagtttctttgtgttttcacaaatggaactgattttccatcttgtgtcgtggttatgccaggctggaggaggcttcatctgacggtgattcccaccctcgccaccaccccactccacttttcctgggaaggctctgggtcccctggcctttcatgaggccaaggtgttggggataggaatgaggacagaggcactggtgttgggtgtcgtcttcccaccaggcattgcctgacacaggctggtcccccccctgaggccctgcgtggttctgtgcctgccccttctccattgcccctggtcctgggggtcatttggctgcttcctggctacttcaagggctggttggaggctgcctttccagaatcctggaaaagctgcttctacctgaggttctgggcctcactgggctcagccccaggctgggggccacccctgacaccccgtctctgtacctatcctgcgaccctggctctgattctgggtgggggaaccttgctctctgcaagacgtgagttcttcctgctcttctcaacttttgaaactcaaaagccaggaagcctcctgggatccccgtacttggtgtccccgcccttcccggaggcactgagtacagacttacagtggggaaggacggaagggagaaaggaagagagcaggggcctaggtgggtgcagggcagggaagagaggccagttctgcagcctccccagacagtggccctcgggatccctttacattttaaaaaactgctgagaaccccaaggagctcttcttgcttgtgtggattctatcagtcgatactcacgttagaaatgaaaactaagaaatgtataacatatttatttattcactcaaatgtaataataaatccattacatgaacataacattttttataataaatacctatgcattttaaaatggacaaatttaatgagaaaagtggcatttgttggattgtggatatttctgcatctctctgtaacagctggcctctgggggacagcgggtcctcacacttgcttctgcagtggatctgctgtgagactttgtttaggatgaagtacctgagaaaacctggcttccaaaggcacatcgttggaaaaagggaggatattgtcacattgtgaaatacatgtatattgagacggagtctcactctgtcgcccaggctggagtgcagtggcgtaatctaggctcactgcagcctccggctcctgggttcaagtgattctcctgcctcagcctcccgagtagctgggattacagacatctgctgccatgcccggctaattttggtatttttagtagaaatggagtttcaccatgttggccaggctggtctctaactcccgacctcaggtgatttgcctgcctcggcctcccagagtgctgggattacacgcatgagccactacacccagccatgaatagtctttaatgctacacaaaaactaatcagtggtaatgtcttaaattcagatgcaatgtggaatctaaacatctatcaatgaacttttcaaactctttacactcatgtgagaatgagagtaaacagggcaaataatcctacgaaccccttaatgggtcttggggacccctagggatcttcggaccacacttttagaactgttgtgttctctacaatggacacgaactcatcattttttatggctgcatagtattccatggtgtatatgtgccacattttcttaatccagtctatcattgttggacatttgggttggttccaagtcttcgctattgtgaatagtgccgcaataaacatacgtgtgcatgtgtctttatagcagcatgatttataatcctttgggtatatacccagtaatgggattgctgggtcaaacggtatttctagggacatggatgaagctggaaaccatcattctcagcaaactatcgcaaggacaaaaaaccaaacaccgcatgttctcactcataggtgggaattgaacagtgagaacacatggacacaggaaggggaacatcacacatcaggcctgttgtgaggtggggggagtggggagggatagcatttggaggtatacctaatgttaaatgatgagttactgggtgcagcacaccaacatggcacatgtatacatatgtaactaacctgcacgttgtgcacatgtaccctaaaacttaaagtacaataataaaaaaaaaaaagaactgttgtgttctcaaagagaagtatcccagcagtcagaaagctgctggttgacccccaccagggacataccagggtatgatgaagaatgcaggttcaattcccatttctgctgcttcctggctgtgtgtctctggggaggtcactgcttctctaagtctcaatgtcttcatttctaaaacggtgataagaagacctaccttacaggcttgtggtcaggacccatgaaaagcaggatgtgaatgcaaagcccttgctcatatgtgttcctttctgccacagggcctttgcgcgggctgttccctccatctgaaaccccttccctcccggttttgccaagggaactcctttccctttagctcttggcttaagtgcttcttcctccaagaagccttccctgacttccctggaacgtctgttagaaacccctagagcatgatcaaagctttatatttttcagggttataggtgattatctgtctcccaccaatccctaagcctgggttgacttttgccctctgccgtaggagcttgtgtggaatgaatgctgttgaaagaatattggtgataaagtgccatctttgctgatatcttggtttttccatccttggaatgaaaaagctgggctttgacaaggggtccctccccaacccccaccttctctgccagcagctggactgcaccaagcaggggcaggtggaggggggctcatgctctgaagctgcaggggttctctcgggggacccagccctgcctgagccccctttatgtggggtaccccggaggcctctggggtcatgctccccatctcgcagctctttcctttctgcacatggtacctgccctgccctagagcaatctctcaagcatccaggctggcagacgcccttctccctcccctactctcccttcagatgggctcagtcaaggatttcttctctgcaaccccaagccgactgtatctctgtgtccctgccatcatggcacatatcccataccctcatcttccccaaccaggcagcacgttcctcaaaggccaggattgtgtcttcatcatcttcgtccccctgggatcagacagtgggcctggtgtccagtaagtgtccaatacatatttgctaaaatgacacgaatgcaggactctgggagaggttcctcttatcgaaggaggttgtacaagttagctttgggctgcaaggaatagaaactcagctcacactgatttaaagcataaaaggcacttactggcttgtattaatgaaaagcctagtagaagggtgagcttcagggttggtttgatcagagcttcaactcttttcctctgcgatttacccagttctgcttccgtgtgttgtttttgtttgtttgtttgtttgtttgtttcctctggctggttttcttcacggcgttgaaacaagcatgactgttccaggtctcgttctgtccagatgaagatctcttcgagtggctacttggaatgcactccagaggcccctgacattgattcttctctagactcaaactaacctagttacatgtccgccctcgaaccagcggctgcagccgaaggtgagatttggaaaattagcttagatttggtgtcaggaaggcgatcagctccccaaaaagggggaccacacgagagaagtgtggcaatcccctcaaaatacgagtagttaccaagagaagagaaagtgggcaagaccgtcaaagcatccactcgaggagtttaattatattcaaacccatagcaaaaaaagaagctgttttttgagcaaaaaccaacccagggaaaactttgctaaacgtccagatatttcaccagaaccttctgtcaaacataagaagataacagatttctgtactctctgactgaattttgctgaccaaatccaaagtcagttcacagagccacagatgactttactgaatttttttaaaaatgtgtttgtttttccgattatgataacaatacatgcttgttgttaaaatatttaaataatgcagaaaagcatttaaaatagtagttctcaaccaagggtggttttgtcccccaggagacatgtggcaatatctggatacatttttggttgttaggatagggggtaggggttagctcctggcatctagtggggagaggccagggatgccactagacatcccacagcgcccaggacagtcccccgcaatgaaaattatctgacccaaaatgtcaatagtgtcaaggttgagaaaccctgatttaaaggaatgtaaaaattaccccaaatcctactgtccagaaataaacactgccgacattttggcaaacatcatttagaatactctttttaatatatgcccattgcacacacaacttaatacaaatgagattatgcacatgaaaatgcttttctctacaatgtcatggctgtctctctgtattgctgtttttgtttgtttgttttttgagacagagtctcgctctggtacccaggctggagtgtagtggcatgatctcggctcactgcagcctccgcctcccaggttcaagccattctcctgcctcagcctcccgagtagctgggattacaggcgcccgtcaccacgcccggctaatttttgaatttttagtagagatggggttttgccatgttcgtcaggctggtctcaaactcctgcccttgtgatccacccgccttggccttccaaagtgctgggattacaagtgtgagccaccacacccggccctctatattgccattttaatgagtatttttaatacagcttaacacaatgttttatatttatttaatgcaatttcataaatttttaatacagcatttcattatatgaggactattgtttgcttaatgaatcttctgtagtttggcatttcagaattttttcccccaatttttcactattataaacaatgctgcaatgaacgaccttccccgtagagactacttggcctattagaataaatgcccccaagttaaatttccaggttgctttaaaatttctgcccagtgaacagcatggtgcttgttgccattctgctcccagagacccttgtagagtccgttcgggacagtatgagaatccccattatcccatactctgcaacactgagagttgccaatcttttttgtcttttctaatctgataggcagaaaatgacatatcattgtagcttatcattgataactggtggggtggaacttgtcttcatacttttttttctttttttctgaggcagtgtctccctttgtctcccaggctggagtgcagtggcaccatctcagctcctacatcagcctcccaagtagctgggactacaggcatatgccaccacacctgtctaattttccttattttttgtagagatgagatctttctgtgttacccaggctggtcttaaactcctgggctcaagcaatccttccacctcggcctcccaaagtgctgggattataggcatgagctgcctcgcctgccagaatagtgggtttttaatacggtgtttacctcttcttattgttttgcaagaactctttgtatattaaggatagtaattctttctaagagtcttataattgactataaaagtctccctccctccctccttcccctccctccctcccttccttccttccttccttccttccttttgttcccttctgctttctaaggatatgcctggtgtttggcaagcattgcatgaattacattaggaaataacttttgtaacaaacccatttaacaaccattctttgttccccgcctcctgataatgctcagagccacagcaacagcctttgcccaactccatgtcattaacccttgatcttttcctgctgaatagcagattgctttccggggctggcaacacagtttcattttcaccttcctgctgatggaactgccctggctctgtgccagatggctgtttacataagaaatgatttgattatattgcacagccaatggcagcctttctcagaataaagaagccagaaacatataatcaaagccattaactgtgtacaaagaaacgcagcccactctaaatttcccaccaaccataatcacagttttccagagaaaaataagaacagggttatggttccctactaaaaacgtgttaggggaaagacttttaaaaggaaattgtggtatagctcagttgcactctcagatcaacccttgagccttgactccaatcccagctctgtaactcactgtccttgtgaccttggaaaagtcgtttactgccaaaagcctccgtttctttattgtaaaatggctataatagtaatatcaacctcagaggtttacgagaggattaagtgagatagtgcataagaacactttctcagtcagaatgttttcagccgcaaggagcagaacacttgactaaaggagggaaaaaaaagctagaggacttataattttatttaacagggttgtttcatttggaggcataaagatgtaaccagtgattcacattcttttcttcttcctgctatgccattctcagcaatttatggacatgtctcctcatggtttcaagacagctgctgtggctccaggcatcacactgggacatgataaaatcaagcaaagaggaggagggcattttttcccctgtgtctcctttcatgatggagaaaattgttcccaaatttcccccctgcagatctgcagacttcttattggccaagatggcgttacatctataattccaaaccagtcactgatggaggaatgagaatgactgcagttggcttggacctataactcactctgaagccggggcgaggaatagccaccgtccctgagctcctgagtagatgcacaaccaacaaaactgaatcccgtcagcgaaggagtcatgggtgggcaacccgtgctgtgtctaccataagcacaactcctggtgctcatgaggtgcccccaaaggctggcatttggcaagctcaagactgggagtccacacagtgctccaggtgggaggatcacaaccgcgattggccagggagtccctctgggtgccagacccctgtatgcaaagccccactcagcatctccacttgattggcttatgggaacctcaaatccaacacactatatttgaactcatcatatttcctccccactggcctcctctgttggtacccaccttgctcaagccagaagctggctggtcctcaggagtccctgctttccttccccatctgtgcccacgtctctccagctctgccatcatcttccacctggacaccaaccaagcccccgctctccctgctgctgtgtgggcatcaacagcctatgctgttccctctgaacggaactcttcccgctcctgtttccctgtcaccttgctcaggaaagctcttctgatccccccaagttgaatccctcattacaaacctcacatcctgacatacatctctccattgccctgatcatacttcttatttacctgtgtgattatttcactcatgtctcaccccaccaggttgcagctccatgagggtgggaattgggtctgttttgttcactgataaccttcagtgcctgacacatagtagggcctcaattttattcctgaatcccataaatgaataaattcatcccctgccctgtggccagggagatcactctaagaagcaaatctaatcactccctctcctgccataagccttccatggctcccctttacccacaggacaaagtctaaagggcttaacctggctctttcaggctcctcaaagtggattctgccacctctccagccccatctcacctgccccattgtcctttacggtccagccaccctctactcctttaggtgtctcaaagtctgcatgttctctcctatccctggatttgcctatatgctatgtttctcccggaaactttgtctcaaaaaatcttcattctcattgccaaggctttaaaatttgcctcttttggggaaggtttagttctgtaagctcattctggaaatctgggttccttctatctagctgttgtcatcctcagtccatagcttccagtcaagtccaaaacagctgctatagcttctccgtcacatctacgttccaggcagtggggagagagaaagggtcattcctcttaagggcatgactcagaagcagtgctatcacttctactcaatcccattggctggagctcagtcatatgaccatgcctaactgcaaaggaggccgggaaatagaatcactatctgccgattatgttagcatgtttcccactaatgctccaaaattctctcagtatgagaaaaaagctgatggatgttggtggacactgatggtcctgccacactcacccccacagtgccagtcatggacttatctctgcccagccagactgtgagctccctaaggacagggaccatatatggtggtcattgcagcatcccctgcaactcacagagtgctggttgtgacatatggcaaatcagagtgaattgcagaggccggaaatacaaggtggagaaactgaggcaggcaccagttgagttccacacacattttctgggtgctgattacacataagaaccctgggcttggtcccggtgcctggggggcagcaacacttgtctggcctggcagtgtccccaaaagcacccagttgggggctgcaaggccccacccggtggggaagctgcagaaacagagcagagtccacagtcagaacaggaggcgccacaagggcctacaggtaaggcaggtcccaggccctcagcccacctggccctggccctgctgcactcttggccactccccaacattatctggccttgggcccagccctgagcacctgcccttccctgctctcccgagaggcctgagctggggttcccctcccctgtcggctgccgtgggaaaggccttatggtagctctcaaggtccaagttccagcctcaacagctgccgtacttgctattccctctggccagacctcccttccgtgctgctctagcttctcctgctctcagcttagacggcacctcctcactgtctccaaagaccaccgcccaccccggtgcctctccaccacattgtgcatcttgttgcttcccagcatgggtctgtgtggggtcgtaggggaatcctgctcttgttcattcatttgttggcttctttgctcgctgtctcccccagtagagacatggacattttctgtcttgttttccactgtatccagagcctagcccagggcctggcacctagtaggtgttcaggtaatatctatggactacctacatacacacacagtgaggaaagacaagagaattagcactcactgcactcgtatgacatgccagcgcatgcgttgttcactctgaggcccacgacatcattgcctggttggaatcattatctccatttcacagtggaggaaactgagactcagagaaatgaagtgactcgaccgaggttacgccaataggaagggccaagtctcagacggggggggatatttataacgaaatgcaaagatcttggaggagggggtggattcttggttgtacacatcgatcaaagctcatcaaactgtacagttgaaatcagaggttctcaaccaagcatggttttacccccaggagacattcagcaaagtgcagagacatttggtcatcatgggggtaagcaatgctactggcatctcgtgggtagaggccagagatgccgctcaacatcctacagtgcccaggacagccgccacagcaaagaattatctgacccaaaatgtcagtagtgctaggttgagaaactctgctttgaaggaatgtagtttactgaacacaaattatgtactccatttattaaggcataatcaatgcattttttgtaaaatagaaaaaatagaaaagaactaacataattggaaaagaaaggaaccaactaagtacaaaacaatggccacataatttaaaaaggcaaagaacagatcagaaaatacaaagagcctatatgtaaatgacaaggggctccaccttaatactaataagggaaattcaaattataacaaaaagctggggggttgcctcatgtctgtaatcccagctctttgggatgctgagttaggagaatcacttgaagccaggagtttgggagcagcctgggcaacatagtgagaccccatctctacaaaaatttaaaaattagctaggtgtggtggcgtgagtctgtagtcccagcttctcaggaggctgaggcaggaggatcgcttgagcccaggagtttgaggctgcagtgagctatagctaaaaaaaaaattacaacaaaaataatcacaatgggaaaaaatttttttaaatgacagatggggccaggcgcggtggctcacacctgtaatcccagcactttgggaggccgaggcaggcggatcatgaggtcaggagattgagaccatcctggctaacatggtgaaaccccgtctctactaaaaatacaaaaattagccgggcgtggtggcgggcgcctgtagtcccagctactcaggaggctgaggcaggaggatggcgtgaacctgggaggcggagcttgcagtgagccgagatcgcgccattgcactccagcctgggcgacagagcaagactccgtctcaaaaaaaaaaaaaagacagctaggctggtgagtgtgggggaagtaggccctctcatcctctcctttgtggatggagggagtgcaaactggcaaagccctggcggtggtgtggtagcactttgcatcatttgtctagcaatcccagttgtgcagaaatacacatgcgctcagagagctgtgtgcggatgctcactgtggtattgtttataatagtgaagtttaggctggaaaactaaatatcaatgaaatcaatgaacgtggaattaggtaaataaaccatggtgcattcatgccatggaatactatgtagcagatcaaaatgataaggcaaatctctacacacatagttaggcggaacaaaaaaagcgggctgcaaaaccacatttgcaatctgtttcgaatcaggtggcacaaaagaaatccagggcccaggccgctagcgcttgccatcattcatcaccccttctccccacttttgaatggggcggcaatgtgcccaagtgaaataagacctccccagcctcccctgaaaccacgcgggtgcaatgtagtagccatgagacccagagcgcacacactttgtcccttccctgccctcttgccttgctgagaagcaaccctcttgagccaggagtttgaaagtcacataccaacatgggagaccaggaagctggtcattggtgatgtccctgaacaagcctacaagcccagacttgctcacctctagacttctttttacacaagagaagtgaactcccattgggtgaaaccctggtgtttgttattttttacttgcagccaagtgcaatttcagaggcagcaaactcactggggaggaggacggttgagtcttctgcaacagaactgtattcaagtgtcatttacatagttaagacttttctaaaataaatcaatacatcaaataaagcctgtctggctagagtctgtgggactcttgctgtttctttcaaaaagtgtttgttgattggctcaggtccctctcaacccaggcaaaaatgccaaggggaagatggagggacatcgaggggtttccctgtgacctgctgaaggagaggttggaatgctgttttcttaggaaaagctccattttcctggtaagaggactagcgcctgagtctctcactccagggaggctcaggggtcagtccaaccagcccaacccgggctgcccctatcataattggtgaccctctagcctagacatgctagcctccaggcagtgacctggctgtctctcccacctgtttgtcctcttcccagaaggaggatgctccctttatctcaggccaaagtacccccctcaccctcccagggaaggggaggaatgccacctgtcatcacgggatgggtgagtcacctcttactggctggaggccatagccagcccaacctctctcttttgccccctagctctcccctgtgggtggggaacgatgggaatatcaccctaaaaatcgtgacagcaacagctgccatctctgtggcatggaacctgtcactggaagcttgagtgcacagccctgggttccaagcccagctctcatgttctaacctggtgatctggggggagtcaccccttcctgatccccatttatgcatttggcaaacgtttattatgcaagcactctgaaccgggcagggggtgctgaggatgccacaacgaacaccccgaaacaatcctgccctgtggaacccattaggtagagacgttcaaaactaacaataatgataatgttaataaattttaaaattccgagtgtcaattggtgatgatgtcacagagagaaggggcgaggagtgctggtgcagaggtcttgttcatgtaagcaggtggtctaggacgccctgagatactttgaaaatggaggaaagggctgggtgtggtggctcacacctgtagtcccagcactttgggaggccaaggaagtcagatcacctgaggtcaggagtttgagaccatcctagccaacatggcgaaaccctgtctctactaaaaatacaaaaattagctgggcgtggtggtgaatgcctgtaatcccagctactcgggaggctgaggcaggagaattgcttgaacccaggaggcggagattgcagtaagccaagatcatgctactgcactccagcctggtgtctcaaaaaaagaaagaaaaaagacaaagaaaaaataaaatggggggaagacctggaggaggtgagagagggaggcttgtggttctctcagggcacagagtctcaggaagagagaacagcaagtacaaaggtcctgaggctgccgtgtgactgatgtgttccaggagcagggaggaggccagtgtggctggaaggaagatgccagaaaggcagagtgggggtgtactaccacacgggatttagggacactgccaggaccttgtctttgactgtgggtgacatgggagccagaggagggtgttgagcagaggagagatgtgatccgacttcctttgggtagcaagacaatgatggaatgggggaggtagttcggaagccatggcaacaatccaagcacacacactcatgccagggcggggctgcggaccttggagggtggtaggatcctggatgcaggctgtggatgggaggtggtggggcagaggctagagaaagagaagagtcaatgaggacactcaggtgtttggcctgagcccctggaaggagagaggtgccactttcagaggcaaagacgatgcaggagaggtaggatcctgctggaggaggcgtttggtttcttacctgggatgtccgagatgcctgttaggcatattgagtcgtagctggatattcaagactgagttcaaggcaggaaatgtatggttagaggcttttagcttggagatagtatttagagactcagtttctttgtctgtaaggtggagattaaacagcatctgctttgcaaggttgctgtgagcctgggttgaggactgagagttcatgggcaggtagcaaagtgcaggtaaatgtcagctccgttacttccacacccagctcactcaatcctcatgaggtcgttattattgccatcagctttaattttacagggagtggaggttcagagaggttaagtgactggtccaaggtcacatagcctgaaaacagcgcagccaggatccaaggctgaatctagagtcttgttcttggctttctaccctgctgcctcctccctgctctcccagcaccaggcccttggatcttgaactgatcagacttgaggggctcccagttgggaagggagacaaccgtgagtggaaatgcctccaggcagacaggacctgagcctgccccactagggggcaaattagaaggggggccagtgaggcagcacagccatgtggttaagggaagcactgtgatgccagaccacctgggtccaatttggctctatcctcactaggtgtgtgatcctggagatgtgactcatgtttatttgtgcctcagtttctgctgctgtgaaatgggataatacaggttattgggaggactgaatgagttggtccatgcaaagtgcttagaacaggaccagaaactcaataggcgctccagctcactttccaccaaacgtgtgcccccagggcctggggccacctgccatgtctttgggtccacatctgtcccttgctcaaggttcacatcttgccttggctgctgtgagctatgtgtttttgggtttctcacccaacttccctgcactcacacttcctttgaccccaaagtgggaaccatatctaccagtggtgaggatcaacatgcacagtgcctgcagaggacactggattgtaactgtgacaggcctcaagtgggtgctcagtgtgcacaaatgttcatgacagctggaaacccagatgtcctcctgcagtggaacgctactcagtcacaaaaaggaacaagtgcgtgatatttgcaacaatgcaatacatcttgcaggcattgtgttgagaccaaaaagaacgctcctggtttttgaaactctagatgaaacacaactaaactttggtgacagcaagcagatcagtggctccctcggctgggccagggatggggagtttggaaagggatatagggaacttcgttttagaaatgttttgaatgttgttttgggtgtttgattcattggaattcatcagactaaacccgtaagacctgtgcattgattgcatgttcatcatatcccacttttaaaaatttttatttttatttaattttattttttgagacaaagtctcactgtgtcgcccaggctggagtggagtggcacaattacagctcactgcagccttgaccttcccaggttcaggcgatcgtcccacctcagcctcctgagtagctggaaacacagacgtacatcaccatgcccagctaatttttctactttttgtagagatggggtctcactatgttgcccagggtggtctcaaactcctgggctcaagtgatcctctggcttctgcctcccaaattgctgggattacaggcgtgagccaccgtgcccggcccccaattattttaaaaagcaacaaaaaagtttgtcgttgtcatcatcataaatttgttcttatttctctgactgttctatggcaccaagtgcccccttagccccctcttttgaggccagcagagacccagagctaagtttggggtgacttttccctacctctggtccatcaaaggtctctgccacataaggcagatgagctggcactgtagaaagagccctcagacccaggtccaaacctgactctggctctgcctcgtccttgctggctgcccctgagtgggtcatttaagcctcagtttcctcatctgttaaatggggctaatagtggcgcccctgcttgtgaggtggttgccaggattcatggagattcttagagataagaggtgtgcagggccgtggatattggaggctcacagaaacaaaacagaacaaagcaaaaacccccaaaggaaaaaaaaacccaaaaccaaaataaggcgaagcagctgggagagggtgggggtgactgagcgcagcggcctggcgccagagtgccgggcatcaggtcctgctcctgggccatcgccgtcacctctctgtgcctcagtttctgcatttgtaaagcaaggatgataccagcacccagcccacaggctgtgtgagggctgattgagtcactcatggagacagagcagtgcgtggtgcctggtgcatgcggctgttatactgagggttgggaaggggaggagcgcaccacctcgggggtaactcagagagcccagtccttcttgaattgctgcctggcccaggccatggtgtcccagcaggtgaaggggtgggcagtccagctgccagccctgtcagatgcagccgcaggggctgtggctcaccaaggcccggggcctgtcctgggctcctcacttggctctcgtggctgggacagattgcttccttcctctctcctgggtgccaggtaggcccagaaaccacctgatgtcagcaaggcctggccacccactggtggggaggaagtgggcgggtgcccagggacagatgagccgggcagacgtgccctgaggcagcacagtcagggctgacgtgggcattatgcacctcggggctttcagagctggctccggtcccgtttgcccacatcaagcaggtcagagtggagagggccaggggcgctggggtcaaggcatgcactgaccaggcgtctgtccccactcctcaaaacacagccaggagatgagcgcactggggtggtggcctgtggaagaggggcagggtctgtgtccagatgtggccggagggtggggtcgactgtgtgcggtacgtgtgtatggaggtgactgtgtgtctggcatgtgaatgtaagattttaggaaggtgagtgagcttgtgcacaggtgtgtgtgtgtgcacgtgtgtggctaagcatgtgtgagtgagtaggcatctgtgtgccgtgtgtgggagccgggcagggggcagcgtgtatggctgagtgtgccagcacattgctgagcatgtactcgtgtgcgtctgggtgtgtgaatgacaaaataagtgtatatggttaattacatgagtgtgtgagtgagtgtggggaggggatgtgtgtatccttgattgtgggagtcagagtgtgtgtatgtgtgtgtgtgtatgtacatgcgctgttgtgaagagttctgcaagaacccctccccttttttaaattttattttttgagatggagtcttgctctgttgcccaggctggagcacagtggtgcgaccttggctcactgcaacctctgcatcccggcttcaagcaattctcctgcctcagcctcccgggaagctgggattacacacgcgcaacaccacgccccgataatttttgtattttttttttagtagagacggggtttcaccatgttggccaggctggtcttgaactcctgaactcaggtgatccacccgcctgggcctcccaaagtgctgggattacaggtgtgagccaccgtgcccagccaagaaaccccttttgcatacagagctttgctcctttgcacgaaaatgcttatgaacaggtggggtcagctggtggatgtgtttaaaattttgacagaaatggccaaggagctctttagaaagggcagaggggagcggtgatatccaagttgatccctgaccagtcagaacaggtgtcagctgcaaatacccaagccagctgagccagccctggtcactccaacttctgctcccaccagcagcatccaagaaggcttgaccttgagtcattctcaggccatccccaaagcaaacagtgaatggtgagctttataataacaaagtcaacatattataatctcatgggccgtcagttacaatggcaaacattcattcattcattcattcaccaatattcactgagcacctactatgccccaggcacagtttctggtgctggggatgcagccaagaacaagacggacaaaaattcctttgctggtggcgctggtgggaacaagcagacgacaaaataagtgaacagcctgtggagagggttaattggtggtaagtgctgtagataaaaataaagcaggaacagtagatccagaacgccaggtgggtttgcagttttaaaaagactggtcagttggggctccaagggaagcaggcgtttgggtgaagacctgaaggaggtgagggccaagccacatggatctctagcggaaaagcaaagcaacccccaggcagaggccacggcaagcgcaaagggccggcgacagcacacacttggccagttcaaggaacagagaaggggccagtgtggatttagtagctttttaaaaactaatgataaaagcaaatggtgcttgtggaaccaccacacagaaaaacgaatacaagagaaattgaaagtccacagtcgctgaagggtgggggcaggggagatggactaaggatccgggtgtctggggtacagttcacttgataatcaaagcaattttccgttttgacaaggcaacgccaaaatagcgcagctgcatccaaacctcccagccgcagcgaaacacccggcgtttttacactcgtaccccagcccgaccctgagccaggcacgtagtaggcgctcggtctgcttctacatcctcccagctccctgggtcctgagggggcgaggaaagatgagtgcaaaccccccaaggtacagactgacttatccccagatccccacaggccgccagccaggcccccagcggccccggaatgacagcgtcgtctcttcctcctcctgcttttatgagctgtgaaggaggcttgtctcgcgttgcacaattgccccttaattgctatttcctctcagttatgaattatgtcatggatatggccgctcacgttattaaacttccacacaggccttatcgtctggagtccggccagcaacccagcctgacctactttcccaccggatttcaaaaccgcctcccttgtcctctcgttggacttttcctaaggagagtctactgtgcccaaaaacttgacgctaaaaataaaaactagaacggagaaggggggccacagctggccccaccgaaggcctgaggctcggagaagtccctggtgactggggccaaacccctcccttcctagaagcttcctcagaaaacctgtccttgcgatgcagggttcccagcaggacaggcagggacaccagccatagtcccaggtcccctgcgtgatcagatcccactctcgcctttctcggtcatggccgggatgactgactttggaggcaggcaaacctgggttcaaaccttagctctgacactgactagcccattcattcattcattcattcactccaggtattgactgtctcctgagtgctggccctgtgctgggcagtggggaaatatctgagaacgaggcagacacagtcgctgccctcatagaacttttaatctagtaggcagagatgggcacaaaacacaaattctgaaattagggcaatgaagaaaataagacagtgcggtaggtttgagaacagcagggctgcccgtttgagacagtcagggagaactctctgtgcggaggggtcatttaagcaaagaccccagtcatgagaagagccggatccaggaagccagccctaatgagggaggggctcaggaggtgcctcgcatgcaggatagaaggaggcgcttgctctcagtctcagccacgcgcaggttggcatttgagagtgagagcctcctgaaagcttcaccctggggatctcacttgccccaacctagtcctgggcctgctgggaaggaaaggcatctaagcaaagggcgcagcgaatgcaaaggccctgcagtgggatgagcctggcgctctggtgcagagagagccagggaagagtgcagtgcagggatggggacgtgggtgaagctggagaggtgggggtgcagaccacagagggcctcgaaggccatgctgaggatttggtaagggagaagctctattgtgagggcagagctggcaatcctcgtgggtgaggtgatatttgccggggaggtagggaagactcagggtgcatttctaggccggatgacttcttgattgatgtaggagagattagcaagtgcttcatttctcagtctttaatattcttcatctgggaagtgggaataataacatcaacctccccagagaaggtaccatacttagcacagtgatttacctgggtcacccaggaagttcgtggctcagccaggactggaacccaggccctgctctccaggatgatcgcaacaggcaggggctggatcttggcatgagattctccagcgatgccacctcccggccaaacaggcctcagcagcaggggctggatttttttctttctgaattgtgcttatgcgtggggctgtttatctaacttggctgaagtttgagtcctgggtctgtaaacatacccttttaattattatacaaatggtacatgttcgtggaataaaaatttgaaaatgaaaataagcaagaagaaaaagaacgagagagaaagagggaggaaggagggaaggaaggaaggaaggaaggagggagggagggagggaggggagggagggaggaaggaaggaaggaaggatctaaatcaacacatgtacacctagatgcattatataaggaccttcattgcagcatcctttgacataacaaaagcctccaaacaatgtgaatatccaagattaggggccttcgtagctgcatgaattaaagagtatttcaatcctgtgctgagactgaagtgaataaagcagatatcgctgtactgatttgaaacaacagccaagatgtaatattagcctagaaaaatgagatgaaaaacagtgattatagaatgctacaaagtgtgtgtgggtgtgtgtctgtgtgtgtgtgtgtgtgtgtgtctgtgtgtgcgtgtgtgtgtttgtgtgtgtgtctctgtgtgtgtgtgtctgtgtgtctgtgtgtgtgtgtctctgtgtgtctgtgtgtgtgtgtctgtgtgtgtcttaaggagagagtgaggaatgtgtttacctatttgctggtagatgctcaggtttcctgactttcgcgtggtaaaaatggcaagtcagagatgggaggaaggatgatattttgcctgtccgtttgcactgttgaaaggaaaacttgtggcttctgtttttgtttttgttttgccatgtgcgtgcctgtcttctgtgcaacattttagcaatatttgaaaaatcagagacttttcgaaaggccctgagataatctaggctggcgtttcctgaaagttcccccaaatcccaggattccagcaaggtgcctgtaggccatggggcttggggtggagctgcaggcagcctgaccctccttactcagagatgtttctctttcatcttttttttataggttggacaagtaaaggttcagttgtaaaagggttttgcctgctttgaaacgaaatttttgaaaaactttgatcttgaataatctcttcattctaccgatgaggagacaggaacccagaaaggagaaaaaaaggatcgtctcagcatcaggctgacctgggtttcagtctagctttggctgcgtgccttggatagtaaattttcctccttgaaccttggcttcttcctccagggagaaaaacctacctgaaggtgattagtacacagatatcaaaagtggaagtagaccctgagtccttagctaaggactagaacgatcgtggcagaaacgtgcacaggaaatcatgtggcctctgtctcaccagcgggtgttccaggaatggcaaaagtgttcccttttccccatttcactcaagtctagaatcaggcatatctcagtttgttagaagtcagctcactacaaaacccaggtattccctgggacacatgcaactgcaaggggcagggaaactcaactcaaatgactttatcattaaggaagtgtgtcttcctgtacattcagaaaacccagagatggcatggcggctctgacaggcatgcattcagcttcgaggaacacagaccctgacccctggcagcatttatttatattgtcccctgctacaagaaatccagaggcatccagagctgatggggtgactcaggggtgctaccaggggttcaggttctttcccagttttgttgttgttgttgttattgttttgagacagagtctcactctatcgcccaggctggagggcaatggtgtgatcttggctcactgcaacctctgcctcctgtgctcaagcaattctcctgcctcagcctcccgagtagttgagagtacaggcgcccgccaccacgcctggctaagttttgtatttttggtagagacgtggttttgccatgttggcgaggctggtcttgaactcctgacctcaagtgatctgcccgtctcagcctcccaaagtgctgggattacaggcatgagccgccgcacctggtcactttcccagtttttgcttagccatctcgaacatgtggcttctgtcctcatggttggccataattgcagcatgaccattccaccctcagctcatgtccacattacaggctggaagaggggacaagggcagagcagtgtgtccaccatgtttgtctcttttcagaaagctcttctgggggccccactgggaaaatttggctttcatatcattggtcatgctggatcacgtggccattcctggctgcaaggcagtctaggggagtgagtgcgttttgctggctcattgccatcccaataaagtcagggttctgtcaacaaggaagaaaaggagcgagggcattgggcaggcactgagcagtgtctgccccagtagttcaagaattgttgatacaatggctgaaagacatcttccaaaacctgtgttctctttctgtttgcattctaccatcctcagtgtgtgggcttccatcctgagacttgttttatcccctcagtttcaggagggggtcccttccttgaaggcatgtgctgatgccccctcaaaaaaaagtgttctcccacctagggaggagagttgaaaagagctgtggttgggcagttgacaatgtctgctccacctctattcaccggaacttcttctgttccatcctcttttcagttcagctcactgcgatttcatttccatctcacagcgtggatcagtcacctatgcctacaagaatgctgcctgagaaaccacccccaacctgttattctcttgaatagggagttggctgcaggttggtggaccttggctggacccattaatatatttcctgttcagctggagttctgctgtcttggctgggctggctctgctctgcctcacgggtccctcgcccttttcctgggaccaatgggccattctgggcatggctgctgatagtgggggcacaggcacaacagccacgtggaaacatgcaagagatctctttttttctttttttgagatgcagtctcactctgtcacccaggctggagtgcagtggcgtgatctcaactcactgcaaccttcgcctcctgggttcaagcaattctcctgcctcagcctcccgagtagctgggattacaggtgtgtgccatcatgctcagctaattattttgtctctctttctttctttttctttccctttctttctttctttctttctttctttctttctttctttctttctttctttctttctttcctttccttccttccttccttctttttttttttttttgagatggagtcttgctctgtcacccaggctggagtgcaatggcgcggatctctgctcactgcagcctctgcctcctgggttcaagcgattctcctgcctcagcctcctgagtagctgggattacaggtgtgcatcaccacacccagctaattttttgtatttttagtagagatggggtttctccacgttggccaggctggtctcgaactcctgacctcgttatctgcctgcctcagcctcccaaagtgctgggattacagatgtgagccactgcgccccgcccaattgttttatatttttagtagagctggggtttcactatgttggccaggctggtatcaaactcctgacttgtgacccgctgcctcagcctcccaaagtgctgggattacaggcatgagccaccacgcccagccacattcaagagatcttaaagcttggtctcaaaatgacacactgtcactttcatctcatgctattggcaaaagcaagtcccatggccgaactgaagtcaaggctgggcaaatacactccatcccttttgtgggaggaaccacagtcacatgggcgactgtcttccttatcatcactgtttgctgatgttcctccgatctctctgactttgttttggtctcatatatgggttcctcttctctctcccttcaaacactgtggggccctaagcgttccatgccagctcttctcttctgtctctatgtgtggtctctgggccatcccaaccattctctagttttcagtcaccacgttggcactaaagacccccaaatccattagtgggctctctcctgagtccagttgccaactgggcaggccacctgaacatctcacagaactcccagatctttctcctgctttgacctcagcaccctcagcctcagccccacctcaaactccctcctcctttattcccatggcacacaaccccctccatgcagctgcccaatctgggaacctggatgtcagcaagcccacctgtctccatggtccgttcatgctacagctgatgctgatcatgaccactggctgagtacttcctgtgcgccaaggacagggctaagcctcatcccaatattttctgatttaattcctgaaacacccgcccccctccccccaccctccgaggaggggggcactgatatcaagttgtctgtattccatatggcacatgccctcatgggacaggtggcttctttcagaagctgcagtgatctctcccaaaccaattggttctgtcaatccccagtgaaaaatccttaagaatcctcattgtcccagagacctgggctaaaccccttggtctgaagcggtcaggtccaagattctttcatttattcacacacaaaaggaaatgattgcgctcactccataagccagtcagcctctgggcgctggagaaacatgagaggccctgggaacttaggcccaacggcaagagagaaaataataaatatctaacatgtcaggtagtgacgaacagatatgaagacaaataaggcaaggcgaggggagacttatttgagaagggtcactatttcaggagggaattcagggtcagcctctctgctaagaagggattgcaatgaagtaagggggtggcaagtgcaaaggcactggggtagaaaggggcttggtggccgcctgtgcaatgagtgtgagaggtggaagaggctacaatatgggcgtggcttcctccctgagtgaagtagggagccatgggagggttttgagcagaggagggccctgccctgactttgatttttacagaatccctctggctacttgtggataacagtcttcatgggggccaggaagcggagaagtctgctgcaggaagcgaggttttgcaggcctcatgacacttagatcacagagaggattcaggggtttgagtgacattctcaaaagacacaggaaaaccaaacaggattttcgggttaaccagaagctgccagaagatggacggtgcccagcatgccctgcccccaggcaccctggtccatgggccttttgtgcagcatcctcggcgggtgtggacgctgtggtgctggtgttgctggtgggttttcccctgtgcctgcctcttggctgttgaggacagtgctggggaggatgtgagcacttagcaccccagcgtggtccgggcgatggtggcccagctcccgccaaagacgctgacttctttgaacccgagaacaaacattgacgttcttagttctgcaaaaaaaaaaaaaaaaaagccctgcgtccatgcacgctgtatccccccatcaccaaactcacttatctcgctgcacaatccttcaaagcacaacacaatgtatttatgtctgtggtttaggttcccaaaacctgtgacatcagataagtacgatgttcacaaaaacaaacatcgcagaaagggaaaaaaacgaccaaaaagaagcagctggtttcagcctcgacttcctctcccaagaaaaaggggctctatctggctgaggtttcactgtattcaggctggggggtcagaggaatgccgtcctgccctctgtccaactgctcgcatctcagcctttgatgtgtgactctctgaggctgaaaaatctcacctgcaaaatggaaatgccaatctccacctcttgggactcataaaaataataataaaatgataataaaaatataccaataattgctcatctttggatcaattgtgttccataggtcatttccttagcaaatcctcacatcggcctgtgttttgccttcacgtggggtggctactgagaacatctccagttgacacatggggaaactgaggcttcaagtaggaaaaataggcagttataaaacactgcatggctacttttggtttttagaaaatgcaaacatgtaatatataaattaaataaataaataacaaaatataaaaatataattaggcaaaaaagtttggccggttaaatgcccaaaagccacagtgctttcctgagtatcagagtgaccattgagacaggagtcccaccgctgtctccttctcgtcattcccgtctcggcaaaatgtcacctctgctgagaggtcgtccccaagctcttgcctaaggtggccctccggtccctcttattccactcaccttatctctttctgccctgaccgtcgctggaatgcgccgtattttttcatctgtttctgggcttatcgcctgtgttccccgctagagcttcagacccaggaaagcaggaacttcaccccgtccccagagccttgcccagtgcctggcactagtggatctcaatacatattcctggaccaacggaaggtgttttcttatttttaaaaaatgtactttgcacactgggcaaggtggctcacacctgtaatcccagcactttgggtggatgaggcgggaggatcgcttgagtctaggagttcaacacccatctgggcaacatagtgagaccctatctctataaaaaaaaaaaaattaaagtattagcagggcgtggtgatacctgcctgtagttccagctactccggaggctgaagtgggaggactgcttgaacccaagaggtcgaggctgcagtgagccgtaatcatgccactgcactccagccttggtgacagctagaccttgtctcaaaaataaaaatacaaagtgaaaaaattgctttgctttttcaaaagcaaagcacaccatatgagttgtttttaattgttgttttaagtgctggtcaaaaatgagctggcaggagcctcagcaggaaggcacagcctcggcgggcttatctggctgagtgtgaaggaagtgggcacactggcttcccacagagtgggtcaagcagcgaacatcccagagtttcccagcccagtctgcccccagttctctggcgctggagatcttcccgcctgggacagggttatctttgaatgacagcgtgttcagtctcccccatggggtgaggctgccctgaatctcagggagcaacagggatcccctgggccaaacacagcccccaggagatgttgcttggcccatgcagttcaaacagcttggaattttggcattattttaaaaatcaagatattttggaagaaaactttgaaaatcctcccaaagggcaccaaataagatgagaataattggatgggaagatttcacatccttaagatgaccattctgccaacatacataaaacttaatgcaatttaaagtagcgacccacaaggtttttttagttggataaaacaatctttgagttcacaaagaaaaaagtacaaaatgaaagaacaatgagaaggatcaggacaaagataatatttcaactcactgggaaaatggaatatttaatccaggaccccagccgagcccactatcagcaaaaaacaaaaatggactcccatcttctactacaaatccagggagttcacataaaacacctggcttgtccaaaagtcccgaccacactgggcccttatttttgcaaggcagcaatggattgatgctgagttgcatctcggggactctccacttcaccacagtctccaccattccctactgcatcccacctgactgccttcaatcatctgtgtgtcttgcttgggtgttcgtagcctctgaactcactacacaacagaaggactcagggaacctttgaagttggatttctgctgttagccacctttgtactgttctcattttgcatagtggaaatgtgtatttagaggagggatgtggcttcaggcatgattaagagcatgattaagttggtccacctgggccgggcgcggtggctcaggcctgcaattccaatgctttggaaggctaaggtgggaggaatgcctgaggccaggagttcaagaccagcctgggtgacagagcgagaccctgcctctaaaaaagaaaaaagaaagaaagaaaaagagcatggagctagaagctagagaggcttgagcaacctgtgaagagcgacttccccgctcagtgcctcagtttcctcctctgccacatggggataataagagctgtcacacatcatgttagttgcagagatttgtgccattctgcaaaattcttagcccggggcccagtgcagtgtcggtgccagggaaacagtggtgatgacaaaaccctccctttacatctacggcttttagttctcaggcttctaagggaggaaagaaaaaggaagaaacgaagggaggaggggtgcagagcggagcatttgcttttacctttgatctccttttgccaaaaaggaggggagaaagtaaataaacaggcctggcctcctttgattccagcgcctgcccggcacagagctccagagctgataagaaccagccaagttctaactgggcaactccaccctcctgaccaggccttcccttggcatttggaatccaggacgccaaagccctcccctgcaccctactgtcagcatgcaccgttaatgcccttctcgccttcccaaccatgggagaaaagatggagagaacttccccactgtggaaccccacacaaaacaattgggcgggtttggagacaagaaaagggtcttagaaagcggcttccgaatacattagaaacccagtcccccatcccaggaagaagcccccacactggggacttgcaggaaaacaaaatgctcagggatttgtcttggcaatgaattaagcagaaggctggtgaagttctcggcgcagagcagaaccacccctcccaccccccagtggttggtggagagaagccgtgtggcacggtgggtaatggtatagctttgaacccattcgtttatggttgtgtgactttgggcaagtgactcggccctgtcgaacttcagtttctcatcagccctggcactgggctcatgggattgttaaaggttaactgaggttgtgcccatcgggtgcctggcgcatacatagcaggtgcttgtgcttggacactgtgattataaaatggcttagggagtcccaggatggcctcaggaggagagacaaaaaaaaaaaaatgctcaggcctcatgtccggaaagatgaaagaggatcagtttgaaatctctaaaggcaccaagggccatgcagtggccaaggtcaggcaccgggtctgcttgaagttgacaggaggtaaattcaggacaaagtttagcatacacagaagacattccttccacattccccccaggtaggccctagctgatggctctaagagcttccccaggacctctgctaaatagctcagagctaaggcagagggcctgggagaagaggcagaggtgaggggtccctcccacccctgcctcctcctggctgtgtgacctgtgtgcctggcctcagtttctccacctgtaaaatgaggccataataacaccaaccctgtaggttttgaggatagaacacatggcattctgctggtgctcaatgaatgaacaaaagtcacaaaccacagctacttccaggatgaggctgtggaagcggttgtcagcagggaaagaactgactgctcttgactcctttcttaggaagtccaggctcaattccacatccacgccccgtccacctaccctggaggcagggcctcgctctgcttcgcacattcgcaagtccccagggcctggcatagagcaagtatttgttcaatgaatgcatgagcctggatactctgtggagtcaacctccactgagagcaaagggaggcccagagaggccaggtaacttgcccgaggcctcacagccccctgcctgcctgaaggcagagctggaactggggctgagctgagcctggtctgcacccctacttgctctgggccttcccctcggggaagcctgctgtcccccacctgaacacaccctgcccaggcttcccccacccagcagagcaggcacaaggagctcctcaggtggaaggagctcctccttccacgagtgttccagacgctcactgacctctgcagggactggccttcccctctctccctggtaggctgaaggccaccagcttgccacctgcaggcctcgtctggcttcagacgagttccgttatgacctgcactgtgtggttttgtataacctgcactgcatgggtttccttcatcattttgaatcatttgccaacatttaaaaattggcgatttcgtataaaacccagaatttccagcttctttcggaaagtcggcctctctggccaccaggcctgcttttttctggctctggtcagcaggagcttcgtcctaggcctcttcactcccctcgctctgacctggtggtcctcactcaaccctgggcctactctcccaggcttacagcctccttacataaaggcccaggcctgcccggagaccaggccactcgctcccccgccaccgtgcggtgcctcctccgttcaccctcagcccgggcactcccagggaaagccaaaaaggcaggattggagccaaactctaggtgtccagtagacagaataatgaccccccaaaggtgcccacctcctaatccccagagcctgtgaacatgtgaccttacatggcaaagggactttgtaggtgtgattcaattcagggtcttgagatgggaagatgagcctggcttatccagtggacccaaggcagtcaccaggggccttatgagagggaggcgggagggtcaggcccagagggcccacttcgactccagtgggagcagaggtgggagcggtgcaagccagtgagtgccattggcctcaagacaaggcatggattctcccctgaagcctccagaaggaactccatactgcctgcaccttgattttcccctcgtaagacccactttggctttctgactttcagaacagtaaggtcatgaaagtgtgtcattttcagtttggtgtaatctgttacagcagcaataggaaacatcccagggtttgaacccaggcttggccactccctggctatatgccctggggcaggtgacatagtactgagcctgggttttcccgtctgaaaagggggtgagcagagacttctgttaggtgggggctgtgtgtgggggtgaagtcgatggcacaggtaaggtgtggggcagagccctgacagctcacgcgctagacgccaccatggttagcatcgccctcttacttcctctcacttctctcactgtcactgaaaccaactcagagcaggcttttgaatctgcccactgctgcccaagataaagacgaaacttcctacttaggatcctacacaatctgccttccctaataataataacagtaatgattaaaacaataatgtccactagcactgatgaagcacttggcaagagccagatattaactacgtattaaactcatttaggccaggtgcagtggctcacactcatcccagtgctttaggaggcaaggtgggagaatcgcttgaggccaggagttcaagaccagcctgggcaacatagcaagacccccaatccctacaaaaaataaaaaatttgccatgtgtggtggcatgtacctatagtcccagctactcaggaggcagagatggaaaggattgcttgagccctggaggttgaggctgcagtgagctgagatatcaccactgcactccagcctgggtgacagagtgagtgagacccagactcaaaaaaacacacacaaaaaattatttaggccagatgcagtggctcttgcctgtaattccagcaccttgggaggctgaggtagaaagatcgcctaaggctaggagtttgagacctgactgggcaacagagtgagacctcatctctccaaaaaaattaaaaattagccaggcatggtggtgtgcacctgtagtcccagctattcagtgggctaaggcaggcagatcgcttgagctcaggagttgggaggctgcagtgagctatgatcaagccactgcactccaaccggggtgacagagtgagactctgtttctaaaataaataaataataacttcgaaaattcacttaatgctcacgacaatcctatcacttgccctatttttctgataggtaaactgaggcccaaaagattaagtcacttgcccaggatcccctggcaggctggtagctagctgggatttgaacccacgtggttgggtcttggagcctggatgctaaccatggggccgtgctgcctgtatatatgagcagaccagggaataacactcagggccccagggagtggccagagactcagtgatcatggcctcccctccatacactgcctgtcctgggtacaatcctggacccgagagatctgagggtcgtggctcctcctggtacacagtttgtacccacaagtgtgtttattttgcaaaacagtttccagcagtgcccactctctgccggacacctggtttccagaaaaaatgcagacccctccactgtacttaagatggtggagacaggccgggtgtggtggctcacgcctgtaatcccagcactttgggaggccgaggcaggcggatcacctgaggtcacgagttcgagatcagcctggccaacatggcgaaaccctgtctctactaaaaatacaaaattagccgggcgtggcagtgggcgcctgtaatcccagctactcaggaatcacttgcacctgggaggcggaggttgcagtgagttgagatcgcgccattgcactccagcctgggcgacagagcaagactctgtctcaaaacaacaacaacaacaataaaagattgtggaaacagatgagtgcctaggctgtcacagcccagtgagggacggcaggggcctgggggcagggggaggtcgggggaagctccctgaggcagggccatctgaggagaagcccaaggaagctgacgctggcatccttgaacagctgagctgagtgccgcaaggaggatccgcccaggaaggccccggtgagaggaagcccgtgtgcttggagaggtggatgtggtcacaggtggctggagtgctggagagagtggaaacgtcaagaggtcggcctgggctcggccacttactgtgtgaccttgggcaaacttcaccgcttttctgagcctcagtgtccgcatctgtaaaatgggaataggatagcagggtacctcctggggtggttctgaggatgcgacgcgtcactgcgtgtgaaggtcagcgcctggcatcgggaagggctgcattggtgtgagtcggtcttgttgctgtgattatgatgaatacgaagcatcgcgttgtcagcctgcacgccacctccccttccaatcagctcctcagatgcagaagccgtgaagctcccacaagttcatggggacaacccgtgtgagaccagtgaggaccccctgcctgtggggagggatgtcttcccaagaagtttcatgtctgccatcccagacccgggatccaggccggcgtctacactccctggggttcccagcttcaggcagcttagccctctgcccggtgtttgctctccgtgtccctcctgtccttttgtgtatgacacgtgtccttcccccgctcccttgagctccttcctcatcttcaccaatacgatttgtcagtcactctcaatgcccaagttcctctttttcaagcacgttaacaatacgaattgctgagagtttttgagcacttgctatgtgcctgatactttcattcatttattcattcagcaagtagcctgaacacatcttgtgtgcattggagatcttcagaaataacagacaaaggtccttgcactccctgctgggcttaacatcttgcgggtggggagtggagacgatcataaagaaaccggcaaagtctacaaactattctttgtacacataaactccctgaatcacaataataaccttatgaaaggttttcccctatttttcaggtgagaaaaaccaaggctcagagagaaggacttgcctaaagtcacacagctatgaaatgtccgaactgggattcaaacccacacctgtcagactccagagcctgtgctccttctctccccggcagcctgtctactaagatgttggcccagctccacatacagtcatctgcctcgccagcagcacatttcagaagctccacaatgtctgaggtcgggggtgtcggtgcccaggggcacagctcactcccacaaggccccgggcagggtgagctctgccctcccttccagcagcctctgaccaggaaggccaagtacacggtcagtctctggccagagcctgcgggaacaggacgtcctggtcctcctgccctggtggggcccagcaagctatttttgggcacgtttattgatgggacacgggtgcccagctggactcctgattcaagaggaaggccccaggctggcccagggtggttctgcttctccaggcccttggctgccttgggacagcaaccatctgctacaccccatgtcaagggtgtagcctgagctggctggctccaggaagagcaagggtccccacgagtgtggatagattttgggggggggtcacacagactacaactatttcccaaaattctggagcctgattaattcataggcaggcagaacacagaatgagtatgacaacaggttttgaggttagacttgagttcaaacccccgctgtgtcctctgctagcaaatttaccgtgggcaagccaggccaactcctggaagctccgtttccctgcctgtgaaataataacaatccttactcacggggagggaatgaagcttgaattagatagcccccacagctcaaagcctggcatacagtaagtactcaataatgaataataactttgcaaataatgattgacagctgacatttattgggagtttagcaggtgtgaggcagtgggctaaattattgacattttaaaaaatctcacttcaccccccccaacgattcctgggggaaggtgaatgatgcacttacaggtgccattatcgttcccttttacagataagaaaacagttcacaaagaggaatgatttgcccgatatcacccagcagatgtgtggcagaaaaacccgctggatgcgtggcagaaaaacccgcctttgaactccggccctaagagaggacagggccaggctgcagagctgtgcctcacgccctcctttccctcccacaaggactggttacaaagaccccgtcaacacctaagtccacgccgtatcgtgcacccctcagtcaccccctgtcccagaaggtaacctcctgggccttcctgttgatggaaattcagacaccaacatccctgaatattcccttgacccttcttcctgccattggggttattttgttttcctggttcatcggcaagaaatctgcaagaaactggctgggttggcaaaggctctgggctaacttggaggccgctatgctgtgtatgctggggtgggtgctgggggcctggcgggcaggggagggcagaggctcgcatgccggggcacctcaaggcccaaagtcaatgcagtgtttccttggtaaagtgccctcctggcctgcacctgcttacaattcaacgcagtgccctgagggtacattgcagcctcctttggctgaaagaagcagccttttgtgatctatcctctgcctttgtagccttctttcccaccactggatcccctccaaaaagaacgtgctttgccctgcttccaggcctttggccctgctgtgccctcctcctggaccacctttcctccatggttctcttaccacgtgcttcttctcctggtacttcaggactcctacactgtgaggccctcccagaatccccccagccccctacttggggttgccactgcgacagagggacattgcttccagaactacgttgtactctagactacaaagcccagctggtgagctgacacctccatgtaggtttcacgcaggcccctaacttcacaaagcggaatactccatttatttccctcctgaaaccccagccctgcccacctgtcttcccagctcaggaaacagtgctgccctgttcagaccaggtcctggtggccccttggttcctgtttccctcaccccacacatcccaaatcttgctgacttgactgccaaatacatcccaaatccatgcccttgttgccactttcacagctaccaccgaggtgcaggcttgccactgtccttgcccacctgaaccgtggcagtgagctcctcctccctggtctcctggcttccagctttgctccactcaatccacacagtcagaggaaatatttcaaaagacaaaccagctgggcgcagtggctcacgcctaataccagcactttgggaggccgaggcgggtggatcacctgaggtcaggagttcgagaccagcctggccaacatggcgaaaccccgtctctactaaaaatacaaataattagccaggctttgtggcttgtgcctataatcccagctactcgggaggctaagggaggagaatcgcttgaaccctgaggcgaaggttgcagtgagctgagacggcgccattgcagtccagcctgggccacaagactgaggctccatctcaaaaaaaaaaaaaagaaagaaagaaaaaagaaaaaaaaatctggtttactgctaaatgtttaatgacaccttctcaacaagggggagccctgatttttacatgtatccatttcggtggtgtaaatagtcccaccatggtccatttggagctaccagtgtgacttactgagcatggcattgggaagaacttgttgtactatttccaccgtgggatatggcatatgatatgatacaacacaacagacgtcaatcacttcaacaacacagagaacagtgaaatggtgagaaagtggtgatctgtgagcagttgttacctttgtttttgttgtaacttatttaactggaagttcgtgcaatttaattcttagcgatggctgtgtgtgacaactagcttgcagaattcgtgagccagtaggaggtggtgccagcaaccccactggttgaaagcgacacgagggcaaggatgtttccacattgttcccggccgtttcctggggcctggaacagtagaaggagctcagggtaggtgttcaggccgcatttgttgactattttatagtgcacctgtttgcatcagagagcacaaactgtttgcctcaacttgacttcatgggctgagtccagcccacaagcaggtgtcatttggctctcagaatgttttggacatttttacaaaatttattgccaacgtttaaaagtcaagggttttgttttttttttttatgaaatctcacataaacctagatgtgtagcttctcctggaaaatcagaagctctggacccgactcccttatgacaacagaggctggagcggaggggcgcgcagccagccccttcagactgggcatgggctcgccagtttccgcaggccccacccctacccgcagtctcacaccacgcccacttcattcgttcacgtaacctgctgggcctgcggatatttaagttgcaactgccatcttcgcctccatcttagcacttgtcacagtgtgggcccgtcacagtgtccctgccagacagtgagcaccttggggacaggctctgtgagggagccccccggggtccccactcctggtacatagtaggtccacaggttctggaactagatgaaatgtttgttgtccagtgaatgccagcccccacccagctatccgaattggggcacgcactaaactcaagccccgaccggaatgtgacaaagaggttggccgaggccagggtttaaaaataccccagggctggtcagctgcgaggtgcttggaggtgttgaaacaaccaggccaacgctggctggaggccagtgcacccactttgctctgtgtgatgtgggctaatgggaggggtcactagcaggtcctggcgtgcgggggtggggagtgggaggagtaggtgcagccccctcccccacagccctgcttgggaaaggtcagagatgtttataaacagcatggggtgacatgacataatttcacataaagggttaccaggcagggcatggacacagggcggcctcctctgatgtttccacgccgcggtctcctggcatcaagaaagccgggatgctgctagcactgtggtctccccacggccttcagaaccatggcccagcccgctggagccaggcttaaaaataacgctcccagcacagtctcctgggggacagccagcatgggggctggacagggaaggaacaagctctgctggagcgcccactggatgccaggcacgtcagaggcatgagctcatggagctgcacacaggccttgggagggagggactgtcatccagatggggaaactgaggctcaggagtggtgccactggctcagtgtttcccagcaagtggcaatgctgccatgccaatccatgagacaagagtgacaagaaggcaggctctgtgtcacgccgctgttcccgagtccctggcacagcgtttggccttagcaagcctcaggaggcagctcccatggaacttgtccaggatcgaaacccgctctcccaccacagcttgtctccgtcaagggcagcccatccttccagatgctcagggcggataccagggcatcatcctcaactcctctttttctctcacccccacacctggtgcttgctgctccatccaaacacagccgcccctccctgccctggcccagccccacctctctcacctgacccctgcaggagcctccttcctggtctcctgcttccaccctcaccctaacagtcttgcctccatcagtgtccaaggtaacacactagactcgtatcatccatcacctgaatgtattaggatgcaacagtgaatagaacacacatgtccccgtcagcgtggagctgacattacggaatgggggaggaagggggcatcagccttcacaggtaaattaaatagatcatgtttccaatggcagtgagtactaaggagaaaaataagccggggaaggaggaggggaacatcagagaggaataaatctaaatagggagtgggggtgcagggcaggaaaggtctcactgagcaaatatttgagtacggcttgaaagagatgagggattgggcaatggggatttccagaggaagggcattcttggtagaggaaacagcaagtgcaaaggcccgaggccggaccgtgcctggcatgagcgaggatggcagagaagaggccagtgtggctgcagcagaatgagtgaggggcagcgtgggaggaagtgagttcagaggggtgaagggcagcgcccatagaaccttgcacgtcgaaggaaagacttagctttcctctggggtaggtgagagccatggagggttctgaacagaagagggcacagtctgacttcgtttctgaaagaatctctccagctgggtgtagaggatgggctgtcaggagccagggggaaggggacagtcagggtgactgcagtggttcatgcagaagagaatggtgaatgggcccaaggggtggctgtggaggtgaagaggcggggagaacggatcttggactcctgatctgttctaaggtggagctgctggggcatatgctgctggactagatgcgatcaatagaaatcaagaagccaaggatgtttgggtttctgctaacacaggaacagaaaaccaaacactgcatgttctcacttataagtgggagctgaacgatgagaacacatggacacagggaggggaacaacactggggcctgttgtgggggtggggagggagagcatcatgataaatagcgaatgcttgccgagcttaatagctaggggatgggttgatgggtgcagcaaaccgcgatggcacatgttcacctatgtgacaaacctgcacggcctgcatatgtaccccggaacttaaaatctaaaaataaaagccaaggatggctccaaggttccagatagagcagccggaaggatggagcttctgccttacagagatgaccaagcaccaagctgggctctgggaaggatgggagtgaggcggcggcccttccccggggggcaccggatcctgtgtgaaggtcatcctcaatacagtgggctttgctttatgaaattccctgctgattcacatcaggattcttctccagctcctccttcccatccctgtccctgagtcccttgtaaattttgcaggagccaccaggtccctcctcccctcgattcctgaagagcaacaaacgcttctatagcactcatgtgcctggcaggatcctagccctttacttaaactttgtgaactcatctgatcatcacagcagttccaggagctggggactcttattacacttatttcataaatggagaaaaaaggcccagagaggttaagtcacttgtccaggatcacacagctccaagtggtagaggcaggatatgatcccaggcagtcaggcctaggcctcatgctgttaaccactacacttactatctcacccttggctatgaggagtcaaactgggcttgagagattgggtgaggggagagggcttcagccaccccttccacataaaagaaacagttgccgttttctgagtacctctcctgtgcctagttctatacccaggcttcctctattctgcatatcaacagaaggggtatcacaaggattgtacccattctacagataagaaaaccaaggctcagagaggggaaaagccatgtccacagttacagccaggactgagaatgtggaactctgggactccagaccccattctgtcccctcctccacactgcctgtgcttgtcacccgcttcctgccttggtggtgaggggggtgctcaggggtcaatggccgcactgcattttcttcttgctggaagcagaaggaggacaggagaagtgacacattgcacagctgcacggattcccgctctcagggctcgtagattttgtctggcacaatcaacatgtctgaggccagctctgggccaggtgctggagagaccgagataggaacacagagtggagggtgagaaagatggaggccctaggtggctttgatgagatagacagtggtggggttgttacagaagttcagagaagccgctcagaggagcaggtgcacatgaaccttgtgtcctggcagcttcttcacttctctggatctcagtttccatctctgtgacacggggtggtcatacctgccaccccatctcacagagctggtcaggactaaaggtgagcgccaagggggcatgcactatctccaccttgccctctgctgtcttccaggacagaaagagcacaggccccagcttgttgtaggcattctggggacctggcacacaggaggtgctcagggcctgctggacgtatggaaataaagaaataaacttctttgggacttattttcttcccccataaagtgaattatttccatgcacccatgcactttacaaagacatagaccctctcaaccacctggcaaggcgagtactaagatcatctttgcttaacaggtaagaaaaacggacacctagagaagctacgagatttcaccaaggtcctagagctaagaagggatggagctagcatttgaatttcactccctctgcctcctcagcattcacagaactaattgcagaactaaactaataacagcttgtgttttgtggagcatttattacatgccatgcgttattccagacacttcacatatattaactaatattagtatctacctcaaatgtgtgggagagatgatatttccttcccattttacccataaagaaagaggttaaggggcaggagcagtggcttaggcttgtagtcccagcactttgggaggccaggtgttcgagaccagcctggggaacatagcaagacccccatctctacaaaaaacaaaaaattagctgggtgtgctggatcatacctatagtcccagctgcttgggacgctgaagtgggaggattgcttgagcccaggaggtcaaggctgcagtgagctgtgattgtgccactgcattccagccttgtctcaaagtaaaatttaaaaaaaagaaagaggttggccaggtgcggtggctcatgcctataatcccagtactttgggaggccaaggcaggtggatcacctgagatcaggagttcaagaccagcctgaccaaccaacatggcaaaatcctgtctctactaaaaatacaaaaattagctgggcatggtggcaggcttctgtagtcccagctactcgggaggctgaggcaggagaatcacttgaacccgggaggcggaggttgcagtgagctgagattgtgccactgcactctagcatgggcgacagagcaagactcagtctcaaaaaagaaaaaaaaaaagtaaataaataaataaataaatgaaaaagaaaaaagaaagaggttaagtaacttgtgcaaagtcacaagtaatttgcaaagccaggattcaaactcaggcagtctggctccagagtccatggtcttaaatcacaacaccctgcaggagagggttggcaatgtcatcccaggcacagagtctggcacacggggagcacttattggattgtgaaaacctagcaaaccacgaacagacaagcagggctttcctattctgaaccacactgaggtctcccttaagaattcacttatttccatttcttcctgtgagtcccacttgacagagaagaagctgcccacagaccattttcccccttcttccccctccctctaggaaaattctgggcagcatccaccaggtcacagctgccagccagaggactggctagagcagagtttggccaggttatcgggtttcgtggtcagccaccttcgcccctgaccagagctgtctttccaaaacagaacattcagtcactgcctgtccctgcgcccagctgtccttgtgccccgaccttgctctctgcccaccggcccagggtttttcctcgtattcttgtctcttactgatatcttgcaaagatgaccggagcagaggaaagaaagtcagggagcagcctgagagaaacgatgaggagacagagacagagaaagaagagacagagaaagaggtgacagatggacagaggagaaagaggagacaagaaagacagagaaagaggagacagaggcgacagacggacagagaaagacagagaaagaagagacagaaagacagagaaagaggagacagagatggagagacagagctggagagaaagacagagacaggagggccctgcaggtgccatctgccctccaaagctgtctcgagggcagggtttgtaaccttgcatctccacccaatgcatcttgacctcccaaggctgcagcatcttctcccaacagcccccatcctgccaccagcccagcaggtcctaagagacctcgttttccttcccccctcacctccatgcacaatccctcacctaactaactcctccttatctcccttcctccaggaagccctccttgcccccacagcccctctatgtaccctgattacacctccctcatactttgtggttcattgataggttcgcctcctccactggaatggcagctcctcgagggcagggtctggatcggtctggctcgccctgcatccctgcactcagcccagtgcctgactcatagtaggtgctcaataaatgttggttgaaggaaggattaagccagctgctatgtgtcagctccttggagaatccttccctggtatggcttacaactgtttggacttcatcgtgtgattatttgatttagggtctgcgtggcctctggtccgaagaaggcaggatctgagtctgctgcattcacccttgtcttcccagcacctggaacagtgcctggcacagagtaggtgcttcagtattggttgaatgaatgaatggatgcatgagcaaatgaattaaccattagccctctggaggttttgaatcatattttttaacccatttgaagcagttcaaatgttccccattgcctttcaaatcagaccccaagtcctgtcaagacctaggaggctctgcaagatctggcccctgccacgtctccagcctctgcccttctcccgccacccctacaggcaccgatgtctctagggtgcccggcgtggtagcagttctcatccccctccacaccccaccataagtcatgtcaacagagctgggttggtttatttgtttttttctatgaacaagactgcctagaaaaatggagcacttttgcacaaacaacctcaatgtcacccatggaccttggtcactgtgggacagtctccaaggtttggccggccagcttcccagggcactgacctgagaaagggtttgcgccctggtcgctccgtccatctcccacccgaccctctaaagggctggctggctgggtgggaggggtgtccttggagcccctgagtctgaccttcatgttctgcaggaagccaggggaggggacccaatggagtggaccccaccacatcctttaggctcagaccaggccttacaccctccagaaagctgccttggccactttcctggcatctctggactcctgttctcaccctaattgcatctcatatcatgcttggctgaaattctctactggacagtttcttccactggactgtgctccaagtgcttaaggccaagtcttttctatcttggtgtccccagagcccagatctggcctatgagggtcatcagcaaacatgcagtgaatgaacaaaggattattgaacaagcgcttcctgccttagtgcatgctgacctctgtctttcttactaggatggggtcccaaggaccttgtctcttttatctttgctcctcagtgtctaacactgcttgacacatcagtggcaccatgaaacatgtgtggaataaacaaacaaggccttcctaccatccatcatatctgcctctcctcctggactgggagcactatgaggtcaaggaccaagccttatttatttctagctcctctgagtctagcactggacctggtacaaaagagatgcttggtaggtacttactggatggatggatggatggatggatggatggatggatggatggatggagttgaaactgatggatcaatggaggaatgaatggaaggttggacagagtaaatgaatagaatgggcggatggaagtgcaggtgggtggatggatggcagatgggtgaatgaaaggctggatagataaatactacagtccaggtcgtgaacgtgggaaatattgctttctaccccccccacacaaaagccaccattttagaagagctaaaatcattttagaacagctaaaatgaggccagagaatgactcagctagagtttctatgagagatatttaaaagaaaaaaaaatgtgagaaagacgggtctcggaggctctgaacttcttaagcaaaaccctgtaagttggccgtgctctcttgcagcgtttatgtgatattttatggagggcctgccatatttagtgcccttgggtttggtctggaagttgaacgaaatttcagatgtggaccctgaccccaggttgctcagagtcagatatatgcccattcatcctcaatgcgtcttcttgtcggggtgtccaaagaacaaaggtttgggaaacaaacacagatttgtatcctgacttcttttctgtgtgacctcaagcaagtatcttggcttctctgaaccctggtttgctcatcctgctttgcagggttgttgcaatcacacaacaagcccatgcttatcaaatgctgagcccaggctgggattgctgttgatgattggtaaacactaaactgggcctcagtgtgcgaagctgctgacttgctgtgtgatgttgtcggaatgtcgggacttttctgttccttcatttcagctcagtggcattcatccttaacaagggccgtgaactaaagaagagctcaagctggggaacccagtagacctgggtttgggatcctttgctccccggctgcatggtttcagacaagccaccgtgtctgtctgaacctcagttcctgcatctacactgcagacctccttgctgtttctcaagcacagctgtcacccctgcacccaagctctcctttggcaagagagccatagaaagtgagttcctggcatccaccttggggacgtgtgggcttctaaatgcggtgcaccttgaggcactccagagcaaagaggggtgcagagggatctggaagggcaaacagaagacacctgtcttctcaccctgtctggaagaggacccccattccatgtggtcccactagcctactgatttatgttgccaatagtttataccacatggctttatagaacatgtttattcagcggggcacggtggctcgcacgtggaatcccagcactttgggaggccggggcagatcgcttgaggccgggagtttgagaccagcctgggcaacgtggtgaaaccccatcactactcaaattacaaaaattagccaggcatggtggcacatacctgtaatcccagctactcaggaggctgaggcaggagaattgcttgaacccaggaggtggaggttgcagtgagccgagatcgtgccgctgtaccccagcctgggtgacagagtgagaccctgtctcaaaacaacaacaacaaaagaacgtgtgtattcatttatttttcctagtctaactccccacctgatactcctgtccgctccatgagaggagagtttctgtgcattttttttttttgagatggagtctcactctgtcactcaggctggagtgcaatggcacggtctctgctcactgcaatctccgcctccagggttcaagtgattctccagcctcagcctcccaagtacctgggaccacaggcacgtgccactacacctggctaatttttgtatttttagtagagatggggtttcaccatgttggccaggctggtctcgaactcctgacctgttaatctgccccccctcggcctcccgaagtgctgagattacaggcgtgagccaccgcgcccggtctacgtttctgtatgtcttgattgctttttcatcctcgggttctaaagcctagacaggcacatggtctttgttaagtaaatgtgttgaataaatgcatgtatgaatggattagcacataaagaaatgaatgcatgaatggataggtgcatgaatagctgggcccaacagaatcagttaagaggcttaaccacacacacactcacacacacacacagacacaagcacacgcacacacaaacacacacacctacatacacatacagaggtgcttgagccctgctccaaaaataaaaataagaatcaacccttaatgatcacttactcattaagtataccaggcgccacgtttagcctgtgatgtagggcatttcactgaatcctcatgaccaccctctgcggtagggactaatgctatacttttttcatatgtcaaccctgaggctcagagaggtaaagtcactgaccccaggtcacacagccaagaggtggaggagccaaaattgaattcaagatctatttgattccagaaccatgcctgaccttactgggccagcggggtcacctctgaatcaagatttttaggattccccaggtgattctgatgcacagccaggttgagaactcctgggccagagcattgaggtttgggggagtctgctggctttgggaccagctgatccagcccctgtgctgcctcgcagcctggttccttatctctgacacaggcgtgatggcagcgcctacctcaggggatttcaggaggacctaatgaattaatccacacaacgtgttaagcagaacacagtaagcacttctcacagctcccctgggtgcagacagatgcattcccaacctcctagtgcagtgcctgggacaagctggaaagggcatctcagcagcattcgagaggctatcgcatctaagagtgaacgggaatgctatagtaattccatcccccagaaaaacatcttgcagaaatactcgcacacgtccacagagttgtgtgccctacagaccacgacagtgtggcttgtgatagcaaaagccaggaagcaggcccaatagacatgtttagggcagggctctccacttcagcaaggtggacgtttggggtcacataattccctgttgtgggggctgtcctgggcgttgtgggatgtttagcagaatccctggcttctaccatctagatgccagcagcatgtcactactccaagttgtgatgacagaatatgtctccaaaatcgctgaatgtccccagcattgctgaatgtcccctggaggaaaaaaaaaaaatcaccccatccaagtggagaagtttgtgacatgcccaaggagatggaactcatatttcagcaaagctgtgactttatcctgcactaagtcccaggtcacacttttcctatttgctttttgtggattccttagactttgctccattcacaatcatgtgttctatgactagagataatttcatttcttcttttcccatctggctgccttggcacgtttgaggacagaacttgcacaacacaaattgtagctcaagtggattatgtaatctgcacagggatgctttttcgggaagttaactttgttcaaatattgaaaattcgtaaaatagaagaatatgaatttttttaatgggaccacccacagagggcaattttctcacagtttgctcgtctgagtagctttctccattttgaaattttattataaagttgcaatcacactgtatgtacaatttcaaatcctgttagtctcaaagtcttcaaaatcatacttctcgtgttattacaaaattttctttgacgttctctttaattgttgtctattgtttctctcttatcctctgatcttctctaatccttaataatgaaaattgcaggctgagcatggtggctcacgcctgtaatcccagcactttgggaggctgaggtgagcggatcacctgaggtcaggagttcaagaccagcctggccaacatggagaagccctgtctctacaaaaaatacaaaaaaagccagatgtggtggtgcatgcctataatcccaggtactcaagaagctgaggcaggagaatcgcttgaacccaggaattggaggttgtggtgagccaagatggcaccattgcactcctgcctaggcaacaagaatgaaactccatctctgaaaaaataaataaataatggaaattgcaagctttcgctgggcacgtgaccacccagaagaaaatctacacttcccagcctctcttgcagctaggtgtccatgtggccaatgggatataagtaacgtctaagtaatgtctgtgggaaggggtgcctctactttgtcccatcctccttgctggctggagtgcagatgtgatggccggaacctgagtggccatcttgggacaaggcggagcaatgagagaaaaggacgctgagtccccagtgaatttgtacagccaccctactagtcctagactgccacctccacgcatcttttaggtaagaagcaaatttctggctgggcgtggtggctcatgcctgtaattccagcactttgggaggccgaggtgggcagatcacgaggttaggattttgagaccagcctgaccaacatggtgaaaccccgtctctactaaaaatacaaaaattagctgggcgtggtggcaggcgcctgtattcccagctactcgggagcctgaggcaggagaatcacttgaacccctggaggcagaggttgcagtgagctgcgatcctgccgttgtactccagcctgggcgacagagcaagactccatctcaaaaaaaataaaaaaaatttcatttgagcccctgttattctggcttttctaacattcaaaggtgaacctaatcctaagtattacactaatattttgtgcagaaggtgtctctaacatccttttaggaaacatttcctgattaacttaaacattccctgcttattgggcatttaagtagattctgattcctcactattcttgtcaattcttttttttttttttttttttgagatggagtctcactctgctgcccaggctgcagtatagcagtatgatctcggctcactgcaatctgtgcctcctgggttcaagcgattctcctgcctcagcctccggagtagccggtattacaggcgcctgccaccatgcctggctaatttttgtatttttagtggagacaaggtttcaccatgttggccgagctggtctcgaactcctggcttcaagtgatctgcccaccttggcctcccaaagtgctgggattacaggcgtgagccaccacgcccagccttactcttgtcaattctgtcgtgaatgtctttgtccactgtcactattcatgattatttccttagtacagaatcccagaagaagggtttgggggtcaaagaacatgaacattcttaaagctgtcagtgcctgtcacccaactgccttccaaaatggttcagctgacataatgccctcctcctccagcaggggatgtgaggacccattttgggaccagggtaaagatgacaacattccacatcattccctccagcagctgaaaatgagtccgagatagtcatttttggatagttcttaaatacaacatatggatgagcagtcattaaccacgaagcttaggagacctagtgtgatctagtgtcaatctgggtttcttagttgcgagggacagaatgcacccctctggctagtttacacagaaaaggagtttatcaaaggttattaggtggttcataggaccctcaggggagttcctgagtcaggactgggggcaacacagctaggaatgaggctggaatttgatggagagctgccccagtgagccccacttctactcaaggacgcccccactgcatcctccagacccaggttctctttcccacctcttttgtcctgttgttctcttttaattggaagcctctcacaggggagcccacttcacactcccgcacccgggaggctcagggaggctaggaaagcaagttttctggcaattcctttgagagatgtgatctactaaggtaggaaattccctgaagggtgaccgcagggtgtgggccagaaagtagggcaaaggtcagctccttcggcaaagacggctgggcttgtgggaagaatccaaaaaggtttctagcaacaccttctccatttctcctccactgagggcaagagaacagcagagagaagtaaatgacaaaagtgtcattcccatttgtgtcacccttggggttcacccaactctgcagaggctaagttagagtggggaccttgagatctgtcctcgcttcaccaacctgaggccagcaagccaacgcggatgtctctatctgatggatgtgtgtctcctggacccctgaccacatccttcaaggagacgtttgtgaaggatgtgtttgccttgtccactgttgcactgaacaacaccagcatccggacaagccctggcacacagtaggtgctcaatagataaatctcgaatgaataaatgatggcactggactctctgccttggaagaaaccttggagtctagagttaccatggattgactcaaccagtatttcctgagcacctaccatgctccaggccctattttaggtgctgcggatactgcaggaaagaaaagaaagtcccagtccctgtcttcagagtgaaggagatgggcaatccattttaaaacgccaaaaatattcatataacacagcacaacacaacataacatcatataatctgatctaatacaataccaagtaaaatgttttacaaggaaatgtaaaactggataagtgatttggagatgctcatttagaaaaataattgaggaaggcctctctgagaaggtgatgttcaagcagagatctgcggtaggaagggagtgagctgagcaaatatgggagggaagtgtattctgggcagagagagcagccggcacaaaggccctgaggcaggaatgaatgagcttggcgtgtgccctttgtggtgaggcggtcagtgaggcaagggttacaccaagtttcccaacttcagcaaatctacagaacccttaactggcggaaacaggaggtagggagggatgagttcttcactcttaagcttctctgggaaaacatgatgtcagggacagacagtaaatcttgacttgtcccagaaaacaatgggcccatgtaaccagtgaagtgttagcctgaaagtaaccggccaaagggctggggtgtgggtgggtcatatggaatttgttaacagatctgcattagaaaaagagcttcccagttgggggcagcagaagcttctggctaacatcaaaaagatgtttattgtggtgattctgtgcagacatgaaaaatggagattcgccacacagagatgtggaaagatgtccccaatacgttaagtgaaaaaataggccacaggatagtattatatattgtacaatcccttttgaaaattcactagtcatttattcagaaaatattcattatggacctaatgtggtgtggaagacccagacgcggtcttgcctgcctcctggaactgaccgcacagtggggaaggcagatgacgatcagatcagtacacaaacatatcatccaaacctttgatcagcactaaggaaagatacctggtgctaccagaatgtgcacacacatcaagtgatggaaaaagcctgcgaggatgtgctccaaaatgtcaaagtggtagtaaggtttcaggagattccactttccttttttgtttgttttttgggatggggtcttactctgtcacccaggctggagtgcagtggcatgatcatggctcactgcagcctcgacctcctgggctcaagccatcctcccaccttagcctcccgagtagctgggaccacaggcgtgcaccagcacacccggctaacttctttttttctttttttaattttgtagagatgaaggtcttgctatgttgaccaggctgatcttgaactcctgggatcaagtaatcctcctgtttcagcctctcaaagtgctgggattacaggcatgcgttaccacacctggcttgattccacttttcttatgctcctctttcttttgattgtctgtaggttctgattttttaaaataaatgtcatgatttataatcgagtgaataaaaaaaaaactcaaaatgaataggagcaggagagctggaactcacgggtctgcagaggacttagacccagggaaggaagaatacacaagaaaccaatcaacagaggctggagtaggaggtatcctcacttctccctggataccttttgaaccttttgaatatgtaagtattcaaataatagtaataagcaaaggtattttaaaatgaaactttgagtcaagttttattttcgtgaaaaatgaaaaaacagacaacagtaggatctcaatttaaatacgcgagctgagctgaattcccgtgcacatcttagagtggttctctctgggtcacctttttagttttcttctttgtacttttctgtgtctcctatatttaaaataagaagaataaaaaaagacgagaaaaaaagactaccgaatatagaccatttaccacgggcaagatcccattctgggtgctttacaaacatgcttttgcttcatccccatgaccttctcattccttactttcatttgacagatgaggaaactgaggctcagagcacaaagtcaccggccagggtcacccggccggatttgacccgcgttgatcagatcctaaagtctgtctctaaactagaaagctcaagtacccttggtatgtccttcaaggaaacgactttgctttgaaaatcagggggaaaaaataaacaaaccaaacaagaaatatgacatttttttaaaccacttatttaagctctgatgggacctgagaccagccgagcttggggagggtttctcggcagggcactgtttgtgttgtgggtggggctgtcctgcctggcagtcccccatggcacatccctgcctgctcgtcagccatgttcccctgtcactgtgacactcagatcccccatctctgccagcctcccctccttgaagactgctggcctagacactgcagtgacactgaattcctgctggggcctcgctcctgttgtcctgtgagccactgtgggttgacaccccctgcagacctgagaagcaggtgcctcaatggctttgttttacaaggagactcagagagggctgggtgacttgtcacacagccaagacttggccccatgcaatactgcctaccctctgggaccaagtcttttgtggttgtggggtcgaagcaggggaagggaaaggcgagtggcctgcagccccaggctcagagggaaggcagccacaaagcgcggtccactctccagccagctgagctaggccgggagaagtgaagctttgctgccaggctgggtaggccaggccgggcggcgggcaggcggccactacagtggggaccgggaagtcgagcactccctctcgcctgcccggcagtgtcccatggccgcccgccaggccccgcctgacgtcagggtctgaccagggacataatgtgctggcgtggggacaagggctgactgcagagagacagagccgcaaggcggggcggccaggggaggcgggcaggcagaggaggagagagagaaagggagagagagaaacaggcagagtgagagagagagagcgagagacaggggatgggaaagagaaacacaaacagatggagagagaaggaaacagagggagggagagagaccgagaaagtgaaaaagagaaacagacagaaaagagacacagagaaggagaaaaacacaactaggaagatgttcagggaaagctggagagacagcaagagccagagagacagcaagagccagagagaggaaagtggaggtgctgggggggaaatgacagagagaggaggcctagcaggggctgtgcggttaagggcaggtgcttgggagaccccagacctgggctggggctttgactctgcccctgtgagctgttgactcacctctgagagcctccactccttacctggtgcaatgggagtctgagtaacagggcttcgctcatctggggaggggacagagcccctttccatgatgcgagagggagaacaggagtcagatctgtgtaaagtactttggcagagccctgcatgtagtaagtgctcaataaattggaggtgaaaattgagaaagagttgggaagtgggaaatggaatgccagagtgtgagtggatgggggtcgcccccatggacagaaactctcgctccacagcactcccttccctgtagccttggaacaacccccttcctgtccctgcatggcttcagcttgaggccaccagcacagaccttggcctggccttgcctgtcttggggcccaaccccctgcttatgggttcaagaaggccatgatcccaaggccatcgcgtcaccaaagccaagcaaggccagaccctggtcacttctggctttccagcctcgtcacccctcagccgcttaattgttaaatggcctggcagggctgagggactgagccagccgcctgtctgggtgggggcagccgttcccgcatgtcctccattagtgcaggggcacacacgccagaggcctcaggtagcacttgctgaggtgaggatgcaaagatccctttctctagctcccactattcccagaagccttcatcagcctcagcctcggcctcaaattctcactgtgtgccaggcatgcttctgagcgcttcacaggattaatctacttaatcctcctgacagccccaagagatgaagtgctaacattatctcattttacagatgaagacgctgaggctcagagagctggagtcactggtccaagcccacctgctaaggagtggcagggccaggcagccacttaaccacagagcagctacgattccctgcacaacttgagcagcagcctgtgccgggtggcaacacaagcgcccggatcatctgaccagggagcagtccttggctgggagtgattttgcccccacaggagatattaggctatatgtggggacatttggggttgtcacaactggagagaagttactggcatctgatgggtggaggccagggatgctgttcagtgccctacagtgcacaagacaacccccatagcagagaattatccagctccaaatgtcagtagcaccaaagttaagaaccttctataaggtaaattctattacaatctccatgttataaatgtggaaactgaggcacagagagagggtgggactataaggtaagttctgttacaatctccatgttatagatgtggaaactgaggcacagagagagggtgccacttgcacaagaagcccacttcatgccctgctcttccataagaccccactgccaatctgcattaagacacccctgcctccattcgaggccttctgagtcctcacttgctcagtacagacaatgcttcgcatcctctcaatatatgaaggtcatcttagtcattgacagaaaaaaaagatcaagccacaaagtcactgggaatgtacgaatgccttaaaatgaatttatattttattcatggcagcattgagggacatttgaaataaaccaaatatggattcatggagcaagtattttctgagcacctactaagtgccaggccctgtccatggtgctggagatacagccgagaaccagacagatccagcccctcctgggtctttaggaggtgacagtctggtggggaaggcagatgatagacaagaaaacaaacacacaaccaaggtcacttttgactgtgtgaaatgcaactgtggggcaggagaagggccgttctagggagggtgatgtccaacagggcctctctgagaagatgagacccaaaggaagagaaaggtccagtcttaggaagaggcaggaatgaaaagttccaggcaacagagcacgtgcagtggctcacatctgtaatcccaacactttgggaggctgaggcaggtggatcacctgaggtcaggagttcgagaccagcctggccaacatggtgaaatcccctctctactaaaaatacaaaaattagccaggcgtggtggcgcacacttgtaatcccagctacttgggaggttgaagcaggagaattgcttgaacctgggaggcagaggttgcagtgagctgagattgtgccactgcactccagcctgggtgacacttctgagcttctgagcactttttttttgagacggagcaaagctccgtctcaaaaaaaagaaagaaaggaaaaggaaaggaaaggaaaggggatggaagggaggggggaggagaggagaggagaagaaagggaaaaggggaaaggaaaggggaaaggaaaggggaacaggaaagggaagagaacaagaagagaagagaaaaaagaaaagagaagaaaagaaaagaagacctggcacggtggctcacgcctgtaatcccagcactttgggaggccgaggcaggcggatcacaaggtcaggagtttgagaccagcctggccaacatagtgaaacccatctctactaaaaatacaaaaattagccgggcgtggtggcgggcgcctgtagtcccagctactcgggaggctgaggcagtagaatcgcttgaacccgggaggcagaggttgcagtgagccgagatcacaccactgcactccagcctgggcaacagagcaagactctgtctcaaaaagaaaaaagaaaaagaaaagaaaagaaatgaaatgaaaagtcccaggtatagggaacagcatgtgccaaggctctgacgcaagtgtttgcctggagtgttgaagtacaagcaggaggccagtgactggagccaagtgaggcaggagagaagaagatgagatggggaagtcacaagtgaagagatgtgtgataccatgtgaccactataagggctttgcatgtaggaggtgggagccatagcaaggttttgaggaggaggcacagggtctgattcaggttctattaggatcatcttgaatgctttggttagctgaatagtggccttccaaagatgttcatgtcttaattccccgaatctgtgagtgttactttatgtggcaaaaggaacttggcagctgtgattcagtgaaggctctgaagatgggaggattatcttggatcacccaggtggggccaattaatcacaggagtccttataccacgaggcagatggagacctgcctacagaggaggagaaggcaaagaggagagagaatgacagaaacagagactgcagtgatgtgctttgagagtggagggtggggccataagccaagggccatgagcatccactagaagctgaaacagacaaggagacagattctctcctggagcctccagaaggaagtggtcccaccaacacttcgacttctcacctccagaactttaagaggataaatatgtgttgttttcagccactaagttagtggtcatttgttttggcgacaagaggaactgagtgtgatgcagtggggaggatagactgtaggagggtgagggtgggagcaggaggacccatgtggagaggctactgcgattgtccaggcaggaaagaatggcagatgaagagaagcggatgcctcactcggccatcgctgggctggtgcctaggacacggagctggccactgcatggttcttgttttgaagaagactccagctagaagaggctcaagaacagttctgggaaatgggaaggatgggcttagctgggctagaacctcatgtcggtcaggtctctgtcccagtgtcccctgcagggtggtgtcctgaccatcccggccccgggaaccctcccagggctcccgctccctcactcagcttcagtttgctgtgtgtgtcccatcatcatcccgtgtgctacacctctgtctgtttctccattgtctggacccaaatgaggaaggactttgcctatcctgctcactgcgcatctccagcacccagaaacggcctggcacaaagatgtgctcagcacatacgtattgggtgaatgaaccaacaaatgaacccccattttccaaccaggaaaatggttgaaaactataccaggaaggtgacttactcagcaccacacagtggctaactacagatccaggatttgaacccagaacggactccaaagtttgcactaagtagcctacttccttgtaacaccaatgacactgcctgtgttccagaaattcctactttgtgggagtagtgctgtatccttcttgaggggtcagacactcgaaacacagcacctcggggaacctacaggacaactgacctgctcgaggctattattagatgaggaaaccgaggttcagaggggttggggtcttccctgaggtgcacagccagccggcggcagagcctagagctgggactcaacccttgttggatcccatagctgggggtctctctcatattttccaccttgctctgggtcccagagaaataagaaagactctcctgccctaagaggcagagtaggtgtagatcacactgcccaatgtccgggctgagcctggaggaagcccagcaacacctcaagctggaaacttctgaaaaatgaggctggggggttaggatctagggccctggggtgaaaccccagctttgcccctcccctgctgtgtggcctcaagcaagtgatctcctctctctggcccaggtctcctctaataactccaaccaaaattctggacagagttgataaagccctatagactacattttaaaatcaaaacacccagccgggcctggtggctcacgcctgtaatcccagcactttgggtggctgaggtgggcagatcacctgaggccaggagtttgaggccagcctggccaacatggcaaaaccccatctctactaaaaatacagaaactagccaggtgtggtggcgggtgcttgtaatcccagctacttgggaggctgaggcaggagaatcacttgaacccaggacgcagaggttgcagtgagccaaaatcgcaccattgtgctccagtctgggcgacaaagcgagactccacctcaaaaaattaataaataataataaaataaataaacaaaaaagtaataaataaataaaaatacaaataaattttaaaaattaaaagacccagtgtgtattctagctgacattttatatcagattgtactgcctggggacatacaaatgtagtcataataaaatgtagtaaaccaaatttggaaaaaattaagaaataaaagaggagtttcttttcctctcatgtgaatgaagtccagatgtaggcagtttgggatggatttggtaactctatgaagctctcagtatctcagcttcttcctggacaccagtctgccatctctaggtgtgggccccactttctcatgatccaagatgaaggccactgcaccggccttcacgtctgccttccagaatgacaggatggagaaggaaggatgatgagtaaaaggcaggcatcaactaaatctctaggaaacagtccagaaacctgtcacactactaatttcaaccccttggccagagctcaggcacatggctgcacctagctgcaagggaagctaggaaggtctgtgtttattctgcacagccatgaactcagctaaaagccaatcaaatatttgtaaataaacaaaacaattttagatagtgatgtatcctgggaaagaacaaaacagggtaatctcttggacaatgagggtgggaaaatgcctccctcaggaggcagcacagctgagatataaatgataataaggcctgagggacaagcattccaaacacgaggaacagaaaagcaagctgccttgaggcagaaacaagcctggtattgtaaagaaacagaaaggccagcatggctggaactgggacagggatgcagtgggaggcgggcacagctggtaggaaaggaggtcagagagttcagcaggttagatcctgggagaaacgggaaggccaagggaaaaatctggattttttttttctcctctaagtacagtgaggcaatattagagggttgggctgatatgctatcactaatggagagaatgccgagctcccctggctcctggaggatttgccataacccttctgagcacttcattcactcaccaattcattcctctcataaatattcattgctgacctgctctgtgccaggtactgacttacggcagcagaaatgactcctccagtccccaccctcaggaaaagaagagacagactgagcaaacacaaaagcctataaatacagctcccagatggctgccagtggtttggagggaaggtaaatggggccacaagaggacctgagttcacctggggatgggagggggtttcccactggtggtgatgtttgagctgaaattggaatgataaggacactttgtcttgtggtctggagacggagagaacattccaggtagagggaacagtttgtgcaaagggctggaggcaggaagagagctgcatatatccagaaactcaccaggctctggcctggcaagagttgagaagggtgagagagaaggtgtctcaagatggccctggagaggtgagcagaagtcagatcacagaaagcctggaaggggccaggcgtggggtctcacgcctataatcccagcactttgggaggccgaggtgggcgaatcacttgagatcaggagttcaaggccagactggctaacatggtgaaacctcgtgtccactaaaaatacaaaaattagctaagtgtggtggcacatgcctataatcccagacacttgggaggctgaggcaggagaattgtttgaacccaggatggggaggctgcagtgagccgagatcacgccactgcactccagcctgggcgacacagacagactccatctctaaataaataaataaataaataaataaataaataaatgaaagtctggaaggagggtggggctctcgtgttctgggaggatgatttatgaagaactttgaccccaaatccctgggaggggcctgtggccaatcccagacaagcagggcctggctctccttggacagtgtttacaagctcgctgatgactcggccttctgccttcctgcggtttgctaatcactgggtgctatgtgccgggatgttctcctgctcctcagccctgagagcacactctgactcatgcctcctaccccagccaccccctcccatcaccaccaaggctgccatctccccccgtgacccccaaggccccacagaatcacacgaccctggcaccaggaagtgcacctgtgtctccaatcagaactgcccatttcacagaggaagaaactaaggtcccatgagaaaagcctttccccaagtctcaccccaagacaggaatagcaccagggcccggtcccaggtctcctaacacctggtcctaatttttcccactgtttaatgacagaagagagaaaatgagaagaaaggaagcaggaagaggtggaggagaaagcaaggagggagtgaggagagggagggaaggggagctggaaaagcagtgttcaaatccccaactcctaagtgagccctgggaggggaggggagaggattcgtgtttgttgggcacccactacacgccaggtgcctcgactgtgtcagctccttcagcagaatcctcacaggagaatggatacaattacttactctaaatgctttggaaaacagagaagctgtgcaacccatctaccatcacacagcagttacctggcagagaggagaatggaacccaggtctggctgcaattcctaaccctaagcacactccaggccccaggctgcctccagcccagcctctgctccgctcctctttttgaggcagttgcagcctccacttccagagccgatcagcagaggctttcccccggctgcccacaagccagcagacggatttcctttggcccacagggcattttaattaaatttgagctaatgttcataaatcaagagatttcacataaaaattcagatttctacctcccttaaaacactgtaagatttcactgggctaaatccacattcccacctggcaaccgtcagctggggacaggggtatttgaagtggacacaccagttcccccacactccccaactctccctgctgcctccctggtcctgaggctgaatgtcgggtgccattcatcaaaatgcatacactgttgttttctgagagcagggacgtatttctctgtaactgtatctctttcaaaaagaagaaaacaagtgctaatccaaaaggggtcaagtttcatgaaaaatgggggaatgtctaattctttgcggaaccaagagatactccttcatgcttattatgcagacgaagtgtgcctgagccctcacaccactgcttagcttcctaaaatatttttttttgtgtgtatctgaaattctaatttaactgggcatcctgtattttatctggtaaccctctctagactagtcaccttgctgggtgagtgatcttgattgagcaagtcatttaagttttctgggtttcaggttgttcctcatagacagggttaataacagcatgagaggttgaggtaggaggatcctttgaggccaggagtttgagaccaacctgggcaacatagcgagattccccatctctacaaaaaaaaaaattttttttttttttttttaattagccaggtgtggtggctcattcctataatcctagctacaggggaggctgaggcaggaggattgcttgagcctaggagtttaaggctgcagcgagctgggattacaccactgcagtccagcctgggtaacacagcaagaccctgtctctaaataataataaataacaagaggacctgatgagatattacacattaagagcttaggacagagcctggctcactgtacatgctcagtaaacgtcagctgctggggcagatgacaccagctgcttgcccaacacccattcccttgttcctcactaactgaaccctggttaatggcagccatagtgcctggccccaggggatgaatgtgattggtctagtcaagcatgccacacccattccaagctgccagtgattggaccaaggtgagcatgtgacctgactctagccaatgaggtacaacaagaagtcagcggggatgagtgctccagggagactttctctccctaaggagttggcactactgccgctgttcctccctttttgttttggacacatccattgggaaaaagggatacaggatcccagcccccatcttaagacagtgagcatggccaaggtctaggctggaggactcctgggctgacaatgccaaacttcgttttaagtaaatgatggatgtcgttatggccgaagccatttgctaattggctctatattagccgaagctaattggctctatactgtggcagcccagttatgttactgactagctctgtgcctcagtttccctatatggagaatggagggaacgatagtatccgctacatagggttgttgtaaagttattcaatgagttagcgtaaatgaagtgctaattactctacctggcaagttatactcaccatataattgttagtcattataattcttctgttatttgcatccaagtctttctaaactgatacagtcaaaaattccctgaaagctgtgaattctgaagtttgataatacatcaaagaatccaagccccaaaatataagcaaatgtgcctgtttaaggtgagtcaatgtcaaagattcattcaagaagtttccttatatttcattcaccctgcaaaggatctaagcagattcaacaggctgttcgtcagctcccaagaaggggaggtgggagatgggcgtgtcagccaatcctagaaataagagatagtcccatcatttggaattttgggtagaaactgcaggaccaaaatatggtagcctgagcataagtgtattagttagcaatgccttctgctgaaagcttcagaatgccccagtcacagtgggctaaacagtaaaggcattctattatttcgcagacaacactttgaaagttgatggcttcagggtcaaaaaagcatctcagcaatgtcattcagcatccagctactttcagccttcatatttagccattctgtgttggctttttatcattagccttgtggccccacagtaacaatatagttgccacagccccaagcatcacatcccttaatgaagttcaagataggagtgttgggtggtgagttaaaaagaaaacaatctcggccaggcgcagtggcttacgcctgtaatcccagcactttgggaggctgaggcagggggatcacctgaggtcaggagtccaagaccatcctggccaacgtggtgaaaccccgtctctactaaaaatacaaaaattagctgggcatggtggcacacacctgtagtcccagctactcgggaggctgaggcaggagaatcgcttgaacccgggaggcggaggttgcagtgagccgagattgtgccattgcacttcagcctggcgactgagcaagagtccatctaaaaacaaacaaacaaacaaaaaaacacaaaactctccccttgagctttttttttagagagatttttgttgttgttttggtttggtttttttagataaagacaagttctcactatgctgcccaggctggtctcaaactcctgagctcaaatgatcttcccacctcggcctcccaaagttttaggattacaggcatgagccaccatgcttggcctctccttgagctcttttaatctggaaagaaaatctttcccatgatctccctgaaaggacttcccttcacatttcattggccagaactggtcatatctctgctccacgctgcaaaggaggctggaaaagggaagtgggatagtgtgactggcacagcccaatcttaatccctctcccctggctggacctatcacctcccacccccaaacaaaatcagggctctgctgttgaggactgagggtccagctattaggcagccagtaaagggtgtcaccatagtgtaaacctctgcttcttccagaaatctcactgacagggtaaaagggcacaaacacacagggcagagaacaggcagaggaagagatgatgccactgggttataaaagctggacagcagatgatgggtgagggaacccactgagttggccagagaaaactggcagcaagtgcctgcaggaaggttgggcgaggcagaggcaggtacatggcaccccagagccctgaaaggaccgagacctctgcagggagcactgaaacctgaggggtgagatgaaagtccccaaggaccctcatcccccttcacgctcatggaagagtccaaggtgaagcagttgaaccagggatgccctgaccacaggaatgggggttctacacagaaaacaaatgtaaatctgtctactgaacaatgagatctgcagactccttctcccacctcgccctcaggaacagctgcctaggacaggagataaagactttcctatcttgggaagcacccctgactgaagacaaaagagaaagctcccggaagataatgatttggagttccccaacaaaggaccacggccctacccaggcaccccaccatgtgacaggccctgcccagacacacggagcatgcaaaggtgattaattgcctcacactcaaatatcacagaacatgagacatttgagaactgctaacacgagacacaaacaggaaaaggtcctggggagatgccagtgctccttggctggggacctagtcttggatctgtcagaagctggctgtgtggcctcggcaaagtcctgtcccctctctgggcctcagtttccgtgtagttgaggagaatctttctggccgggaacttgcctcaacatatctcctactggggcatgtgagtcctttgctctgcttgagaaattatcctgaaaaccattgggttattttgtggatctcacctggatgacctaaagggtgtggatttcaagggcagaagaaaacttatcagtcctcacggtgcatgaaattccagcatgctcctctaaaggggacccttgaaacaaataaatttcaatggatgatactcaaaggatgtgtgggaagagcgtggctagagaaggctggctttgagcacttaaatgttgcctggcactttacacacattgtcttatttccttactctctttgtgaccttgaggaaccacttaactatgctgtgccttagtttccctatctgtgaaatggaatgtggttgagactgttagttgtccctaagtatcttcccctagttccatagtaatgaacttgtagctgagcataggactgtctcaataaaaagtacatttcccagcctcccttgcagtcagatgtacccatgtgaccaagttctggccaacgggatgtgactgtaagctatgtggctgatttccaggttgtactttattttattttattttattttattagttaattaatttatttatttttgagagggagtcttgctctgtcaccaggctggagtgcagtggcacaatctcggctcagtgcgacctccacctcctgggttcaagtgattctcctgcctcagcctcccaagtagctgggattataggcacacaccaccatacccagctaatttttatatttttagtagagacgggggggttcacctgactaggatggtctcgatctcctgacctcatgatccccccacctgagcctgccaaagtgctgagattacaggcatgagccactgcacccagcctgtactttatttttttaattattaattttaatttttttagagatgaggtcttgctatgttactcaggctggtctcgaactcctggccttaagtgaccctcccaccttggcctagagttacagaggtgaaccaccatgcccagccaggctgtatttttttttttttttttttagagacagggtctcactttgttgcccaggctggagtgttctggctatttacgggagtgattccactactggatcagcacgggagttttgacctttccgatctgggccatttcagccctccttaggcaacctggtggttcccctctcccagggagatcaccatgttgatactgagcttagtgtaggcacccgattgacacagcgcactacaacccagaactcttggactcaagtgattctcccgcctcagcctcccgagtagctgggacttctggctcacaccactgtgcccagcctaggttgtaccttaaagggaaagggtatgccattccccctttccttttcccactggctggaatgtggaatgtgacaccctaaggaggggaaaatagcaagttagcagcccgggcatgggcagtgggtgtctgcactgtcagccccagcctaacacactgggtgtgaagcctcaatgtgttgagacatgtaaatcacttaccacggggcttggaacaaagttggcattctgaaattgtgagctgttttattattaccatcaacgttatgattataatcatcactccaaatgggcctgtgcaagaaggcctcttaaggcccatttttcagatgagaaaatggagctcagagaggttaagcccctgcccaaatgatcccagggggagggtagcagaaccagatctgccaatctggggaaggagtaaagagaagcagtagagggtggaagggggagcagtcccaagtccccatgccagccccatgcaagtccccatgccagcccataccagccctgtctggttggtttaaggggttttcttcagcgggtctagtgcagtgggtcttaaccagggacacttttgtaccctgggcgacatttgacaatgcccggaggcatttttttttctttttgctttttctttttttttttttgagacagggtcccgttgtctcccaggctggagtgtagtgggcgatctcggcttactgcaacctccacctcctgggttcaagcgattctcgtgccttagcctcctgagtagctgggattacaggcgcccgccaccacgcccagctaatttttgtatttttagtagagacagggtttcaccatgttggctaggctagtctcaaactcctgacctcaagcgatccgcccacctcggcctcccaaagtgctgggattacaggcgtgagccaccgtgcccagccctgcattttcaatcaccgcgactgggagaggaagccaaccgccggccctagtgggtggcagccaggaatgctgctcggtaccctacagcgcacaacacggcccttgccagaaagaatcaacagggctgtgggcgaggagccctggtctcacgagaggttgcccacccctcacctggtgccccaggaggtgggaggcttcgcgggctccaggtcttgggcaggattctctgatttcttcccctggaaggcgtctctctgccctcaccgcatcttcctatcactcgccctctctgtccacacaggcccatttgtggggcaagggattttcatcaagaggaatctctaacctcagcccatccctgcaactcacccctgccgcctgccccgctcccgaggccgggaacaagccccaacagttcagccttcctccccacccacccgttgccagcaaggccagtttccgggtggtgggtggagggcatggtgccatctgaatacggtccagttctccccggtgggggagggagagaagggttttgctcctggaatgcagggcccacaccatcagagctgcccatctgtctgtctatccgtccatgtgagacaagagcggggactgttgagggaactacttccaaatttctcctccctcaattcccaggaggtggtgagccccagccttctaggatggcaggccaggcttccagaaccttccatctcagccacacaaaaccaagagactgaagcgaaaggtaaccccctgaggaactcccgggatttgtgaaaaattcaagagggagtggcgcctgggcctgatccgcatccagaggctgttctgttggtgagcagtggctcatttactgaagtacagactgcaccctgtggccgcggcagccacgcccctctgcacccaccagtcctgttcactggcctaggcttcaggccgccagcacctccatctttttgccaagggctttctctggccaccacaccccactgagcccatgcaggacaagcggagtacctgagagatcatgcccctggcagctgcccttaaccaaccactgacaggaggtgatggaggaagacgccggtttccttgccccttggtggaaatagcctggaggcatgtttacactggctcccagagttccccagtggaatcgagccccagttgcccagaccagtaacttgctcaaaaatgtcccctgtgtgtgtcttctcatctgtgtctcatgtccccactcccttactcccttacttcctaagactaccacccaaacaaatcacttgaatccttgcctcggtgtctgcttctgggggcacccagcctaagaccaacacagtctaagaggcagacacagatatttgcagatcaggatgaatgtggctgccccctctagcaactcacaatcagatggaaagcccaacaccactcagtcacacagacgcagaattgcaaatggggagaaggctgagactgtgaagcaacagagaaccttgttgttaaaaccctccaatgggctgagcatgacggctcacgcctgtaatcccagcactttgggaggccagggtgggcggatcacctgaggtcaggagtttgagaccagcctggccaacatggtgaaaccccatctctacttaaaatacaaaaattagccgggtgtggtggtgcacacctgtagtcccagctactcaggaggctgaggtaggagaatcgcttgaacctgggaggcagaggttgcagtgagctgagatcgtgccactatactccagcctgggtgacagagcaagactccatctcaaacaaacaaacaaataaataaaacccttcaggcagggcatggtgacttatgcctgtaatcccagcactttgggagacctgaggtcaggagttcgggacctgcctggccaacatggtgaaaccctgtctctactaaaaatacaaaaattagccaggcgtggtgacatgtgcctgtaatcccagctactcaggaggctgaggcaggagaatcacttgaacctgggaggcagaggtttcagtgagtcgagatcgtgccactgcactccagcctgggcaacagagtgagactctgtctcaaaaaataaataaataaataaataaataaataaataaaaataaatttttaaaaactctccataggccaccctcccctcccaggccaaaattcaggtcctctaggtcctgaaccatctgccaccccttccctttcctgtgctcacctctccccatcctgctccagccataatgggctgctggctgtttctcagttgtgctgtacgtgttcctgcttcaggacctttgcacttgctattccctctcctcagatgcttttccctagatctccccatggccggctcctccttctagttcaaatcttggttcacatgtcacctcctcatggggtcacctcagcacccatcccccaccacctcccaccagtcactttctaaccatgtcaccctggtatattgacttcatagcccatatcacagccggaagttatattgcttacttatgtgttgaatgatccccaaagatgggctctgtgaatatgagcagaggctgtgtccccggtgcctggaacaaaacctggaacagagtaggagccctatggctgtttgctggagaagtcattcaatgtttaagtgatgagagggaaaatgaatgaatgaatcatagaaagacatttaacagggggacccaaccttgtctggaaaatcagggaaggcttccctgaggaggtgacatggagctgagatatgaatggagatggggtattaactgagccaaagggacaggaagagctactcaggcagagggaagagcacatggaaatgtccagaggatcccagaggacacaccaggactgtgcaggggacaagccagctgtagccgaaggttttccttaatatttttgaacctattatgtgtccagctcacggatacatggagaacaaagcaggcaagttgctgtgcccctggagctcccaatctggtggggaggacagacactcaccaaagagtgggccaacatttagtcccaaagtttcagttgcccttgcacagcctcctcttacagtacactgttgatgcttgctttccagaatacgccactgagatgctgtgtagaaacacacttggcatgaacacacacacacatacacatacacaataagtgaagaattccctggatttcccaccaaaagagatcagaaaagacattcagagtagctcctttttgttgttaataatttaattaatcaccctctaccaatgtgatcaccattagcacagagctataatttcctgagttcaagaaagaagggagcagctatgccaattgtatgacaatgtgtcctcccatagaaaatttaaccgccaccaccccgccgccaccactagtctgacaacagccaaagccaggcccagtcacctagtgggttctatatgaagtgctgggatggagccaggttttatctctcggcctcccagttccgggctcgtgttttgtccctcccagcagtcagaaaaaggctccagctggacgctcaagcctcccctcccctcccctgcagggccacagtagaattggtcccactccatttgcatttcctaccgggctcctaaagccttttgagtttttgaccccaggatgtcatggcaggagggtcacagttagatacctgtcagggaattcttcatttgtgtgtgtgtgtgtgtgtgtgtgtgtgtgtgtgtgtgctgagacagcgtttctccatgttggccaggctggtctcgaactcctgacctcaggtgatccacccgcctcggcctcccaaagtgctggggttactagatgtgagccaccacaccccaccaaaagttataaatttatgcaaataaatatatacaatttttatttgtccagttaaaaaatatatgcaagtttttgtcaattaaaaaaatttcatgaggggagggggttgggcgatcagggaaagatgtctagacaggctcctagaggtgagagaaactccatgttagagggaaacatagggctatgggaactcctaacaagaccccttaacccagcctgggaaatcacagaatccttcctggaggaggaggccttttcactcattcttaaagggtaaagtcagctagagcagggtcaaaaaccttttctgtaaagggctagatagtaaatatttatgcttcatgagttcctgtcacaactatgattacagatctaaagcagccatagataaaactgaaatagatgtggctgtgttccaataaaactttattgacaaaaaccacacgctgagccagatttggcccccaggccatagtttactgacctctgagctaaacaatggaaaaggagaaagcaagcaaaggaagtcacttgagcaaaagctggaggtgtaaaagagcagagaattaggaaagagccacgttgtggttttccttctccctgaggcacagaaggagttgtctatgtttacacaaagacttgggctctgacgcaagctgagtgcaggattccaaattcaccccatcgacaagtatttattgagtgcctactaggtgccaggcactgttctaggcactgcaatgacacagcaatgaacaagagactttctcctgtggaagacaaacactaagcacacacaagtgaacaagcgagccaaaaaaaatacagcttcctcacctgctgtgtgaccttgaagatgttccttaacctctctgtgccccaggaggataatatgatcagagtgcaggcccagcacacagtggctgttctataaatatagctgctgttattattgtaagtcaatatgcaaataaatacacattaaaaaaaaaaaaaaaaggccaggcatggtggctcatgcctgtaatcccagctactcaggaggctgagatgggaggccgaggccagaggaccacttgagcctgggaggcagaggttgcagtgagcaagactgcaccactgcaacagagaaagaccctgtctcaaaaaacaaaaacaaaaccgtgacacaggtagtacccaggaaccgggcaggtgcatgagatgagggtggggggtcgactttggatcaggtagtccgggagggcctctgaggaagtggcagtcaaagacgccctggatcgcattctgtgagccaatatcctagaattagagtttgcagccccatgccctgcagactcgcaagagcagttaattaaaaatacctgcctctctggagcacaggaaggtgtcttctctaattagtgtgtgagtgtaaagtgctttgaaatccaaggataaaaggggagtgaggggtgaggctctggtcacagggccagggtgtcccactgggaagcgatccatgaacccgaagagctagactcagagagccatgctcgtgctcacgggcctgccggagccgaccctctctcaggttccaagtggagtttagggcagcgggagatgcgcccacctagggcaggctgagaggagcagagcacggatgttggagccagactccgaggtcatgtgcttaaagccgtggacccagcacgtggcagctagcggtgccaagttggtattagctgtttcccgtcttgttacatgatcgcttttgtgttcttgtttttgctgttgttgttacctgccatttactagccgggtgaccctgggtaagttactgaccctctctgaaccatgattttcttctctgagcctcagtgttctcttctttaaagtgggacacttgcagcccagcagtgccgggtgcaggcaacacgtgtggcacagagcagaacaaacaccactctgcccagtcagccattgccttgtgccaagcactgcctcaagcatattgtatgcgttcactcatttaatcctcacagacattattcccacttcctggacaaggacctcagagccaccaggaatagccatgcactgcccagctccagggggccccaatcacacagaccatgacatgaacagcagccctgaggctgtaaaacacagacaggttaagtttttcacccaaggccacacagctagtacttggcagaactgggattagatcccagactgcctggctccggagctgggctcctgaccctgggtcagcgctggtccttgtcaaggagactaaagtaacagagggtttctgagatgtagagaaattggttctccctttgcccaggcaagcaggcagcaagtctcaatctgccgatctctcgtttctctctagcctaagaacctgtatgtttctggggattttttgatgttttgttgttgttgcctcctaattttataagagcaagtcttgtatgttttggtttgtagggcatactgccatcctgggaggcttctgaatatgccacgacatcaggcctcagattggcgctgaggaagcgctaataatcacgtccccgtaatcccatgctcaaggccttcacttgacaggctcagagaggcaaagtgacccgcccaaggtcacacagctaggaagtggcagagctgaaataggacttctagactccagcttctttcttaattcccacatctgatgtctcaaactggtggcccatgggccaaatgcagcctgtagaatgtttgatttggcctgcgtgacgtttttgtaaaattagaatttatcatcagtatgtaaagaaacggatatttccaggaatagtattcaaaatatttaaccagactggcctgggcatcgaccattcagagtggctgctggtgggatagcagaagccaatggctactgcaaaaagacgccataaaaaatatcagatctggaaaatgcaaaaccatggagacaataaaaagataggtggcttccgggagtgagagggaggaagagatgtctaggtagggcatagaggactttctagggcagtgatatgatgacaatggtggattcctgtcattacacatttgtccaaacccataggatgtacaacaccaagagtgagccctaaagcaaattatggaccttgagtgacaatgatgcatccatgtagttcatcaattgtatcaaatgtaccaccctggtgggcaatgttgataatagtggaggctgtgcctgtgtcgggggagggggtaggtaaaacatctctgtacctttctctccattttgctgtgagcctaaagtttcttttaaaaataaaggcatttggccgggcgcagtggctcacgcctgtaatcccagcactttgggaggccgaggcgggcggatcacgaggtcaggagattgagatcatcctggctaacacagtgaaaccccatctccactaaaaatacaaaaaattagccgggcgtggtggcagccagctgtagtcccagctactcgggaggctgaggcaggagaatggtgtgaacccaggaggcggagcttgcagtgagctgagattgcaccactgcactccagcctgggctacagagcgagagactctgtctcaaaaaaataaataaataaataaataataaaggcatcctaagtcacaggatgagataagaggtcagcacaaagtacaggtcataaagaccttgctgataaaacagactgcagtaaaggagctggccaaacccaccaaaaccaaaatggccacgagagtgacctctggtcatcttcactgctacactcccattagcaccatgacagtttactaatgccatggcaatgtcaggaagttaccctatatggtctaaaatgggaaggcatgaataatctaccccttgtttagcatatgatcaagaaataaccataaaaatgagcaaccaggccgggcgcagtggctcatgcctgtaatcccagcactttgggaggccaaggcaggcagatcacctgaggtcgggtgttcaagaccagcctgaccaacatgaagaaaccctgtctctactataaatacaaaattagctgggcgtggtggcatatgcctgtaatcccagttactggggaggctgaggcagaagaatcgcttgaacccgggaggtggaggttgtggtgagccaagatctcgccactgtactccagccttgggcaataagagcaaaactctatcaccaaaaaaaaaaaaaaggcaatcagcagccctcggggctgctctgtctatggagtagccattcttttattcctttattttcttaataaacttgctcttacttcacacacaaaaaaataataaataaaacttacttttggccgggtgtagtgctcacacctgtaaccccggcactttgggaggccacgacaggtggatcacttgaggtcgggagttcaaaaccagcctggccaacatggtctctactaaaaatacaaaaattagccgtgcttggtggtgcgcacctgtaatgacagctactagcaggggctgaggcaagagaattgcttgaacctgggaggtggaggttgcagtgagctgagatggcgccactgcactccatcctgggcaacagagcgagactccatctaaaaaaaaataaaataaagtatatgttttaaaaattcagaaggtttggctacatggctcccacatttttacaggaccatgatggctgcagtgagttccaggtgcctccatagataaagcgtgtgtgcccgagcctgtcggtcccctgagactgcctccctctgtagcatcagccagccagtccccgcaggcacctgagcaatgactcaggcatgaaggggattctttggaagttcctggtgagaaagagaaccgggtgaaagtgtggcctgcaggagtggccaatgaggagcaaagaggagggtgacacccgcctgtgtcagctcctgctcatcatctccccagtgggagcctcctgtgcactttccacaggaccgagtgagccactcttgattcacccttcctctgcccaggcctgcagtgggcgggtgcccaccgtggtacacagcccatgaagcagccaccctctgccactgaggcttggcagtctgaatggatgccagcctatgagattagaaggaaaatgggcaggatgtgaaaaatcagaagctgcctgactactcctgggaaattgttcctgagaccatgcccttcctgcgtctacttgtagcatcgctctttcactgacaagcatgtatcgagtactaggcaagtccaaaggaggtcttgaagtagatacagcaggacaggcaagaggctggttccatggccagctgctgtttgtacctgaccaatgttcctcccccatgttccggtaacagcacccttccaccactatcactccatgtgcctccccaaccagaggaggtggatgaatgaggcctgggaagtcagcatattccatccccccggccccagggattggtctgagatgggtatgtgacccaagtctggccaatcacagtcaacccctagacatgtgctgaggctacacagaaagtcagcttctgctcacttggcttgtcgatctggcagaatggaagctgggggatactggggactatttttgccaccacataaggtgaccctaactgacacggaggaaaacagaaccaagaagtggaaacagcatgattcctaaacaacagatgcacacctggatccagccattcctgaagctgaaggtcttttcatttaaatgaaccaaaacattcacagaaacacacactattttttttcttaagtcactttgagttgggtttgtttctgtcactttcaaccaaaagaccctgactatacaagtggatgtatagctgtttccaggctggaaaacaaacagctatggcaaaagcagaccatgagacatccatgtaaaatctgggagttgagggctgggtgcagtggctcacacctgtaatcccagcactttgggagtctgaggcaggtggatcggttgaggtcaggagttcaaggccagcctgggcaacatggcaaaaccctgtctctactaaaaacacagaaatttgctgggcgtggtggcatgcacctgtaatcccagctactggggaggctgaggcacaagaatggagaattgcctccctctgaactttttatttggtgctataaataaaccctttcaggtctgagcggcagtcaggtggatttccagttacttgcagctgaatgcatttctacctgtcactcctcctcaggaccataggttgctctggattcccaccacacacgtggagatactgaggtctggaatgcagagaaaacttccccagtgtcacgtggtggagtcatgagtttactgactcactacccagtgctctttccgctcaagacaacctcgtggtccgttcctttcattcgggctgctgtatgcatggccaacagctgctttgtaaattaaacacttcccatggaggcagtgatgatgatgaccttgcccctgaatctttccagcctcttacgtaaatcgcccctgggtcactgtctccatgcctttggacccaggacagcttccccacatcctttaaaacgatgagataaccacatgtaaacccagtgctcctggaaaggtgtgagtcatgcatcacggaacagaaggttcacagccaggagtccgcctatcatgcttgtcatccagccttccaggcttgcgtggagcttgttcactgcaaagctgattcatctgcagcttgtggtcagctctgacactcagatcattttctgctcatcttgtgcctggctagtgacctttaattaggtgctgtcaacttcctgtcttcctgtctctgtccatgttgtctttccccctattttaaaaggactgtatgaatactaaagacatgatgatgatgatagcagttagcacttactatattctaaatgctctatataaatttaaaagttgtttctcaaaagccattgtctgagataactagtattactattgcagttttatggattggaaaacaagggcttagaaaagtgaagtcactttccttgggtaacagagccaggagtatttggtggagctggaatatgaacatgagtgtgttggaccctggagtgcagctcgaaaacacaaagccagttgagtctgttaagctagcttcagaggctccactacagcagtttagactctaattacatttactgtttgtttaaaagacttctggacagactggagacctcatggtgtatttgtcatcttaaggttgtcataaaggacccacagtctttgcactttccctctcctccgtcaacagcaagtcagcaacttgtcctcagtctggtcttcacatcacagatggctgccacagctcacgcatcacctcttcacacaacaatgtccaaagcaggcagagaaggaaaggggcaaataggtttctctttatgtgcctctttcttgtcatagagtaaactctttcccagaagcccccagattagtttccctttggacaaaactgggtcacgtgaccacctctgagccaatcgcaggtccaggagaacagggtggctatgactgggtaaagcaaatgcagtttttcccctaggactaggcacatggccagctgcagaaagtcagggttttctcagcaggaaaggagaggggaatggcagttgacaaggcaacccgcagtgtctgataccccagcatttaaaaatgtttagcacagacacccacgttgatttgcaatatgattgtaggtggtacatgaagttgtggttgcgtgtttttaaataattttagtatttattaagtatttaaatgcatttgaaaaaaacatataggccaggtgtggtggctcacacctgtaattctagcactttgggagaccaagactggcggatcacttgaggtcaggagttcgagaccagcccggccaacatgatgaaaacccatctctactaaaaatacaaaaattagccaggcgtggtggtggtgtctgtagttccagctactcaggaggttgaggcaggagaatcacttgaacctgtgaggtgggggtggaatgagtccagatcgtgctactgcactccagcctgggtgacaaagcgagactctgtctcaggaaaaaaaaagaaccaaaaccatatatatggctatctcatcaatcagaaccacaacaactataaaacaactatatttaaggttttttgcaaaaaaaaaagttaaagaaaatattaagtaaataatagatcatttgcttcaagatttggcaaatgtaaggataggaaacgctgttctatgttatcctgcttggccttttttccaacttctcagaggcgttctgccttcaaactccctcttgaggaaaataaacacccacaaagatttttgcatcatctgcaaatatgattcaaataaagccttgagctcaaatataatccaggcttcctcagctgggaaggacaggcatctcgagtccaagcctttcctggtatttcacctctgtcttcatggttttatggggttttattgggtctgtccctcctctggaaagccaccacaaatccgatttctgagagaacaagatataaataataaacagaatgactccttgagatttcttgtccttgtgaggaattttcaaacgttcctaagacatgaaatcttttcgtttaaacaagagtttgggagtccgtcatgagaactggataaataatggcccagtgacacagggacatatgtcagagcctttgttcaaagaaataaagtagctcaatatgtgccgatagcaaaaggcgcctgggatctatcgtgatgcgagaacagcaaggtacagaacaatatgtgcgaggtacagaaccatatctgcagactttttctgtaaagggctgcatagaaaatcctttgggcattgcaagccgtactgtctctgttgcagctgctcagctctgccatcgtggcatgaaagcaatcatagatagcgcacaaagcagctgggctgtgtatcaataaaactttatctatggacacagatgtacattgcatataatttttgtgtgtcataaagcattcttctttcttttttttttttttttgagacagagtctcactgtgtatcacaggctggagtgcagtggcgtgatcttggctcactgcaacctccgcctcctgggttcaagtaattctcgtgcttcagcctcccgagtagctgggactataggcatgcagccaccacacccagctaatttttgcatttttagtagagacagggtttcgccatgttggccgggctggtctcaaactcctgacctcaagtgatttgcctgcctcggcctcctaaagcgctgggattacaggtgtgagccactacacctggcctcaattttgttttgttttgagacggggtctcactctgtcacccaggccagagtgcagctgtaccatcacagctcactgcagcctcaacctccctgggctcaggtgatcctcctgcctcagcctcctgtgtagctgggactataggcatgtgccaccacccccagccaatttttgtattttttgtagagatggagtctccttatgttgcccaggctgggctcaaactgctaggctcaagtgatctgcccgcctcagccttccaaagtgttgagactataggcatgagacaccgtgcctggcctttctttcaaattttaaaaatcatttaaaaatgtaaaaaccagccgggcatggtggctcatgcctgtaatcccagcactttgggaggctgaggtgggtggatctcctgagttcaggagtttgagaccagcctgaccaacatggtgaaaccccgtctctactaaatacaaaaaattagctgggtgttggggtgcatgcctgtaatcccagctacttgtgaggctgaggcaggagaatcacttgaacccaggaaggggaggttgcagtgagcccagattgcgccattgtactccagccttggtaacaggagtgaaattctgtgtcaaaaaaaaaaagtaaaaaccattcgtagcttgcaggccatacagaatagtgagacagatttggcttgaggacgataatttgccaatccatctataaacctctgatgcataacaaaattgtagagaaacaccagaagtatagagaggcatgctacacgtgcgtgtgtgcacgtgcgtgtgtgtgtgtgtgtgtgtgtctgtgtgtgtacagctggctctccatacccatgggttccacccatccgtagattcaaccagtcatggatcaaaaacattcaaagacgctgggcgtggtggctgtaatcccagcactttgggaggccgatgctggtggatcatgaggtcaggggttcaagaccagcctgggcaacatggtgaaaccccgtctctactaaaaatacacggtggcatgtgcctgtaatttcagctacttgggaggctgaggcaggagaattgcttgaaccgggacccgggaggcagaggttgcagtgagccgagctccagcctgggctacagagcgagactctgtctaaaaaaaaaaaaaaaaaaatcaaagaggccgggcacagtggctcatgcccgtaatcccagcactttgggagaccaaagtggtggatcacctgaggttaggagttcgagaccagcttggccaacatggtgaaaccccatctctaccaaaaatataaaaaattagtcagtgtggtggcacacgcctgtaatcccagctattcaggaggctcaggcaggagaatcacttgaacctgggaggcagaggttgcagtgagccgagagcttgccactgcactccagcctgggtgaccgagtaagactgtctcaaaaaaaaaaaaaaaaatatatatatatatatattcaaagaagaaatgtgtctgtactaagcatgtacagactttttcttgtcattattcactaaacaatacattaaaaccactatttacattggatttacattgcattacatattataaataatctagagatgatttgaagtgtacagggggatgtgcctaagttatatacaaatgttactttattttacataagggactcaagcatctaaagattgtgatatctgtggaaggtcctagaatcaatccccaaggataccagggacaactggagagagaagcggggagagagagacagatatttgtttatatctctaaaaggacacactaacaactggcaacaagaggtgcttctgaagaggggaactgggaaatgtcagaggaaatgagaaggaagatattttgcacgacatggccttttacactgcttgagtttttctccacatgcttgtgttacttttacaaagcagaaaacatttgccaaaggattactatgccacagacaataaaaatgagacgctataaacaaatatacacagtcatgcatcacataatgacattggtcaatgatggaccacatatacgaccgtggtcctgtaagactgtaaggcggtatttgtactgtatgctctctacgtttaggtatgtttagagacagatacttcccattgtgttaccattgcctacagcaggggtccccaaccctccaaggtaccagtccgtggcctattaggaactgggctgcacggcaggaggtgagtgacaggtgagtgagcaaagcttcatctgtattgacagccacttcccatcactcgcattaccacctgagctccacctcctgtcagactggtggtgccattagattctcataggagctcgaaccctattgtgaactgcccatgtgagggatcttgattgtgtgcttcttatgagaatctaacgcctgatgatctgtcgctgtctcccatcaccctcagatgggatcgtctagttgcaggaaaacaagcttagggctctcactgattctacgtgaaggtgagttgtataattatttcgttatatattacactgtaataattgtagaaataaagcacacaataaatgtaatgcacctgaatcgtcccggaaccatccccctcacactggtttttggaaaaaaatttcttccacgaaaccggtccctggtgccaaaaaggttggggaccgctggcctacagttttcagtacagtcacgtgctgtacaggtttgcagcccgggagccacaggctccaccgtgtagcctgggtgtgtagtaggctatgccatctaggcttgtgtgagtacactccgatgttctcgtcatgacgaaatcacctaacaacacacttctcaaaacatagccctgtcattaagggacgcgtgacttcacaggcaatcacagcacaacttcagcgggtgccgttcattgggccatttgtagaatggagccattggagttgtgagggcacaccccatgtggcagccctgttggtaacaaaactaacaccaagagtttctatgaagtgaaatttgtgagtaaatattaaagaagtagggtcggagtggaagttgtgggaggggaataaaatctcactctttccgttttatgctattccttatcaggaccacaataaagccaatcttctgccaatatttacttttgatttttttctccagagtggaagaaaaatgcccaggcctggcaggaataggagagtaggattgaaagttgaaacaagagcaggaagctcacccggaaataaaatcatttccagaacctcacaatgaaaatgacacttatttcacagaaacactcaaaggctgactccacttacgagactcctctcttgtaaccccagtcagctttcccagatatcttgggattccatgaaacccactgcaagcattttgacccaggttggaggcctcaaacagcagtctcccacctaagaacatggaagatgtggatttttggtcagcagtggtttcaaaatcaagacatttcatgtaaatgcaggagtttctggcttcccttgaaactcttggctctctggccgccctgagcccacattcccacgtggaaacttcaggctgccgtcaaacggtagttgctccttccagatggggcaagggctccccgtttgccacagtccccaccactccctgtcgccctccatcaggaccacttcactcaattctttttttcatttgtacttcattcactcaaccaagatttattgagcacttactatgtgccagaaagctgcaaacaaaactgacacaaattcctccttcatgcaacttatattctggctggtgaggcaatgaagaaaaagaaggaaaagcataaattccagagggtggtaagttctgctgacagtgaaaatagtgctgcaaaggtggagaaggcatgctgggtgtggtcaaggaaggccttaggaggaaggtacatttgagcaaagatctgaagctggtaaggacagcaagccttcaggatatctgtggaaagaacagtccagccagcaagaacagcaagtgcaaaggtcctggggcaggactgctccttgtgtgtctgtgaagcagcaagaaggccagtgcagctggagaagagtgagtgaggggaagggggtggaaatgaggtcagagaggggatgaggtatcaatcttgcagggcctcataggatctttggcttttactctaagtgaggtgggagccgtggaggattctgagcagaggcaatgtggttgtatgggtgatagactccctctagctacatgtggagactggactgtgtgtgcgaagcgggtggggtgggatggaggagaaaggtggaagctaagaggccagcaaggacccactgcagtggtccgggtgcagggtggcagtggcaggacagggcggtggctatggaggtggtgacaagaggttggagtctggacatactgtgtttcccggctctttttttttttttttttttttgagacagagtttcgatcttgttgcccaggctggagtgcaatggcacgatctcggctcaccaaaacctccctctcccaggttcaagtgattctcctgcctcagcctcctgagtagctgggattacaggcatgcgccaccatgcctggctaatttttgtagttttagtagagatggagtttctccatgttggtcaggctggtctcgaacccctgacctcaagtgatcctcccgccttgacctcccaaagtgctgggattacaggcatgagccaccgtgcctggccttcttcttcttttttttcttttttgagacggagtcttactgtgatgcccaggctggagtgcaatggtgcaatcttggctcactgcaaactccccttcccaagttcaagcgatttttctgcctcagcctcccaagaagctgggactacaggtgtgcaccaccatacctggctaatttttgtatttttaatagaggcggggtttcaccatattggccaggctgatctcaaactcctgacctcaggtgatcctctggccttggcctcccaaagtgctgggattacaggcctgagccaacatgcctggcctgtttcccaactccttttggcacttaggagaaactcccctcactcactctcctccagccacattgtgcttgcatgatccaacctcagggcctttgcacttgctgttccctctgccctgcacacgccgcccccagatattcccaaggcttcctccctcccttctcagggctaaagctgctgaaacagcccacattcctgacattctcctcccttgctctgctgggttggtcactacagtgaacttcctggcctcaatatacaggagacgttttttcttgttgttgagttgtctatctcctgccgtagggcatcagcttgaggagggaaccagtgatgtctcttttttttttttaaacagagtctcactctgttgcccaggctggagtgaagtggcacaatcttggctcactgcaacctccacctcctgggttcaagtgctttagcctcctgagtaactgggattacaggtgtaagccaccacacctggcaattttttttttttttagtagacatggggtttcaccatgttggcccggctggtctcgaactcctggcctcaagcgatctgcccacctaaccctcccaaagtgctgagattacaggcatgagccaccgcgcctggccagcaatgatttctctcgttcactgctgtatccccgagtctaactatgcctggagcagagtagtccatcagtgggacttgtagaaagaatgagagaaggcgtcagagattgattttgtttctgccactcattagtgtatgacctgtgcaaatggctcctccctccatccccagtatcctcttctataaaatgggtctctctacataacctctgtagggctgttgtgagaatctgggaagcctacggcaaaaagcctttagcaccattcagggatcttcgaagctgtccgtgttaggtgttgctatgaaccttaggagggaatgagaggatagctggaagagagtcacccccgcagaggccaagaaggaagagagaaacacgtttgtcctaagatgggacaaggctgttttttccagtattttcagtaagaaaacgaaagagcatccaagaatctcagggcacagtccaggctgcaagcttcttggctgtctggcctctgcccatctttcctgctctctgctccagcctatagctcccttccccgcagccctgtgagcccctcagtggccccaggatcctctgctcctctgctcctctgggaatccagtcccctccggctgaatgcctcaccttcccctggggtctaccactcagccctctgcagccagcccagctcctgtgtggaattccctggtggctggtatgagggggtgcccagcatcccctcctcatcctgtgacagtggataagggccagctgttagcatcattgttgttattactattacacaaacgcttccaatggatccacaccacctaagcagcgccaggaagccagggaaatgccagaagcaataacagtcagcaactatgtagtacctactgtgtactgtgctgtattgcacataggcaccgttccaagcccttcgtgctattaactcatttgattgtcacagtgtatgaggcaggtactatgttaactccattttacagataatgaaacagatctagagtggttaagtaactaaccactgagaaagctagattcaaatttgtgggttggctctaaaacctgttgttttaattaactctacacactgctgccttatggcattttattgtttgaaataataacatttcctgagcactcactatgtgccagctactaggctcagaattacctttcttcaccctgaaagaccctatgagttcatttgattattaaatagtcccattttacagaagaagaaactgaggcatagaaagatagtgcctcacacagtgtggcaaattgtgttttctgtttttttttttttttttttcttgctctgttgcccaggctggagtccagtggcaagatcatagctcactgcagcctcctgggctcaagccatcttcctgcctcggcctcccaaaatgctggaattacagggagtgcacccagctgcgcatcgtgttgtcttaagatgcttacagcatcatctctcatcctcatgatctgtttctgcttctttttttttgtaaaaaaaaacccccccagctttattgagatataattcacataccataaaactcacccttttaaagtacacaatccagtgggttttggtgtattcacagagttgtgcaatcatcaccactacctaattttagaacacttgcattgcccccgaaaggaacctcacacccattagcagtcactcccccttcccaccatgttgtgaggaaacccaaaccagcccaagtgaagagaccacacgaagaagtcacacacaggtgtctttctgatggcccagctgcggtagcagctgccagacacgcaagtgaagactctccgaccgaggccagcaccccagccaccaagtcgccctcagccttcaggctgtcccagccgaggccccagacactgtggagcagagacaagctgtcctgctgtgccctgtctgcattcctgaccacaggatctgagagatatcattccaggcgagtagaatggctgctttacaccgctgtgttctggggtgggtttgttatgcaggaggagtaaccgagccacagctggtaaggggcaatgctcgggtttgaacccgagtccttctggctttgaggctgccccttaaaccacatataggctggatgatcccctggatgtggaggagtcggcactccctttcttgtgcaatcgactcagtgcatcggggtgacgtgccctttctctagctgaccttctggaagcacataaacggagacagaaatgctttctttttgttttgccagtttattgctgctgctgctgctgcagttcttatttagtatatatgaattcttgttcttattttttgctagttagagtaaggctgggcgtggtgaccctcagctgtaatcccagcaccttgggaggccaaggtgggcagatcatttgaatcccagagtttgaaaccagcctgagcatcgtggtgaaaccccatctctacaaaacaaatacaaaaattagccgggcacggtggcatgtgcctgtagtcctagctacttgggaggctgaggtgagaggatggcttgagtctgggaggcggaggttgcagtgagccaagattgcggcattacactccagtctggccgacagagtgagagcctatctctcaaagaaagaaagagaaagaaagaaagaaagaaagaaaaagaaagaaggaaggaaggaaggaaggaaggaaggaaggaaggaaggaaaggaaggaaggaaggaaggaaggaaggaaggaaggaaggaaggaagaaaggttagaataaatagataagaaacacaaaaaatccacctgccatccccactacgcaggaaaaacctccacataacacttgaatcttgtagaattgtatctaccaggcatttaactcacgcaatttcactgggcatcagtgggccaaaaagggtgatggggagagtgacaatctttattttttcgtttcttttctttttctttttttttttttttgagagagtcttgctctgttggccaggctgcagtgcagtggtgcaatcttggtttactgaaacctctgcctcccgagtttgagtgattctcctgcctcagcctccagagtagctgggattacaagtgagcaccatcacgcctggctaatttttgtatttttagtagagatggggtttcaccatgttggccaggcagatctcaaactcctggcctcaagttacctgcccgcctcagcctcccaaagtgctgggatttacaggcgtgagccaccaagcccggctgagaatgacaattttcatatggcaagtgagtgtagctggcaggtcctattttttgttcaacatggccccaaacacaagatgacccctctccatccaggggctatttggatttgctaagtgtttataatgcaccacggttgagaggaaatttaacatatttttcaggatcatttttgattctgcataaaaagagaccttttttatcccttccaaaaatgggattgagctatgcagatggttttgtacctgactttttcacgtaacaacgtactttgaactgcttttgggcaagtggctttctcctggccttcatgggaaggaagcgctctgggagtccacctgcgctcttgctgagtggcagtcaaagtcgactggaactctacaagctgtgcagtcaggatgctgagcaaaagaagccagatgggaagagcacacactgtgtgcttccctttatagaaagttcaaaaccagcaaaagtcatctatggggttagaattcaggacagccattaaccttgggggtggtggtggggaggatttaccaggagagacatcaagggggcttctggaatgtcctgtgtacatctgggtgctcattccacgaatgtgtccacttggcgagaattcactgagctctttatgtataatgtgtgtacttttccttgcaattaaaacacacatacaaacacacgcagatgcatgcgtgcgcgcgcgcgcgcgcacacacacacacacacacacacacacacacacacacacacacacagtgttcttagagcgcaggctgtcctgtctggaaatacatgtttaatgcttttgccacatatgggcagaggtgagtgttgagaggactgggtatgaagttgggaacccaagtctgaatcctggttcagccatcattaaatgtgtgaccttgggcaagttacttaacctctctgagcctcagtttcctcatctggactctgtaccaagcccacaagatcacagaagcagccactgctcgcctctccatctggctcttccgttcttctctggctgtctctctaagcccacaccacactggccaccattcttgttcctatcacagcaaagctcaatgtggcctcagggcttttgccctagctattcctgctgcctggaattaccctttccctgattttcttgtggttggttccttttcctccttcatgtctcagttcaaaggttaccttctcagagaggagagcccctcactgaccactatccacaccagccatcatcagttccattccctggcctcagtttcttcccagtgcctcttaggttctgaaatggtcatatttgtttcttgcattgttgttgctctttacttgttatctgcttggcactccctctagacccatggactctaggacatgaggaatcatgattgtcttgttcattgctacacctccatcacataaaacaatgtgtatttgttcaattaaccaatcaatctatacagcgatctgattctactttatggaattctcgggaagtttcgaaagtacgttttaaacagccaggtttataagaatgaggaaactttgaaagctctgtttgaatgtggttaactctactgagaagaatctagataggcccaagatgcttcgtgagctgcgtcttccataatttcatctacactgaaagtcactataccgcttgcaaccacccgccccccacctccaccttttgctatttgcaccttttgttattggccatttggctggaacaaagtcactaatattcttagtagtttatttctatatatagagattttctttttttttttttttgagacggagtcttactctgttacctaggctggagtgcagtggcatgatctcggctcactgcaatctctgtctcccaggttcaagagattctcctacctcagcttccttagtagctgggattataggcatacaccaccgagccctgctaatgtttgtatttttagtagagatggggtttcaccatgttggttaggctggtctcaaactcctgacctcaggtaatctgcccaccttggcctcccaaagtgttgggattacaggtgtgagcccccacgcctggccaacatggttttaagatggtcaaaaggtacagagtgtacaaagagaagtctgtctccctctgactactgctctagagccgattagtgtttccaggtacctagtaagcgcttccagaactgttctgtgcagaaacaggcatgtgggctatatcttcatctttcccgtttacacagaaaggatctagttcaatacactgctttatatctttgctttttcttttttcttctttataattgatcttggagctgtttccataccacacattgtatgtgtatgttttagttgcacagaaaggtgtacgcatcaagagctcagagagtaactggtctctctctctccttctctctctctctcttcttttaagacgaagatttgctcttgtcacccagggtggagtgcagtggcctgatctcggctcattgcaacctctgcctcccaggttcaagtgattctcctacctcagcctcttgagtagctggcattacaggcgtgcaccaccacgcccagctaatttttgtacttttagtagaggcagggtttcaccatgttggccaggctggtctcaaactcctgacctcaggtgatctgtccacctctgcctcccaaaatgctgggattacaggtgtgagccaccgtgtctggccatttttttttttttttttgagacagggttttgctctgttacccaggctggagtgcagtggcatgatcttagatcactgcagcctctaagtcccgggttcaagaaatcctcccacttcagcctccctactagctgcgactacagtcattctttttaaaaaccatagaatactgacggacacctcaggcagctctggtcttttgcttctgcaggcagtgctgcagtgatggtccttggatgcacctttgggcccaggaaaatcactgattccttttgaatctggtaaagcaacccgagagtttacccctccccaacctcatcttcacccctcggcccatcccgcccttgctggtgtttgtgttttggccttttaaagactttttcaaaattgactttggcttcttggcctgaactctgaagtgtttgagctgataagatagcaggcttggctgtgggggccaggggtaaacagtgaccccggggccctcagccccagtaagggaggggccacagccccaagtctctcctgtctccagctgtgggagcaggcggtgtggctggaggaggaagctgaattgcgttgggctccagatgggtttgggaaccggaaggaagtgggaagctggccccacacagacccacttctctgggcctttgagaacagtgccaagaggcgcaacatgggctcagtatttgccggggcctctcctaaaccaaacaggacgccacgggcaagttggagcaaagtcctggcaaacctgaagacacatcccgtggagccccaaggagccgagggtcacaggaggggccctgcctccaaggccgtggcagacagaactggcaccatctccacacagcgtcaccgagtgatgtccagtcgtctcaggccggggattgtaactgccccgctctgatctaggccacagaagtgaacaaatcagtttggattcccaccctctagaactttcttcagttgaggagggaagagagaggataaataggcaaaaactggccagggtgcaggggactacaatggagaatggccaggctgtgggggcagagcaggggcactgctcaccctggagggggaaggcctccccagtcatgcctcgtcccagcttaaaatgctttggggcctgccatggtttctcagggctcctgggaccatggcctctgcgtgatcttccctgcccacctctaccagcagggtcagtggtgccagcttggcaacacttggtgcccatgtctacctggggtccctgcatggctgctccctctgctggcagcgccctcacctcccacctcccactcagctctcagctctcagctgagatgtcaccttctcgtccaggaagccttccttgatgtccctggatggtcttggggctatcacatgctcctgtacattcctcatccctgcttcagtcactctggggttacttgtttgcgggtggcccaaggtagcccagcatggccagaacccagccctgtggatgaccctgctggattcaaatgctagctccgcctcttagctgtgcaaccttgggcctcagttttgccatctggaaaaagggcatagtgatggcatctacctcacagggtggttgtgaggaagaagcagtttaatacaagtacttagaaagacatctggcaccaactttgcactcagtaaatgttggctgtgccattacacttgttctctctcccacagaacacagcaggtgctcacttcacatttgcatgctaaatcagtgcagcccttcaaatatgctcatgaaaatgagcaatgggggggaaggcttagttaattcagatgctcctcgacttgggatggggctgcagcctgataaacccactgcaagttgaaaatatcattaagtcaaaagtgcatttagtgcacccaacctacggaacatcatcatagcttcgcctcgcctcccttaaaggtgctcgaaacgtttacactcacctacgttgggcaaaatcatctaacacaaagcctattttataataaagtgttgagtatttcatgtaaaattattgtactctgtattgctaaactgataaaagattaaagttcaaaattccaagtatgatttctatcaaatgcctatctctttcgtaccataataaacacgaaaagtcctaaaatgaaccattgttagtcgaggatcatctgcaacggaaaaatttttttaaaacacaacagtaaagagtgatttacaactatgtaacacacacacacacacacacacacacacacacacacacacacacacagtccaataccctggcttggggaaaagaaagaaacagaccgtttagtgtggttttgttagaaggatgggacaaaaaaataatttttcttctttcttgtttgatgtgtttttttctactcttctttaataagcatggtttcaatttaaatgggaaaaaaaataacaaagaatctagagaaggaacccgcaagccctttctgttccatagagttttcccacaaactggggcagggggtggggtaggtggggtgtggcggggtggacagagaaagagctgccctttagaagttaagcaagagcaggaaaaccatcgtgtgccgggcgggggtagggtgtcagcttgaccaggggaagttgtggcaactaataacaaagcaactcctctcccaactctgggcatggcaagacatgcccccactccccagaccccaagatggagctagcaaccctgcctaatgccacggccctgtgtttccctgcagcgtaacacgtgtcgcacggcagcgtctgtaaagaaagggccttgtccgggcgcggtggctcacgcctgtaatcccagcactttgggaggccgagacagacggatcatgaggtcaggagaatgagaccatcctggctaacacggtgaaaccccgtctctactaaaaatacaaaaaaattagccgggcatgatggcgggcgcctgtagtcccagctactcaggaggctgagggagaatggcgtgaacccaggaggcggagcttgcagtgagccgagatcgtggcactgcactccagcctgggcgacagagcgagactctgcctcaaaaaaaaaaaaaaaagggcctcaccacctgccccctactcgcgtatgttacctcgcctcacctgcctaaccctgaagacctgcctgcaagcagtaaggtactactgttagccccatttcacagacggggaaactgaggctcaaaaggtgtaataatttgcccaaggttgcccagttgatcaatgacagagtctgaacttaataccatttgggctggatgtggtggctcaggcctataatcccaaagttttgggaggccaagtcgtgaggattgcttgagtccaggagttcaagaccaacttgggcaacatagtgatagctcatctctacaaaaattaaaaaattagctgggcatggtggcatgcacctatactcccagctactcaagaggctaaagcaggaggatctcttgagccctggaggttgaagctgctgtgagtcatgatggtgccactgcactccagtctgggtgacagtgagatacacacacacacacacacacacgcagattttaacaccatttggttttatccttgtctgtgatgtctgtgatttgtcatctttttttccatttccactaaagtagatgttaacaaatggaaggctggaagaatggatggatgaatgggtgggtggatgataaatgggtggatggatggatggaaggaaggatggatggatggatggatggatggatgaatgggtgagtggatgataaatgggtggatggatggatggaaggatggatggatggatggatgggtgagagatggataatgagtggagggatggatgaatggatggatgggtgggtggatggaaggatggatggatgggtgagagatggatgatggatggagggatggatgaatggatggatgggtggatgaatggatgggtcggtggatggatggaaggatgaacagatggatggaaggatggatggatggatggaaggaaggatggatggatggatggatgagagatagatgatggctggagagatggatgaacagatagatgggtggatggatgaatggatggatggttgggtgggtgaaggatggatgatggatggagggatgaatgaacagatgggcaaattaatgaattagtggatgactgggtgggtggaatgcatgcataaaataaatgggtgactgaatacaaaaagaactaactaaataaataatgatgaaaggcagagggcactaagagggtttcacctttcagggtttgttcctggacattgaatgtgccctttggaaagattgcaaactggcagttatcagggtaaattgggctgcagacatattttgtttgatcttcacagggtttttaattttttgaattgtcattattttaaaattaggaaatttcacattaaaaatctagatttctgatttctcctgcaaaattgggccggcacccataccaggaaataatataccaggactgacggggctgagcctctgagtgctcacggtccccactgctccacaatgcagtcctgctattggggttgtgtccactgccatttatcatggcagtttgggctggtgtttttctcagtaccattacaaggaaaatgaaaaatctcttacaggtggctcttggtcaaaagtggaaaatgaacttaggtaaagaggaaattgggagagaagtatttctttgtggccatggagaacactcctgtggattcgatggaccagcaatgcatcttgcctgagtggttaggggcacagatgctagagcctgatggcctgggttcaacccccggctgtgctacataccggctgtgtggcctcgtgcaagtcactgaacgtttctggcctcagtttcctcatgtgtaaagcagaggtggtgtcagtccccacctcatagagtgtcaatgattttctctccgtggggctctctaggtgtgagctgctattatcttacacagggctggctcccgtcatgtgtgtgatctgcctaccctgagcgtccacagcagcggttctcaaccaaggtcaactgtgccccccaggggacatttggcaatgtctagagacatctggggttgtcacaacttgggtggggaggggctaccaacatcttatgggtagaggccagggagactgtgaacagcctgcaaggctcaggacagatcagcaaaagattctgctgccccgtgtactccgccccgtgtactacgtgctgaggctgaggaacccggatctacaggagtccaagtccccagaggggctgagctatggccagatatctaggagtccctgaaggctgccagaggtgattccctctagacgtggcaggagccattccctctggcctgagccacctcagccctcaggatcatcaggccccaagtagtgccccgtcccagggtgcctggccccagcctgctcccagccccatacaacaggcaagaaatgtgtctgtccctagcgcctcctggtggcccagccctaaactacatgactcttcccagcccagggtggtgggaggggaggatgaggacgtaccttccgggtgtttaatccagactagttgggaatgtgggaatttaaggtcatggaaggcggtagccaatgtttcaaagacaaattgacataggtttgaatctcagatcttccactgaccatctgggaggccttggacacatcccatgactctcctgggcctcagtttcctcatctggaatggggatgatgttatttatgtcacagtttcgttgggaggattaaattaagtgcataaacagatgaaacatacgagatgcttaggattaaattaagtgcataaacagatgaaacatacgagatgcttaggattaaattaagtgcataaacagatgaaacatacgagatgcttcacaagcctcctctcggatacttgttattgctgtgttcatagcaattcatagccacttgtgtttgatgaatttccagtgtactcagagtgatttttttcactgactatcaacaaataattttgctgcaaagaaatacagatatgggaaaggatgcacaatatattatcaaatgaccacaggcctcagaaacattgtatacaaacactctatctgtgtgtgtgtgtgtgtgtgtgtgtgtgtgtgtgtgtgtgtgtgtgtgcgcgcgcgcgcgcagagagagagagagaatcttggttgttaaccagcctggagtgaacacgactcactgcagcctccacctcctaagctcaagcaatcctcccacctcaaccttccaagtagttgggactacaggcacctgccatcatatttagtagagacagggttttaccatgttgcccagactggtttcaaactcctggactcaagtgatcctccaaccttggcctcctaaagtacttggattacaggtgtgagccactgcacccggcctgatatatctatattttaaaaatatgtactttcataacatgtatgagaaacaaatacctcattttcttagtatataaaaatccctagcagatcaacaaaaagacaattatccaagagaaaaatagactaacaatttgaatgctttgccaccagaaaagaaatataaacagtctttgaacgtattttttaaatgtccaatctaacatataaacaatgaatatgtagattagaactatggtgaacacctttttcccctatcggcaaggccaagatcaagaagtccaatcatacttggccttggctaggacgtggggaaaccagagctcacggaggttgccggtgcaaatgacgattggtaggtacaaccttagagagcatttagacaaccagcgtcaaaatgtttaaacgcacctgccctatgactgggcgattcagttgctaagaatgtatccatcagaaatagctctgaatacatggaaagacttctgtgaaagggatactaattgcagcattgtttgttgcagaaaaaccctggaaatacctccgtgactatcaccagaaaacttgttagataaattattatattcagacaatggaatgtgcaaagaatgctctcctagtgctgatctggaaagatctgccaaggtacattgctaagttgaaaaaaacaaaatcccagtgcagaacagggtgtgtggtgtgcttctatttagagaaatgagtacaggaatccacgcacatatttgcttatctgtgttctggatgtctctgtaatgatccccaagaaatgataaccagaatggattctggggagggaagcttggagttttaaagctggggatgggggttaaggattagagggagaagacccactgtaaatcttttggtatcttttgaatttttgcatatgaatacaatcccttgttagtttttaaaaatggaactttttaatgcattgatagatgacagagagaaaaatgccttgaaggatatgctccaacgtgtcaatagcacttatctctgggtggctgatgtgaattagaagcgacttttattttgttctttttttattatttctctaatcaattatttattttgagacaagatcttgctctatcacccaggctggagtgcagtgatgcgatcaccactcattgaaacctctgcctcctgggcttaagtgatcctcccagcttagcctcctgagtggctgggactataggcacttgccaccatgcctggctgattttttatttttaattaaatttttttttgtaaagacgaagtctcactaagttgcccaagctggttttgaactcctgggctcaaacgatccctctgtttcagcttcccaaagtgctaggattacaggtgtgagccactgtgcccggtctgttctttttaaaaaatacagagacagggtctcactttgtcacctaggctagagtacagtggcataatcatagcaccctgcagccttgatcttctaggctcaagtgatcctccagcttcagcctcccaagtagctgggaccacaggcatgcaccaccacttctggctatattttgttctttttacttagattttctaatttaaaaaaataattaccagccgggtgtggtggcccatgcctgtaaatcctagcactctaggaggccgaggcaggaggatcatttgagcccaggagtttgagaccagcctgggcaacatagtgaaaccgcgtctttactaaaaatacaaaaaaaaaaaaaaattagctgggtgtggtggtgctcacctgtagtcccagctactcagaaggctgaggcaggagaatcacttgaacctgggaggcagaggttacagtgagcccagatcacaccactgcactccagcctgggcaacagagcgagactccgtcttaaaataaaataaaataaaataaaataaataattatcaaggtatattcagataatttttttaaaaattaagtaagtaaacacctcagtgttctcttggtagtcaggggaaaactaacttctacatgaaaaaaagaaaagaccaaaaacacatacacttctctaaacaggcagattattttcattgccaaggacattacagagactgaggagtgggttggaaatatattctatgaaaaatcgagaattaatacaactgtcctaccatgcactttctgggcatcaaaacgccaagcttctaactcagacctgagttcaaactctgactgccacttactagctgggcaagttgctcctacgccgttggcctcagtttcctcatctgtagtctgagaccacattgctgctggcaggctcgagtgagatcatgcctgtgaagtacttggctcaggcgtactcagagacccagttcaaacagggaacaggcagaaattctgcaccccgcaagggtgacagggcggagggaggacaggaggggccgctttgccggactggggatcagtgtgcaactagctgggcccggagtcccccacaaaccggccagctcagaggttcttccgacagtttggagagagtgacaccaagtggccaagtctgaaactacaccttcaagccggagggttagagcctctccccgacccctccagctgcggtcctgagccaggcactgaacttccctgaatctgagttttttcagctgcgaaatggaggtaatcctgcctacctggcagagcggaggtgggaattaaatgaggtaacccgcagagattctctccaggaccgccatgttgcacaacttcaggggccccattcatgaaactgtgcaacatagcggcacccctaacaggtggctgtcattatcatccctccctcagacactgagtttccttctctactcccctagagcgattctgaagctgggtcttccaaagtatagaacaaataccagtgggattcgtggggagatcttggtgggcacagcaccccagtatcaaataacatttcattctctgtcaatcattctgatggcatctaggcggcagtctcagtttgataggaacatgacattaacgcctttctaacacttacctgcctcccttccgaactttctgtttgagagtgggcctcagacttagtgccttcagaaggcaaaattatttggctagaatttaataaagttacatgttttcataatatttactttttgtggtcaccttctattgagagcaagtggtgctggttttccctttacagtagatgtggtagattgtattattgtcaaagtatttatcccattggcaattccctggtgaccctcccggctgaagtcaggcttggctgtgtgacttcctttgggcaacagagtgtgagctaagctttcgagaagcggctttgtcatgtggtttatctctgctgtgagaatggcctgccccaggaatgggctgcacctttaacctggatcagagtaaagatgacatacggcccagagctgcagtgacccacaaccaacaagtaatgagaaaataactgaggattcatattctcaatatgaataagaaatcgacctttgtcattaacaagctcctgagatgctggggctgtttgttattgcagtaaaacatagctcgagttggctgatgcagtagagttattaagtttcctttaaaaataaatatactgggccgggtgcagtggctcacgcttgtaatcccagcactttgggaggctgaggtgggtggatcacgaggtcaggagttcaagaccatcttggccaatatggtgaaaccctgtctctactaaaaatacaaaaattagctgggtgtgatggcacgcgcttgtactcccagctactcaggaggctgagacaggagaatcgcttgaacccaggaggcggaggctgtagtgagccgagattgtgccactgcactccagcctgggtgacagagcaagactctgtctcaaaaaataataaataaataaataaactggcctggtgcagtggctcacgcctgtaatcctagcactttgggaggccgaggcgggtagattacttgaggtcaggagtttgagaccagtctggccaacatggtgaaacccatctctactaaaaaaaaaaaaaaattagccaggcatgatggtgcacgcttgtagtcccagctactagggaggatgaggtgggaggatagcttgaactcaggaggcggaggttgcagtgatgagttgagattgtgccactgcactccagcctgggcaacagagcgagcctctgtctaaaataataataaataaataaataaatatactggcctgatgcagtggctctcgcctgcaatcccagcactttgggaggccaaggcggatggattacccgaggtcaggagtttgagaccagcctggacaacatgtcatagcccctgcatactcctgccctccttatcctgtttggtttttgctgctgttattgttgttgtttgttttttgtttggttggttttttgagacagagtctcgctctgtagcccaggctggagtgcagtggcacgatctcagctcacggcaagttccacctcctgggttcaagcaattcctctgcctcagcctccagagtagctgcgattacaggagtctgccaccatgcccagctaattttttgtatttttagtagacatgggattgtaccatgttggtcaggctggtcttgaattcctgacctcaagtcatccccccgcctcagcctcccaaagtgctgggattacaggcatgagccatcacacccagcctttgctgttgttttgttttgttttttgctccgtatcacctatcatcttttgaccatatttcacatttatgtgtttattttctgtatccctgtccccattagaacgtcaactccctccttaaaggcaaggattttgtgggttttgttttgttttgttttgttttccactttatagcccagtgcctagaacactgcctggcacataataggtgctcagtaagtatttgctgaatgaaggaatgagtacatgatggcaaaaggtagacaacaacggctccaggcccatgctgcacgagcttcaagtccagctgaaacacttctctttcagctgggcgcggtagctcatgcctataatcccagcactttgggaggctgaggctggcagatcacttgaggtcaggagttcaaaaccagcctgatcaacatggtgaaaccctgtctctactaaaaatacaaaaaaattagccaggcatggtggcaggtgcctgcaatcccagctacttgggaggctgtggcacaagaatagcttgagcctgggaggcagaggttgcagtgagccgagatcgctccactgcagtccagcctgggcaacagagcaagactccgcctcaaaagcaaaaaacaaaaaaacttctctttcccagtgttctggaaaaagtacagaattgaatccttggagtggagcacactgattgtccaggcctgggtcggatgcctgtatttaaatccagaagtaggctcagccccatctaaaccatgtgagctgacactgagccaggagtcttctctacaaaaactgtgatgctgttacaggggcagaggaaatgggagccaggtaggtaaaaacaatcgtcacccaccacaagaaggaggcttattcacccagctgagtgcctaggacttagtatgggtcccacgaataagtttgttcactttccttgtttccttatttggaatcaagttgtattcaggtggtggcgggggcagggatagtctgttaataccgaagataggactagaataaggggcaggcgattcaggccctccctggacaccaacatatctatggaattaaaatactgctgaaaaaaagtagatgcttagagccaaaagaaatcttggtttttctacatgtaacttcttacataatcagcaaaatattaattaacctctcttctgacactgacaaagacacccttgagaagaaatttaaaaagaaacgttgttggcttgaatctattgctgttgattagtttgtgaccccacatgtgcttattgcattatacaaccataaggcatatcacaaaccccaagaccagccaagtgggcctcctgaaattggcagtcatggtcagctaaaattctgaaaccatatggcatagtgctgttattgggaatgagtaatctattttgttccagaatctaaattctaagctctgtaataatgcctccagttgtagagtctgagagttgtccccagtatcagtttttcccttctatagaggtaaatgctccgtggaaacacatggctggttgcagtaaagactacatttcccagcctcccttgcagcaagaagcggccatgtgactgaggtatggccaatgagatgtgagcagaacatgggacagcaaacaaggtgatcagccatttggacctctggatggggtccacatgctggtgagaatgggacaacaagttaggggcccaagcctctgacaactttctggtacagagccaccgcccagctcagacatccctgtgaaaaacaaataaacgcttatcatatttcagtctcttattttatgtctctgggccccacagacgaaattatgttctaataatacacctctaaagaagttggcctggcatacataaataaagctcttcctccttcttcttttcttctttttcttcctcctcctcctcctcctcttccttctttcttcttctccttctcttccttcttctccttctcctcctccttctccttctccttctccttcttctcctccttctcctcctcctcttcctcctccttcttctcttcttcttgattcttcttcttttggtttgttggtttttttgaaacagagtcttgcttgacacccaggcctgagtccattggtgtgatcatagctcactgcagccttgaactccttggctcaagtgatccaccttggcctcttgagtagctgagactataggtgtgcaccaccatgcctggctaattttctttgtaaaattttctttagagatgtagtctcactgtgtttcccaggctggtctcaaactcctggactcaagtgatcctccctccttggcttcccaaagtgcctgggattacagatatgatccaccgcacttggccttcttttttttttttctttaacggaagtatacaagtttgattcacttatatcagtttattcctgttcaacaaatacttaagaccatctaaagatgcctgccaaggaggcccctatgttatagcggcattaaaaaaaataacaaaaactgggccaggcacgatggctcacatctgtaatctcagcactttgggaagccaaggtgggaggattgcttgagcccaggagttcaagaccagcctggacaatataacgagacctcatctctattaaaaacaaataaataaatgaaacctactctttggcacctttaacttaagtcctccagggagctggtttccaaagctggctgactatcagcagcatatggggagtctttttaaaatagattcctggaccttggccagttcatttgaaaagcaggatattggaaatctgtaattttaaaaacactccccttcctaccagctgtgtgactttgagcaagtcatttaatttccgagtgctgccattgcctcatcagtgaaatggggacaataatcgtacctaccacataggtctgttgtgggcatgaatttatttcatatgtgcaaagcactgagcatagtgcctggaacagagcaagatctctgtgtgtgagttatcattatgtctgttggtgggagtatagattaatgcaaactggcccggtgcaatggctcacacctgtaatcccagcactttaggaggccaaggtgggaggataacttcagcccaggagttcgagaccagcctgggcaacatagctagacctcgtctttacaaaaaattaaaaaaaaaaaaaaaatagccagatgtggtggtgcatgtgtgtggtcccagctacttgggagcctgaagtgggaggatcacttgagtctaggaggtcaaggctaaagtgagctgtgattgtgccactgcactccagcctgggtgacagggtgaaaccctgtctcaaacaacgtaaaacaaacaaaaaaaatgatgcaaactttctggaggacagtttgtgctatctaccaaagtattaaatatgtacccagcaacatggtagctcatccagggcacaagaatgatcattacagcttacatttattcaacaagtatttattgagcacctactacagtactttagtcagaataaaataggctatactgcagggacaaagccagcgttgcagtgacttaatacagcaaaggttcatttcttgcttttgcattatgatacaaattgagtacttttctccatctggaacaggctgatgcaggtgaatcccaaaatcagggctcagcctgggagggttcttggcttcactcaggaaagaattcaagagtgagccaacagtgaaagaaagcaagtttattagagcagcagtgtgcagcagaggggctgctccgtagacagagcagggctactccataggcagagcagcccagaacagcagcaaagaccacagcccagagcagtagtccttgcagaccagggctaccgatatttatacccactcttaattatatgctaatgaaggggcgggttattcagaattttctagaaaagtggcagagggttcccagaactatataaggtaacttccaggtcattgccatggcatttgcagactgtcctggtgctggtgggagtgtctttatgctatgagcagtgagggcaactagaggtcacttttgtcaccatctgcttgtttcagcgagtttctttactgcatcctgttttgatcagcagggctgtgatttgtgcttggaaaataagtcctactgatctcctacctcaccttctttatctggaaaaggaagtcttagagatgaacactgtaggcaaagagagagctagaaggtaacatggaatttttcaacggccagacctgaaagtagcttccatcacttttgcatatcccattgggcataaatgagccatgtactttcaaccttactgcaaggaaggctgggaaaggtagaggagcatgtagatattgagtgaggggtgtctttgtgacatctactatgttcaaagacagtgctaggagctggggcagtcatgggggagcaagaccaacaaggttcctgccctcataggtcctcccttctaatgagggagatagacaataaacctctgctctaaacatgatcccagatatatgtcattttgcacttgagcaagaatatctgatggatacattttcagaatctgtggctgctgcgtcaaagggtatatatatttgtcatttcaacagatatggtcaaattgtcctccataggactgtgccaatttccacctccaccatcaaggtacaaaagtgcttttttttgcctgcaggcttgccaacacagtgtgttatcagacttttggatttttgccaatctgataggcgagaaatgatctctgtgtacttttaatttgcatttttcttattataaaggaagttgaacatcctttcacatgtttatgagctatttgtatttccttttctgtgtacttgtgtgtacatatccctcatccattttcctctgagtcattgattgaggatattactaaatgaaaaagtgaagggacagaacagaatgcatagtagaatcatttttgtaaatgaaaagtgaaacaatatgttggcatatacatataaatatactcgcataggcataaaaattttctagaagcagccaggcgcggtggctcacgcctgtaatcccagcactttgggaggccaaggtgggtggatcacttgaagccaggagttcaagaccagcctggccaacatggtgaaaccctgttcctactaaaaatacaaaattagctgggcatggtggtgcgcacctgtaatcccagctactcaggaggctgagtcaggagaatcacttgagcccaggaggcggaggttgcagtgagctgagattgcgccattgcactccagcctgggtaacaagagcaaaactccacctcaaaaaaaaaaaaaaaagaaggtgtaaacaactacagatgtccaccatgaacacctcctgtgtgcaaggcactgtggaagctgctgggaatacaatggtgaacaagatgtgtgtggtccctgccctcaaggagctaacatcttagagggtgagagaagaagggcaaattaacaaatgttttaggtcaggcgcggtagctcacacctgtaatccgagcactttgggaggcctaggtgggtggattgcttgagcccaggagttcgagaatagcctggcaaaatggcaaaaccccatctctacaaaaaatacaaaaattggccaggcatggtgatgcatgcctatagtcccaggtactggggaggctgaggtgggagaatcacttgagcccaagaagttgaggctgcagtgagccatgatcatgccactgcactccagcctgggcatcagagcgagatcctgtctcaaaagaaaagaaaagaccaacaaatcagtgggaaaatggtcaaaaaaagatcaaaaagaggaaaaagcaaatggctcttaagcataccaaaagatgctcagttttggccaggcacagtggctcacgccagcactttgggaggccgaggagggcggatcacccgaggttgggagttcaagaccagcctgaccaacatagagaagccctgtctctactaaaaatacaaaattagccaggtgtagtggtgcatgcttgtaatcccagctacttgggaggctgaggcaggagagtcgcttgaacccgggaggcggaggttccagtgagccaaggtcacaccattgcactcctgcctgggcaacaagagtgaaactccgactaaaaaaaaaaaagctcaattgcatgtataaaaagagaaatgagataccatttcctaccaccaccccgcccccaccattgcactggtttaaccaaagtctcaaattgacaatccactgtgttggtaagggtgtcagaaaatgagcacacgcaaactgatgcgactccacatgaagaggactttggcattattcattaagtttaaaatgaccatagctgttaccaaggcaattctgcttttaggagttcatcctacagatttattcacacacagcatggacgcataacattttaagggaatggggaggaacagaatatatattcacatttgcttgtacatgcataaaccatcttagaaagatatgcaatggactaataactgattgtgggaaggaacagcatatgcaaaaggccccaagctgaaaaagaggttggtgtatttcaggaactaagagtgtgcctgggaaggatgacatgtgacaagtggtggcctgaggctgctgagccttgtagatcaccacttaggagtctggtcttgagtccaaatgcagtgggaagacattcaaaagaagatgatctgatttccattttaaaagcatcttgctgccatttggagaaactactggaggaaggcaagacgcaagtcaggagactgattagcaggctggacagttccctgagggagggacagggagcgggtggctgcacctgagaggtggcagtggtgaaaacgagcaggcagattgaagacagtttgaaattgcaatggatgagttggatgtggcccaggaggggtaacagagcagactcaaggaagactcaaggctgaattctggcttacgtggccacatgggtggctatggaggctactgggctgggaaggctagagaaaggggcccagatttcgcttgggtaccccagggtggggtgtgttaaggttgagaagtcaataaacatctgagtggcaacttccccctctctctccacttccccaaccccgcctagggtcatggtgagggtggggagtgggaaaagggcagggcataaaaataaaaaataaaacgccaggcacgatggctcacacctgtaatcccagcactttgggaggctgaggtgggcagatcacttgaggccaggagtttgagaccagcctgggcaatgtgatgaaactgtctctagtaaaaatacaaaaattagctgggcgtagtggtgtatgcctgtaatcccagctactagggaggctgaggcagaagaattgcttgaacccgggagacagaggctgcagtgagccgagatcgtgccactgcactccagcctgggcaacagagcaagactctgtctcaaaaataaaataaataaaataaaataaaataaaataaaataaataaaataaaaatgttcatagcagctttattcataataactcaaaactggaagtggcccaagtgttcaacagcagaatggataaatgtttactatccacagcagaatggataaatggataaatgtttactatatatatatatgtatgtgtatatatgtatgtatacatacaaatatattacaaatatacaaatatattatttaatctataatctgggaagtctactaaaatagtctaaatatattattagtatacattattttagtgtgcatatgtatatatatacacacatatattaaaagaatgaaaatgaacaaactactgatacagcccacacaaatgaatctcacagacattctgttgcgcaacagaagccagacaccaaggagtacatattgtctaatgccatttattcattttatttatttatttattgagatgaagtcttgttctgttgcccaggctggagtgcagtggcgcgatgtcggctcactgcaacctctgcctcccaggttcaagcaattctcctgcctcagcctcccaagtagctggggctacaggcacgtgccaccacgcccagctaattttttgtatttttagtagagacagggtttcactgtgttggccaggatggtctcgatctcctgacctcgtgatccgcccacctcagcttcccaaagtgctgggattacaggcgtgagccaccgtgctcggctgtctaatgccatttatatggacttgtagaatcagcaaatctaactcgtgatgaaagtaaaaactgagaaaccaagtttcctggaagcacaaaaggcaaggcaagatctattttgaagcaagctcagagtggcagcagattatgtaggggccacaaggcagcctttaagctgcacctcaaaaatagcatctgtcccctggatattttaagagtgtcctctgcagggcatggcaggagccagaggcctgtttgggcatctccaagcgtgcacctaaagaatgtatcatctggccgggcacggtggctcatgcctataatcccagcactttgggaggccaaggcgggtggatcacctgaggccgggagttcaagacaagcctggccaacatggtgaaaccccgtctctactaaaaatacaaaaattagccaggcaaggtggtgcatgcctgtaatcccggctgctggggaggctgaggcagtagaatcacttgaacccaggaagtgaagtttgcagtgagctaaaaaaaaaaaaaaaaaaaaaggaatgtatcaccccgcctccccttgaccctgagcaccacccggctccaaagctgtgtcagcagcaatataaaaggtgcagagataaagagagacatttaattagaagatgatttgggaatcatcttctaatttaggaaccaagctgcaaaatatctttctcccttaatggcacaaatggggaatttggactttgaaccttttctcttgtcaggccaccaaaaacgtcttcctgtattaatagaaggcaaatgtaaggattcagggccaggagggctgtgggctgtgggtcttagattgtctagagtcagaacattaagaacatgagagccctttctggacctctttgtttatgcggggcttctgctggggcttataatcacctcatcactgctgctatttttgcagtaattattaagtactttaatacgtgcacagggcatgtgcagtccttcaattacactgctcctgcctcattgtcgggaggcgagttggaattgttctccttgttttgcacaaaagaaagcaaaggcctgggtgaatgaacaagttcagggtcaaaaatgagtcagcacaagggagatggcaggaggtgggtgggaacccggcagtccctagttcccgcccagcttgaagtgctagcaggtctaaattcaaggcatgtgccacatccttgaagaagtgatcgacggccgggcgtggtggctcacgcctgtaatcctagcactttaggaggccgaggcaggaggattgcttgagcctagaagttcgaaatcagcctgggcaacatagtgagaccctctctaaaaaaaataaaaataggccacggatggtggctcacacctgtaatcccagcactttgggaggccgaggcaggcagatcacttgaggtcaggagttcaagactagcctggccaacatggcaaaatcccatctctactaaaaatacaaaaattagctgggtgtgctggcgcatgcctgtaatcccagatactcgggaggctgaggcaggagaattgcttgaacccgggaggcagagattgcagtgagctaagattgtgccactgcactccagcctgggccacagaacaagactctgtctgaaaaaaagaaaaaaaaatcacctggttcatagtaagatgtcattgttaattttggaaggtgtgctaatagcatggtggtttcagaaaaaaaaaaaaaaagaacaacttagtatcaactactggtgaagtgacaaaaggcttacgatgaaattgacaaaatgaatgtggataattgctgaaggtggatactggagagttagttatatgactctatttttctagatgatgtttgaaattttccatagtacatgttttgaaattgtatagactaaatgttgcaaacttgtatcttatgggtaaaatgctgctcacaaaaatcctgtacctcctttagatgggtccttggctctcagtgtgccacagtccccacccttccctattatagcctgacactgttcatcatcactcttgggtcactgtttttgtttaagtagaattaaaaggaaactgaatgagttctcttggggcaagactgttatttgccatccatatgtccaacctctacttctttcttacttatagaaactcctacactattggcaatgaattttgaaataacatttcccagtttctcttgaagctaagaattgcccagtgtttctcagtcagaggtgattttgtcccccagaggacatctggcaaagtcttggaagacagttttggttaccacaacaggggcagggagggaggcagggagtgctctactgatatctggtgggtgggtagaggtcagggtactgctagacagccctccaatccccaggtctccctcccacaacaaagaattatgcagtccaaaatgtcagtagtgcccgattgaatggccaatgcatgataagtggaagttgatgttggggtttccaagaaagccctttggtgtcttgccaatcttcctagaatataaacatgatggctggagtttgagcagccattctgtgaccttgaggagggaggttctatgctaaagatggaaggaaatgggatccccgaaaacatcatagaattgccatatctgttctttggaatgcagattttcagacatggttttatgtgaaagaaataaatctctaatatgtttaagtcactgaaatcaagtctctgttactgtcagccaagtgcagtttctaaatgatttgtctctgtgcccagttctctatgctaatggagaaaggaaagatagactaagagggccatatgtttaaagaaaaaaaaaaaaaaaaggcctgggacatgctggctcttgcctataatcccagcacttcgggaggccgaggcgggcagatcacctgaggctgggagtttgagaccagcctgaccaacatggagaaaccccgtctctactaaaaatgcaaaattagctgggcatggtggcgcatgcctgtaatcccagctactcgggaggctgacgcaggagaatcgcttgaaccaggacccgggaggcagaggttgcagtgagctgagatcgcgccattgcactccagcctgggtgacaagagtgaaactccgtctcaaaaaagaaaagaaaaagaaacgagaaaatacgtttcttcacaacaatgaaacagttcattgccttcatttatgtcacttcttgatccctgtaggcatttgagtttgcaactcctggactggtccttaaccaaaaagatgaggaaactgaggtcctcagcaggttaatgatgagttaggagtgaatccacaacctggtccctctccccgcatttctaaggtaccaaggcctacgcactggcgaagaatatggtttctgcagccagacagacgttggttcaaacactggtactgacacaggaaaagttcccttatcctcctcgaagggcatgcgatgggggtgtggctcacttcctcagtgcttcgctgctcaaaacccctagggggagcaggcagacgggcagggtgtgggactctggccacgcagcgtctaggcgtgaatgtttacagctcctgaggccccagtgggcgtgtgttccagggtgctcttttcgtttaaccgtccatagacagcttgtgttagctcaattagaccccttgccttatctcaaggacagagggctatctgtatcctggggtttcttgccttggcgtacctgaagaactggatcacacgtaggcttggagaatgaacgcaaggttttattgagtggaggtagctctcagcagatgggggagccaaaggggatggagtgggaaggcgattttcccctggacctgggccgctgagtggcccaggctctcctcccaccaccccagccaaactccaagttgttccaccggtcgatggcctgctggcatctgccggtgcctgatggtgtgctctcatgccagttccttcttctccaggtctagttgcttgtgtcttttttttttttttttttttttgagatttagtctcactctgttactcaagctggagtgcagtggcatgatctgggctcactgcaacctctgcctcctgggttcaagtgattctagtgcctcagctgggactacaggcacctgccaccacgcccgcctaatttttttgtatctttttttttttttttttttttttttttttttagtaaagatggggtttcaccatgttggccaggctggtctcaaactcctgacctcaagtgatctgcccaccttggcctcccaaagtgctgggattacaggcgtgagccaccgcacctggccgtcgcttgtgtcttcttccaccagtgcgttcttcttggcatccagccacttgtgtctctgcctgctagggtctgggggtttctataggcataggatgggggcgtggcaagccagggtggtcttgggaaatgcaacattcgtgcaggaaaacagaaatgcctgtcctcacgtaggtccgtgggcacaggcccaggggtgaagccctacccagggaccacgcccttcccttcccagcacttccctgcccccactcccgtatcagtaccaccaattactagctctgtggctttatgcagctcacttagcttctctgtctctcagtttctgatgcgtaaaacaaggatgacaataaaggcacctattgcctagggccattaggtggattcacatcagtccgtgccctggcaggaggagagttttatgaatggactgtctataaaatgtaggtggggaccgtccatttctccaacagctgggaaggatgttggtgttgaagtttacacacctatcaaggacagtaactaccatggcttctggtgctttgacaaaacctccaatgcatagccttctggttaagcgtctgtgatttcatattattggagcattcatggtatccctggtggttgcagctttctacaagattgctatggccgaaccaagaaagaaggcatacgcagatttctacagaaattatgattccataaaagattttgagatgaggaaggctggtatctttcagagtacaaagtgatcttggaatatgaagaatttctttgagttgaaatatctagaagtttgtcactgacttgtgttcctgaactatgaaacatgaatgaatatgtcagctaagaaatagtttctcttggtcaggcgtggtggctcatgcctgttatcccagcactttgggaagctgaggcgggcagatcgcttgagatcaggagttcgagaccagtctggccaacatggtgaaaccccatctctactaaaaatacaaaattagctgggcatggtgggcatgcctgtaatcccagcttcttgggaggccgaggcagaagaattgcttgaacctgggaggtggaggttgcagtgagctgagatcgcagcaccgccctgcagcctgggcaacagagccagactgtctgaaaaaaaaaaaaaaaaaggaaaagaaaaaagaaagaaagaaagaaagagtttcttgactaggtgtggtggctcattcctgtaatcctagcattttgggaggccaaggtgggcagatcacgaggtcaggagttcgagaccagccaggccaacatggtgaaaccccatctctactaaaaatacgagaaataattagccaggtgtggtggcgtgcgcctgtaatcccagctactcaggaggctgaggcaggagaatcacttgaacctgggaggcggaggttgcagtgagccgagattgtgccatcattgcactccagcctgggcaatggagcaagactgtttcaaaaaaaaaaaaaagaaagaaaaaaaagaaaaaagaaatagtttctcttgataaataaacaattaacaacaacaataacaaaatgtaggtgggatttacagaacccagggatgctgcatcactccagcgatagtaacaaagggagtttatcacagctagatagtaacagaggggtccttagcacccccacatagtaacagtggcctggaggagcaaaggaagaagtggtctccaggtccagagagagggagctctacagagaggctacctgacagaagctgtgtcatccttcagtcaagggacacagtagaccatggtgacccaacaggagagctgggggaataaacagctcctctggaattgagatgttcagttagccaagtgcatttgttagctgcccaaccactctaagctcacgaggagcaagagaaagcatgccttcttagtagctactaaacaaatcctgagatgaactctgattgaaccaatctgtgccacatacccatctctaagccaatcatcgtagtttttttgtttgtttgtttgtttgagacggagtctcgctctgtcacccaggctgcagtgcagtggtgcaatcttggctcactgcaacctccacctcccaggttcaagcaattttcctgcctcagcctcccaagtagctgggattacaggctcccgccaccatacccggctaattttagtatttttagtagagacggggtttcaccatgttgtccaggctggtctcgaactcctgacctcaggtcatccccccgcctcagcctcccaaagcactggattacaggcgtgagccactgtacctagccaatcatcatagttattgtacctccactgctctggttcgttggtgctaagtcacatgctccttgttgggttacaggctcaagggaacttcctgatggagcgaacttccagaaggggtggttcccaaatggaaactcaggttacttggcatggaagagagtgccgtagattcagggtggccccaaatcagcaaacattcattatattcacgttataaaatgaaagaacattcagaaaacagcataaagtagcatgataccattggtaggcactgtgggatttcccatcagccatcctcaaaacttatttttggcaaatgaaagtgttggactagggtaactcttccctgccaacattcaacatgtgtgactatccccagaaagtaactacgtaggaacaagaacatgagatgctcccagctggagccccaagggccatttccaaagctaccaacagagcgtcctctgtgtttcagtaagggtaactttctgcaaaatacaacaaagatgttcatgtgaaataaagggggtgatttatgtatgaaaaggtggggtgtgagccttgtgaataccatgggaagatgaggtccttccactcagggaataggagccccgtggtttggccccagatggtaaacaggagtgctgtttagttgaagaacagcatgtcccattctgttcttttggggagatttaaagcaagaccgtttgcaattggatctaattgataagtgtcttagtttggaatcccctgttggcacacctcatatcttagtttagattctctagatacagaccctgagacaaagactcaaggacacatcacttctttggaaggcaaaagaaatacgagtagagaagaaaagagacccagggaaaggaggacaaccaatattaagcaagttatcaagacagttactgccctaggcaagtgaagcttaattccacctgtgtagaacacatgtctcagagttatcttacctgaaggatcagcaactccatcttggaagctaatccgccatgttggcttctgattaacccctgttccaagaaggcctctaagatttctagtttatctattattccttgtgtaagagcaggttctgactctatatcctgtccttaggtcaaacaaccttgatgttatcttacttcaactgttctacacatcccttctgaaccacccctctcctatggtatagaagccctgggtctgggagataatggagtggggatccaccatcttgtctggccaccgcaggagacacagacgtggcatctgtttctaagtttctattaaaagtttctttctaaggaactgagtatgtcagcatcatctcttcagcctctcagcttccttggactttggggtaagtttgcatagacctgcccactgcaaaacaatcaggaagctggggtatttatacaccacctctatccattccttggttgaaggcagctggaaagaagagaaggaatattcattctccaacctcctttaggctgcttgactctgacaaccagaagaaaaaacccaaaaaactcatagaaaaagatgcacatactaccagttagaagttgggcagttggccaggcgcagtggctcatgcctgtaatcccagcactttgggaggctgaggagggcggatcacctgaagtcaggagttcaagaccagcctagtcaacatggtgaaacaaaatacaaaaattagccgggcgtgacggtgggtgcctgtaatcccaggtacttgggaggctgaggcaggagaattgcttgaacccgggaggcagaggttgtagtgagccaagatcatgccactgcactccagtctgggcaacagggcaagactctgtctcaaaaacaaacaaacaaacaaaaaaaagagctagttacctttatgggcaactggggcacagtcccagaggggccctcaggggatgatgtggagtataccgcaagattgtctcaggaagggttggggaaactgtgctgtttatccgcaatgaccactctcagcggttgaaggtggtgcccggggccagcaactccagtacacttcccttcccacacatgtgacctgccatgcgcacatgaagcacacaggctctgggcagagagatgcgggtgccggaggttgggtatacgtcaccagcatttatagaactgtccatctagcttcaggcagctctcttgagtgggctgaggaggatgagtgagcactgatgctggccaggaaacttaggagaaggaggggaaaggaagaaaggaacaaaactaacatttataaagtgcagggtagttgccagccattagcacagttactttcgttttctgattcccattgtacagttgagaaaaacgagctcagagagggaaagtgacttgctcttgactatgtgacagttaagtgctggaattccagctcagattgagtctacaaagacagtgttctctatctccctcttccttttctccttgtcctcctcttctctgcttttctctccctctccctcctccccaccaccttgtttattttttttccaaataatatttagagttaccaagacagaagtcaagaggaaagctttctggtgtccttaaagatgtgctttatgaaagatagttttcatttgctcttttattcatttgacacatttattaagcacctatgatacgcaatatatagaaaacaagacagacacaatccttgccccttaggctttatactctagcaggaaaaggaggcattaaacagctaaatacacatggcgaggagggggtaagggaagcctagatggggaagtgggggagtgagatgggaacaggaaggcagccataaaaagcaattagttgattacgttgtgatacaggtttctcaacctccgcattagtgaaattttgactggatcattcctgtaggctgttctgggcattgtaggatatttagcagcgtctctggcctctacccactagatgccagtagcattcttaccctggttttgacaaccaaaaatgtttccagacattgtcaaatggcccctggggggcaaaatcactcccagttgagaaccactgtggtaaataagaaaggcagatacgaaaacatgtaacaaggaaacagaatctaggcatacccacaaggaagtgcctttaggacgagatccatgtgacaataggcattagccaggcagaaagcaggaatggcatcctaagtagagtagacagcatgtgcaaaggccctgtagccagacctgaaaggatactggagaacagagagtggcctggtgaaatgggcagggctcagttcacacagggccttagagtctgagttataaattttagcctttatccatggtcacttttccttttttttttttttttttttgacacagtttcagtcttgttgcccaggctagagtgcaattgtgcaatctcagctcactgcaacctccgcctcccaggttcaagcaattctcctgcctcagcctcccgagtagggatgtgccaccatgcctggctaattttgtatttttagtagagacgggggtttctccatgttggccaggctagtttcaaactcctgacctcaggtgatctgcccacctcggcctcccaaagtgctgggattacaggcgtgagccaccatgcccagccacttttacttttaaaattcatttcagcatggttaaaataataaaaataaactaaatgacaacagacaacatcaagtgctgactaagatgcagagcaactggaactcccatacactggtggaaatgcacaacggtagagcttctttggttgtttttttttttctttctttctttctttccttccttccttccttccttcctttcctctttctttctttctctctctctttctttctttctttctttctttctttctttctttctttctttctttctttttttgagacagagtcttgctctgttgcccaggttgaggtgcagtgacacaatctcggctcactggaacctccacctcctgggtacaagggattctcgtgcctcagcctcctacagtacagcttctttggaaacagtttggcaggtttgtttgtttgtttgtaaagttaaacctacggttatcatacaactcaccaatcctggccaggcatagtggcttatgcctataatcccagcactttgggaggccaagatgggaggattgcttgaggtcaggagtttgagaccagcctggtcaacacagtaagaccccgtttctataaaaataaataaataaataaataaataaataaagtaaaaatcccacttttagaaatatacccaaatgaaataaaaactgtttatttaataaaaacacaaaaacctgtacaagaacgtttatagtggctttattcataaaggccaaaatatgggaaaccatctaaatgcccctctactgaggaaagattgaacaaacggcagtacatctgtacaatggaatactactcacgagtaacaagatgagaactctttttttttttgagatggagtttcgttcttatcacccaggctggagtgcagcagcatgatcttggctcactgcaacctccacctcccgtttgcaagcaattctcctgcctcagcctcccgaatagctgggattacaggtgcccgccaccacgcccagctaatttttctatttttagtagagacagggtttcaccatgttgaccagggtggttttgagctcctgacctcgggtgatccacctgccttggcctccaaagtgtggggatgagaggcatgagccatcgcgcccaggtgagaactcttaatacacacgatgatgtagatgaacctccaaagcatcatgctgaattatagaagccagactcagagggtacatgttatatgattccatttatatagtcttttgaaaaagggacaactataggaacagaaaacagttaagtggttgccaaaggctgggagtgggcacaagggtagactacaaagggtccccaggaaattgggaagacaattaatagaatggttctaaaccttgactgtggtggtggttagatgactgtgcatttgtcaaaaaatacagaacccagtcagccaggtgcggtggcttatacctgtaatcccagcactttgggaggctgaactgggcaaatcgcttgagccgagaccagcctaggcaacataatgaggccccatctctacaaaaaatagaaaaaattagttaagcttggtggcgcctgcctgtagtgcagtcccagttacttgggacgctgaggtgggaggatcgcttgagcctaggtggttgaggctgcagtgaaccaagactgcaccactgcactccagcctgggcaacaaagcgagaccctgtctcaaaaaaaaagaaaaaagaaaaaaaatcacagaactgtatactagataggatagattttactgcaggtaaataatgcctttattttttgaaagtaaaaagttattataatgaagactctacagtaggtctatcagttgcacatttggggggaaatcaagctgggttctggttcaaggaaaaaattaagaaaggtaagaagaaaaagaaaataaattttaaaatctaaaaagaaaaagaaaatagtccgcgtgtggtgactcaggcctgtaatctcagcactttgggaggctgaggcaggcggatcacctgaggtcaggagttcgagaccagcctggccaacatggtgaaaccctgtctctactaaaagtacaaaaattagccgggtgtggtggccggcgcctgtaatcccagctactcgagaggcttaggcaggagaattgcttgaactcaggaggcagaggttgtagtgagccgagattacaccactgcactccagcctgggtgacagggcaagactctgtttcaaaaaaaaaaaaaaaaagataaagaaaaagaaaataaatcaagcttggtaagaactatgaggtaaatcttgactcccggggggactcgggtaacaggaagctagatggtggtcatgctcaccatttgaaccacatgtacctatgagcaaacgaaagaaagataaggcaatgcagacatttggtgctggttgacaggaatgactgttttccagcacatacaaaaaagattgttccaaacaggtaaatgcaaaagcactctggggaaacagtgctgggttccacacttatcttcgtgagctcagctcatggatagaccaacctgcaggaggaggagaaacctcaactgagcagaaaataatcctcagactcttggccatcttcagagtagacatgtgtttaatcttgactccatttcaggagctttgcagattttctataaatgtatcatgaaaattcaatctcaaaaacaggaggttgacataacagtgaaaattcagtagatcttcaaagctacatctggcccatccaaaccccagatcaaacttggatttcatctttttaaatgaaactctttggtgtcaatatcaataaagactgtctaagcctggcacggtagctcatgcctgtaattccagcactttgggaggccaaggcaggtggatcactcacttaaggtcaggagtttgagcccagcctggctaacatggtgaaaccccatctctactaaaaacacaaaaattatcgtggtgtggtgtcgggtgcctgtaatcccagctactggggaggacgaggcacgagaatctcttgatccggggaggtggaggttgcagtgagccgagatcatgccattgcactccagcctgggcaacagagcaaggctctggctcaaaaaaaaaaaaaaaacacacacacaaaaaaacaaaaaaactgtctggtgagtcaatgacccttgcaatttcaaaactgcggttttcatctgatggctggtgggacttccacagaactcacaatgttaattccagaaaaaaacaatgaaaaaaaatagcaaatgacagaggcatagaccaatgtctgtatgtttatatgagtcccgataaatccgatataagtggtgtttttaagtacaaccataaatagtacggctagcacgtgtccctctggctctgcaagtagcagctgtgaggccagaggaagtcccttcatctctctgagtaccagcgctctcatttctgaaatgcagatggtaataggacctgtccctcagggcagccgtgaaaattaaataagatgatgtgtgtaaaatgctcaataaggtgatatcttagttttctattgctgctgtaagaaattaccataaatttagtgaccgaaagcaacacaaatttattatcttatagttctggagtccagaagtccaaaaatgggtcttgtggagctaaactcaaggtgttggcagagctgccttgcttctgtggaagaatctgtttccctgccatttccagcttctaaaggccgctcgcattccttgactcgtggttggtccatccttcatctttaaagccagtggcatagcatcttccagtctctctctgaccctgctgccttcctcacatggccttctctgactttgaccctcttgcttcccttttataaggacccctgtgattatactgggcccactgtgctaacctagggtaaccccccaccacccatctcaagatccatattttaatcacacctctaaagccccttttgccatataaagtaacattcacaggttcaagggattagggcacagacatctttgggggagaccattattcagtctaggtagctcttatatcttgctggttgtaaagacgctatggccatgtagaataataatgatgacataaaagtaaagaaaaaagagatgctctcaaactgctggattgaaagcttgcatgagaataaaatactggaagaatacacaactaaatgctgattgtgattagagttaaatccgtgtaaccaggggtgtttgttttttttccaatttttcatgatgcttttttattacttttataataaaaatatttttaactaaaatattagtaatacagtggatgttcatcccctccaaatctcatgtggaaatgtgatccccagtgttggaggtggggcctggtgggaggtgtttgggttatgggtgcagatccctcatggatggcttggggccctccccatggtaatggctgaattctcactcagttcgttcactcaagagctggttgtttaaaagagcctggcatctctcttgcttcttctctcaccatgcgacatgccttctccggcttcacctcctgcagtgagtaaatgctggcactgtgctttctgtgcagcctgcagaaccatgagccagccaggtaaacctttcctttataaacaactacccagcctcaggtattcctttttttttttttttttttttttgaggcagggcctcactctgtcccccaggctggagcagtggtgcgattgtggcttatgcaacctccacctcccaggctcaaacaatcctcccacctcagcctcctgagtagctgggacttactggtgcatgccacctgtattttgtatttttagtagctactttttgtatttttagtagagaaagggtttcaccatgttggccaggcttgtctcgaactcctaacctcaagtgatctgcccccttcagcctcccaaagtgctgggattacaggagtgagctaccccgcccaactaatttttgtattttttgaagagatgcggtttcaccatgttgcccaggctaggttttcctttatagcaatgcaaaatgaactaatacaattagtaaatatgaaaatagaaatatctttattttatatgtatattatattgatgtatttttctggttatcaattgctgcatgacaaactacctcaaaacctagtggcttaagccaggtgtggtggctcacgcctgtaatcccagcactttgggagccgaggtgggcggatcgcgaggtcaggagatcgagaccaccctggttaacacggtgaaaccccgtctctactaaaaatacaaaaaattagctgggcgtggtggcgggtgcctgtagtcccagctactcgggaggctgaggcaggagaatggcgtgaacctgggaggcggagcctgcagtgagccgagatcatgccactgcactccagcctgggcaacagacgtaaacaccgtctcaaaaaaaaaaaaaaaaaaaaaaaaacctagtggctagtggcttaaaaacaacaattatttataccactcacagttctatgggttgacagcttagctgagtggctctcacatgggggtctctcatgcagttggctactggagcaggaagtccagaactgacccagcatcatttccactattttctattggtcaaaacagtcacaaggtcaagcccaggccaaattcaagggggctgaggattagaccccctatctcaaggaggagtggcacacacatatggggagggaaggaattgatgacagtcatctctaaagtcaagctaccaggctggccaacacagtgaaagcctgtctctactaaaaatacaagaattagctgggtatggtggcacatgcctgtgatcccagctactcgggaggctgaggcagaagaatcacttgaacccgggaggtggaggttgcagtgagtcaagatcgtgccactgccctccagccttggcaacagagcaagactccatctccaaaaatatacacaaaaataataaagtcaagctaatatatatcatactgtccctctccccacccctcccccatatcattccaggatgtctccctcttctttgtaaggaatgtcactgaggaagttcatcccagttgaggtgggcttttttgttgttgttgcttgtttaacatccgttccacttcccatgccagtatcccaagcttcctgtggaggagcttcaggtcaaccacagtgccttgtcctctactattctgtaaatgggtatgtaacccaggccaagccaaacaaaccctctctgaaatttcaatctcaaacagaatgacaaaaaaaagttctgaaagaaagtttgcagtggaaactgtggatgactctcaccaggctattatatcccaggagcagggatgtgcctgatttgtctaagccaaggtttctcaatatcaggactgttgatatttggggagagttcattcttttctgtgtgcaagggatgggaaggagctgtcctgtccattataggatatatagatgcagccccagattctacccacgagatgccactagcacctctcctagttatgataaccaaaaatgtcttcacacgttgtcaaatgtcccctgggggccaaaatcatcccttgtgcctcttgctgatgattggttcaggagtgaacaggcccaagccagttttgcccaataggacaccaggggagctggctgcagtggcttacacttgtatttccagcactttgggaggctgaggtgggaggatcattgaggccaggagttcaagttcagcctgaacaatatagtgagaccctgtctctacaaaaaaaaaaaaaaaaagttttaattacctgggtgtggtggtgcactcctgtagtcccagctattcaggaggctgaggtgggaggattgcttgagcccaggaggttgatgctgcagtgagccatgatcacgccactacactccagcctgggcaacacagtgagaccctgcctcaaaaaaaaaaaaaaaaaaagacaccaggatagatttcttggggacttctggcagtaacatttccttactctcaagagagagctatggggagacactccctctctttcgcactggatgatttagcaaatgatcttaccgtcataatcactactggcagcgtgccccgttttgcagccacagggaaccagttttcagataaagccaacacatggatagtaatgggaagaaagagagagaaccctggatctcaattacattcttgaacctctgaatcaaccaaccttggtgttgcccttcctacaataaactcccttactgcttaagccaggttgagttgagttttctgttacttgcagccaaagcgtcctgagtgccgcaccctcagagctgaagagcacactcgtgagttgatgccagcaagatcccccagcgcatcatgtggccaattctttctaaacttggtttcagagctttcttgctccatttctaaaaagcaccttatatccttctaacaaattccttttctgtttctgttggtaagaaccagtttctttttccttctttctttcttttcttttttagacgcagtttcgtccttgttgcccaggctggagtgcagtggcgccatctcggctcactgcaacctccacctcccaggttcaaccgattctcctgtctcagcctcccgagtagctgggattacaggcgcccgccaccaggcccagctaattttttgtgtttttagtagagatggggtttcaccatgttggccaggctggtcttgaactcctaacctcaggagatccgcctgcctcggcctcccaaagtgctgggattataggcatgagccaccacacccggcctgaccagaaccaatttctgtgatatgcaatggaagaattctgttacctcagttggctaatttcagcaaaaagccccaacattcttagtcatcataaaactcgtttgctgagtatgactgactcacctggtatttcataaagtgctacttatgagacccacaagaaagattaagcctcatgtgaacaggctgatgggaaatccacacagaaaatattttgataagttctaaagcagcaccacatgctttagaaggtcatgccaaaggcagtccaatggggtcatcccagtgcatcctaaggaccaccagctccagcaggagaattaggtaaaagggcaaggagaacagcacacagggtcacagagaccctggctccaccaccagctcgctctgtaaccctgtgggagtgagttgagggagtgcgttgcttctccctctgagcctcagttgcctcatttgtcaaacaagcattcacttctcagggctgatgtgaactttaactgaggtgacacatgtctaactggttcaggggtacgtctcaacttgttgaggtgtaactacgaaaccactttatttttacaataattgctaccaaatggtctctgttgaaatttcctttttccctctggggaatgatcagaataacagagtagtggtagtagaggcaggagcagaggtagcggcaagctcccaggtggccccgcctctgtgccaggcacttgcctaagctcttggcatatattactcaccaaatcttcacaatgagcttctgaggtagggaccaatagttatctccattttacagaaatagagaaaaaagaacttaaatgagttgcccaaagtcacggagctattaaagaatgggcttcctcaaccagcctctcaacaattccatagcatgcctgactgactctttggttaccaaagctgtctatttcaggtcttaaaacccaaatctcctccaattagaatgtcagtctcaaccagtgaagcacaacgagacccagtctcatggtcatgatgtcgaacaaacgaagacagacaccaaaaagcatgcacggcatgattccatttatgtgaagttcaaaaacaggcaaaagcaatccagggtgttagcaggatagtggtcacccttggcaaagggtagtgactaggagggttactaggtagctttctgaggggctgggagagttctgtatcttgatctgggtgcaggttatgtgagcatgtttagtctggggaaattcactgagccgtgcacttatgatatatctgtgtgcatgtacacacatatacttttctgtatgtgttttatagttcaatataaatttccttggaaaaaacttcattctcagatctgattcaaagttcttttagatcccctggccccatgtcacccagttcaagccagactcatgattctagtggcttggagctgggacaatgggtagggggagcaggagaagcaagacgtgctctctttccccttctccttgacgcccacggtagaatgggcataaggatgggctgccattctgctgaaatggctccacagcgagccgtgaaggaaggtggctgaccccaactgctgaatgacctttgaacttaggccaagagactcagagcacccctaacatcatcctgttgcacatgtaaagtgcctagcacaaagcaggtgtgtaatggggggggaggtgctagatggagatgcaatatttttgatatcttgaggactaaaagtcgggatgatctgctctttcaaatatgccagaaatttttggattcataatcagttgaataattgatttctatttgaagccttttagttagacaaaaggaaaagtgataagtctgccatcttcatctgagttcctccagaagccaactctgagacaaggatttaaatgcaagtaatttattcctgaggagatccttggaggcagcaggtgaggagtggggaagtgaccacgaagtttctgatttaggacagtggtgaaaagttgatgcaggtggcttctaaaagatcttgacttccaaggcaactagggctctggggaaggaatatggctgaacttcagacccatagggctacaggaagatagagacagaagacaaagaccatgtaccagttagcatgctctcaactgcaagtagcaagccaatccaaagtggcttaaacagtaaaaatgctcctgatgtcttcaaataatgtcttcaaataatgtctgggaagggacatgaatgagcatgtgggccagtggggctcaaacccacccatgtaagggccatgcctccacattgccatacctgagaagcaaggagctggggtatttatctctttcgcactttgggaggctgagcgggcgaatcacctgaggtcaggagttcaagaccagcctggccaacatggtgaaccctgtctctactaaaaatacaaaaagttagctgggcgtagtggcacatgcctgtaatcccagctacttgggaggctgaggcaggagaatcacttgatcccaggaaacagagcttgcaaagagccaagattgtgccactccagcctgggcaacagagtgagactctgtcaccaaaaaaaaaaaaaaaaaaaaaattgataaaaagagaaagagagagacagagacctcagaaagacagagtgaaagggaggggttagaataaagggaggatgaagatcgagatgaagtgacagagagacctaagaacttgtgaaaatgtgcttaccaaaatgtgagcagtggccaggcgcggtggctcacgcctgtcatcccagcactttgggaggccgaggtgggcagatcacaaggtcaggagatcgagaccgtcctggctaacacggcgaaaccccgtctctactaaaaatacaaaaaaaaaattagccgggcatggtggcgggcgcctgtagtcccagctactcggtaggctgaggcaggagaatggcgtgaacccgtgaggcagagcttgcagtgagccgagatcgcaccactgcactccagcctgagggacagagtgagactccgtctcaaacaaaaacaaaacaaaacaaaaaacacacacacaacacgtgagcagtgaccagcacaggtagtaagagttaaaagtaagttgtgggccaggcgcagtggctcacgcctgtaatcccagcactttgcgaggccgagacaggcagatcatctgaggtcgggatttcgagaccagcctgaccaacatggagaaaccctgtctctactaaaaatacaaaattatccaggcatggtggtgcgtgcctgtaatcccagctgctagggaggctgaggcaggagaattgcttgaacctgggaggcagaggttgcggtgagccaagatcgctccattgcactccagcctgggtagcaagagtgaaactccgtttaaaaaaaaaaaaaaaaagtaagttgtgtctcttttatatgcacttttcaagttttcttcattaaatgagtattccttttgtgataagaaaaagaaataagaacaacaaaaatgtcctacctccaatgctagaacttccagctctgcgtgtgaaaacacccactttaaattgcttctctctttagttcaaccatgtttcttgaaatggtttgaatacaggcagagtttccttctctccctccttccttctttttccttttttttaaaggagaccaaagtcagagttgcctcagtgctgacccaacattgaggctgaaagtgggtacaataagggtaatttaagaaggcagggattaacagctgctttggaaatgacaattgggttaacctcttcttcattctcactctctctctctctctctctgcaagaaccatcttgccctagaggaatgcaggaaggcagtggggagggaaaatgactctgtttagggaggtgataaaatgggatgtgatgattaattcttcatatatttatttgacaagcattcagggagcacctcttctcgcccaggtcctgggctaggccctggggacatagcaagatgaatactacaggatccacgactgtgagggctgagagagacacacgtgcagattgctaagaccaatatgagaggatcattccatacccaaacacagagttgcatgaaggccgaggttctgctttcaccccaccagataccaatttcgctcctgaaatgaagaagtaaggagtgaccagagagaatcttatttagcaggcagtgatgataagttaatacaggtagtttccaaaagatcttgacttccaaacaactggtgctctggggaaggaatgtgtctaaacatgagacccatagggctaaaggaaggtagagacagaagacaaagaccctgtatcagttagcatgctctcagctgcaggtaacaaaaaaaccaacccaaagtggcttaagtagtaaaaatgtttatgatgtcttcaaataagtccagagctaggcagtcccagggacaattcgataactcagtgatgtcaaggacctaagtgctttttatatttttgctcctctatcttagcctggttttaaaaaaaaataattcctcccatatgtctctcttttttttttttttttttttttttttgagacggagcatcgctctgtccccccaggctggagtgcagtggtgcagtcacggctcactgcaagctctgcctcccaggttcatgccattctcctgcctcagcctcccgagtatctgggactacaggtgcccgccaccacgcccagctaattttttctatttttagtagagacagggtttcaccatgttggccaggctagtcttgaactcctgacctcaagtgatccgcccgcctcggcctcccaaaatgctaggattacaggcgtaagccaccatgcctggccccatatgtctcctttacaagaagggaaaatctttcccagaagctcttgggcagattttgcaatactgccattggccaggattgagtcccatacccatgccctgatgcaaaggaggctttgaaggggcctcccagttttttcttcttggcactgtcagccaagaagaagggggaagagaaagatgaatagataggcaaccaacagtgtctgcctcagaagggaattaacattcactgggccctgtttataaccccagccatcccccagatttccagcttcctctttaatatctaacatcggaaccccatgaccctaacaagacagaactttcatcaggttctttctgcaggatattactcagagtctctgggggatgttctcatgttccctggaccatgcttgtgattgcttggcaaccacagtgagccctttctcccagggcatctactgcccttgtctgccacctcctaactgtctgcaccaggatggtgctcctgtcactaacaccatctcaacttgaaagtagtacccagccctcttccttaacagcccccaaaacatggctggattgattagaatataggtttaattactgtaactgagaccctcattaacagcggtttaaacaaagcagaagtttattactttttttttttttttttgagactgggtttcgctgtgtcacccaggctagagtgcagtggtgtgatctcggctcactgcaacctcctgggctcaagtgtttctcctgcctcagcctcccaagtaattgggactacagggatttgccacaatacctggctaatttttgtagttttagtagagacggggtttcaccatgttggtcaggctggtctcgaactcctgacctcatgatctgcccacttcggcctcccaaagtgctgggattacaggcgtgagccaccatgcccagcccagaaatttatttctaaccagtcagaatgatacctacaagcaatcaggatgactgtagctgtgcatatcagctgaatatcagcccttttatgtcttgttcatgtaacagtgtgtgtgatcagtctggggctaatggggctggcccatggggtcagagtctcaggctttttctatcttgttttcttccatcccttccatgttgctcttgtccacacagttcaagttggtgccaccatgtcacattccaggcagtactatggaagaaaaggtgaaagaaagaccccaacccagccgggcttggtggctcacacctgtaatcccagcactttaggaggccaaggtgggcagatcacaagggcaagagatcaagaccatcctggccaacatggtgaaaccccatctctattaaaaatacaaaaattagctgggtgtggtggcacgcgcctgtagtcccagctactcaggaggctgaggcaggagaattgctcgagcctgggaggcggaggttgcagtgagctgagatggcatcgctgcactccagccaggcgacagagcgagactccatctcaaaaaaaaaaaaaaaaaaaaagaaagaccctgaccccaccccacactgttcctgaaccaagcctttaaaggcatgatttagaaatggtgcacgtcacttccactcaggtcctattggtcagcatgcagtcatatggcacatctagttgcaagggaagttgggaaatgtagtctttagccaggcaggcatgtgcccagttacaatcctgtttctatgaaagcagagaactgacactggggacaattagtatctgacccagcagctaagatgagcccatagcagttaacaaaattttactgaagccttggggataacaggtgagaattacaatgcagaaaagggaaatgcaaaatgaaattgtaaataaatcatgtttggaggccatatagctgcttcatgctttccttcctgctggtcttcaccctcctttctctctagcatgctgtcatgctgtgagaaccagcctacctcccgtggatgatggctgcctaacttcttctccctagaatttaggaccccctctttctcctctttgccccaggtaaagcaaaaggccctccccttcccacagtgagtctggcttccttgcctaccccaggatatgggcagtgggaatatccatgtcctcctgaagaaagtacaattccccatgtggttccccttgcagctcacttccctgtggcctggatgaggccatcacaagagttgtaagtgcgatcccctaagcccgggtccctccactttcagttattccaaatcagagtcctctccaagggcttcccaccagcacaaggggaaggaaagttcaggtcagcgcctcttctctgcacagtcaagtctcaaacagaagaccagtttcatcttcaaatacagaaactgctggagcaaatacttggtcaaaaaggtacacatctttcccaaggacttcaggaacccttctagctaaatcaaagcttagaaattcattcctcttttctaaaaggctatggtcctagtacagatccacccaacttacatgcattatcacaatgctggtgtgcaacagtgggcaagtcatgtatcactccaagcctcagtttcctcatctgtgaaatgaggttaatgacagtttctcttacagggttgttgggaagatgtagagagatgataaaggtaaagtgctagcttagtgcagagcctagtctttcgtcaaagcccaatacatgtagctaacataactagtattattaaacaataagaaacaactcaacatggggaatctgcatctggataatatcactgtcttaggattctccccaagagcagtgatttctcccagaataatggaagaacattctcatcttcaaagacaaaaatggctccaaatccccttcaaaaacttgaaaaactagacttcacctccagaactggttacataagctcaatgcagaatgaatatgcggggctccttgttcaaacattattgcgagtttcggccaggcacagtcgctcatgcctgtaatccctgcactttcagaggccgaggcaggtggatctcctgaggtcaggagtttgagacaagcctggccaacatggtgaaacctcatctctactaaaaacaccaaaattagccgggcgtggtggtgggtgcctgtaatcccagccactcgggaggctgaggcaggagaatctcttgaaactgggaggcagaggttgcagtgagccaagattgcaccactgcattccagcctgggcaacggagcaagactccatctcaaaaaaaaaaaaattattaagaatttcaaggctgggtgcggtggctcacacctgtaatcctagcaatttgggaggccgaggcgggcagatcacttgagatcaggagttcaaaaccagcctggccaacatggtgaaaccccgtctctactaaaaatacaaaaaaaaaaaattagccgggcatggtggcaggtgcctgtaatcccagctactcgagaggctgaggcaggagaattgctttaacccaagaggcagaggttgcagagagccaaggtcacgccactgcactccagcctggacaacagagcgagactcagtctcaaaaacaaacaaaaacaaagaaacaaacaaacaaacaaaagaatttcaagacaaagacagcagagcaaacaagtgcaggccccttctgagctcgggactctgcaatcacacaggttgcacacacacccatgaaaccagccaagttcacctacagcagcagaacaaaaaatagggttgtaaaattgcaggttgcaatatatattatgaaaaacttctgaagacagatggtagcttgcttttttccactcagcaacttacacaactgtagaacaacagcaaaatttttgagtccttgctgtgaactagagaccaggctgagtgctttacacacatactctcatttaatcatcacatccctgcattctgtaaaagatggaaaaccaaggattggagagggtaaggaacttgcccaagggcacatgagcccaattcagcctaattccagaacccacacccagaaccaccatgtgtacagtgaaagtgcccccgcaagcctcagccctgcaaactagagtgtggaggatgttgtaggggcctctggaaaccctccccagactcctcctttgctgaaagcatggagctgggaccggtttccatctttggatccaacttccctccttgaactttcccgcacatctctgaccctcctttctcagaacacatgtgattcccctagttccccctgaatgcctcctcctcccccaccggggaagttgctcttaccagacaggcagcgtgggattatgtttacgcatttatttttgtttctttttaatgacttgctgtaaagcttaaaatgtcttccgggtggtagagaggcaggggagtcgcccattaaaaatgaagcccagtaaaaatgaagcccagtagagacgtgagtgggagattctgggctgttaaccttcccgtgagttctgaaatagtgcagaactcatatatttaatatagtttcagaactagaagcagcaaatagagctgaactgggttcaaatcctgactccaccatttctcatctgtgtgactgtgggcaagttgcttaacctctctgtgccacggttcaaatggagatcacaatagtacaggctccagagtggtggtgttaatgaatgattatcgttattattatcctcattgttattactattgtttttagagctcatgggagtccttggagagactgtatagcttcatggctgagaatatagatgctgaaatcaggctgcatctgggattaaatcagggatttaaatcccacttgactacctactggctgtatgaccttggttaaataactggcctctctgagcctcagtttcctcaattgacaaattctcccctgggcagagggattggattagagatggcatgtgagcttcagttggatcaatgagactcaaggccaggactcagggtccaccagggaaaagaagctcttcccactggagctgctgagctgataggctgtgagcctggggctgctggggctctagaggacagcctgctcgagagtgaagctagcacaggggaagaaacataaaagagctggggagagagagagtcacaatgacgtttgaggccctggatctggcggtgcctgaagcaaggaagcctcctttggacttcccaatttcatgagccagtaaattccccgttttgcgaaagccacttttcagttgggtttttctcactggaaagtatccaggctgacaccaggatttccatttagcaacttgacccaggcctgcaagctagtgagtagcagcctcaggggttagaagctcctagctctgtaccacggtgctctgtcatccagcatgcaagccagcattctgtactgggtgttcattgctttcacctctttagcctctccgagcagctattttctcatctctcaaatgtggataaacagcaggcttgcagggctgttgggaaacacaaaattcaaagtaatgcttttaggccaggcatggtggctcacgcctataatcccagcactttgggaggctgaggcgggcagatcacttgaggtcaggagtttgagaccagcctggccaacatggtgaaactccatctttactaaaaatacaaaataaattagccaagcgtggtggcaagtgcctgtaatcccagctccttgggaggctgaggtaggagaatcacttgaacgtgggaggcagaggttgcagtgagccgagattgtaccagtgcactccagcctggggcaacaaagtgagaccctgtctcaaaaaaaaaaaaaaaggtaacactattagttagcatggtttatggctgaaggttggagttctgtgcacccagtttctagtgccttgggccttggcttttccccattacttattccattgcagggatgtctctggctgtccctaagtcagccaaccagtcaaagtgcccaaactctcttaggcgagcatgggtgaatcttgtggggggaagagccatcttccttcctggctatgtgtacccagtggtgagtggaggaagctagatgaccttgaggattcttgaactctgagtctatgatgtacaaagaagccctgttatgttcatttccagaaccttctaaaactgatatgctcttctgggaatgatctgtattgcagggaaacagcaatgaaccaaatcgacttagtctctttctttaagaagtttacatttactggcagatacagatgataaacacataaaaatatacaacatcatatcacatggtaacactagggaaaaaataagtcattaaatgcctgctaagtgccaagaagaaaaaggaatagagtgatagagcactgtttattagaagtggtcagaagggggctctctgaggaagtgacatgtcattagagactcagtagggctcattcaggatcacaagctcttaaaactgtgctatctcccaggaagaagatcaggaccaatttttccaggaaacttgctgacctcactaagtcaggagtcagtgatctgttggaggcttggtaaacagccatccttctccactgacgactcttaggacatttaaaaaagtttaatgggtcattgatttgtagtgctgatttcctccattagctaaatccacgaaggaaaggctggagaagccgcgtgagaccattcctcaggcatgcctgccaggaaaaggttttagccatcatgtcacatgatcatttgtctatttctaaccagtcatcactaaagattcccaatcaccaccatcacatctctggaggatcccagggcatggctgcttctaggccaggccttggcagggaagtgccagagctttgcagatcaacaccaagcctcagagagtcggagtagaccttaagttcctcctctcaaccaaatatcaaggaaacagacaagaagtcgaggtccctgccctcctagaacatgacattgaggggcaggagaaagaaacaagccagcaaataaataagacacagatgagtgctaggagccaccagaagctagaacaggaaagggaggatcctcccctagagagtgactggggactattttagggaaggtggtcaggggagacctgtttggggaggtaacgtttgacctgagacctgaaagctgagaagatctgcaagaagcgtgatccaggcagaaggaacagctggtgcaaagatgctgggttgggagccagccccgtatatttggagatagacctgagactgcagggaagtaagcgaggggacacagtgacgggccaggtcacgtgggccttgtgggccagggttagacatgatttgggttttcttctaagtaggatgggaaactgttggaggattttgcataggagggtttcatgacccaaatattaaaagctatgtacacaatgaatggaagggcaaattagctggtacctgaaattaggggtttcgttcaggatcaatatttgtggcaaggtttcactctctgccactgtagtagattgagtggaggcctccaaaaagatatgtccaagtccccatacctgtaaatgtgacctatttggaaaaagggtctttgcacatgtaataaatttaagaatcttgagatgggattgccaaatcgttctggataggatgagccctgaatccaaagagaggcatccttgtaggaacagggcagagggaaatggggcaggcagaacaggagatacagagaagaaagtctgccaagacagaggcagggatcagagtgaggcagccacaagccaagtaatgactggagctaccagaagctggagaatgcaaaggaggaccctcccctggagccttcagagggagcacggcactgtcaacaccttgattttggactttgggcctcaagaactgtgagagaataaatttctgttacttgaagccaccaaatttgtggtaatttgttacagcagccactggaaacaagtacagcctctaaacagcccaaacttggaccctgcttgaggctgcctccaactcccctctcccccaccaagaccctgtgtatagcttcggccccattcaaaggctactccaggctgggtgcagtggctcatacctgtaatcccagcacttcgggaggccgaggcgcgcggatcacctgaggtcaggagttcgagatcagcctggccaacatggcaaaaccccatctctactaaaagtacaaaaatcagctgggcgtggtggcgcacacctgtaacctcagctactaagaaggctgaggcaggagaatcgcttgaatccgggaggtggaagttgcagtgagccaagatcacgccattgcactccagcatgggtgacagaacaagactctaactcaaacaaaacaaaacaaaacaaaacaaaacaaaacaaaacaaaacaggctactccagtcactgggcagcaccccctgcaggcgtgagggccacttgggcttgggatgggcatttatttacttacttagcttgacatacagggacaggaatgaaccagccctgtttttgttccaggatgctctcaggattgtgagttccagacaaaccagaacccaaaaagtataagggtttaagggcgggaggagcacaggagtctggacagtcacttaaaggaactaagacttcaattaggtagcttccaagtgtggcagctcccacagttttcactggaatgggcatttttgttaatttttcccctatggaatgctcactttctaaagacactgctgatcaagctaattgcatgtattcaataacatttcatttatctcctttatttgctattatttaaagatatgtagtaatgacagttaatatttattgagccactcagtatactaagagcatgatatgtactcatccaaccttcacatcagccctatgaggtgggcacttttattatctctgttttacaaaggagagcagagactaatgaaaatttgcccaagtttgcaccactagtatttattcagctggaacctggacccacgaagcctggctccaaagcaggctctggaaaccaggctagaatgcaggtttccataccaatgtgcaatgctactctggacaagtaattttgtctctctgtgcttcagtttcctcatccattttttttttttaagacagagtcttgctctgtcacccaggcccgagtgcagtggtgtgatcttggctcactgcaacctctgcctcccaggttcaagcaattctcctgtctcagcctcccgagtagctgggtctacaatcacacgccaccatggctggctaatttttttgtatttttagtagagatggggtttcaccatattgatcaggctggtgtcgaactcctgacctcaggcgatcacccgccttagcctcccaaagtgctgcgattacaggcatgagtcaccgcacccggtccccccctcatctaattttttatttttattttaatttaatttattgtatttatttatttattttttgagatggcatctttctcccgtcgcacaggctggagtgcagtggttcaatctcggctcactgcaacctccacttcccaggttcaagccattctccttcctcagcctcccaattagctgggattacaggtgtgcaccaccacacccatctattttctgtgtttttagtagagacaggctttcaccatgttggccaggctggtcttgaactcctgaccttaggtgatccacctgcctcagcctcccaaagtgctaggattacaggtgtgagccaccaggcctggcctatttttatttatttattttttttgagacagtgtctcactctatcgtccaggctggagtgcagtgacatgatcatggctcactgcagcctcaatctcccaggctcaagtgattctcccatctcagcctcctgagtacctgggactacaggtgcacgccaccacagccggctaatttttttttttttttttgagacaggatcttgctctgttgcccaggctggagtgcagtggtgcaatctcagctcactgcagcctctgcctcccaggttgaagtgattcttgtgcctcagcctgccgagtagctgggattacaggcatgcaccaccacaccctgctaatttttgtatttttagtagagttgaggtttcaccatgcttgtcaggctggtctcgaattcctgacctcaagtgatgcacccaccacggcctcccaaagtggtgggattacaggcgtgagccaccacagccagtcagttttctcgtttataaaatgggaataatagcacctgtattgaagggttgttgtggagattgaatgggaatgtgtacttagaattccaggcatagtgcctgccacaagcactcaaggaatgagctggagttcagctgataataccaggcagtgtctctgggcaacacggaatgaagacaattctctcttccaggttttcaaacctcctggaattcacaacgtccacatgacatgccaggcccagagggggatggtttaaactggagcctgcaggaaggcaacctgaccaacctgctcatgggtgctttaaggatcataggtacgagaatcagctggagttgttggtgaaaatgcagattccgggtctcatccctagaccaaagatatctgaatcatttggcgatgggtccaggaacctgcattattcaacacacttcccaggtgaccgtaaatgtcaaaagacaaaattacaacaaacttaaacatcttaattggcttcattcatgattctagaatcgggcaagacttcattcctcaaaatagcacaagtgtcccaatgagctgagcagaggaggttggttttatagacagaaaagggctgaaaaaagcagaaacaaagaacaaaaagcagattggtcatttcaaagttactttccttgtaaggcaggaacagggaaacagaacaagagagaaataactgattggtcgcatcgggttacttcaggttactttttgttgtaaggattaaagcaaagggaacttcattatgttgattaaaacggtctgcttgggaaatcagggtgtgtatctctcttctgattttgtgaaaggttatcagtctgatgatgtagaactttagcatgagtgactccattttgatttttagtctagtctgttgagaccctaatgccagaactttttttgtttgtttgtttcgctcttgttgcccaggctggagtgcagtggagctatcttggctcactgcaacctctgcctccagggttcaagcgattctcctgcctcagcctcccaagtagctgggattacaggcatgcgccaccacgcccggctaatttttttttttttttttttttttagcagaaaccgagtttcaccatgttggtcaggctggtctcggactcttgacctcaggtgatccacctgcgtcggtctcccaaagtgctgggattacaggtgtgagccaccacacccagcccttttttttcaagacagggtctctctctgccacccaaggtggagtgcagtggcgccaaaacagctcactgcagcttccacctcctgggctcaggtgatcttcctgcctcagcctccccagcagctgggccccaccacaccggctaattttttaacttttagtagtgacgaggtctgattctgttacccaggctggtctggaactcctggcctcaagacatccgcctgcctctgcctcccaaagtgctgggattacagatgtaagccaccgcgcctgggctcctatgatttttatttaacataatgcaccatggaatttgtgctctgcttagttcagtctgagcaggagttccttgatacttcgggaaacactgaaaatcattccatccccatccattcattcctgcagcacccaagtggaaattctgcgtttcagacagggacactacccttagagagcagtgggcttccccagcagcgtagtgaaacatgatactcctgagtttcatgaaaaaagggcagacatctggccagagctgggaggcaggaaatagagcacggtgccctcctcccatactccagcttggattactgaggctggggcccaggccctgcaggaaaggaggtgcatgactactttaaggccactcactctgtgactcaacgggccgggtcggggctggaactcaatgccctcccgggcctggagagcccacgcgccgtgggcggggctcccggggtcgcctaggcaacaggcgcgcgccgcgcccgagcccagagccccaaagcggaggagggaacgcgcgctattagatatctcgcggtgctggggccacttcccctagcaccgcccccggctcctccccgcggaagtgcttgtcgaaattctcgatcgctgattggtccttctgcttcaggggcggagcccctggcaggcgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggtgcgggagcgccccggagcgtggcgggcccttcgcttaggccgcttgaacatcccctcagacctccaggccccagactccctctgggtcttgccctctgcctcgctcctactgcttgaggattcgatgggacagcgacgcactgcgtccccccaccctttgtccccggggcgggcgtgtttctcgccgcagcgtcggagcccccttcgatcccccacctcccttctgttctccagctcgggtgatctctcaagccgggggaccgccggtctgtgctctcaacgcgaatccctcgcaccccgaccccgccccctgcctgtccactctttgtcccctggggtgatttagcacccccactatttccttttctggagtggaccacctcagactctcttcctttgtctccctgggggaaaaggttactccccccgtccctccttcacatttcctttcccctagtctcagtgtgcgtcgagtcccagagatgacagtcccctttcccctttctgttcattcatttattggataggagttggcaagcttattctgtgctaggcaccgcttaggcattggaggtggtgtttgctaatcaggacaggcaagatcctagccttagtggggcctagagtcgaatagggcaatcaaacacaaaagcaaataatttcagatagtgacaggtgctgtgaagagaacgacttcctaacggggtacagggtgactgcatagaaggccggctgtcttagagaaggggatcagggaaggcctgtcaaaggaggagacatttgctttgtgagctgaaccaagaggagcagaaagccgtgagaatatggggctaaagaaccttctagccaggaggcctgcggtacccactccattggggccatgatattattctttcaggcagggactcaggaaggttaacgttttaaccctctctaaaatagcatctttcctcaatgagcagcttagtctttggtcgtggcagagatgaccttgtcttaggagtcatctccttgtgtgttaaaaagttaggaaaggagggtttctcatatatctataaaacaagtagttaaaaacacaaagagctcttcctttcacaagcagctgaataagatacatactcccaattaaatgtcattgcgggggttgttaagattaactaaaaccacacttgcacagtatcttaaataagcgatatacagaatagagagattttgttacttgtgtaaagggagacagcagatgattctgttttcagcttataggctcaaaaggcaaattgtgagatccatcagctgtagtattaaaatctattttgagctccgcttagaaaggaaaaaaggtttaagcagttctttggtatgcttgactaacaaaagcctttttttttggcagccttgattttcatgtggatttacatcaagcttatttgacaggattctttttatttggactgtagtgtgtatattagtttctgctagactaatatttctaaccactgtaatctatatactaataagtatgattgatcagtatataaaatttgtatgccatatctggtctctgaattagctgaatgaattccataagggactttgagactgtgtagacaaattttctgcatcagtttaatgcagtagagtctaaaatgtctttaaatgaaaattgttggtctgaagtgttggagttgattatgatacaccccatcacagtggaagcattgtggagagaagtcttttccactgaaattgactgagttgacaacaagaaatacgtattgtaacttagttcttagttgaattttatttcttacaattttaagccagagtgggttgacctgtcacccaagcatggttaaaattgtattcagcatgcaactagcatggagtgtgtcagtcttcaattcatttccttcattgttcttaagtttttctgccacaattaaaccccacaagttagtcaaggtgttgagattttcactgcttcttaatggattgccacattccctgaggtagtttcttttggtcttagagaattgtcagggccagcttttctcacctccactgtatggatatttttcttttctaagatcttgaaatcagaagcttttctcctaagtgtaaaagtagctctttgtcatacaactgtagcgttttctgaaacagagttcagatgaccttgagtctaaagtggctaactttccaaggtgtgtatcgctttaccaaaaccattatttttcaaggattcaaagaatgtgtttacaattgatagaaaatggaagtttaaaaaaattaatactttatagcatgttgaaatgagggcagccttatacaaagtcatactttgagcttgcctagcctattgtgatcagagaataatgtaatttttgcttacaacttggtaagcaggtcagttattctaacttattttctgattagaacaaaaagatgtaaaaacttgaaaactattgggaaaagaacaaagagtgaagaggacttttgagtgctgaggaatgtggcagcttggaaaacaaactttttaggcagagattctttgctaggtcagtttgataaagtgagcataaccgtatttttaatctttaatgctaatgaatagcatagatgctaataagcatctaggtctataaaaagtcagctttgatagtgtatatagatggctttaaacattgttttctagcatttaaacactttcaaatcatccggttgcttgattgggcctagctgtctaagaggagagaatgagcccagatgaggaaaagagattgattttactgagctagaatgagaggagagagggttgagtgaatgaaaagaatagctcatgtgctcccctccatctgtagtttaagaggggttgggtccggtgttttgcttgttttctcgtctgtaaattctttgattctctgacaccactcactatatttcattgtgaatgatttgattgtttcagataaaggggactgcaataataccttgtgacatgaaggcaagatttattcatgttagaggcaggctttgtaaaatgggccactcttccaattgacatttgtttttatagctgttttcattatgaaatacaatctaatgcctgactaggttaaaaccatgttgtaacaatagttcactaaaattccttactgatatacagcttatgttgttatattccaaaaagatgaatattaaaatttgccaataatgtttatttaaatactattttcttcagaggaaaaaaaactattttatgcaaaggagaaagatctatacactatgactcacttcacttaaaaaaaaaaagactaacggaaatgacatggagagactgggaagttctagtcatcttgagtgacccattagatctaaatgttcttgtttagccctggtttgagtgaactaaatttaggtgtctgatcagtactttggaaatggtgtaaatgcctttgtaattgtctggactgatattagattaactgggagcacaagtagaaatagtgaaggaaagaactttttgctattgttatttgacatcactggcatatttataggaatactttggtgtttttggaagtaagtaaaccaaccagtggttctaaaaagtcagctgggggataatggtaatgccgctgtttcttagctgcaagttatctgccgttacttctcctccattttgcattttatcttgaatagctcctcaaaacctattaaaatacctggtattgaataatgtaattgaatgtgtactgaatttcacagtggaaatgaataagaaatttcctgtggaggttttttgacttagctactgaaataacggccttttgttgtgtgattctttcccttttctctttgttaaagaaaactgtcttgtgatcttgtagattacagaatccttttggcaatttctgttcctagcactgctttttctttctttctttcttttaaatagaaatggggttttgctgtgttgcccaggttggtcttgaactcctggcttcaagcgatcctcccaccttggcctcctgaagttgggattgcaggcgtgagcaggtactttttctgaggcctgcctgagcctatatatattttgcacaatttggcattcctccctacagtgtttatgctgatttgtttctggtaacaactaatactggcaaatcggctgggcatgttactttatgctgcccatattcaggaaaattggaattctagctgggtcattgttcccagatgatgtagtttggcaccagccattccatgttcacattttgagtatccaggagggctggggactttggagtagttggtgattccctctgccacatttcactggttggtcactatggcatcctttccaccacactagtagtctaggttctcagatgttgcttatgagcctgcaatggtttctagtttcacactgcagaaatgagtgaagccggttacccgttaatatggtcccatcatcactagagtaattcattgttctaaaaccagatctgagtctctcactcctctgcaactacttctgattctttcataacacttgtaaagtccaaactcctctttagcatggcagccagcttccagtccttccctcctatgtggcttccattctagccagacaagaaagggcagcgttctccaaactcatcctcgcccttcattcctctataccattgctgagcactttgttgaggatgcctctcccgttcaatctagcttgcatcttccagctcgaatgtgtgcttccttgcaccagagttttgttccgtcacctgtgtgttttcatacaagctggcacatatctcttctaaagccctgctgtcattgtagctgcgtctttacaaacattttttttttaaatttttataaagtcaaggtctcactatattgcccaggctggtctcaaactcctgggctcaagtgatcctcctgccttggcctcccagagtgctgggattataggtatgagacactgtgcccagctgtagctgctactttatatcccaggtctatctccaatggagcccaagcttcctgaggccacctgttgtatctttctcattcatcttgaagtcctctgctcctggcacagagtaggtacctaacaagagttgggattgaattgatggtcagtactttgctagcctgatggtataaagatgtacaaaacatgttcctggctcccactctaggggggcaatgatggaaacaaatagattagcccacattagtaccaatagtagaggtcactctgggagaaggcccccaccacattttgagtcatggcctaatgaggtaatttagtattgcctgctgcagtggctttggaagaaaggctggcattcttagccagtagaagctgataccactgatttgtttcacagaagctttaaatataacaataaatttgtgcttggcctacggtgaactttacaggcaacttggaggtaatatgtttgtctctctaagaattgttgaattcctcttccctcatccctcctgactggttctcacaagcctagcgggcctttgcatgtggttggttcataaaatactttttgattttgggatataaaatatagttctccataaaataacgactgttaccaagtctttgattttttttttcaaactataaatggtaatgacattctttggcctttgatcagaccacccttaggggcaagagagtagtttcatgttttgctttttctagtgtcccctgtgtctgggtatagttgcagtctcagctgtcatactaacagtgctgagtgagtcccttactttctttgggttttggtttctcccttgtaaaaatgatcctggactaactgatcattaagttcaggtcaagtaataaaaatccttaatgtactcacaaatacaatttaatgttcctgaataatccttgtaaaaactgcagcagttactcagttttgtaaggtgtggttgggtactattaggctcaaaagtttataggagctttgtgagtatagttaacaactcaaaagaatggggtgttttttcccgaggggcatgaaatgtttttgataaatagagttcatttgacttggtaatgtggaaaatgagtagccctgacacgtacgctatgcttttgcagtttttctctcaagtagcaattgggtggcttttcctgtaaaagatagaggaactgattcttgagaatttacgaaagcttcaaccctaactaggtatgcaaagaatagttgccctttatgttgtaattttaggaagaaacctacatctggtctaagtttcatttgaataatatgatagtttacacatctgccatatttgagaagaaagtacctaagtctccagcattttagaaataatgctttactttgtgtagaaatggtctttagagtttaatagctgctgccctctcctttttcaaagcagcttgacataatcatgagtatcttgctgacagcttgtaaattttgattgtatgaaaactgaaaataagaccatttcacatggaagattccctcctgccctgaaacagccaaagaaaactgtagccatcaaatctattgatctctgggctttggtacaagtcacactactacaaataaaataataccaagtacttataaatgattttcagtccttttaaagtttatttttttaatattttttttgagatggggtcttgctgtgtcgtccaggctggagtgcagtggcacaatcttggctcactgcaacctccacctcctgggctcaagtgatcctcccacctcaggctcccaagtagctgagactacaggcatgtgccatcacgcccagctaatttttgtatttttttggagtagagatgggattttgctgtgttgcccaggctggtcttgaactcctgggcttaagccatctgtctgcctcaggctcccaaagtgttgggattacaggtgtgagccactgtgcccggcccagccctttttttaagagaaaaacgtatgacatcgttcgatttactgagtgcttatggttttactaaggcagtaaggttttatggataccctatggtaattagatagaattagtgctctgaagtcagctctgtaatatggactcagagtaaacatggcaaagggacacttaaggtctgcattttctctgggaaataaacgtattctttactactctgaatctagtgctgggaaattctaaatccttcttgaggattaaccacttgaagtaaagttttgggtcccaagtaggcttgtgtccctgtctccttctctttacttttcagatgtttcttcctagagactgaggtatattttacttttacagatgaagaaggaagcctcggctgtgtttgtggcttttgtgggtgagcaacatcacttgcaaagataagatgagcatagcaaaactaggctttcaaaataatttttaaaaatttcttagtgattagaaaaggaaaactcttcccttgtctctgttaagaaacgtttttcgacttttttcctttcttaatggatcttttattggcacttctcttccttttgcagaatcttacttaaaagtcactacgttacattacagcaaacagcttagctaatttttatccagatgggccccggttacaggattgtacactattgcgaatttcttacaggaaagtgaacatcaagtaattattccaaatagagttctcttaagaacgtgagttacttaaaaatgtctaaggatgaagtcacttctgaatataacttcactcaagagaacaaataagcaaactgcatttagcataacatggtaaattagctttaactctccttgatgtttgaacatttgtcgctgttaactactgtttcacttttcaaatagtcagggcttagtttgcttctgtaaggataaagggaaaatacgccttcactgagtcataaatatttttgtggctaacttttgcacagagaaaagaggcctctaagaaggtacccagtgaatttttttttcggggcagggagagaatatgtcattttttggtttgttgttgttgttgtcattgttttgctttgttgtttttactctgaactgaactgtatcttgacagcacttttgaattaagagcattactcttattgttctctactacctggacgccacctccctgttgccatagtgttaaggatcatgctccgaggtggggtgaggcagaatggggccaagatcagaaagttacattaagctacatcaggtttatacaagcataaaaccaaatttttggagcagtccccagaatacaacctggtttagccacacctaaaggttgctcttgaatattccttgagaatccacatccctagaatgctgggtttcaatgggccctttatgtacctatcatggtgtcatttctgagcatttctaaatattccttcatgtcttactgacagtttttcttgaataaatcttaggaatattagtgccattatcagtattttgtttggtctgttcacaccacaaataactacccaggtctgctacttgcccctatttctctacctgctaatgaaaatgcttttgaaagtttgagtaacagtattggagtgtgcacagtggtattggtaggttctgtactcatccttaaccacttgttttcatcctttgtgagcttgaagtttctccaaaaaatttatcacaaaacttatcagacatagttaatacactcagagagagaatcactgaaaaagtagatgtagtttaacaaacccagtgccttttttttacccatgaatacatatttgtcaactaaacctcattttgcaacttgttccactactcgaatggtaacaaacttttggtttcccaatagatttggaagatgttgcttttgaaagtaggaaatagatggctttagaagatggaagaatattttgtttgaagtgggagcgtggtatgtccttagctgtctgtgaaatgcagctgaagatgggtgtgggccttcatctgcatttcccatcttcagtttgaggaggtagttacccttctaaccacttaagaactgcatggtacatgctgttttatttacagggcaaaactgtgctcccgtagtttccctggtgcttgccttcacgttaacacagtgtcatcgtttggcagtgtttatgtgccagggtccatgttagaaggaggaaaggtatagcgaagttaaagggtgcagttggcctcccacctttagttttgtaagtgcctttaaagtttgatttttgtaggttgatcataaggaagtgataagtatgttaggttatttgtggtttgagctaattttagtctctttttacagcttgctttgtatcctttgccattaaaacatgctttctagaaagacaacttttgaatgtaggacacagtctatattctatacttggctacatttcaaaaaatattttctcagtactttggaagttggacagttggaagcatagtgacagtatttaaaaatctttgattccggccgggcatggtggctcacgcctgtaatcccagcactttgggaggccgaggtgggtggatcacttgaggtccggagttcaggaccagcctgaccaacatggtgaaaccctgtctctactaaaaatacaaaattagccgagcgtggtggtacatgcctgtaatcccagctactcaggaggctgaggcaggagaatcgcttgaatctgggaggcggaggttgcattgagccgagatcataccattgcactacagcctgggggacaagagtgaaactctgtctcaaaaaaaaaaaaaaaattaagtgatttctttgctttgtgacacttctacttttccagcaagtaaattatattctttcatacaggtatgaaattcttgttccaagctagtggttaaaaaggcacagttgatattagaggatttgtaaaagattatgaccacgcctgcaatgtactgaagcaaggctttgctgggctgtgtataggaaaccttccccagcctgtgcccttgcttgatagaacattttgctcctaagggtaggtgcctgtatctgtctccagtactggttagtttcacacagaacagttgtgtttcagagctttagtctcaagctgccctgctcccctgaagcagccaccctgagcatgtgcactcacaggaggggacatgtgaggtcatggaagaagacgactcaggaagaagaagacttgggtttgggttctgactctgcctttgactgttgtgggattttgaggagttgcatacaggatctgtaaaatgtagtcattagactagactagacagccatatagcattacctagatgtaactttctacaaagacatggtcacaggagaagaccagagggtggggtgatctttctggaaaaattggggcttcatgccttactcatgctagatatggtagcattatatggctgtgcctgatccccctaatctaaaagtgggacagaactttaaaatttcatattaactcaaattaaaacttgaaaaaaacccattatttccttaaaaataataaaatgccctgtgggggcataagtcacattatattttaaaattcctgaatgccacatggatgaatgtagttccttttgaaattcttcttttgtctaaagaggaatgttggattttgtaattggactaaaaaatcttccatttgagagagaaacagtctgctgcatgttctacccttgttcaggataaaacccactaatagctaacatttattgaattctgtgttgtgcctcaggcactgtgcaaagtcctttacatgcaatgctgtttattatatactgtcaattggtctataacagcaggaaatgtttcaggaggacaatgaggtcccagaccctcagtcttctcctgtgtcctggattcagcttcacaatagcactatggcagtgtggccactgcttcagcttccacatacatggctgtgaagagagacaggggattgtgctaagcctccccgatttattaggacataggaggagagagtttgtagtttttgacctttgcctagttttctaacctctttcctagatgtcacaaattggccacccacagtcatattttgcttgcttcacgcaatgctttttaaaaaagagaagagtttaatttgtgccattgtttataaatgaatcaggagaaatgacatgcaactctggattctggcctctcttgaaaaatctgaaaatcacaccgtctgagcttacactggcagtggtctgctggactgagggacacaactccttttggatgtacatgtgtgcgttgcagagtttaccacagtcccacagtgggtcacactgtccttgtcggtgtacactacctagcacttgagtttgcaacccctaccccaagctgagttttctcgtcaagcttgatgttaatgttatgtgatgcttggccttgtaggtatttggtatattatcgttagataaaattgaagcaaagggctaaagggttggtggcctgagggagtgcccttgacagtaaagtctaggataaaatcattggccaggtactccttcccttcccgcccttcctcttttctctttatcctcagcctccttctgctattttgaggaagttagaagccaccaccattttttcccacctcaggcaactgagtgtggctgtatttctgtcccatgttcagttatttccaggaactatttttgatgaccaacttgaagttacattgggtgggcctaatgggggctgataaaagaatgaggtgaccaaatatgcttgcactgagacggctacgaagtaaggtttttaatgacttgctttgtgacttggtcaggagtgataccatttgtcatgtgtccaacttcatgactaaatggttgctctaccttatcctcatagctataataaaataaaataaatacatacattgcagggaggaatgtatcttgttaaaggtctctcccttttagcaacaaaagtacatattatgttgtagaacatgctttttctttgatccttcttgaacacctattactctatagaggtatgttgtgtatggcaaattagaacaagcaatagataaggatgattctttaccattataacccagtcaaggtctttgtcctaagttttgtacctttctccagagggaaaggtatttgtatttatttatttatttttgaggcagagttttgctcttgttgcccaggctggggtgcaatggcacgatctcagctcactgtaacatccgcctcccgagttcaagtgattctcctgcctcagcctcccgagtagctgggattacaggtgcctgccacgatgcccggctaatttttttttttttttttgtatttttagtagagatggggtttcatcatgttggccaggctggtcttgaactcctgacctcaggtgatccatccacctcggcctcccaaagtgttgggattacaggcatcagccactgcctccggccaggtatttgtatttttagtctctatgccttaccgtctcagatcaggaggatttggtgatttatcgaatgtgggggaaggggaagaagaggaaacgggaggaatgttccagattagggaaatagctagatggaagatgcagcccctcatcaaggtggggacacaggaaaaggaacgtgtgcaaagaagatggtgatctggttgtgaccatgttgttagaggacgtccagggaagcatctggtaggtggtggggtgtttaaatatagaacattcggagaatgctccgaagcttcagagaacccttcccaaaaggacaaaaccagctcagtgttttagcactccgggatcatatggcatgacagcatggctgctttatacttttttgtgtatgtgaaattaaaaccaaccactcaggaccaatttctctgaagctttttgtcaatctttcatttgcttttctcgtctagattgtaagctccttgcagccagtgtctgttgattcagtcattcaaaaaataatacatgaacagctactaggtaccaggctctgtgctgggcagttgggatatgtggtgaggaagacaaacttggtccctgcccttaggaagttcagtagtccagcagacaaagtggctgaataaagataatctcagttcacagtgataagagctcttacaggcctaggctccaggtgctgtggggatgctcaggaaaaggtatctaattgggattgggagcaggcaaaacaaataaaggatagtgtataaaggtaatatctagttgaagttctgaagggcaaggaggagtgagcctgtatattctctgagtctctccctaatctgggattgacttcttgtccgtctctgttcatattaagtgtcacctaggcttgaaagggtgagatcatatttcacttccttcctctttggtcttaacctttctctgctaccccctcacacaatgcatatgcattattctcttattgtatatatttttcctctcttccttttcatgtttcctctgccattacttttaacctcgactgccatatggcctctaaacgcttccagaagggtagcctagtggaggttattccatcatggccttgagctcatgcgaccagatagtgaaggcatctgtgtaggtgtcttctccaggagggtgatatttgtttcattgtaaattttgtagccctagaacaccaacaacagtgcacagtaattagtaggcaggcagtacaggattcattgaagtgaagtgataacttttatccaagtatgtatgcagataatctttgatttgtacaaaaaaaattatattttaatatgtaaagattttttaaaagaatcttcaagttttagccttcccactaggaatatattgaaaacatgtgcctagttcactgacttgcagctgccactatgagaataaaggtctcatttagttgttgtgaattttaagggatattttcaatgatgttggctggtttatcccattatgtggtctttttttttttttttttttttttttgaggtggagtctcgctctgtcacccaggctggagtgcagtggcgcaatctcgactcactgcaacctccgcctcccgggttcaagcgattctgctgtctcagcctcctaagtagctgggattacaggcgcctgccactacgcccagctaatttttggtatttttggtagagaagggtttcaccatgttggtcaggctggtctcgaactcctgacctcatgatccactcacttcagcctcccaaagtgctgggattacaggcgtgagccaccatgcccagcctatgtgctcttattagcaattctcagtacacagatagctttgagtgattctttcaagtcaagtaccttattaaaaaactcaagtgtactgataattatcttacttttaaatggctaagtgataagactgaatttttaggtactgtaacacttcagattacagattctgatatttttatggttatttatatttatttatttttgagatggagttttgctcttgctgcctaggctggagtgcaatggcacgatctcggctcactgcaacctccgcctcccaggttcaagcgattctcctgcctcagcctcctgagtagctgggattacagtcacccgccactacagccggctaatttttgttatttttaatagagacaatgtttcaccatgttggccagggtggtctcgcacttctgacctctggcgatccgcccgcctcggcctcccaaagtgctgggattacaggcgtgagccaccgcacctggcctggttacttaaatttaaatacaaaaattatgttgattaattctgaatgatttcctgattgctccccgtttaccattcacacatttattaaattcttcgcttgccatatagaagcagtctctctgccatatatgccatatagataacagaactagctgtctgcaaaccactgaaattgtgaaaacatctccccttttttcctgtttctaattctagctatgaggattatatacagaagtagtcctggatttgatttttttttttttttgatgattgttttttgatagttgttgactacaaatcatttaaacgtctgaaaggggaaaggttttccttaaaaatggatgacaaaggagaataaaaaggtattttgactatttttttgaatgatgagttttttttttctctttcttgttttcttttggagtcatttatgtgtcactgagtggataccatggaacatgtggcagaagtagatatatggggtaaaagaaccatagttcataagctccttgacagaatcactgaagtgtagccgttatatggccactgtcgcagggggaggcagcagttttgaagaaggggatgagtaataatgagtgataaaaaggcatcctggatagaagaccaaactctgcagaagaccccagtttgattatgcttttgttttctgatttgcggaggagagtgaaaatgcctgaggggtgcgggggagcacatagggtgtatgtgtgtgtgtgtgcgcgtgcagattctctctttcactgtatgtatttgtatgcatgtatgtatcttaggacttaagctttctagtcaataaattgccatagtggggaattgcttaattgcttgccttctgttgttgtatttaatttaattttatttttaatgatttttttggtggggtacagggtcttaactatgttgtccaggctggtcttgaactcctaaactcaagtgatcctcccgcctcgggctcccaaaatgctgggattacaggtgtgagccaccatgcccagcttagttgtattttaaatgggcctgtttgcagcattccctactccccttagtttacctggctcacaacctgtctttccatatcaaggcttctgtcacccctggcccatgtcagtgcatttgggcagcccacccagcatcatcacctcatgtcccagggaacttcctgttcctctcttccagctatttccttccctggcagttgagatagtctctacctttgacctactgttaagctcagaccttctgctctctagttacagcctctgtgctgccagattccctcgctcagttgctttctctagtttgggttttctcctttattcagatttccagctgtttctctcctccccccaccgcagcctcctcacttccctccttatgcatctgagactgtggtcagtcactttagatgctgcctctccactgtacttgtgtccatcttcttacctaccacctctagccctggagcaggctcttcccctgtctttgtcttcctgggcccaggctcctaagcgctgctggaaaaaaaatcccccagtattgagcccctagaaatccagtctttaatcccaaatctgtctcccccagcatctggccatcagatctaaagcttacctgccatcctttccacctcatttctctcacaggggaaaaggagcctttgctcctagagtctgcgctcctgaccccttcccatctcacctgttcaaggcatcttgcaataaggggttggtgactctcgaggaatggatcccaggccctccctattatcatcttatgtatgccagttcaacgttctcagcttcctccagccgagacggcccctccagccactgctttatactctccttctctggttgaaatttttgaagtaaataggtcactctgcccatcgttcatcttccagtcactctgtgtgtttatcttccagggaagtgaggctctatgctaccaagccactgaaataatttttttttttttccagactgagtcttgctctgtcacccaggctggagtgcagtgccgcagtcttggctcactgcaacctctgcctcccggcttcaggcgattctcctgccccagcctcctgagtagctgggattacaggtgcctgtcatcacgcctggctaattttttgtatttttggtagagatggggcttcaccatgttggccaggcttgttggcatgttgaccatgttggccaggctagcctcaagtgatccacccgtcagcctcccaaagtgctgagattacaggtgtgagccaccgcacctggcctgaaataattcttgacaagatctgcttccttgttactaatacagtggatattttgcatcctaattttaatgcagttcagtgtggtagacctgtatttgcatattgaatattcccttccctgttttaataactctattttttccttttcttttatatctcctgcttctctagctagtcctagaccttactcatcggtgtcttctctgtttgttcctcaacttgaggagttcctacagggtttacccaatctgctgctttcatttagcccttttgttctttttgagccatctcattcactcacccaggatgtagcatcggcccttgaattcagtgtgcacacatacactgtgcactatgggacagccttcagaggcactttgttcctgaaattgtggtggtctttgcctctcatggagccttgcatatgctgtttcctctgcctggaatatcctaccttttacttaactgattctcgttcttctttccagtcacattttgtacatttcttctgggaagctttctctgatttcccctttccacaggtccaagttaactgccttgtctaggtcctcccatggccctctgaaggcctcctttcatagcaccatgtctgagtatactgtaataacacgcattgctctgtaatagcctgtttacttacctattgccaagtaatctatcaagtcttataaagggcggggctgcttttgttctagtcatttgtatctcttagtacccaatatagtgtttggcatatagaaaatacccaacaaggccagtcgcagtggctcatacctgtaatccgagcactttggtaggctgaggtgggcggatcacttgaggtcaggagtttgagaccagcctggccaacatggtgaaaccctgtctctactaaaaatacaaaaattagccaggcgtggtggcgggtgcctgtagtcccagctacttgggaggctgaggcaggagaatcacttgaactggggaggtggaggttgcagtgagctgagatcactccactgcactccagcctgggtgacagagtgagactccatcttaaaaaaaaaaaagactccatcttaaaaaaaaaaaaaaagaaaaaagaaagaaaatacccaataagtagttcctgaatgaatagatgagaatgctgtttagaaggttcatgaattggaaaccgtgattgctagggaggctttgagttgatggtattgtgttgaaccatgtgttacccaggatcaatttagattttacactttgttttctctgttcctttttatagtaattttctgtatgtggtgttttccccccatgagattgtataccatttctcagcgagaactgtgtgtaatgcttggtggctccctcatggtgccttgcatggaattggacttcgtttcagtggatctgatcccagttatgttaatgctcgatggagctaagtcttatctcgaagcagtccatgtcttcatcagctggccctgcctccatgccctgcacagaccatgccactctggagaggtagtttccctgtggcttattagtcttatgttccagtgtgctggccaagtatgagagacatcagtggtatgagagagtctctctcattcaaacttcgtaggttttgtagctgggactgaccagtgctgacaggaaatagaggcatttattaaaagccagagatttttcaagttgcaggaagcaaagctcttgttagctatgattttgtggtgggtttggtagtccaatataaaagtaaaaactggatgacaatgggaggagcatgcttgggtctccaaagttagatcatttttcctaagtaatttgtctttaaacttttactggtttggaatttcctgagattttgatcttgccagaaagtttatagcaaaagttctgagcagatgacacttttgcgtctgaaaccaaatcattgtttttgtttttaacttttttcttaatatattatccttagttcagccctgaagattattctgttatttgtggatctcaactttccccccatctcctggatctttgtgaaatgaatggtattaattgaatagagaaggaagatataaacataaacttagtcaaaaacttgttcttgactaggcaagttgggctttatagctttgagctgatgacatgtctattcttgtgaaaaagggatttttagtgttggtttggcttcttgttatatttgatttattattattatcattatcattatttttgagacagagtcttgctctgtcgcccaggctggagtgcagtggctcaatctcggctcagtgcaacctccgcctcccaggttcaagcgattctcgtgcctcagcctctggagtagctgggattacaggcgggtgccactacacctggctaatatttgtatttttagtagagacaggtttcaccatgttggctaggctggtcttgaactcctgacctcaggtgatccacctgccttggcctcccaaagtgctgggattacaggccttagccactgtgcctggctgattttttttttttttttttttttaggtttgttttaactggaactttacgtgaatgtaattgaatttagaataaaagcacttaatttcacagtgtgcagtgaactttctgttacttattttaacagtaaaaccccttgcagtaaatgacttggagcaaagattgcttttttaaaaaatgttttaatttgtttttcttttcttgagatggagtcttgctctgtcaccaggctggagtatggtggcgcgatcttggctcactgcagcctccccgcctcctaggttcaagcgaatctcctgcctcagcctcctgagtagctgggactacaggcacatgccaccatgcccagctaatttttgtatttttagtagagacagggtttcaccatgttggtcaggatggtcttgatctcttgaccccgtgatccaccctcctcggcctcccaaagtgctgggattacaactgctgggattacaagtgctgggattacaagcgtgagccaccacgcctggccaattttttttttttttttctttttgagacagagtttcactctgtcacccaggctggagtgcagtgtcacagtcaaaactcactggcagccttaacctcctgggctcgaatgatcctcctgcctcagcctcccaagtaactgagactacaggcatgtaccactgtgcccagctaattgtttttttattttttattttttgtagggacagggtctcgctattttgcccaggctagtctacaactcttgggctcaagcagtcctcctgccttgacctcccaaaatgttgggattacagggacaagccactgcacctggccaaggattgttttttaagtgaactgagacccagccttattagtggtcccagagcagacctgggacctgaagggaacccttttcttctggtccagcgtctttcctctgatgggctactttcctggagcctttgattgcctgtcatcagagtaactgagtttgaacagagtaggtagttcctctccagaccaccacactcaccagctttcattctgcttctctcgtttagactgtggttctgaatcctcagttctatttactgagtgtttttaaacataaaaatgccttttaatgagattgaaggccagaggtgggacagttgaggacaaagtagaaataaaaccttcaaggcggggttgttggtgggagtctttttttgtttgtttgttttttgagactgagtctcgctctgtcacccaggctggagtgcagtggcacaatctcagctcactgcaacctccgcctcccgagttcaagctattctcctgcctcagcctccttagtagctgggatttcaggctcccgccaccatgcccagctaatttttgtatttttggtagaaacggggtttcaccatgttggccaggctggtctcaaactcctgacctcaggtgatctgtctgcctcagcctcccaaagtgctgggattacaggcgtgagccactgtgcctggcagggagtcttatagaagctgtcgtggacaatgtgggaagtagtgagcctttgtattccagtatgctgggctccactgtgcttgctctggcccccggtcgctctctgtgtgttattgagtccccatccacggccatactcttcgtcctgcttctctccttaccatcctctccccgctagtggtaccacggctaccactagcaattactgacatgtgggatcttagggctacttccctataaggctgcagggcatgtggtgttggctacgcgcatggtaaccatggtagccctgtggttctccacatgtgcgccttgtgacctgggattggctgcagactagtaataaactgcgtcttctggtatggaatctgtctgtagttgtactttctacctctgtatttaaggggagatctgtaacctaccaatgccagttgaagaggatggatgatagagatgttaacaaacagctgaaaaactaactacaatggcctgcaaaatagaacagcaggtttttgtggcaaaactttgtgtccatgagtttgttttttaaatatcctcatataatctgttttaaatcgagaggctttgggtaaaagccatggctagtcttacatgtcatggagtacctagcttgtgaggttcacagtttattatttacagagtgtccccttaaatcttctttgggtcggttcagcgaatgttgctcagatggacttttttggctgacatagagtcaaaatggtaatcaagcatgaaagtacagacagtccttaacgcacaaatgtgtcatgcttgaaaagttggaaagttggttctctggagctctgattgtattgtcctgtagaatccgtgttgtgaatggtggttaaatcccaaatgagtccgtagaacctatataatctgcaatatacctgcagtattccaattaatatgtaattcccccatagaactatgttaatgatttgtatgtatggtatttaatattatacataataatgattgtatgaataaaaaacattctgggctccatgtggatgatggggtgtgtgtgtgtgtctgtctatgtgtgggtgggtgtgtgttcatagatcccttttcctgcaatcctggcactggaattggttttatcatttccaattaagtttcattcccatgaattttggagtacagactgggtccaggtatgcagggcatagattagagccctgagaaataggattaggctggaattgctgggttggagatcagtagcttccaggaacactttttgggcctggctgtcttcattatccccttttgttttctcctggggtctgcaggtattgccctgttttgttcctctaatatcactttttttttttttctgcttttgaccagggtttttgcctctggtctacaactgaatatcctatcagactctcctgattttgaaataaatatatagtttttttgaggtgttctagcgaatttctaaatctaaatgttgtggcagagttattacatactaattttgctatgagaggttgtagaatcccagatgactaatcttgtaaaccatacacgcatttccatctaattctccattgtatatcatgttgcagaaaataacagcctctagagtttacattgcctcctttgactatatttcttatttaagattagttttcagataagaccttttcatggcagtacataactgtacagagggcttccaacttgtcttgggagctctcatctctgggagacatcacattacccactgccccctgccccccgcccccagcctggatgcactcagcctgtaccccatttctgtcctcagccaaacactgctgaaatgcaagagctttcaattgctagccagtgaagatgcagactaagggatttccatgtagaagcccgctcttttcagctggctcgtcgagagctggaggccccttgcttgttcacatgaggctttttgtccctgacttggtggctgctgtttcacttctcagcagaaagggacacccttgcccccccccagaaaggaagatttgatgtaccacttccgaaaggttcagtcgggcatcactgtaaccaagaagataggtcaggtgaggctggaggtggaacagggctgctcgctagaactccagattgttccacaagtgccttctggcagagaatgatggaagcttccgtgatttttttttctccttaatagttatgagcacagaagaggagcagattgtctggctatagaagctgtcttattttttatttttgtttttgagatggagtctttctctcttgcccaggctaaagtgcaatggcgcgatctcggctcactgcaacctccgcctcccgagttcaagcgattctcctgcctcagcctcctgagtagctgggaattacaggcatgcgccaccatgccagactgatttttgtattagagacagggtttcaccatgttggtcagtctggtttcgaactcctgacctcaagatctgcccacctcagcctcccaaagtgttgggattacaggtgttagccactgcacccggccgaagctgtcatattaaatagcactttctgcttttagcaaatttaatccaaatgagactttagattttcttgctctgacttaccagcagttccttgaaacacatttaattatttttgccagaaaatcactcaagcacttacgccatttttttaccgtgaaaatatgctgcattattttaaaatatattagaagtcagtaaccataagattttatatgttttctaatgtattctgtaagctttctgctgcttttgtttggaaggtgtattttgtaacgtagaggactgctttatctgcttgtaagcttgatttttgtttttactgtaatttttttttcttttgctgtattgagaaatacattgagtaattataaagtcagtggcatgtttataagttaatatttgtatctattccttagttactctaactcaaaacctaaagtaatcttcaactctaatttactctgacatccagttgactgccaagtcctccaacttaatccttatccttttttttttaaagagatgcagtcttgctttgtcacccaggctggagtgcagtggtgcaatcatagcttactgtaacctcaaattcctgggctcaaatgatcctcccacgtcagcctctggagtagctggggctacaggctcttgctaccatgcccagctaactttttatttttattttttatagagacagagtctcactgttgctcaggctggccttgaactcctgccttcaggcggaactcctgccttcaggcggtcctcctgcattggcctcccaaagtgctggaattacaggcccaattttattcttgggatgtatgtctgaaactctttccttcacttccttcccaagccttagttcaggcccttctcatctgtggtcttcaaagtcgccttcagctggttcaggtccttcctttctgctgtatctttcatgggaggacatgttatgtatcactgtcctacttgaaaacttccattccccattgatgagggtgttacctccagattcctaacacaggtgctgaaggcatgcctggataaaggcactcccttgatctcctggccaggtccccgtacacctgcagcgcatgctccacattctgtctttactgatgctgtgtcttctgcctgcggagccacccaccattctattcacagcccctgcctcagcggagcacgtgcctccctcttcctacactgagctgtcctttctattgaatcccctcttttttgtagtatgggaaatattttattatgaatactcttttctctgttgcctccgtgaccacgttaactttgccctaattcgccttaggactccatctgcttaggggaaagttaggatttggttacagaaagcaagctgctagaaagaacagtgtttagcttctgacaggcaaaataggattttgcaacatgcttttcctttttaatgcttagacattttatatgaattaatatttttatttggttgcttatacattactttctttttagctagaatgtgaaccctataggaacatggggattgcctttcacatctttgtatcctcagtacctaatgttcagtcaccctgtggtcttgtgtcgtatatacatttagccttccttaattaaaccatatgtactggtccccgtcccccacccccaaatagagagaaagaaattccttgaatactacattgccagtatcaaaccacaccttgatatcctctggggaaagggaggtatcagttgaaaagagaaaagaggttaaaatctaggcattaaaatgtgtaaggcttagatgctggcaatttaaggtatgttttcctgaggttaattttgattgtgtgcaaattttacctcatatctaactgtaggatttagtcaccacataagatgggatacctccataaatccttcagaaatgtttgtgaaattaaataaagccttattgaagactcagctcttgagagtcatctacctacctaacagttattcttgaacagaagagtcttacttttccctataaggcagtgtgatagccatctgtatattcatataatttatgttggcgcttacttcatttaaaaatgtattccgtgaatgcagttgccaggcggtgtgctgatcagaaacgtgtaccaatggcctcttttataattataagaggaagaccaacctgaaacagtcacacaaatgattaattttaattgtggaggagtgctgggaaagaaaaataaaagatgcaatgcaagtgtttacaaaggagctttgagcttgtttgaagtggtccttgggcacttaagcaaggcttaaagaatgatgtgattagaagtggcttagcaattctaaagaacacagggaaggcgtgtggccagaacattggtccctagagcacatcgcctcctgacataccatttccttaagttaatgttttaccactatacataggccctcccctttgtttacccagatttttttaattttaaggatgtttttaataacttagaatcctgtaatttgttgaacagtcctgtattccctttacttatattccttgagattttataaaatattttttacatgtcccaagtcttgattatatctttttacctcttgttaagaaatacttacttttctatttttatgctatatttcatgtttactgtagaaaacaaaaaaagtaaaatttttctttattcctatcactgcagcttataagcactctaaacattttgatctatattttgccaatcatatattttagttaaaattgttgttgacataattgtagattcctgtgcagttgaaagaaataatacagagctgagcgcggtggctcacgcctgtaatcccagcactttgggaggccgaggcaggcagatcatgaggtcaggagtttgagaccagactggccaacatggcgaaaccctgtctctactaaaaatacaaaaattagctgggtgtggtggcgggcacctgtaatcccagctagttgggaggctgaggcaggagaatcgtttgaactccggaggcagaggttgcagtgagccgagatggtaccattccactccagcctgggcaacaagagcaagactgcatctcaaaaataataataataataataaataaactttaaaaataaaacagagagatcccatgtgcgctttgcctagttcccccatccactgcccataacattttgcagaactgcagtacagtatcacaaccacaatactgacattgatacagtctgctcatcttattcatatttccccagtgttactcgtatccacgtgtgtatgcattgtgttttcaatactcttttattataaagctgtttttaatgtgattcaattctaggttgttttgttctgccctcaaaaagcattccctctcctaatcatatctccgtcatacccttgtatgttttctttaaacctgttttaagaaagcagctacctgtaagagaaatgagattgaaaacagaattgccaatctgcttgtactttataagcctgttgattgtttagatacggtttagccagtttatagttaccctgggtgctgaaaggtatgctggatgatacctaaccaacagagaaccattgaatgccgttcaaaatggactgaagcatcagcaatgtctgaaaaaggcctgacagtaatgtacatgtcaaatggcccgtaatttaagcagagtagagtaagtagaagaataaacatggggaaagttccagcaacagaggaggctttgagcttttgctcttcatcttgagtggatgttgttctcaggtggtaataggccatcgagctttctccactggctgcctctctggggaacaaataaccgaaaagatactcagcaccctggttggtacataggtggtcagttgatttatacttcctggttttcagtgttgcttgaattttctaaatggaaacacagtacctttataatcagaaaacaatcccgagttttgatttgagggtgttgtaaaaagttaaaaaaaaaaaaacagaaatgtgaaaaggaagttgtgttagagtatttggagttgagaaagcatgaaaaggacagaagagaagctggttgtcaggttgcatggggtagctacaagcacactgaccagaaagtcagctggaaaaaaaatgtagaaacaggagataaaacggccaaggggctatacaagcaaacagcaaggacctgagaagaaaaactagttaggtgtgactgtcagagtgatgtgtacagtgtgatcctttctgtgtaaaaacaagcagtaagaattcgctgtttacgtttgcgtgtgtttggagaagagtggggaagagtaggcactgccagactgtgaacactggttaggttattgttatatctttgtattatatacactggacatgttatttgtataatatgagaagaaattttataaatcattaaatcttttggcatttaggaacatttgtgttttctaatagttgcttctatactattatctttattatatgcccttcatcttctcagtgtttggctgttgttgtgattcccttttgtgagcagtgttgaagttagctaatattcatttcttctcccttctttcaccctcctccagagtctgatttgaagtattcctagctgctacctataaaagcaataagcaagattgttttacttttcacaaactcgtcctgttctgtgcctctgcctcggacatagctgtagtatagagtgttgtctcccttacatccttctatcttagacctactagtaaatattaatgctcactctaagttcttctcaattcttttttttttttttttttttttttttgagaaagagtttcgctcttgttgcccaggctggagtgcaacggcacgatttcggctcaccgcaacctccaccttctgggtttaagcgactctcctgcctcagcctcctgagtagctgggattacagtcacgtgccaccacccctggcaaattttgtatttttagtagagacaaggtttcttccatgttggccaggctggtctcaaactcccgacctcaggtgatccacctgcctcagccttccaaagtgctgggattccaggcgtgagccaccgcgcccagcctcttctctcaattcttcctgaagctctttctgcactagattcctcaggaagggcttgtgggaacaatcttctgtgaatcaacagtacatattcataatagtttgtcagcagcctattattttaaggccatttggtctgtatataaaaatgtttggatcacattttctttctttaaggtaaatatgttattctgttgtcttctggtataaagcattgctgtaaatgtttgacagtctaattatcttttgcttataagtgacttagggttttttgtctatgtgcccaaaggattttttccctctttctctctttttttttttttttttttttttttaaacagacaggatctcaccctgttgcccaggctttagtgcagtgaggcagtcagagcttactgaagttttgaactcctgggcttgaggaacaaaggatttttttaaccttttaattcaaagtctcatcatttatgcaaccatgtcttggtgttggctgttttgggttgttctccctcaaaaatccatgtgctctttcaatatgtagttttaaatcttttttttttaatttcaggaaaatcttgaattagagttttccgtttttcgtctggtacattgcttgggtttccttcttcaggaactcagcctgttatgtgtatgtttgatcttctttgcctgtcgtctgtttctttcacttcctctcacttttttaaacttcatttattaaaaaaaaatttttttttcgagacagagtttcgctcttgttgcccaggctggagtgcaatggcgtgatctcggctcactgcaacctccgcctcccaggttcaagtgattctcctgcctcagtctcccaagtagctgggattacaggcatgcgccaccacgcccagctaattttttgtatttttagtagagacagggtttctccatgttggtcaggctggtcttgaactcctgacctcgtgatctgcccgcctcagcctcccaaagtgctgggattacaggcgtgagccactgtgcccagccttattaaaaattttaaaaacatacatttaaacttaacagaaaaattatgagagagaagggggtggtgccaggcttttttaaacaaccagctcttacatgaactcatagagtgataactcattaccatgaggacggcatcaagccgttcatgaaggatctggccccgtgacccagacacctcctactaggtccatttttaacattggggatcacatttcaacgtgagatttggagggggcaaaactacaaaccatgtcactcagggattggaggagcaagtaccacctatactttggactcaggtagaaaggcaaaatatccaggaaataagctgctaccgtccagggttcagcagaggtgcccatcagcctgccaagtactcaagagtccagcctctagggagctaatcatcatggtgagctcttcgaggcacagggagctgggaagacagtgcttgccacccctgcctgaatagtgtttgcacagagagttctgttgtgtcttgattgggtcctcctgccactgggaatgctgtggattatactaggtctctatctggcttgtttcagggctccatgtgaaaaccttcttgatatcctagccatccacctgctcagtccctagtttgcaaggaggctgtggggagcctagattctgtgtcagatagaatgtactacattccgtctcaggaatgtaccacatcagaaaacagtgcgacctgcaggagaagtagaggtgaagaggcacattcttccgagaaatgtttctctcaacacccagcattccctggatatcagcaggaaattactcactgctagaaaatgccccatgagccttctgttaaggaggtcaagggagagaacagagaaagttctcaaagttgacttggtcactggtactttcttatgcggttcttattttgtttgccatcgtcatcatcatgctatgtctattttctcaatccaaatccactgctttcaccttggttctttctgaccggtttggcacactcattcagtaaatccttatggagagcccaatgtctgcataattgtgctgtgctgatgaccaagctagacctacgagtgtcggctcctttgagatgtacgggacagctcttctgtcatctcttctgggaagcctctccaggcttggtgaacagtggcaagatgtttaacagttgtacatgtgtcccatgttcctttctaagagcctgggcaaaccagacccggtcgcaggtcatcgtagtatggcgtgagcttcctctctcctttctgaccttttgtgtgatggcaagaacctgcagagtgacacaagcagcaggcttctgaggttgctctagcctcagaatggccgtcccttctccaccctggccctcattgctgaggtttcctttgaagcaacagtgccggaacagactaggggaagcagcttggacatagctgtatgatttattaccacccattgaggccaaccaaagtcggcaaggagaggtagcaggtcagtggtgcctggaagcttcctctttcctttgcaccagatgtgactgctctgcaattactcctaaatttgctactctcgtttttactagccaaccttgatgtttttcccttcttcctgtagaatagacttcccctctgatcagtactttctactcaacactatttgtggccacagtgggaactcattgaggacagggaccatgacattactacctgacccatcaacacttggcataacttgaaatgcaaggacaaaaattggctgcaagtacaatgtggtcttcactctgaaggtgatccttaaaacttggctttggcatcatattgccttaatatacctaggggattgggtaaaaccagttactttaaaagagttttacaattctggccttctagctatcttgtcttcttaaacaagagcacaagatgaatgtatcttagtgaaattttatatggtttgctttgagtaatcttgcgaagattgatttttagcacagtaggaaagacacattctaatagtgatttttttccccgagtttatgtactgctgttgcatgaaaatctgactagatttaatgttcctaaagttctttgttcatcctgatttttgcaggtcctagggaaagctttgttttcctcttaacctaacttagatgttgtcatttcatgagctttggaggaagagtgtatagccaattgtgtaatgtctttaaaggatattatctctgcaatagttgtttataaggcctaagttattcatgtaataatagtggccccggatctgtttctagcaataggtatatggattttggttcctatatagttgtagttgtggctttgagatattgagcaagcccttttaagaaaggatttggcatccctcagccttcaaaagcttctcaaaattgatcatatgttattagcaaaggtttactgcctgcttccattgtatagacaatttattttttatgtattccgttctaagaaggcagatgaccaaaagatcttgcatctgttgcccaaggcttgtgactagagaggaaagagataagaatacttttttaaaatcccattttactaaatatgttgaggaagtggtaagatatattaatttgttgagatttttctgttatgcctattatatgaaataggtactctgaacatggcttcttaattaaatatatttgataaaatacaacttgcttcccctggagtttagaagtcagataactgccatggagagctatgctttctttgttttaaagatctgcttatgaacatgataaacaggaacaatttaatgttttcaatattttcttgtattttactgcaagtttatacacaacataaatatgggggaagggggaaatgtttataccagagccatcctgcccattctttccttacagaaggacaaaggagcagtatttattttaactacaaaaatactattgtaggttttaaaaattccgtatattttgatatcttgtgttcctcttgacctttaatttgctaaatagttgcaaagaatgaaggtaacctgcatcatcttcttaaaaaccaactctatctaattataatagtttgtctatctctgaaaaatagtgatgtgttcattctgaaatcagaactaccggatgcagctgcattttgttactatttgaatttcgggagagggaggaggatgcagcctttcgagctgctgaaatacacaaacacaaagaagacaccaagcatagtagaactgtgttaagctgaccaagccagaagaagcacctattctcagcatagtatgagacgtaaaggcaatataatgggcatagttgaagatggtagaaggaaaatagactctgatggtttaatgttaaatgctttttttaaaaaagtggtattccaatatcgaagaagaagactttctacttttagaagcaataaaggaaattgcagaggaaagggtcaataggttggaatacataaaaattaaaaacttttaaactttttttttttgagacagagtctcactctgtcacccaggctggagtgcaatggtgcaatctcggctcgctacaacctccgcttcctgagttcaagcaattctcctgcctcagcctcccgagtagctgggattacaggcatgggccaccactcctggctaatatttgtatttttagtagagacagggtttcaccatgttgtccaggctgatctcaaactcctgacctcgtgatccgcctgcctcggcctcccaaagtgctgggattacaggcatgagccaccgcgcctggactaaattgtttcagtattaattttttttaaaacaagatcttactgttgcccaggctgaagtacagtggcccaatcatggctaactgcagccttgacttctgggcctcaagggatcctcccacctcagcgtcccgagtagctgggaccacagacatgtaccaccacacccagctacttgttttatttttatttttgtagagatgaggtttcaccatgttgcccaggctggtctcgaactcctgggcccaagcaatcctcctcccttggcctcccaaagtgctggtattacaggtgtaagccattgcgccctgcctgattttttaaatgtgcaaacagataagttggaaaagtgatttccaataaagataaagagttgatggttttaaaatacgtaaagagcttatatgaatgagaaaaacactaacattccaaaagattagaaggcaaaggacagaaagaaacaaatcactatgtctgggaagggacatgaaggagcaggttcccactgggccagcggggctcaaacccactggggacgtccgagagactgcaagggccatgccttcacattgccgtacctgagaagcaaggagctggggtatttatctctttcacactttgggaggctgaggtgggcggatcacctgaggtcaggagttcgagactagcctggccaacacagtgaaaccccgtctctactaaaactagaaataattagctgggtgtggtggcacacacctgtaatcccagctacttggaaggctgaggcatgagaattgcttgagcccaggaggtagaggctgcagtgagcataaattgcaccactgcactccagcctgggtgaaactctgtctcaaaaagtaataataatcatgataaataaaataacattagattgttagcagaagtagccacaggtttctcccacctctctgcaagttgctgagtgtgattcccatcaagaggtacaatgtctttttatttttattttatttattttatttatattgcctatgttgtctaggctggttccaaactcctgagctcaagtgatccttctacgtcagccccccaaagtgttgggattacaggcatcagccactgcacctggcccagatactttttcttgagtaggaatttcgagtcaccctgaacattgcatgccttcgtagtggggaagacaataggaaaccacaggctgtaggctaaaatgggttgtgtttcttgtaacgtcatgacaaggcataacccatcttggcatagtaaatagtaagcactcactgaactgatgattttaaatctttgctgtttattcagcaatatcctaaattagcgctatgttagtggagttgcatctccctcatggattagtctgaaaaagatgagaaatctgtatgtagaccaagttatccttaaactgctcataatgtatgatgcacgtggttttacgtgtacagcctggtaccattgttcttaggcacatttcagtgccagaactcttaatacccaggaagaagcaaaaagaaagatggaggtgcagctagaggttgtggcctttgaacgattcattctgccttaataagagtggtctggctgagctcggtggctcacacctgtaatcccagcactttgggaggccaaggcaggcagatcgcttgagcccaggagttcaagaccagcccaggcagcatagcgagaccccccctccccccgtctctacaaaaaaatagaaacaatgagccaggcatggtggaacgtagtgcgtggtgcctgtagtctcagctacccagttggctgaggtgggaggatcacctgagccctagaagtcgaggcttcagtgagcccttattgtgccactgcactccactctaggtgacagagcgagacaggtcctgtctcgaaaagaaagaagaagaattaaaaaaagtgattagatcccttgtgtttgggacacttgttggcagcagggatggtagcgtttatgagggttgcatgtaacatcgcctagctcagacatctgtttgactgtcttcccccctgaagcgcaggctctgtgagggcaggtcttttgtctttcttgttaatcttcatatgcttagtgcttgccacatagttgatgctcagtcgatatttggatgaattgaagggattaatgcattgaatctgaaccttgctttcttaatgcatatggggagttctttggaaagccacacagaggagcttggttgcctgcttcctctcttccccagattgtctttttattgttgtggcttcactgaagcactctcacttcaaataattttgggcattggtcgtattttattctttgttccttcttcatccttacccctcagatggtatgtagaaaagtacactacatctagaaagtactttataaactcatttggttgataataatacatatgccttttccttggtcctggtagcagaatcttgtgccactcttggaatacaaacgaaattcttaaccaaagccagtttcattttgatgttctattttcctcccattcacactccaaattgtgcaccaaagtatcatcctagttttgtgaggatggttctccatacttcagggtaggagtatcatgtggattcctatgatacctttctccctgggaccatggagggcagcagctggtgattgatagtctgattcccggtgaggaaagctgtgagccttccacttgcagatgtctgccaactacatgtgtccttagtcaactgtaccactgtcctccggcaaacagcagaagcccagggcctgaagttcttaagctgtcattatggaaagcagaaggtaaacaaaacagaagtgaaagtagatttaattttttagactgttctcttacaggaatggttttgtggttctcagcattttaaaaaaaatagtggttccaatatgttttattgacatcaattactgtaagtctgattcattttctgcctattgatttctacccaaggtgaaattcatgacatttaacagaaagcataagtgattttttaaaagcagacactattagggacggtaaaaataagatttaaagtcgggacacttgaaaaagcaatttttatacctttggtaacgattctattctgattctttgtataaataatataaacaaaggctctagaagcttactataatgaagttggtgtgctgtttctaaattctggtttaaggcccaaattcattttatctgcattaacttttttttttttgagagtctcgctctgtcacccaggctagagtgcaatggtatgatctcggctcactgcaacctctgcctcccgggttcaagcgattctcctgcctcagcctcccgagtagctgggattataggtgtgcgccaccacgcccggctaatttttgtatttttagtagagacggggtttcactatgctggtcaggctggtctcaaactcctgaccttgtgatccgcctgcctcggcctcccaaagtgctgggattacaggcgtgagccactgcacccggccgtgttaaaatttttcagtggtagaccactatgtcaatatgttgctttcactgacaacagtattttcttaaagataggataccccatttctagatgaatctcattctagctggaaaataatttttcagttctgaaactacatcaggcctcagggaatcaaaactagctattagccacacacatataaagtggctttgctttataaacgatttagggtcaccatcaatgacaatggtccctttttattgtatttttaagagtttcttatcttaaatggctgcataactgtagagttttaaaaaaattaagtaaatgaccatgttaatgctctattaagcttccaaacaatattgtaatttactttgaagatttttttttattctcaacatcctgcagcttgaccgtttgcctccgtgtctcagtgctgcttattttgaggtgtggactggagtccatctgtcccccttgcctctgaactgctccgttttgtgtttcgtaattcttcatgctgcatcctgggcgcatttctctgtagtagctttcaatttgctcatgctttgactgggcttagtctagcgtttatcctatctcttaaggttttttaaaaaattttcatgattattcatttatttccaggatttctcatttcttcagtcacatctccttgttctggttttacttcttcctgtttttattcataacatcttttttatacacgattccttcatgtatttctaatcttaagtatatttaattgcttatttgattcttttttttttttattgagacagggtcttactctgccaccaggccggagtgcagtgacatagtcatagctcactgcagcctcaactacttggactcaagcgaccttcccacctcagcctcccaggtagctaggaatacaggtgtgagagccgccacacccagctgatttgtcttactatgttgcccaggctggtcttgaattcctgggctcatgtgatctgcccttcttggcctcctgaagtgctgagattataggtgtgaaccactgcacctggccaagtatgtttatttatttattctaatttgagagggagtctcgctctgtcgtgcccaggctgtagtgcagtggcacaatcccagctcactgcaacctctgcctcctgggttcatgcgattctcttgcctcagcctcctgagtacctggggttacagttgcgtgccaccacacctagctaatttttgtgtttttagtacaggcggggttttaccctgttggccaggctggtcttgaacttgtgacctgaagtgatccgcccgccttggcctcccaaagtgctgggattacaggcatgagccaccacgcttggcccaagtatgtttatttttaaagtccccaacaagctatacaataaattgcatatggaatggatttttgttctagttgatttgttggttatcatttgtagaactaactagttgtcttctgtgtttgataccttgcttctaggtcattttgagttgggagccttttgttttgtttttattctcatgctgtttttgagcctagctgtgcctttatggttttctctaaatttaattgaccattgttttatatttggagcagtgggtgtacatcagagtgtgaaagcagccccaccctctccaccagaaggtctccatgccagtttcacgaagcatttttcatgccctcattcctgcccttatcccttgatttgtggggagtttgtaaagcagttgattgttttttttccacgtagttttccaagtgcacataattgttctgttagtgacttgtagctccattatctattaaccttgccccagaccactgtacaagcggacccaacgcttcctccagctgtggcagggacagttacttggtatcctgctgccttttcaatgctgaccagttttgccccttcctcccctcaacccctgtctttcattcaactatcaccaaaccaaaagattctggtttgctttttagtatgtgttcttattcagtacatagtcattttaaaatttaaaccaaaacagacttggtactgattagcttaattttaagctttttctttattattaaacagtgtagtttatcttagcatttcatattaagtatatgatttatttcatattgcttatatgaatgtacacataaatataataaaaatattttcctaaggtttttgtagtaaattatatcgtttcattaactttcatatatagcattgcttttgacctggaagacattgaacctctgatgatttgtatattcctcggagtatactttgttacatagaaattttctcatttataatgagatttgtgattaacaaaatttgttcaacatgcattactttgaagatctggtttctaaaattttatgctagttaccccacccccccttctatatatatctccctattcagcgactactgcaagagttccaggaaatgtacactgtgtgttcacttactgcattttaaatcattgcctttactatatttctgcatttcccttcaatctagctctgtctgtacatttctgaaagccagtagcttccctgaagaaccaggtaacaacccgaacaatcaaattagataaccatttgtagaatggaggttccgggagatcttagaagatgtgatgggtgctaagggactttgtagttccctgaagttccagtgagtaaaaggtacccttggaattttttattccttcagacttttaaaacagagatcactttcaaaaattactctttctgctttgaatccatgttttagtaactattttgacactgtttggtcagaaggctgtgtgggtcaactgcaaataaataaaataaatgtgatttcagtaatttccattttgtaacaagtaattgagaaaataggattggatcagatatttgcttatacacattccctttcaggagcacttctgttctataaagaatgttggtatattgttaaggacacttcaagctttgggaacctttgaagtatccattgattcagttaacaaaattatgttgagtgcctaccctgggcctgggcctgtgttaggaggggacactaagatgagagtccaaagcacttcttctcagactcctggctgctaatgggttgctgcctctacttcttcacttagcagatagctttaaaatgagtaatgcattttaccatggagcccgtaagagacattcacccagttgtggaccgaggagaagggtgttaaacccagattgtgatgtttcacttgatgaagtgcttaatataaacatggaaatatttccgcaaggataaactggcttttatgcctgtgtgttttcaggagaaatagaaatctctaatcaaatattgccagcttttcacccaagtttgactttttgcctaattgagtttgggaggtgtctgaataatggataatgagctttcctgaataaatataaaaattaattaactccaggctctaattcattctgttaccagagttttgtaagcatgttacccctttgtgttcattgggagatcatctgttaccttcttaaatgagtggggaaggatgggaaatgaggaagagctataaaaactattcaggtgaagaaggtttctgcccctccttgccccttttaaaatctccagctcagcagatgctttgtttaaacttgatcaagtgcttgtgaatcttcctagcctagctaaatcataactttggaaggacttgcttttttctctcatgacaatggtttaccacagaaatgattcagatcactttgtgtgcctgatgcctatgtaaaatgatacagtgaaatggaaaccatttacctgtaagctttgggcacacccaagcctgcttcaggagcacatgatcaggcgtgcactctgggagagccgtacacatttgacatctatgatgtgtggcgttttattctatcacatttctgaaatctacactaagagaaaggaggctcttaaaaaaccactgaggtgtggactgggggaaggagagatccgtaaagaacctgtttgttacctgttgatactatttcccattggtaaaatttctaatttagtgtgatccagccctgaaatgctgaggcacacactgaatgactcctgacatctttagtgtttttgttcaggggactcttctgggaatctgtttcatggcaagtttattattcccttttggtttggctcatcagtttacccagcagtcatcttaatcggttttaaaggcttttattttattttgttttctctgtggaaattttacacattcagtagattagaagtagttatttaatctttggttagcataataaaagatcttctagggacattttttgcttgcagtggaaggctagttaaatgtgttcattagtcatgaatctgctttttctatagctgttggaaacgtagctcccctgtgatacagttgtagaatacagaaatctcgttttgctgttacggtacggtagtctacttactttcttccaaaccattaatgttatagttacctttaattgcgtaggtcctatcacccctcaattttaagactctaagcctggcattttatcttacaaaatgaaatataaagacttgtactcagagtatgtgtgtgttttccatataccattctaaagtagagaaagatgagggattcgccagaaactgatttctaataaattatccagaaactgaccccttctcacctcttctgttactgtcactgtggtttcagccacagcatcctttgctgcattgttaccttagtttcctgactgtatccttccttacaccattgatccctgcaatcccatctgcgcgtagcagccagaagggatccacttactgctgtgatcagaaatcctcagccaggtgcagtggctcatgcctgtaatctcagcactatgggaggctgagactggagaattatttgagcccaggagtttgagaccagcctcaaactgggtaatataatgagacctcatctctacaaacaggaaaaaaaaaattttttttttttttttaactagccaggtatagtgctaatatacctgttctgggatccagcatgctctccctgacctgcagcttcatctccaccactttgcccctcactcccaccacaatggctttcttctcttcctcagacatgccgtgcgtcctcctacctggaatattcccctccaaacattcccatggctcactccctcaccttcatcagatctctgttccagtgtcacttttactggaaggtcttttgtgaccatcctacttattataaaaaaataatctgcccaaccttctccttttatttcctctacttgatttttcaatttagtacttatcagctgacatatattttgtctctctgtctctctctgtctctcatagaaggtaaattctataaaggaaggaatttttatgtttggttctttgctgtagctccaatattcaaaacagtgcctgacacacagtaggccctttatatttgttgaataaatgttgacactctgatatctaatttttgtctggtgactaatacgaaaactatagagtgataataaaagcattaccttagtagactggaaagggatgagcgctaggatgaactttctgcctggcgatcttgctgaatttaggaggcagattggggttcaaaggaggctgaaatggctaggatttgcagagcagggtactaaggatgagcaggctatgacagaaagaactccagaaatctgcaaagggatcaccttgagtctggctggatacagtgtacactttgtagggtgtctcttcatgagcttggataaagaacaactgttggggagtggataattcccagcactcattcaagcttgcatcggccagaacggagagagacagacctctgtaatacgtaggatatttggtagaaacattcaaccgaaaaccatcagatatgcaaaaagtaataataataagtaaacaatgtgatgcatagctagaagaaaaatcagacattagaagcaagcccagaaatgacagatgataaattagcagataaggacattaaaacagctattataaataacttagcagatttaaagaaaaacaacataatgaggataatggaagaaaaacaaccgaataccatttctaaagaagaaaaatacaatatctgaaatgagaatttagctggataggattaatagtttaggcactgcagaagaaaaaaacagcatctatatgagaatatacccaagggaagtacagagaggaaaaaaatgtggattggggggtgcctcagtgacatatggaacaatattaaacaagtctgcccccaaaatacttgaaggaataaggttcaagttttttccaggtttaatgaaaactataagcctacagattcaagcatttcaacaaaccttcagcaaaataaacaaaaccacagtaggcctggcacactgtctcatgcctgcaatcccagcactttgggagcctgagtcaggaggattgcttgagatctgcttgggcaacatagccagaccctgtctctacaaaaaataaaatgaaataaattagctggatgtggaggtccacacctgtaactctagctagcctggaggctaagaagggaggattgcctgagcccagtagttcaaggctggagtgagctaggactgcatcactgcactccagcctaggcaacagcaagaccacatctctctctctctctctctctctctctcaaaaggcagtgaaataacgacttatttggggaaaaaataaaggcagagaatttgttgccagcagactagcataaaaaaaaggaagtccttgaaacagaagagaaatgataaaagatggaaatttggatatatactaaagaatgaggattgctaaaagtgacatacatagataaatatgaaatatatttttattttaaaatttatttaaagcaaaaataaaaatacatcatatttataacatagaaataaaaaatgtatgataatagcataaaggataagtggacaaatgctgttgtcgtatttttggtaaaatgcactattatttgaaagtagaccatcgtgaattcgatgcatattgtaaaccaaatagaacactaaaaaatgaaaataaagagatatggctaatgtgccaatggtggagataagatagatgcaaaaaaagaaaaacattcaaaagaaggcagagacagaggaaaaaaggaccaaagatcaaatgagtcaaatagaaagcagctaaactagcaatatggcagatttaaatctagccatgtcaatagttatattaaatgtaaatgttctaaatacctgaattaaaggatgaagattgtcagattagattgaaaaagcatgacccaactacatgctgtctgtaagaaattagaaaaagaacaaattaaatccaaagtaagaagaaaggaaatagagtagaagttagtgaagtataaaacaaagagcaaagaaaatcaattaaatgaaaagctggttctttgtaaagatcagtaaaattgataaatttctagctaaactggccaagaaaaaagaaaagacatacaaattaacagtatcaggaagaaaaacagagaattcaaaggagtgtaatgcaaactttatgctagtaaatgcaataagttagatggtatggaaaaaaatgtgaacaatacaaagcagactgtggttgcctttggtggcagtagcggggtgggagtggaaggttgaattgactggaaccagaagcacaagtgaactttttggggtgatggaaatgttttgtatcttggttgcattgatagttaaatggttgtagacattgcttaaaactcactgaacacttaagtgggtatgttttattatttgtaaaatatacctcaaaagcagttttaaaaatgtattcaagtacatacttaagatctttgcattttactctgagtataccttaattttaaaatctgttttttaaaaagtattatgtagataccttttattttcccaatgtctttattaaatgacatctccacgttttgcttcttacctctatttttttttttttatttctctgtctctcaggcatgcacacacacacaccaaaaaaagtacatatgcataatccttttggctgaataaaatcagttgcaactgttatttcggcccttatttgctccgggtaaatattcgttagctgagtggtttatctgtatcagatatttcttacatcttcatccagtcacaccagctggactgaccagattgtttttcacttcaagggcagaatttgtactcactgctgaatgcttccaaatgatacgtagaataacaaatttaagacttagatttttactttttcaggtctttttttttttttctgtgctgtatagcatttccctgaaagcttaatctcatctgtaagtgatgcagtggatgtgttactattggattaatttatttactcttaggtaggtttgtaatctgtcatcatgctgttgtttttttgtgtgggtttgtttttggttttgagacagggtctcactctgctgcccaggctggagaggctagagtgcagtgatgtgtttatgggtcactgcagattcaatctcctgggctcaagtgatcttcctgcctcaaccccttgtgtagatggaagcacaggtgcacgccaccacacccggctatttttttaaatgtattgtagagacgaggcatcatttttttgcccaaggctgatcttgaactcctgggctcaaacaatcctcccacctcggctcccaaagtgctgggattacagatgtgaaccaccactcgagctccatcattctgttattagttgttctctagtatgagtcaaaaactcttacctgcccttttacagttttataaataagtaagcagaatagcagaatgtggacattttttaaatccaaattgaatatgcacatgactcaaggagtcaaatagtaccgtaatcggtttatgataaaatccagtggtttggctgggtgtcgtggctcacacttgtaatcccagcaccttgggaggctgaggcaggtggatcacctgaagtcaggagtttgagaccagtctgacctacatggtgaaactactaaaatacaaaattagctgggcatggtggtgcatgcctgtaatcccagctacttgggaggctgaggcaggagaattgcttcaacccgggaggcagaggttgtggtgagccgatatcgcattatttcagaacaattttccacaagatcagtgagtgctgtccaatagacatataatacaacccacatacatgactttacattttcttgtagccatagtagaaaaggtcaaaagaagcagatgaaattaatagcctgggcaacaagagcaaaaccccatcttttaaaaaataaaataaaatatggtggtttgctgtccccacctcagaccatttctctggtctttctcattgaccaccactcccaatctttgttctgctgattgattacagcttgtatatatctccatatttctaagcaaaatgtttatcttttttaaatttataaattctttttattatttttcagagacagggtcttaactctgtcgcccaggctggagtacagtggcaccatcgtagctcactgtagcctcgaactcctgggctcaagcagtcttcctgcctccgcctctcaggtagctgagactacgctacaggcacataccaccatgcccagctcaaaatgtttatcttttgatacattattcgagaccattattaaggtggatgatttagttttcttaaacagccatcccctttcttttcctcccctctgcttcaccgcccccattttcccaatgttttaccttttggttaaatcagtactcattgtttacattatttgcctctgcacatagtcacagatagtattgtactgtactgtactgtgtttcttttttaaacattatttctgttgttaataattgactttttaatttttttcctattttgttttttaaagagatggggtcttactatattgcccaggctagagttcagtggctcttcgcgggcatgatcccactgctgatcagtacaggaatttccacctgctccatttccaacctggaccagttcaccccttcttaggcaacctggtggtcccccattcccgggaggtcagcatattgatgccaaacttagtgcggacacccgatcggcataacgcatgcagcccaggactcctgggctcaagcagtcctcccgggctcaagcagtcctcccacctaagcctcccgcgtagctgagactacagacacttgccaccacaccaggttaatttttgtgttttttgtagaggtggggttttgccatgttgtccagactcatctcaaacttctcagctcaagtgagcctcctgcctcagcttcccaagtagctgggattatagacgcatgccaccacaccccatgataattgcctttttttttaatttgcataattttctttgtagcttttgctaatgttcccatatcttcttatagccttacagaatgattttccacaagatcagtgagtgctgtccagtagacatataatacaacccacatacatgattttacctttttttgtagccatagtaaaaaaggtcaaaagaagcagatgaaattaatagtatcttttacttaacccagttcattcaaaatgttatttcaataaatggtcaatatttaaaatacttgagatattttgcttttatttatttcttttgttactaagtcttcaaaatccaatgtgtattttacacttacagaacatctctttttagactggccacatgtagctcagggttactgtattggacagagtggtttcagtttcaagtttttccttggagacatcctacttgaaatttccattctccatgtatctgggtggttggtctatagacttgccactcacagctgtcatcttgagactttctttgcttttcttctctattggatattcagtttcctggatttcaggtcttctcattttcctctagtagttttgttaggtcatggttggtatggcatggttgggatagcgtgttcacacagctatctcgtgagtcatactcctccaatccagcctgctcgcttcccgtgtctgtcatgtagttgtcaccctgctatctctccctccagtttttgcagaaatttcctttgtcttcactcttggtcttcctctcccatcccccatgtatcctatatctttctctttcttggtttatttcatcactcaggtggaaaagatgctccagtggattactgggaaaagggggagcatggatgataaaggtattgagaccttacacgtcagggaatttttttttttttttttttttgagacggagttttgctcttgtccaggttggagtgcagtggcgccaactcggctcactgcaacctccacctcctgggttcaagtgattctcctgcctcagcctcctgagtagctgggattacaggtgcccgccaccacgcccagctaattttttgtatttttaatagagacgaggtttcactgtgttggccaggctggtcttgaactcctacttcaggcaatccacccacctcggaatgtttttattgtcccttctcatttcatgactgctgggctaggtatagaattccagaatcattgttcttagaatctcgaaggcattgcttcattgctggccagctttcagtgttcttgcaaagtctgaagctgtgctaatcacctcatcctttgaaagtgaactgttttttcttcccagaaacttacagaacattctctttgtccgcagaattctgggattgcaattactgtgccttagaatgggtctgtttttatcattatgaagagtactggatgggtcgggaggttttcttgaattacttcttgatgttttctttccttgtatttttttgtttgctaattttctatttttttttcttggtttactttcttgggcagggggatttcttctacttatatttgattcttcagttgagcttgtcatttttgctatcttgtttttaagtttcgagagacatctttgttttatataacattctgttcttaatacatagatgcaagatcttttctttctgagtatattaatatgtatttgaaatctttctattctctgcagtttgtttcccccaagggtttttttttttttctggtttttgttttttgtttttatgttagagactttcctgttatatctggtcatcagtggtacctgcatgtggtggagagtaggggcttattggagtatgagaaccttgagcaggtgtaaggagcctgtcaacactgcgctggcctcagggcctctagggaggctgccagttgtgcattctgaggataccttttggttgtgccttttgtctggtcagattatctagagatgctctgcctcctacctggaggagaagggtctagctgccagcggtgtgagtgtctcttggggaaaaggactcgagttcctggtgtttggcttgtgtatggccgcttaccccatttttggtggagcgctcacatcttccactgtgccaacagtcttgctgcagttcatagaccttctggtttacatttttccagaaagtatgtctttagatttctgcagaagtctgaggagcatggaaggagcttggggaatgagatggcaatccaggtcttcccagatggctctacctttatcccctgcagggaatcccactcctccttcctgactgggagcacagccagagccttgggaggaatctggagtggaaatctcgggcggtctggctttcttactgttcacttgtaattttgctttctcacaactgccaaccactaatcagcctgatttccagcttccagaattctattgctgttgtctgctctcctattcccaccgtaggggatggggctgtctttttttttttttttaattttggtaaaacatacaaaacataaagtgttccattttagccatttttaggtacacagttcagtggcagtaagtacattcacgttgtgtgtatttgtttttttagtaataaacaatataaaattttttaagtaataaaacacaaataaaagattgtttaatgtgattatcgtggaattttaggtgtgatcaggagccatggtgtagtcttctgttgaaacagggtgataggatttgtttaccacctcctaggaaagcagttggatagtttgttggcataaaagtacattttatctatttttaataatcgtagctttatagaaattgcagttggaactcccaggcctggcattcaaggctctctgagatctgggctacccacccatgtcctccagccgtctgtcgcacctcctactgcccactcactgttcctggcatgagatgtgatctccagcccccatgcctttgctgtgcagggtgttccagagtgaattgtccctcctgtctgtctctctgccctcttcctcgtctttccatcttcctgccccacatcactgcctcctacccaaggcctgtgctcattcctcctcggttttcccccatggcctggtacatacctctgaattatcaccttgcatttcccatattgcccggctctctttgatgtctgtttctttgctgggtcttcctcagtgtctgacggtcagttaaatgtctttattcttttttgtaggatatccgacatgaagccagtgacttcccatgtagagtggccaagcttcctaagaacaaaaaccgaaataggtacagagacgtcagtccctgtaagtatccacgtggccggtaccagtcttgctcttcctttgctgcaggcctttttagtcaagactcctttcgcctcagggtttagtataataataaatcaatgtagcagaggtttatgacgcgattgtttcctatagtaaaggcattagagacttatagtaatagctcatttttccaccattatagaagggctcaggtttcagtttctggaaaattcagtgaagttcaaagcacttttcttaagctttgactgtttttgtgatgaatcattttcctaccagctgaagcagagtatagcaggcataataaaaccttttctggatgactcagcagcagcgtcattagggcatgagcactgtgttccgctgtaatgaagccccgcacaggcattcggggtgggcactgtcgtcccctgcgctgaatatgcaaggcagctctgtctggagtccccaccgcctccacccccgccaacctcatcatttttctccctctttcctgctgttagttcttcctaggattgtcagtgtgcctgctggcctgtggcagccctgtccgccttctgagtgattggctgtcagtctgccggtagctgaaaagtaaataacttaacatgttagaatttgcataaagtaaggaaaactggagctgagtacaggacttgaactgcgccatctcctctaggccacagaggcctttttgacccccttccaggtctttagacattgtcaggcagtgaggggtcgtagctgccagtgtctccatggtagcgtgctctgccagggatgcagaagattctccagtcattcctccagtgggcacttcctgcaggtcctgtgcccatggctgggagtggtggctgtcattgttctctgccagaagggttagcagtgcatcctgacctgacttatgtggcgcccagattcctggaaggggtctaaaaatggacctagacttggtgtagaacgtgtgcctcttggcctgccaccatggttccctgcctggttttgtgtgtcagctctgccgcttaagaactgagtggcttcgggcaagttgttctctctcataggagtgtgtgaagatgaagcaacataagctgcttagcccagcgcccagtacctcacgcagacataagtgctcagtaaatgttgtctgtggtggggatggttgtcaccaacatctgaagtgcacttctaggtcatcaggtgacatgattggcgccaacacatggtactcttgatttagcacatctcagctgaggcacctcattgatatttgtttaaaaacaaaaacaaaaaaccttggtgattctgctgtgaagtcctggccagaaacctccagaccgctgatcaacacgcaacagaaccatcaccgttcacctctttgacatggtgccaggataccctggatctctagcttttgctatagttgctctaattagggaataatcttgtctttaatattcctttgctacattttttaacatttcttatctaaatggttttatgaatcagttttacagagaaaaaaaaccagtatttaaaatattcttccaggggctggtccaagtacagtagtgtttacaactatgtgatcacaaccagttacagatttctttgttccttctccatccccactgctttacttgactagccaaaaaaaaaaaaaaaaaaagttattccagggaaacaattctccaactttttcactcccaatctcactcctcttatcttcctcccgtactcctatcctcctcccgtactcctatcctcctcccctactcctatcctccagtagaaacagtcatttgctgtgaaggttatgggggagaatgagtcaaggtagaaggtcacctgctgcccagctcacagtgctgctggtgatgacagcagtccacagttacaggcacttgctgaacgaggggctctgtatacacctcagctcattgactcttcccacaaccctcttgtcacctaccatttagcaaatgaaaaaaccaaggctctgaggtgagttgtttgcccagagtcacccagtgctgtttgaacccactcacataaccaaccaataccattatgtaatttttgaggtcttttatctctgtgatccacttaaaaattatccaagtatctttatttgtactaagcctccataatgagaaacagtgttccagatggtggctagttttcaaagacatctctctttggaattcttctttagaacaaaaagccccagaccacttatccccattcatatcccctttggacctagggagaaggtactatttataggtgatcacctgagtttattgtcccttgtgctgtgccagaaataaaggtccccacctgctcttattagctctactaacaggataaggaaagtggccctcagagagctactgcttttgtgacaaacaaatgatacaagaaaaaaaaagtggctttttaattttagtgacctggggcaggacttccaaatgaaagtttatttctaaaaactaaaaggtaaatttaatatactttcagtgtttgggcttaaattctctttcaagtgtctttgtgatatgctctgaattttaaaaatttagaatcattgaagttcattatacttgaactttaaaaaaaaaaaacaaaaacctcgtataaaggtcaaggtatgacttcatgctgctgtgtacttaggtcatttaatcttcaaaccactggatagaggttaggttgaagttcgatcttaaatcctacctactgtagctcattgtaccagcaacagctgtagggactaggtggaattcatggtgggttttgttcccttttaaagattgaagccaccatattttctgccctctaaaagtttatgtcagccaggcatgggtggctcacacttgtaatcccagcactttggggaggctgaggtgggtggatcacttgaggccaggagttcgagaccagcctggccaacatggtgaaaccccatctctactaaaaatagaaaaattaggtgagcatggtggcctgcgcctgtaatcccagctactcgggaggctgaggcaggagaaacatttgaatccgggagatggaggctgcagtgagctgagaacatgccactgcactccagcctgggtgacagagtgagactcttgactcaaaaaaaaaagttatgcatcagagaacagatcctttgatgccctcctctgccctgaaaggtttttgggggagagtaataagtatcacaacaagatatgacctgagaacagatttcccagataggacatgatccatgttttaatatggcttactgctgttgcttcatagtgtgaagcttcagacacttctgaaaaccctttcagaaaatcccagtcgccccatactgatgactaatctcaactaaaacagggcttcagccagtgtgaatgccactaatgccaccaactcacctttgcttttctgtagggtgtgcacctgtatgtacacattcagcttttccgggattaacctctgagttctggtttgtctttcagttgaccatagtcggattaaactacatcaagaagataatgactatatcaacgctagtttgataaaaatggaagaagcccaaaggagttacattcttacccaggtaagcagattgtctgaattttctatttaatgtcaatttaagagtttgagagtgctgttatccacacctcaaataaaatctgccacatcctttagaaggtcaggatttcagcataccaaaaagcagcaaggaagggggaaaaatcatccttcaaaggttcagtttggttataaggaacgctaatcttttctgggaagcataagatgacattgctggaaatgagagcttatagaaaacaacattaaaatgccagagttgcctgtgtggtctgttggcagagacagcagagccatggctggaggagggtctgtacctgtgttgcttccagaagtatttgtcgtagagcacttgtgatggcaaatctaagaacgttagcagtagaccaggaatctctgtccagagccattcagagtagctcagcatggttctcattctttggccagaagaaaggcatcattggatcatgtgaacaagcatgaaaaatgacttaaaatttctgttggcttttggcatctttatggaaacaaaatcctgaaagtggtttaataattgagcctcttgtaaaacactcagtggcatgtgaccaaaagggtatctgggaaagaggataaaaagagtttctttttaattaatcttctcaagtcttaacttgttacctgtaagttggtctaaaaagactgggtttcttattttgtttttcatcataatttttgtttctcattccatgtcagctttcagtcttatatggctttaggccacagggcgattttgaacatttgtaattttgcttaataattaggaaattaaaattctggggaagacagaatgctctatgaagaaaggctgctttgagcaaggagctaggtcagggcgcgttcaactgaggcctttcttcactgcctttttgtcttgtcccagttcctccccatttatgactaaaatcagcccagatgcttctcgtcatctgggatgcagagcatcagcccagctgtgttcagtcctatggggccattgagtaagttcttggtgcatggatacagggcaggcctttaccaggccctgagcccctggtcctcccagcacctctggggtatttaggggaggctgatgggggagggggttgataaggcgggagatgtctggggatgaggttgaggcaaaagtgacttcttgaggactttgctttttggagaagtcaaatttcctacttcttgatttcagcccttcaactctggtatggagtcaggaagccctttaaatacctgttgtcgggtgtatcatgtcaagtgttgcattagcaaatgaccatgtatccttgtgctactgtcctgcctaccccgcatcctagcgcttccttgggacatgagaagctctgtctggtttgtgaggtggcactggggatgttgagaaactgtttacacagtttccctttgccctggggatttactaaaggagtcgaggcagcctgaccccaaagcatcacccctggacactatgaccgaaacatttccccagtgcccaaaccaagaacacccttcccatttttttttcagtggtgttcattatgtaataatacaagtctctcttctcattttttaaaagtcagaagtacagaagagcagagaataatgtccaaggggccctccttcacctcccccgtgcagtgtcagctaagtgtggtgcgtgtccttgcagatcttaggggattgtgatccttcagaccattctaaactggggtggtgctgggagttagggaaggcatgaagggagtagtggagagctgcagtgactggggtcttcatgccagggtggagaatgcaaggcccaggtggccagccatgtgccacgggatttctggctgccaagagctgtttatctgttcactggggagggaagagttaaatgtggtctgcttttctccgagtcccttcagcacagggagtgctgacttgtcttgttcaggtagtaagttcaagatgagctcaggaaagaaagtgagaggacactgagggctagtggttgagccaagtgtgatgggacttaaagggagaagatttaaagaataaggagcttatgggccggggacggtggcttacgcctgtaatcccagcactttgggaggctgaagcaggtggatcacttgggtcaggagttcgaggccagcctggccaacatggtgaaaccccgtctctactaaaaatacagaaattagctgggtgtggtagtgtgcacctgtaatcccagctacttgggaggctgagacaggagaatcgcttgagcccaggaggcagaggttgcagtgagccaggattgcgcccctgtactccagcctgggtgatggagcgagactctgcctcaaaaaaaattaaaaaaaaataaagaggttaggtgaaaatagatgagaatggaaaccatgagaagaagtgatgctggccaaggacatgacaggttctgatgtggaggtgataggcaatgtctcttccagccactgctaataattgagacaaactcaaggcattcataccctgtgtccagtaaacatctgtgcccattgccaggtgagctggattgaaatgggccagctgctcagcagacaccctcatgccccagtgactctgttccccttgggccacctcattgaccatttatgtttctacatctcctaagtttgttgggccaaggatggaggctgtctgccgtcagggtcctcattgctgatggtaggaatagttgctgatgtttcattggatgttgctgtattctagggactgtgctaagtactttatagaaatgaacatacttcattttcacagttttatgaatagggactattattagtcaagtaagcgatggggaaactggggcagggagcgatgaagtgacttgcgcaaggtcacaagatgatgtgattggaaccaagagaagtgttgtggttggccacgcccccacactgcctctcatctgcaccaaggagttttgtcccatagcccaagggccttggggacgaatctcagtggaggcccttagcgggcctgcctgagccagaaagcagaatcggcatttttctgtccttggttggcccagccctgaactgagatgcggaaatcgcctttcgctgcctggtagaaaatggagctgcagttactgaccaccaggcagagagaggtgggtccctgtcccagcctcagccaccactctgcctaagctgtggggactgagggcgctgtcgttagctgactgcagaaggtgagcacacgctgtagcatgttatgtttcagatgtcacatgttgtgttattgtgtctttgcagggccctttgcctaacacatgcggtcacttttgggagatggtgtgggagcagaaaagcaggggtgtcgtcatgctcaacagagtgatggagaaaggttcggtaagtctcggcttcatttgctgtgtatgtgatcatgcataccactccatatagttaccattttcgtccagatttttaaattatttttcttgcctttgtatttcctttacgtagtatttttatttaaaaaaattaaaacagcagcatataaatgcatgttggttgtcaaccagttaatgaagtgaataaaagggaggaggcggaagaactgcacggacctcttcgcccccgccttctcctgtgtggtgcgtgtggcgctccgcccacctgtgctgcctgtgcggctctcatcacagtgtggagttgtgtgtggagttatggagacctgcttttatcttgaaaagcaagttcttagtgcatcttcatggtgtctgattttttggctggtgagagtgtggctacctctgcggagctgtgggagcggctgactagatgagatttgcctccattcagtacctagactcttgccctgccacacctcttcggagtgagcattgacttcaggatgtgtgtcattctaagttcctgcaacttttcaaacacccctcgggctagcgtgtggctgcacggtgtccatttgtgcaggccaccactcctcttgcatctgggtctagccacctctccttcttgacttaccatagttcattttgtaccatgctttcagaatgagctttctcaaatccaagtctcaccacggttcttcccagctgaaaacccttgtgcggttccctttgcctcacaggataatacatggtgtggcttacggaaccctgcaggtctggccctaggcccctggacacagacctctcaccactcttggaactttagccaggacaaagttttctgtttttagtttcttaccatgttctctgggccgaggagtcccagtgcccacgttcatcccacttgcaggcacccctggacggctgcccccagctccccaactgcctgcattctcccctgccctcctcactctgttggaatagctgagaatagccgatttctgggcagccggcctcctgtgtagactgtcctgtgtagactgtcctgtgtagattgtctgtgtagactgtcctgtgtagattgtctgtgtagactgtcctgtgtagactgtccatgtaaactgtcctgtgtagattgtctgtgtagactgtcctgtgtagactgtcctgtgtagattgtctgtgtagactgtctctgtagaccgtcgtgtatagactgtcctgtgtagactgtctctgtagaccgtcgtgtatagactgtcctgtgtagactgtctctgtagaccgtcctgtgtagattgtctgtgtagaccatcctgtgtagaccatcccatttagaccatctgcctgtgcaggcgcaggccagtgttcagcagggccacaggctcctcggcctccctgccctcgctgctccccaacactgccaaccctgctgcggggtccaggaggagatgggctgaggatcgtggagaccagcaggagcgtgtggcccaggagcagggaactgggtgtccttgggccttgccaggtccaggctcagctaggacacggctctcacagctgtcctggttgcctccggccacagaagaaggtgagggctccagagaggccacctttccaaaaaaagcacagtcatggccctagaatgtaaaaaatccaagtgttaagaaggaacacatcaaaggaaacttcagcagtgaaaacttgaagcattaaccacgaagcctctgcctccaccacacacaaagaaacggctttagttactcgcagaaagtcttcctcttaggacagcgcgtgtttaaaatcataggggtttggtttgttttgttttggggttggggttttttgggggttttttacccttgcctactttttaaaaaatgaaagtgtttatttgcccaacaataacagacagggagcttgcctaagtgttctgttgatgatataatgtatcttgtcttagaaaaaaactttttcagtgaaaggtggtttttaaattttttcttccctccttagtagcttgattagtaaaatgtgaagttacaaatgtgaagcaaacccccacccttcaccactagtcagcaattttgagtaaagaaacaaagcatcaggtgctcacagcacacactgtcttagagggaaggggaagcctggtggcctgtggaagccttcagcatagctccatctgcaggcttctgaccctcagcactactgacacttgggctggatcattgtctgctagggatccgggcagggagtggctgtgctgggcgctgtaggaagtttagcagcatctctggcctctatccaccagatgccagtagcaccccctccccagatgtggcagtcagatgtgtttctgtctagactccagactttgtccaacgtcccctggtaggccaaattgcccccggttgagaaccaccgctctagatggtattgagggttgggaattttaaatcaagacatttattcagaaattaccagatatagtagcatttgcttcttatttatttctttgttgctaagtgtttggcaaaacctctttgctgtgagcacaaggtttgctttagcaattgttgtcacattacagcaaggagtggtgtccagcgctgtagttatgtatttgagcagtgtccagtgctgtagttatgtgttccagcctcaccaggccctgtgcttcattgtctcccactcaagactgaccacaaatggcccacagatccactgtgacaacctttccctttgggttactgtggtggcatcgagaacatggctggttggctttgctgtagtttactgtgataactgtgccagcagtccctgctttcctttgttaagtatcccattccactggaggattacttgggcgtgcagattggcatgaaaagcaatgtatggtttgagattgttaaagtttctttgggatcaacattttcaattctgtatcagcattatccctcccagagggctggctgggagaaatcatgagaagttacagtatcttatttgctcagctaatctaattataaatgatccacacagcttgtggtaaaaccagcttttggggagttttcatttaatgcatacttgtcttctgatttccttccttcaccaaatagtgtaggatgctccctcttatttttggcaaacatgcctgttatcttttgggaccctgggcttcctggaaaccagttatgcagaagatgattgtgtgtgttagactggggtcatccagatggctagagttctcactggttctgtttaaggattgactttagacacctcagtgtaggctgcaccatggcgtaagggttgggattgttgtttagaagggggaagtaagcaaggtgagtttaattggccattgcagaatctcacccgtatctccctcctgaaatcctcactaaagctgccgtttgctttcaggtgctttcatgcacaagacactgcattttgtatcacagggtccatataattcatttttctctcgtacttagttctctgtgttaagaattacttacttagttctctgtgttaataatttttggcgaaaccaaattacccgtcacagggttactgtagatgtctttcataggttttccaaacaccacttgcccacttgtttgggaaggccccaaggactgtttaacatctgccttcatggtggaaacagcaactatgagagatgctagcatgttggcactgccatgttcctctggtaccagcccaagataggactcaatttgaggcctggtgaagtactgtgttctaataaaaatccatctacttttcatggccgtatatatcaatgtaatagggtaactggaaatgtgatcttgtgccttttaaaaattttgtgtgtttaaaacaaaaatttctattggaaatgacagagcatagcttgttgctgtagacacctgagagtccttaaaaataaatattgggttattgacacttagttgcatgacagaattcctcacttgtacagttccaaagtcttagtctttacccagattacagagggttattaagcattaggtttggttttgaaagtgagtgcttgctgtctggaggtgagctttaagactcgtctgccctgcttatgagatgaggaagggtggcctcttcctcctgcatttctgttcttcgcttccttctctgtctgctcactctgtggaatgcccaccccagcacgggtggggtggaacctgtcagatcagtctcttgtttctggggtcttgaggcattataagatctagttgttagaagtgtgggattaattcatcttttcacattcttctaagttcctgcttttagctgccacacccactttggctaagtgggggtcttgccatgtaattagcgcctccatgccaagtggcagaattgcttcaatggtgacagattgtccccattcaagagttcacttttggcaactcatcattgatccaggaaggtgacatggatgaaactggctaagacttcagacaggcttgtgtccagactcttgagaaagctctgttggcttctggtctggcactgtgaagtttgctgtgatgctggcaccacaacctggtgtttcctaatttgtttctcccacattttgctttggttttgtcttttgggcagcttccagctccagtagagcaggaccaataggcatttgtggttctatattcaccctcctcacgtgcttcctggctcctcattgcccccagatgatgccacaggtccctgggcctgctgccagtcgtctgtgatctgggcctctgctggccccttctccagctgctcttttcagcctcttatttgcagtcactgcctaggaaatcctagtcatccttcaaaacctgcctcttgcacagagctttctctgatctctcttttctgtaaccttggctgacctgaaacatttccctcttctgaattcctgctgcatgtccgtagcatttccccctcagccctcccccatagtccaccttgtcactgctgggcacagcagtgtcttctgacagacagctggccctgaagtggttcccttcacccacaccatcctttgccccagaggaggtattgagtgggtcagtgcacgtgaactgccagtgtcatttgccaaagagctgttgacacacgctgacatttcttttgctgaaaatcataagggctttgagcttccctctgtccaggcacatggtcaggctgacccggtagctctgcccctgctgacctgccatttttgtccacaacagttatccatgagcagaaacatttgtgtaactgaggcagaaacttagttcaagtaaaatgtcactaaattcgagtcagtttttgtcttagaccctaaatgaaaccaaattttcataaattttcttgttttaaagaaaaatttaatgagctacatttaaactgagaacatcagatagtgtctgagattatcaaaatagaacatcaaaagtatttttctgaatgaactgaaccaaaccagaatgaaagggcaagccctggggagcctgtctccaagccttctctgaaagggagtctgtatttggtgataactgctcagcctctccaaagggcctcacctgctgtctctcccagttttatttttaattgcctgtgagttttctgtgcagggtaaggcacctacattctatgccagcagcctgatcaggtcctgggtaatgtttgaaatggctacacagaggagtttcaaagccttttgttcaatctggcttcacctcgtagacggtgagaaagcgtcagagccctgcaggatcccgttgccacgtttgaccggggagccgatgggtttggaagtctgagccctgtctgcacaacctgccccggtcagcagcttcgtgcccccacccccatctccccatgaggcaggcatctgtgctgaccatggcttccatgttcagaaacccccaggcctttgagttatcatgaagcttgtgggatgtgctccaagcctcctgccatagaaaaactgccatattgctcacaataattcactattatttgtttccccagttaaaatgcgcacaatactggccacaaaaagaagaaaaagagatgatctttgaagacacaaatttgaaattaacattgatctctgaagatatcaagtcatattatacagtgcgacagctagaattggaaaaccttacagtgagtatagcacacacttcagcacttcaggcggctactggttcacatgcctcttcctttatcccttgggtgatattacctaatgtcagtgttcctggcttttgtataccccgagcaagatgtggtttgggcactgtggtgagcggagcttacttgtgtacctaccaagtgcccagggagggtggaggccacagtgctctctctgacctttaacaacagttaacaccagttcttagggaaaggagagtttcttacccaaaagactggttcctgcttgtgcagctgcagagggactggagcggcagcctgcaagtcccagtgaagcatgctgccttctttgtggtcctcagtcttcgagtctgaagagagggaagaaggggtataggggctcactccagtttcatagctagtgaaagttttctgggccaggtcttgggtttttttgttgtgggaagagtttataacaccagctacttgcttggtaaaagttggtcttggaacatggcaaggcattgtggcaagcagcactgccgctgaacgcgctgctcctggggctttggaataattcccctggatccgtaacttgggggtgttcatgtcattctggggaacagtggagggagtgcgcggcagcacctgggggcaccagtgaagagtggccagccaccaacctctagaacctaactggggtcgaatcctggccccaccttactagctcatcacagtgtctccgtttcctcttctgtcaaactcaggttttgcgagggttctgggaggtcctatacgggaagggttagcagttaccatgggtgtgtagcacgggctttatctgaagggaaggtggagccgtagggagaccatgtggagtggggctccagggctgtgtgggtggggagggatctgcttctgggttaccccatgcctccccttctcaagtactactttttaatcatcatggctcctgccattcatttcatagttgatgtaagccaggtgcggtggctcacgtctttaatcccagcacttggggaggctgaggccaggaggatcactcgaggccaggagttcaagaccagcttgggcaacatagtgagacccccgtctctacaaaaaaacaaaaacagttagtcagacatcgtggtgctcccctatagtccagctactcaggaggctgaggcaggaggattgcttgtgcccgggagttcaaggctgcagtgagctatgcttgcaccactgcactctagcctgggtgacagagcaagaccctgtctcaaaaataaataaataaaaaaaatagtagaagtaagatctagaatgtagcacaggttaccaggacgtaggcaaggggttcgggctgcctggctcttgaggatggtagcagtgcagctgatgtgagtgctttctgccctctggtggtgaccgcgccggagtcaccagccctgccatagccctgatggggcagagggttctgagtacggtggatggaggtgctttctggaagattctcaggagtaacatgggcagtgtgttggaatgtgctagaggatttatgcagtagccttttaaaagaatgctttttagcatttgcaagcctgacattaagagtgacttctgggaaactatttgcttgttgagggaaactgaatttcaacagagcagaagagctgtgcgctttttgcttggcagagtgaatacagccagctcagaggttttgatgttaggatctgtttgctccaacagactttgtttttaaaaggcttttctcagccatagctgtctgttctagcacaaggctggaatgagttccttgtgaaagaggtgagcaggtgtgagggagggtgtcagtgggcggtaacccacaccttcaaggattaaaggaaaacttgcatttggcatgcttgcttcttattcaattttaaaatacattttaacggccgggcacggtggctaacacctgtaatcccagcactttgaggggctgaggtgggtggttcacgaggccaggggttcaagaccagcctggccaagatggtgaaaccccatctctactaaaaatacaaaaaaaaaaaaaattagccgggcgtggtggcgggcacctgtaatcccagctactcgggaggctgaggcagagaattgcttgaacccaggaggcggaggttgcattgagccgagatcatgccactgcattccagcctgggcggcagagcaagactctgtctcaaaataataataataattttttaaaaatacattttaagtccttttcttccccacctgcctccacccaccaaatagaagaggtatttcttcttctttaatgtcattaaggttatatggataccattttctagagaggaaagaatgatggaattgcctagtgtgagtctagcaattatcctaacatacacaaatttctccttgttctgtgccaagatactgtatttaatatttaatgaacattaaatattatttactagtgtatttaatggctgaggcagggttaaatatgtattattttcatcccagcagagttgggggaggtcctagtaactatgccatgagctctgtgagggtgaggtggtgtctttgcccccgcctccctggcacagtgactggcacatgattggcatagtgtggacattcgtcaagtgaaggaaggcatcatgagcagatctctggcctgaatccttctgccatcagctgctcgccaggtggccctggcactgggccacagggaaactctccaggctggtatggttcctgtctgtggctgtcttcccgggcccatgttaggagactttcacttccagagccctttccctctcagggccttgcttaccaagtgactggttcccatttactaggagctcttaggtcattgaagatgttgcgtactccccccagtgagggctgccttttgatcacagccgccagaagcctcaaggaaggagcagagctggaaacagacgccaggccattgcttctgttcctctggggcagacccagccacggaagagacattctgggacaagggctggggtccacctttcaaacgtgtctgcagcaggctctcagcatggactctctgcctccaaacatccacctcctcatcggaaaatggatgggagtgcctgcctggagcagctggtgggagagcgcagcgccagcacgtaggacacactcggttcatgggctgatgccgttcgcattgactgcctcttcagctgggtgttgagccacaccttggagtcaccagtctttggagaccaagtctgctacttttttctctaaagtgacaatcctctgaaacctccagatcatcttgaagcccccgtctgaaagttgcccagagccagtgcctcacctgctgttccttgttcactttttcacgggaggccttgcagggctttatgacaagattttatgggtggctgcccagcatcattgtgactcgtgagacagagagaaaccagttgtaaccatgtagacagtggaagtgatagggagaaaagaggtgaggggactcttcaatccgaagggaaatgaagtctaagcaggcgcaccctgcaggttcagtgtcaagcccagggcctggccccagggtgtggtatttgttgactgggtgtgtggaccctgggagaaagtctgagaatgaatgttcctcttagaggtagagagtggaaggtgactctgtgtgtacttggaattagtgatttctgtacagatgattcttttagaatcatcatgagtatttttctctttcagacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctggtaaggaggccctcgcgggtgccctggggagctcctctacctgctctgctgtgatgttttttcctaagtagaaactgaagcgctcctcttccaaaatacagagactcactgtgttagtctgtttttgcgttactaataaaggcgtacctgagactcggtaatttgtaaagaaaagaggtttaactggctcccggttctgcaggctgtacaagcatggcaccagcatctgctcggctcctggggaggcctcagggagcttccagtcatggtggaaggtgaaggggagcaggagcaagagatgggggaggtcccagactcttaaccagctctcttgtgaatgcattgcctcagggagggcaccaagcctttcatgagggacctgtccccctgacccagacacctcccacccagccccacctccaacactagggatcacatttcagcatgagattgggaggggacagacatctaacggtgttattaacgttgcccttgagaattggacctggctgacttatatctcctctctggctttcagatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggtcagcattgcctttgtttgaatccaggtgtgaccattttaacttttttgtctttgaaggaggctgtcagttgtaaaagttcaaacaccgtctggtgtcaggggaaatagctacccttcatgtttaaaatagctagaaagttgtcaaaatgttcaccatgttgcactttgtgcctttgaagtgctcacatagagagcattgataggaagacgagactttattttcaaaagatttcatcttccaagtacatggctgcagccctgagaggccgagagcccctcgccaagccgtcacctctgctcatgcaaagggatttcctgacaaaccagccgaagtgaacactaataggacttcctcttgctgctctttcaaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaaggtaatatgattgggtcccagcttgttggggtgaggggaaatgactttctgttctagaaacacacgctggtactgaaaccctgtggatgcagcctcctgttggcaagcagcgcttccgcatccttggggaacagggcgcgtggaccacagccactccactcctggctgctggaggtccggtattgggcacagggtggccgcaggacatgagccacttctgtgggcttctagtgccaccttgtggtgcttgttggaatgaggggctcggagccaccgagtagggtttttctgccccccctgacgacagcgccctcccccaggtttccggacagtcctgaaatgtgatgtccaggcttgagtgccctcagtccccacagtggtcctttggggaatgtaaccttttttatgtggtcttgattaaatcccattttacttccttgcaggttaacaaccattattgagtacctattgatatgtgtggtgtactgagttaactagaacatgtcccctggtctgtgttctagaccatcttgctgggaaaaaggcagacccaaagcatattttggtgggggcccatggacagtgatgtgatagaggtgtccgctgaggtggtcagggaaggctgcttgcagtaggtggccgtgcacggaaagtttgcagaatgagcaggtgttagttccagctggagatgactgccggctgtgcccttggtacctgctttctggagggaagttttaagacgtgtgcatacttgacccagcagttgtatacatggagaaatttactttgcagcaactctcaaaacaagcgtgtaaagatgtgtataggtagttgtgtttgttgtggcattgtttgtagtagtgaaaaattagagacaggccaatgatataaccagggacctgatcaattatgttctctcccggtgttgggatattctgtagctcttaaagaatgagatctgggtgtactgatgtggccagacattgcaattgcagtacatgagaaggcaaatcatacagtagtgtgtacaccagtgagtcctccagccagataaatcctcacagtgaccagtcgcccaggcaccttgtgaaccctaccctgggtgtgggtgctatctgaagtacctgggggagggggtgacaagtggacttcaggctgatgtgggccctggcctggccctccctccaagcagagggggctggctcgctggaaggttaacatcatccaactctgtctacacgtggcttgttttttcctagaattcctgccacaatagcagcatccttgccattcattttctccaaagtgagtaacccatctctgccctctgattcctcagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacagggtatgtttccactgacagacgcgctggcgagatgctcgtgtgcagagagcactggccgctagcccgatggtaggattcagttctgtggtgcatctgagccagtctcagaagaaacagatcaaaggtttttaaagtctggaactgtggaagggctaacaagagaattaaggatcgatgcactggggttttaaggagccctctggtcccaagaatataagagtctaatctcagggccttaacctattcaggagtaagtagagaaaatgccaaatacgtctgtttctctctctctttttttttttattcctttgtttttggaaaaaaatagagttacaacacattgttgtttttaacctttataaaaagcagctttttgttatttctggaacaaaaaaaaacaaagtaggcacttatgaaactttctcatacccttaggtgatgtaatcagccatataatttatatttgatttcccagggaaggaatcccaaacttttacgaatgtaaactcccttggagaagagggttaggacgctgttgcgctcaagcccccctcagctgtgtgcacactgagccaggacagggtctttgagctttcccactataagaagaacagcaacaaaaggccgtctagaaaaacagaacctgcctctgcttctgctcagggtgtccccgctgggtttccattgtcctttctccattgctccctcctgtgacagccatcttgctcatgtaccagccctcatcaccccatccccataaatgggtgtcctcgaggcctctgcctgggggtcagaggtcaccacagggtggccattggcatgtcaacccgctgttaattcagagaagtgggctccacctcattgggagaagtgccatttcagcagaaattcacacgttagacgtgtgttgctgttaagtaaggggaagagagaggactagcctcagagctctggccatggaaatgacctcctaagactttttcgtggttttaaatattttacctctttccaggtggcatctgagtacatcagatggttttgcaaaatgcaaacaattttttccttggggatgatttttggggagagggggctactgtaaaaaataaaaccaaaaccccctttgctccctcggaggttgaagttgccggggggtgtggccggggtcatgcatgaggcgacagctctgcaggtgcgggtctgggctcatctgaactgtttggtttcattccagttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaaataaaaacaaaaaaagcaaggtgttttggtataataccttttcaggtgtgtgtggatacgtggctgcatgaccgggtgggtgggggggagtgtctcagggtcttctgtgacctcacagaactgtcagactgtacagttttccaacttgccatattcatgatgggtttgcattttagctgcaacaataaaatttttttctaaagaacatgaatttggggtgcttcccatttttttctttgcttaatagagctaaaccaggatgagtaactcctgtttctttctatccctgctgatgtgaaacagatgttgtcaatcagctggggttagagttttccacttctaagaattaacctcagcatccctgcattgccagcaccctcaggctggagcgctttccttgactgtgagcttgttgaacaccttaggcctcagcccatttccttcccaaattgacgctttgcctgtgtagggccctcagataacttaacaaacttaccagtgttgtttgaagaacagtgttttgagttgtaatctcaaaaccatatcccttacccaattacctgtaagacacaatggttaccacatctcagtacgtaaagtccacttgatatagaattgacttagaaataagacagattagtatagtttttcatttgtgtacaaaattaaacaatgtaaattccccccaaagtgatttttttgactttttgaagtaattttggacttgcaaaatgttgccaaaatagtacgaagagttccccagtaccctcgaagtttcctcgactgtttcaaagctggctgcaggcccaggctcatgagactgggaagaggacaggctgtggtcatgtggacccacaggggcctggggctgcagaagtcagtgtggcttccaccatttcaggtataaaaaagggcatctaagctttcaagaagagggaggatgctctagggcagcggtccccaaccttttctggcaccaggaaccggttccatggaagacaattttttcacaggcctgggggtggtgagggatggttttgggatagaaacttccacctcagatcatcaggcatcagattctcataaggagcttgcaacctgatctcttgcacacattcagttcacaatagggttcacgctcctaagagaacctgatgctgcagctgatctaacaggagatggagctcaggtggtcatgctcagtcgctcgccactcacctcctgccatgcagtccagttcctaacaggcctcagaccagtaccggtctgtggcctgggggttgaggacccctgctctaggctggtactgctgatgcttaaaaagagagggtttgccagaaatcagatgggacaaaagggcaaaggccgtgccacagagtgcccatataggggagagcacgcctggagccttcgagagcatgcagagaagcctggagactgcatttaccggagctgctgcctgaggccaccctccaagtgtccccacagcgcaccacaagaccacaggagtgacctcctcactggcaggtatttggggaaacaactgctgtctactcttttgggtaaaaagtgaaacaccaatagtttaattgaaatttcagaaaattgaacatatgaacaaggcaaataaatactaagtaagttaaaaacacaaaatatgtccaggaagtatcgatgagaatgttcaagttaaagttctccaatgccattgctacagcaacctcaaaccctaggttctctctgcactattaacacagacatctcaggacatggtttgcttttttttaagacttaaataggaaactaatttttctttctttaaagcaattgcgttcttcagtgaactctttctttaggccagttgatggcttcttagcagtttattgacgagatcctagggtagcttccgaagctgggttgattgattgcatttgggtgcggatggccaaagtgagtggccctactgcctgtgctgctcagggctcctgggctgatgtggtggcttcttccctttgtgctgctgaacatagggaaagtgaggttcacagtccaccatccaccagccgccgtctgtgagctccaccagcactcgcagcaagtcagtcgggctgagagtgtggttgtagaaaccctggctttgtgccttcccaccttccccagctcaccaaggtgacacctggctgctgctgaaatggcctgagcagtcttgcattagcagggccagccacctgccagcctgctgcatccccagtgcctcttgacgcagaagtgccgagcagctgaccggcagcgaggcctggagttctacacacttgccttggagccttttatttagggcctcaacttgcctggccttggcccttttgtaggtggccacctagtttggctcagctctgcatctcggggaaggtcacacagaccctcagccagaagttgagcgctctgttgaggccgtgcagcccctggaatgctgtacctttgccttgcttttttctgcctctgtacaaaagaccagcccatgccctggggctgggtcaatggccggagtctcaggtagagctctgggcagctcacactcctggaggagtgcacagcaccattacccagagtgcaggctatgtccaggctgggcagcagcaaaaaaaacgatgtgagatttgtgctcatcagccaggattttttaaaatattgtgatttcaacatctgcctcctggcaaaagacttctctttgttctgagcagagcttgtccatcttctcaaaagctaaccgtcctttttcacctgaaatagcaaagggacctgtcagcgggttggatcctgccttggcacttccaactctcctgggccagggtggccctagtgcttagtgactgtgggtctcagtggtctctgcaaagcggcaggggagggagtatgtgcgggagcccccacctggtgactcacatggcctgggggccttgtctttacctctaggatgttccgctgaatgggaaccctgccttgcctctggcttctatcccaaaggtctaagaagacagcgaacactccctgccaccccagccatggaggaggcctgccttggcaggatgctacaaagggtggaggtcggctctgtgccagggctgctaacggtgcccatcccaggtgccccagagttgttctgcctgctgggagagctgggtgtggcctctcgcagattctaagggccccaggcaccccgctgcgctgcacagtttgtgccactttttaccgaacgacagtgtggtttcccgggctgccgcccgcacggcctccaggtcagactggcacaggctggcagtctggtcgatgctttcaatgccctgttcgagattaggagaaaaagaaccctttagggggccttctcaacagcaggtagagtccacttagtggccctgcagggccagtcctagcatggtctctggggcctcagccccttccttttctccaggcttccaggttttttaggtggcctcaggttcatgagaggcacctctggactctggaagcgtctcgcctcttcagcccttacacccgctagggagccaggctgttagcagaactcgtcatcctggatgcctgctgaaaggctagaattgaaaaggagacctgctgctttctggaccttcctgcctccctcacgctctccttgccctactctccaggacagcctgtgccagtacttcgcccaactcaggcacatgccccctggctgctcctgcaggccaaggaccggcatgcgctgcagcgccctctactgggcacctggccctcgctggttttctgatcctaaccagcttctcctcttagaatttcctgctgatccatcccagaatgaatgggagttcaatctgtactgaattatctttcatctagcaattgtgcaattccaaatgcaggtgaggttgagggaaagcgggcatcccctcacatccatgggatctatgtgtgggttgtatcaagagtctcaaaaatgctcatattctccggtcctagaattgggtctagcctaaggaaataattcagaactccatgtttttttaaagctttatgcacaaacatgatcataagacatgatttatgataaaaattggatgaagtaaactttcctatgaaagcagctgagtaggttaaattaaggtatacacttgatagccccttcataaagaattctcaagtgaaaaaaaaaaaaaaaaaaagaaaaaaaacaccacaaataaagaattctaggccgggcgcggtggctcatgcctgtaatcccagcactttgggaggccgaggcgggcagatcacgaggtcaggagatcgagaccatcctggctaacacaggtaaaaccccatctctactaaaaatacaaaaaaattagccgggcgtggtggtgggcgcctgtagtcccagttgctggggaggctgaggcaggagaatggtgtgaacccagaaggcagagcttgcagtgagccgagatcgcgccactgcactccagcctgggtgacagaacaagactccatctcaagaaaaaaaaaaaaaaaaaaaaaaaaaaaaagctaaagtgctgccagtctaacacaaaatgttcttattttgttgactgtttttaaactatgtttggatcaacaattttaaatgctcacacacacccacaaacttttaaaagaagcataccagaatgtcaaccattgtttctgctacattctaggatgatggataactttcttttctatctctgtattttgtaacttttttttttttttttttaagatggagtcttgctctgtcacccaggctgcagtgcagtggcacgatctcggctcactgcaacctccacctcccgggttcaagtcccgagtagctgggactacaggcatgtgccaccacgcctagctaattttgtgtgtgtgtattattagtagagatggagtttcgccatgttggccaggctggtttcaaactcctgacctcaggtgatctgcctgccttggcctcccaaagtgctgagattacaggcgtgagccatcacgcccagccccagtggaatcattttgaagttaactaaccttaaccctaaccacaagcaggcttttctatcagccactaatggggaaacgtcaggctcaccttgaggtgtttgagcgctaggcatgcggcctgctggagccttgcgtcgttctctgccagggcgttggtgtagaacagcaaagcctggggagagtaaggaggctgtgaatggaggggtaagcagaagtggagtccatggttccgggtccatcagccaccaggtgccgacagtaaggcacgctgtgcccatctttctctaaacaacgttcaggacacgatcggtccatctttgggccctgtgtacacagtcacaagatctatactgtggtgtttaatttatccctaaaaacagatgccagggctaatacaatgaagaaagctatttttgtctaataatattccggaagtgcattctgaaactgctgtctataaaatgctgaatcagagaaatcagatgcccagctcagaacaacagaagaactgatcatcccatgtgcgttgccctcttcagctgaaaacgggcaaggctgctgccttgggccagagggaaacctgcctattcccctcagccctcctgtccaatcccagcggtgaccctgccctcttcggtctcacgaccatggccacatcagttcatgtctttgggcctaacttgactcagctgaaaacaaagctggcacttgcttcatgtgttattgtagggtttgtcagaaagcacacagggttatgcccggcccgcagtggagtccagcgtctgcggctgcaaagggaaacccaggagtgggtttgccctcactcagtcgagtggctgcaccttcaactgcacgggtggggcgatggaggggcccaggtgtagagttggctccagggacctgggcccagagccaaaagagaatggccgcctttccatctgcaggtggctctccaaagtgtctgctgctttgggaagacagactgggagtaggatcgggtcctcccgctcctcctacacagggctctggtgaaggctgtgaggccacatcggtgtggaaatgtcacactgcccactgcctctaaccccagggtcccaggtcatggcagcctactccttcctcagcaccctcatctgaggccaagcaatctgtcactgggttggcccccacctcagtgtttcctactctctaaagtctgtcacatgaagatgaaggccctttttttttttttttttgagacagagtctcacttcgttgcccagcctggggtgcagtagcacaatctcggctccctgcagcctctgcttcccatggaggccttgtttatatacccccatacccaaaaaacaaaatacacctgacttcagtggatccttgaagccaactactagttttcaggaactacagaagacagagaaatacattaaactaccgttaaacttcctgcaagcagcaaagtctagatagtctaggtcaacctgggatcgatcaaattaattgcaagcagagaaagaaacggggaaaaaaacctttagattgattggaagccatcagccaatcacaatgtgtgtccttatgtagatactattttaacaaaaaataaaacaggatgcttgaggcttggaaatttgaacataagatatatgatataaaggaattgatagttaattttttagataagataatggtgttagagttgtgatttttgaaagaattcttaaccttttgacacatatagttaactatttaaggtcaaataggatgcctcaggttgcttcaaagtgatacaggggagtggaggggaaaggggcaggattggccatgggttgatggtggttgggcttgggttatgggtgcaggtggattcattatattgctctgtctacttttgcaagttcaaaagtctccaaataaagagttaaaaacaaccacaaagtaggcggatgggctccaagaagggctattggcaatggaactggagatttcctctctagtctggagctgagaccatcagtgtagactatgcccttgatgtcacccttcctgaacccctcagggtgtggcgccttaaacgtacagtagttacaggcaaagagtgaaaaagcagagaggtccactctcttggttttcaaatggactgaacacagtgacccattaccaggtagccatgaatattaattgaaagtaaataaggatgactatcaaaacactaagaaaggctgggcgcagtggctcacgcctgtaatcccagcactttgggaagccaaggcaggcggatcgcagggtcaggagtttgagaccagcctggccaacatggtgaaaccctgtatctactaaaattacaaaaattagctgggtatggtggtgggcgcctgtaatcccagctactcaggaggctgaggcaggagaattgcttgaacccaggaggtggaggttgcaagatcgtggcactggactccagcctgggcaacagagcagaactctgtctaaacagacagacaaaaaacgcactaagaaaaacattcagcgtgcaagtgacatctcagaggcctaacagatgtgttgctttggaagcagcaaggtgcattcatgtgtgttagatcgtagcccaggtccctccatcaaaatagctcacagctactgcagcccctggcactcacttctttgtacttttccatgagaacaccagcttacctatgcccacacatctgtggccagggtctgccacctgccctggacaacgtaccttttcccggaagcttctgttcctgactgcaccagccaggcgagcgctggccgccctgcacaccctcggagtgccgtccagctggagcagcgcccaggctcttaaggtctggggcagaggctggagctggcccagccgcttcccctgcagcttccggaccaccttggcctgtcccgcacagtgaagctcctcgatgagtgtcactagaagacaggaaagaggtgggcccaggtcccctgaatgggagtttggcaggacagctgcaagtttgcttggctgctgccagtagccacagaggaacaaatcccagacccaccgggatgatcaccaaggcccagcctggactaatttcacagggagctcctggaatctccaggaaggccttttaacaaggggtcaaatatgctccataaattaataaaaccacagcccacacttccagggactctggccagccaagatcaccctcctacccagctctgacctctgttccgtgctttttaaagctgacttcccttggagctaatatcagcccccatcggctgaacgcagaatctcattaaatcggggttcccaaaagaacagttggcggggatggatgtagtggttctgaattataacctgagaaactgcatgtgacagggctccgtggatattcctctgctatgacagccacccaccccagtcttaccttccttggtgagctgggtgaagtgcttctccaggtcagagacgctctgcctctgcaggtagctgtgaaactggaaccaggtaatgatctgttcttctgggagcccagctccggggagcagcccaccacagctgaccacctgctccaggagcctgcggcacgctggccaaaggggagagtacatcaggagaaactgagacctcgaccctccacgcttctcagctgggagtagcctggtcagctaaaaggctttctgggccgggcgcagtggctcgcacctgtaaccccagcactttgggaggccaaggtgggcagatcacctgaggtcaggagttcgagaccagcctgaccaacatggtgaaaccccatctctactaaaaatacaaaattagctgggtgtggtggtgcctgcctgtttcccagcaactctggaggctgaggcaggagaatcgcttgaacccgggaggtggaggttgtagtgagccaagattgcgccactgcattccagtctgggcaaccatgagtgaaaccccatctcaaaaaaaaaaagggtttctgatggcacgagggcaggtgtccctcactgcattccctgtgctgtaggggaggagtgtgcccagctagagtcaggactgtgactccaactcaccctgagtcagaccgtgttgggttcatccccatgccctgggccccacaccacacctggatcaaaatcccggaggcagggcctgggaatatgcatgtcaacaagcagtccaggtggtgcttggaacatgactgtcacctttcacttgctccacagagaaaggcaaattctggggaagaacgcagtccagccagcatttctagataccctcgtgggcccctgcctgcctcccttcccataaggttcattctttacccgtcaggctctggtgggaggcatggaatctgtccccagaaaaatgctctggcggccgggcgcagtggctcatgcctgtaatcccagcactttgggaggccgaggcgggcgaatcacaaggtcaggagttcgagaccagcctggccaatatggcgaaaccccgtctctactaaaaatacaaaaaaagaaaattagccaagcgtggtggtgcacacctgtaatcccagctactcgggaggctgaggcagaagaatcgcttgaacccgggaggtagaggttgcagtgagccatgattgtgccacagcactatagcctgggcgacagagtgagactccatctcaaaaaaaaaaaaaaaaaaaaatgcaccggcccaccaagtttgcacgcagcttcagggctccacagactgctcagaaggccccacgtggaggccccttctcgcccggtgaaagggcggtgactcgcactgaagctgagaaagctcctccgtccgatggcatgaagacacagaggtgaagacagggctgaaatgaggccagctgtggccaccctgaaggccctggagactcaatacagcctttctgtgggaggggacgacaggacagaagggaacccacctatttccagctgtcctgggtacttccctctgactctgtgctggaaggttttcttgagctggttcagcagcgtcgtggcagggcaggacaggaccctgccaggccctgtgcaccctctccacagcttcaggcaccccttcgtccgcgaggcctgtgggatgactgaaagccccagttcagaaacctgaatggtgactcggggagagcacatgacaaggacccgaaaggtttccctccactaggacctgagggggtagggaggaggggacggtgtggcttgatgcgaggtcccttccctgcattcccatgtgacacgtgagcaactttggctctaagcatcttaccagggccaccacctgcagtccccacaacaacctgggaggggctgctgtcaccagcctctccttacagacaaggaacctggccttctgaggggaggtcccacggggcagaggcacagctgggatcacagctactgtttgacggcacattctgcaccttgaatgtggcctggggttacctcactgaaccccgtgcagtgccctcctcctatgcagatagggaagcagaggctcagagatgtgaatcatttgcctagagtcacacagctgactgaagagtgtgctgcaactccaggacttgtctcccttacctccccacaaagagtgtgtatctctgagcccagcccagccacagcctccactctgggccccgattaactctggctattaggaaggcagaagaggctccccgagctttgatcccgtccccgtgccgctcacataggcagcccctgggtggcaggcagctacttactctcttcaatggatgttgccttgccgaccttctcaaagtcaaggacagaaagtgtctccagaacgtgcttttgctgtgccacttcttccaggaggcattcctggaccagccttgataaattaggggaggccagtttctgggaagcagcccagatgctccagattagcatggaacatgcccaccgaggtcagctgttacggctgtggctcccacctgcttgtgcccatctcttctgtcccgggggcagctccctgactgtcatttggggattcccctttcaccaaggtggctgagctaatgggatgcaggctgggctgccagggaccacctttgcccccagaaggaggaccaacctgcctgaaagtgaagccaacccacattgcaaagcagaactgagagagacctagtcctgatagcatttgaacccgtgcatccagccgagcctgaagcctacctctgaggctttcagtaccatgagccgataaattttcctgttggctgagccagtttgcattagggttctggcacctataaatgagagtcaccaccaaagcctttggtttagggcttggcctgtgtaagagccacacgagtattcacccagaccctggtctgcctctcttccactggggaatagcttcagtctcacgggcttccaggatgcaggtctgtcaccccttcatgcttcccaccaccttcaagatgagcctttgcaaagaggactccaaacccctgtctgcccctccctgacaagtcccctagcccagccacctgcagcagagctttgcagacttggaggtgtaccatcagcagcacgtccagctctggggcaccggctgtgagttccctggatgacgctttcagtgatgacggtgggggcaggggccggtcctttctgagttgaattgagaactgggtgaccattccagttagcagttcagctccctctgagggtgggggaaccctcccttcccagcgagccccaggtcaggaggcccactccaggtcccaggaagttcaactgaagaggaaggggaaaggaacaaagggtggcagcaactcgaaacagagctgggaggtgtggccaagggcctggggaaggcagggcgggcagtcgtcttccaggatgtctcgtggaggtagaagagaattccaactcatcccagctctgtgacgctggacaagtctgcctccccaaggctcaggtgactcatctatcaagggaggcaggagccccacactcaaggccgtgaggggtgcatgaaatacggtgggcaagagcgcctcacaccaagtccactctgtggtagaggctagacctgctgcccgacccactcagccactcaggaagggtggaagcaagtgtggcacgaaacaccgcactcgtccgtgggattgtgagaggcgaggagaaggaattgagcctctgctcttccatgtggtgagatgcggatgcagaagccctcgggggctggggcaggtgaggctgcgtagcctcgagggaagctgtcatgagaggtgtgggccctgtggtgggacagagggaacagcactggatactgctgcaccttggttaggggctaagagctttttttttctttttctttttctttttttgagacagagtcttactttcgcccaggctgaaatgtagtggtgccatcttggctcactgcaacctccgcctcccgggtccgagtgattctcctgcctcagcctcctgagtagctgagattacaggctcttgccaccatgcccagctaatttttgtatttttagtagagacggggtttcatcatgttggccaggctggtcttgaactcctgacctcaggtaatccgcctgcctcggcctcccaaagtgttgggattacaggcgtgagccactgtgcctggcctcaaagaacttctactatatacttggtgattatttttaaggtttaaaaaataatactaaaagctggttccttggagcagaaggctcaggggcaggctggggtgatctcacccacttcgtggtctctgaggaccggctctgaggcaagtgggggatgtgcggggatggcatggggaagggtgcacgatagagtgacaagagctgagccaaggacagtgggagaaacagacggggaggctggcaggaaacgtggagctcgggtcacccggtgggagtggtggccactgggtcactgctggaaggaggtgcactcaccggagaccctgggagcccccaaacagggacagctcatccagggcgaagtcggcattgaggaaggcgaagctctccaggatgcactccatcaggctctcggccgaggtgtgctcctgccgtgctctgcagggctgtggacgaagtggccagacctgagggcaacaccgggccccacccacccgactgggacactggccaggggcctcacggcagacttgggcaatgtcccggtcccaagccccaatcccacacaccgtcccccagcagaagcccagccgctggcccaaggcgtggcactgggcgtgtcaccccccaaagtccctcctgaatggcctgtgacaaggtaggagcagaatcttgagggggacagatctgaaaaccctcccctgtatctcagacacccacggggacaaggccaatggcaggagtgagtgagctgccccagcggggaccagggaggcaggagcgcaggtgcctcccctaagagggggccacgctcatagatcgcccagttctaagaaaaccctaaaacatggatatttatgggaaactgcccagctttgaaataccaacaacaaatttcaaagtattttaaatacatggtgtaggtcaggcaaacgcttcttcacgaggctcagaggcctgtgggctccaggttcctcctccctgttgggtttctctccccaacagattaagggagagtgttggggccaccaacccgccactggtcaagtcaccagagcctccagtgccagctccctccctggagatttctgtcttgtccccaactcgtggctggctctggggctggttcctgcccccgttcccagcacaccccacccaggccttgtgtccaacacaaactgcagccaaggcacagcccaagcagaagccataaaaccaaaccaggatcctaactgcggagccaaagagaaaatcttgaggacgaagggaataacaaggctagttgcagagatcacattttccaatacaaaaatataggcatacatgtgtatgtaagtgtgtatcaatacacacatgcatgtagactgctgattctcaatagtcaaggtagttatgttctagaggccaaggcgggcagatcacttgaggtcaggagttcaagaccagcctggccaacatgatgaaactgcatctctactaaaaatacaaaaattagccgggtgtggtggcacagacctgtagcctcagctactcaggaggctgaggcaggagaattgcttgacccggggaggcggaggttgcagtgagccaagattgcaccactgcgctccagcctgagcgacagagcaagactccatctcagaaaaaaaaaaaaaaaggagggggttatgttctataaaatcacagcaaaaaaactgaatcagcaaaagctgaaccattgctcctaagggagttactgggttaggttcctgtgaacctctggtcacagcagttttatcaactcagcaatgcagaactttgtatgtgtcttttggtttaaagacaccttatttaatagctattgttggctgggtgtggtggctcacacctgtaatcccagcactctgggaggccgaggcaggtggatcacctgatgtccggagttcaagaccagcctagccaacatagtgaaaccctgtctctactaaaaatacaaaaattagccgggcatgatggtacgtgcctgtaaccccaggtactagggaggctgaggcaagagaatcacttgaacccaggaggtggaggttgcagtaagctgagatcgtgccactgcactccagcctggacaacagagtgagactccgtctccaaaaaaaaaggaaaaaaaaaagctatttttgattcattaacattgaactcaacagccagcatcgctacaactcatgcctgaaggaagctcatctaacacacattttctctgtaaggtatttcacaggcttcctggactgaggaacaccagccggcactgaagctctgggcttgggaggcatttaaacagtgaaactgtcaacaaaaagcacaaaaacttgaaaaacatggcattaaatagaccatgaggacacttgtttaccatttgggcattgaaacaggaaggcaaagcattgcctcgcttgacctcagctgggaatgtgtgctttgagcagctcagattttctatcactctgcccggccccaaaacccactttggaatcgcctcgagtattgatttgggggttagaaataaattttagcaagtaagtaaattccaaaatgcagaatccacaaataatgaggataaatcatgtatatgtatgtgtgtatgtatgcgctcacacacacacttttttttcttttgagagagagagtctcgctctgttgcccaggctggagtgcattggtgcgatcttggctcactgtaacctccgcctcccgggttcaagtgattctcctgcctcagcctcccaagtagctgggactacaggtgcacgctaccatgctcagctaattcttttgtctttttagtagaaacggggttttgccatgttggccaggctgctgttgaactcgtagcctcaagcaatccacctgccttggcctcccaaagtgctgggattacagatgtgagccactgcgcccaccatcatatacacatagatttgcataaatgtgtgtgtgtgtaatttctctccagaaagtcaaaccaaaaaccacggtctgtaatcaatttgcattgttctgacttcgtttgccaaaaaaagaaaagttccttaaagacgtttaaaatgattacattattgcggcattaacatttttatgtaaattgggtgtaatttttcaaaatacaagtatgtgacaaatgtgcatgccgactcaaattagtctacaaaaaaaggctgttaaaaagtacaaaaaaggtacaggcacgatggctcacgcctgtaatcccaacgcttcgggaggctgaggcacgaggattgcatgagtccaggagtttgagaccagcctgggcaacaaagtgagaactcgtctctataaaaaataaacaaaattagccaggcatggtgatgtgtgcctgtagcctcaactagtcaggaggctgaggggggaggatcgtgtgatcccaggaggcagaggttgcagtgagccaagattgcaccactgaactccagcctgggcaacagagtgagaccctgtctccagaaaaatgaaaaacatgaagtaccaaaaagttgacattatttcttaaatttttttctggaaattttcaggcaggtcctttttaacaaccatagtagtggtaaacggaacatattttaaagttatggatgtaaaatgagaaattaaactttttttcccctatgttgatttgtcctgttggaggtgtggttggcgataaaatgtgtttgaagagagctgttaactatttcagtgccaaagtgtatcttacacaaaagaggggaaaacagaaaacagcaaaatcagagaagtgcacagccagtctgagggcataaggaccgagggaacacagagcaggaagggatgggcctgccggggccaggtgggagttgccatttaaaagagggtgtccaggccaggtgcagtggctcacgcctgtaatcccggcactttgggaggctgaggcaggcggatcacttgaggtcaggagtttgagaccagcctggccaacatggcgaaaccccatctctactaaaaatacaaaaattagccaggcgtggtggtgtgcacctgtaatcccagctactcgggacgctgaggcaggagaaatgcttgaacctgggaggaggaggttgcagtgagccgagatggcgccgctacaactctgttgccagcctgggcaacagagcgagacttcatctcaaaaaataaatacataaaaaataaaagagcgtgttcagggaaggacacccttaagttaattgatgtattagtaggtactagtggtatacatttttttgatgtacattcaaatttgtgtaaacacgagaggagaatgtaataatttgcctaggtcagcacctctgaaagccacctgccacctaagccctcctgtgaactgagaacagccccggggtatgagccctgtggagaaggttcagtgcggggtgcgtggatgaggcaaacagggaactgtgtggggccttccatggagccagctgcgaccctgacaacactccaagtttgggtttgtagccacaagccacagccccgcccacccaggtcagaaggtgcgagatggggccagtttctggctggatgtgcatgagcctatctactgtgaactcttaaaatcttcctgagccccatgagggctgttgttatccccgcttgccagatgaggaaaccaaggcccagagagacacggcccacccaggtcacgcagaggtgaggccaggatgtcggcccaggctgcgtggccccagagcccccgactcccagtcatcatgccatcagcaaagcagggccaccgcccggggcggggtggccataccttcagccggtcccggaagccgaggacctggtactccagctcccggagctggggctgggtggagtccgtgggcctcagcaactccaggacctcctgcagaggcccctcgagggccacgccaggcccgtcctctctgtccccggttgccccttcctcgtggccgttctggctactcgaggctgtgccgctgtggaacagggagccctgtggcaggctggggctctcccctcctaagttcctccagccaggctgctctgcaaacgggcctccagagaggtgggccatctctggcaggagacctgggggcagggggtcctcccgagcctcctcttcaatggaggcgtggggaccgaaggtcaagggcaggaagcccacatctgaggtggacgccgacgtgctggtctccgtgtctcgggggtcctcagagctgaaggagtccatctcaggcagctcctgactctggcttcttaggctgggaccccggaggtcgctgtcagacaggtagctgaggatggaggtggcccttgggccacccagcagcaaggcctgctgtgttggctgctgtaggacagactggagaggggacacgggagcggcctcaccagccaccccagggaccacagcaagtcccccagaggggcttcccctgacagacacccgctgtgcatgcccatgttctcaggatgactgaggcctgccgaggtgaccagcatcccagaggtgcagaaaaaaccctgtcccctctctgcacttatcccccatcccgcctccaactcactccccccaacctcaacagcctcctggctattgctcatgccctgtgggctgggccccacgttcctgcctcagggcctttgcactgactgtgctctcgtcagaacactcttccccatgtgccttcatggcttgtgccctcgcctcctcaggaccttacataggtgtcacctctcctgagaaccctgtcctggacagccttttttaagtggcaatttctacctggccccagtgggccccttcccttcctgctgtctcccacagtccttatgcccctggggctggctgtgcacttctcggattttgatatcatctgtttcccctgtagaatttcagctccctgagggcacagtctttgcctggcctggagcagaggctggcatatagtttcggtttttgttttgttttgttttgaaatagtctcgctctgttgcccaggctggagtgcagtggcactatcttggctcactacaaccttcatctcctgggctcaagcaattctcctgcctcagcctcctgagtagctgggattacagtggcactccatgacgcctggctaatttttgtatttttagtagagacggggtttcaccatgttggccaggctggtctcaaactcctgacctcaggtgatccacccgcctcggcctctcaaagtactgggattacaggcatgagccactgcacccagcctagttttggatgaatgaagtgaatgaatgaatgaagggcctgacaaacacaccatagaaacagcagcagctgtcattaagtattctgaggttgccggccctattccagggccttcccattaccctcaccacaccccatgggggtggcactgccctaacctcggagaggtccttaggccacacgggtggtgagtacagtgccacagtgtgaatctgggtacacggacacgaacccttacctctcatcagctgaaccaatgataatggttgatgttcattaactcagttaactctcacagtaatcccataagggcagtgctgttattctcacttctctgatacagaaattgaagtccagagagggctgggcacggtggctcatgcctgtaatcccagcactttgggaggccgaggcgggtggatcacctgacgtcaggagttcaagaccagcctggctaacatggtgaaaccccgtctctactaaaaatacgaaaattagccagatgtggtggcgtgtgcctgtaatcccagctactcgggaggctgaggcaggagaatcgcttgaacctgggaggaggtggaggttgcagtgagctgacattgcgtgactgcactccagcctgggagacaagagcgaaactccgtctcaaaaaaaaaaaacaaagaaaaaaaaaggcgtatacacttgctggtagatggattgctgtctctggaagaatatggaagaaactgatgacaggagttggtattaaggaggggaccctgatccatggagatcaacaggaaagatgttttactgggcactctgtcaagtactactactagaaacgtatatattaaggccaaggccatgactggggtgctagaaccatccagagagcccactgcagatgtcctgaagaaccagccaagcccagaacccaggctaggttggaggctggcagcagaggaagaaagtgcacaggaaaacacccaggatcgcctcaaacggaagctgagcccgaggcttgccatgtctgggagggccagactgctcagcccagctcctgcgtgctgcccccatcccagggtgaccacagcggccctgccccgggaaggctcactcaccaggtagtatctctcccggaagctgggggtgctcgggggtgtccagttgtacaaggagcccttcctgctgcccatagaaaacttgcccgtggggctgggtgacaccaggaagctctcagtatcaaacgggctggaggagagaacagaaggtcaggatgccatcggcacccagaggccatttcaggcccagacggcccacagggctcttaggttatgcaggtagatggtcttcatcttacaatacaatagcatggatggtgtgtgaggagctctgctctaaactgttgcttgtttttgagacagggtcttgctgtgatgcccaggttggaatgcagtggtgccaccacagctcactgcatccttgaactcctgggttcaagcgatcctcctgcctcagcctcctgtgtagctatgaccacaggcatgtaccaccatgctggactaatttttaaatttatttttattttttgtaaagacagcgtcttgccatgttgcccaggctggtctcgaacttctgggctcaagcaatcctcctgcctcagcctcccaaagtgctgggattacaggccatgagccactgagcccagcctctactaaactctttacacaaatccttatttccacccccaagacaaccctctgtggcctggagaattatttacaggggaggaaaggaaggctctgagagatgagtgacttgcttagggcagtgtcacaaccaaccacgcgagacggaactgaattcacacacagattttctctgaccccaaagccttaaagatcactaagagtgatgcttactcttcagacatcactgtacttaatggatttaagaggaaatgggctgggtgctgtggctcacacctgtaatcccaacacttcgggaagccaaggcaggcagatgacttgagctcaggagttcgagaccagcctccataacctggcaaaacccccgtctctacaaaaaatgaatacattagctgggctaatgtggtgaccaacagacacttgtagtcccagctactcaggaggcagaggtggaaggagcacctgagcctgggaggtggaggctgcagtgagccgagatcatgccactgctctccagtctggggcaacagagcaagactctatctcaaaaaaaaagaaaaaaaaaaaaagcaaaataaaacaggaaatggaggcttgggcctccaagtccagggccttgcccatggtcacaggtgcagcctaggaactccaggttacatgacctctacccctttagaaacctttctcaaggctgggcgtggtggctcatgcctgtaatcccagcactttgggaggccaaggtgggtggatcgcctgaggtcaggagttcgagaccagcctggccaacatggcgaaaccccatctctcctaaaaacataaaaaaattagctgggcatggtggcaggcacctgtgatcccagctacttgagaggctgaggctggggaatcgcttaaatctgggaggcagatgttgcagtgagccgagattgcgccattgcactccagcctgggcgacagagcgagactctgtctcaaaaagaaaaaaagaaacctttctcagactctgaccgccctgagggcccttagccagatggtgagggacagtgactgtgagcaggagagcaggatctggaggcaggaaacctcaggtcaattcatgctaaatcaaggaaagacaccaaggtctgaagggacagggaatctaaggccaattaacgcaatcttcctaaagctaacccaaaaggaaaaaccccgtctccccacactgagtagtaaaggatcaaaggcaacgctccctacagccctcctgcctccaaccatggctcagatggaaagggagggtgtatggatgggccgctggcgaaacagggaccatccctctatctgcatagggcgccatccacctcagcctctaaccacagaccaaatcctttatccagaaaaggggcagcccataggaacctcaaacagggtacttaaagcccagaaactttgaaaccatgcccttgagccacatgctcgggcccactcccaccctgtggagtgctttcttgccttttttttttttctttttctctgagactgtcttgctctgtcacccaggctggagtgcggtggcgccatcttggctcactgcagcctccgcctccccggttcaagcgattctcctgcctcagcctcccaagtagctgaaactataggcccgtgccaccacgcctggctaatttttgtgtttttagtagagatggggtttcgccttgttggccaggctggtctcgaactcctgacctcgggtgatctgcccacctacgcctctcaaagtgctgggattataggtgtgagccaccgcgcccaacctgctttcttgctttaataaagtcctgctgcttcattcctgcgtttcattcccctgctccttttctgcattttgttcaagtctttgttcaaaatgccagggacttggacaactcattgtcaagaccctccaccagtaacaactggacacccccagttagaggcccctttgagaagctcagccgatgagcaggggacactcggttcagaccccttgtctgtaaaaggggtgcgcttacagaagaacccccatgtggaacatgcacagggaagggtgggaatccaggcgagcgcatgggagcaccgaggcaagtgatgctcagcctggcccgtgatgctcagcctggcctgtgtccagccttgcactcggagtaggtaggtccccatagatccatttgcctcgaagaaacttgcttataattatttgcacaaaggcctggctcgtggcacctgggcctggcctgaccagaaggcctagagctcagaggctctgcaagtgcccacttctctgcccagggtgtctgcagacccgcaggcaccctgggtcctaggcttggatggcactgagctgcccgccaccctgtacacttcaggggcccctgggcgaggggtattctcagccctaccagacaggtgaggaccccgagggtgcaggtggtcgctcaacagaattcacccagctcacgagggagagggcagcagctttgtgacccccagctcggacacccaccctagggagagaggagagagaccagccccgactggccagagcaagcacagagcagaggagtgtcctcagccctcccttctgctgcctctgcgctgaggaggaggaaaggaacaccctggaaatgcaaggcttccttagaacagagagctctggagccctccacgctcatgggcatgcagtccagggagtgatctcatggacatgggcttcatgggtctgcagccgagagggggacgcaggtgaccgctcagccccaggccaagggggcagccagggtcggccaggaatgagggggtgggagcagcaaggagggccttcctggagaggtgagcctcctccaaggagccaagcccgggaggccccggaaagtgtccccccaaccttccctgtggctttaatagtcaggggttcagaagcaagaagggaagcaaaaccagaaaggcaggcaggggctacagagaagttctaggcctcgacctgactgaggggtgggagtgagggacagatgaggacccgtgagggcagggacacccttggcagaggctggtgcaggaacccagggccagagtgtggccaggccaccaggggcagccagccaggcctccgctctccccaggctggacgggactcacttccactgcacctccagctgcagcttgatggtacccaactccgtgatgtccaccacgatgacctgcggccgcgtcgtgaagaagtcggcgatgtcacacgtcactgcacccacagccagcgagcccaggccccgcaactccgtcacctgggggtgggggctggagggtggtgtctgagccgaacacccaggcaccccagccctgcccccgggccccatccccaccttgatgtccaggttctcatgcagcgtggggatgaaggccttctcctcttcgtcccaggtctggctgtcatctgactcgatccgacccttgagcttccaacgctggcggcccagacgcatgagcacctgtgaaccagcccgagaggggccgcgtcagcccaggtgggtgtccccttgctgtccgcccagggccctccctgccaggcagagccccagctgcaaccctggttcccagcagctcccgtcccccaaagacctggcggggagccctgaggattgaccccagagagtggccgtacctcatagtggtctccgggacagaggcgtgcgtagcccaccaagcctggaacacagacatggccggtctcccctccgccttccactctccctgacctgggaccacaggtcctctctggggttcccccgagtatagattttcagtttcagtggggtgaggatgggggggaggtacaccatcatgatggaaaatggacagagggtgctgggccctcacaccaggctcagagaggggtgggacttgccagaagtcacatgtcacatggatgcaaaagccagggctgggctcagacccctgggattctggccaattcccgtgcccctcagcagaagtctcagggcctccagaaaggcctccgcccaccccctctcagccctgttacctttcatcctgatgtggaactcgcccaggtgaacctccagggccccctcgatgagccacatgtcctgcaaagccccggaggtggctcagctggctgcctggggctaggccacgagggcctctaaccatccctgcagccagacagaggccacaggcagagagacgcctccttggggcccagaacacctcctccagcccccactggcccagctctcgatgtccccactgcccggcccagctcttgctgcccctgctgcccagcccagcttggcccggcccacctcggcgcactcgtgcaggctgcggcccagctcctgcaggctctctcgggctgcgcggctcggggggcaccgggcgaaggcccgctgcatgctggaggcgccgtcgcgcaggcggcactggatgcagtagtcctcgtacagctcatccacctgtggtgggcacacgggctggtggcgctgcccacgcggaggggcggccccacacctgcctgtcgacttctcctctctgggagaggccctccctgagctaagcaccccgctagcccagcccatggtgacagtcactacctgtccagtcccattcaaagcagtcacccctggccccagtagaacatgaacccccataggcagggaccacatctgcctcacctgcctcacctgccaccactgcctcacctgccacccctaccacccctgcctcacctgccacccctgcctcacctgccacccctgcctcacctgccacccctgcctcccctgcctcccctgccacccctgcctcacctgccacccctgcctcacctgccacccctgcctcacctgccaccccggcctcacctgccaccccggcctcacctgccacccctgccaaccctgtctcacctgcctctcctgcctctcctgccacccctgccaaccctgtctcacctgcctctcctgcctctcctgccacccctgcctcacctgctgcatacccagctcctggcagcgactggcacacagtgtgcacagcaaaaatgagtgaaagggacaagggaatctgtcccttcacctcctctgcctggtttttcaacaatgaaatgggagatgactttgtgataacctgccacccactgggcagtgtggggagtaaagcaagatcatgaaaccgtttgcagactctaaagcttacagatctgctatgcgaccttgggccaacccatgttcatctctggacctctgcttttccaactgtacaatgggctgggagggctcaaccttcccagccatctaagactgagcatgaggtctttctgcataaactgaagaaagagcccacacagtcctcagggagtcccacctcagggctgagccccctgactcccacctcagggctgagcccctgctgtccttcaactggcccgaggcccctgctcatccttagcctcctgcagctgccccatacccagaggccctgatccctgtttcgagggcacctccccagctcctgctaacctagctgaggcccagcaagctggcactgccccaccccaccctgcaacatccacgagccagctgaccttgctgatgtgaaactccatcttccgaatgtgcctttccacacagcgcgtttgcttctcccggaaaaagggaagatgtttgcaaagttgcctgggccacccacctgccccgcttgcccctgccaccctcctacaggtcctaactcagagaatggggcccctcaccatccctgaggaaggctcatcgcagagactcagccttcccattcctaaaatggggaggagacccaggttttctgcccatcaggcagccaggaagatgcaatgaggcacagtcattctcatccagccaggcccagcccacctcactcaccgtatgcagactcaccttgtccaggtcataatagaaagcctgtgagggaggaaaggagggcggaagaagctgtcagagtcccacatgttcctccaaggcctatgaggctctatgctggcggcgcctgagctcagagtcagaggacagaaagccatgtctacagccacccccacccactccttcctctgccaacggcagactgctgtccacgccaaggacagcactgattaaacacatgcacgtgggatgaggcagttctaggtctggctcttctatttcccagctgcgtgtcccaggcaagtcattcagcctttctgggcctccgtttcctcctatgtaaagcagggtaggagaagcgcctacctcacagggagaaaaaaggacacagtaggcccttgacaaaatgggaaccattgagattgaaggaatggcctcggccatgacaaaagaacatgagggggatggaagcgggaggggcacatggcacagcagttcaggccttaatggtgaattcctaagtctatccattccaggggccagggtgcgaccaacacaaataatatatcatcagggcaggcaaacctttctataggtttgtaaagggccagagagtaaatatttcaggcttggcaggccacggcgccccatgccaagatctataaagtaggaccatcctggccaggcgcagtggctcacgcctgtaatcccagcactttgggaggctgaggtggtcagatcacttgaggtcaggagtttaagtccagcctggccaacgtggcgaaaccccatctctactaaaaatataaaaagtagctgggtgtggtggtgcatgcctgtaatcccagctacttgccagacttgaggcaggagaatcacttgaacctcagaggtggaggttgcagtgatctaagaccgtgccactgtactccagcctgggtgacagagcgagactccatctcaaaaaaaaaaaaaaaagaaaaaaagtaggaccatctaaaacatacacacctttgcctaccttagagttacttctagaaccaagaaagagtgtgaagtggacctaagacatgggaagtgctgtacctgcctgtggggttaaattcatcagggtcaaagttttgtcctaactaagcaactctgccatcatagtgggaaagcagccacagacaatatgtacatgaacaagtgtggtcaagaaacatttttttaaacaagtgtttaaaaaaactcttgttttttaagtgactctaattttaaaatatagtgactctaattttcactggctgttaatttccagtggagattagagtcactatgtctgagtctggaggggttaccatggggttgtagatccaccagggaggaaaagtaagctgtaggagagtatgtaaattgacatttcatttttgtaagacaattttaactcacaattgctaaacacatttacatgattatgtgaccagagagaaaaatatggaaagatcaataaaagattgttctcaagggttaaacgggatgggacacggaagattgaatagaggagggcgtcaatcgagaaagaaagaaggattcaaccccaaaaagtcccatgtatgtatttatgtggaattgtacatatgcgataatgaaataaaaattccatttaagccaggtgaagtggctcacacctgtaatcctagcactttgggaggccaaggcaggaggatcacctgagcccaggcattcaagaccagtctgggcaacacagcaagaccccatctctacaaaaaatttaaaaattaactgggcatggtggcacacacctgtagtcccagctacttgagaggctgaggtaagaggattgcttgagcccaggagtttgaggttacggagagctatgatcgtaccactgcacttcaccctgggtgacagagtaagaccttgtcactttaagaataaataaataaaatctttttaaaattaagaaacaattaaaactccatttaagaaataaagaaacaggatgggtgtggtggctcatgcctataatcctagccttttgggaggccgaggtgagtggatcacctgaggtcaggagttggagaccagcctggccaacatggtgaaaccccctctctactaaataaaaaatacaaaaattatcctggcatgattgtgcgcgcctgtaatcctagctactcaggaggctgaggcaggagaatcacttgaacctgggaggcagagtttgcagtgaatggagatcgtgacactggactccagcctgggtgacagagcgagaatccatcccgaaaaaaaagaaaagaaaagaaaagaaataaataaagaaagaggaaagatcccaagcctttgaaaagaagagtgactacccagcaacgtctcaaaaaccaacatcttgtttcaatgagaaccagcagtgtcatgggagcaggactcgacatgggcatcttgctgtgtggctccagtgcggtcactgtgccctggcctcagtgtgcccatctatgacatgggagcagctaaaacatacaagtatttatactcttgcctgctttagagttacttctagaatggaaagaatgggaaacgaagtccacggggtgagactcactgtacccatgtgagaagaggggcaggtgctggagctgggtgatatcttggcagcaccttctcccaccatctgctgctggtcacccgcccaactgtccactaagggtgaggcatgctgagcttggcaggcctttccctccccaagtccctggcacacacatgaggctgggtccttgcctctcctaccctgcccaccccgaggccctctctgctggagccaggatacagagacggccgcttgtttgcttgcttatttcattcattcattcattcattcattcattgaaacagagtctggctctatcgtccaggctggtgtgcagtggtacgatctcacctcactgcatcctccgcctcctgggttcaagctattctcctgcctcagcctcccgagtagctgggactacaggcacccgccaccacgcctggctaatttttgtatttttagtacagatggggtttcaccatgttggccaggctggtctcaaactcctgatctcgagtgatccacccgccttggcctcccaaagtgctgagactacaagcgtgagccactgtgctgagccactggatgctattttggtagaaaaactcatctcccctcctcgctttcccagtccctcagtcaagctggtggcctgttctgcacattggtgctttggaggagggattctgggaaacactggctgggaggagaatcccacagtagcaaggcctccttgcttttgtctccaaatctaattcattaaggacatgtggggttttctcaaggcagcagcggagagacttcccagatgaaaggaagatcctcctgctgaaaggatgaagtccctgagcaatgggatcctagcagtgtcaccagataaaatacaggacacctaattaaaattaaaatttccaatcaacaaggaacaattattttagcataagtatgtcccaaagattacatgggatatacttatacctaaacaaatttgtgatttgtctgaaaaaccaatttaatgggaggccgggcacagtggctcatgcctgtaatcccagaactttgggaggcagaggcaagcgaatcacttgaggtcaggagtttgagaccagcttggccaacgtgaaaccttgtctctactaaaaatgtgaaaaaacagctgggcgtggtggcgggtgcctgttatcccagctactcaggaggctgaggcaggacaatcgcttgaatctgggaggcagaggttgcagggagccgatatcacaccattgcactccagcctgggcaacagagtgagactccatctcaaaaacaaaacaaaacaaaacaaacaaatttaatggggcatgctatttgtgagtgtgtgtgtgtgtgtgtgtgtgtgtgtgtgtgtgtgttgctaagtcggtctctgctaagggagaggcaaaaaaccagagcaggtgagccttgggcaacacagggcccagggccagcctgaaagacactgccttggctggcacagtgcctcacacctgtaatcccagcactttgggaggccgacacaggaggattgctggagcccaggagttcaagaccagcctaggcaacatgatgagaccctgtatctacaaaaaatttaaaaaattagctgggcatggtggtgcatgcctatagtctcagttacttgggaggctgaggtaaaaggatcgtttgagcccaggaggtggaggttgcagtgagccgggattgtgccactgcactccagcctggacaacaaagggaaatcctgtctcaaaaaaaaaaaaaaaaaaaaaagacactgccctgatgatggcaggaaacgctgcctgtcagctgggcattgaaggaacacgcaggcttcatcaaggacagcggcagaggccactgtgacatacccaagatgtgacacctgacccactttcctggcattacagaagccatcccaagtccaggtcacctgatggccaaggtctataaaataggaccacctaaaagaaatgcacctccatacactgcccaccttagcattacttctagaaccgagagacagtgtgacatgggcctaaaacgtgtgaactgctgtacgtgccaaagtgaagttaactcagtgcaacgtgaagaggctattccataaacctctagttctgagaaagagtcacaccgtgacataggctagaaggaacgcagggttcatcttttactcctggccaaggctatctgggtgggaagcaggcagggaggggtctcaccagcctggaattcctcctggtgtctttgtggcgtccagacaggtggtccagctcagcctgctgcacacacagatactccctgcaaggaaagcaaggaagagtttcaaatggaagaggaagaagaaagggaaaggaagtaggccaaatggacaatgtccccacgtggagagcagacacggggctcagcggggctcagaggcaggtaggaagccaggctccctcacactgggggctgtgtgcccagcaccacacaaaattggttacagggaagttcctagttaattcccccaccaggcccacaagtagcttctactgttattatatgcattttctttctttctttacttatttattgtttgagacaaggtcccccctctctcgcccaggctggagtgcagtggtgtgatcacagctcactgcaacctctacttcctgggttcaaatgattcttatatctcagcctcttgagcagctgggactacaggtgtgtgccaccacacctggctgatttttgtatttttagtagagatggggtttcactatgttggccaggctggtctcgaactccttgacctcaggtgatctgtctgccttggcctccgaaagtgctgggattacaggggtgagctaccgcatccaacctagtatatgcattttaaagatagacaaaccaacccttgaaagcagcaagtaccccagccccggtcacacagcagagaagaggctgaacccacgtctgaaaccacacagtggccttctgagcccaaaatcttcatccccatgttataccccctcccaagctggggcccagctcatggggaggtcatcatggcacacctccctcaaggtcaagggtctaggccgggcgccgtggctgacgcctgtaatcctaacactttgggaggccgaggtgggcggatcacaaggtcaggtaatcgagaccatcctggctaacacagtgaaaccccatctctcctaaaaatacaaaaacttagccgggcatggtggcacacacctgtagtcccagctactcgggaggctgaagcaggagaattgcttgaacctgggaggcagaggttgcagtgagccgagattgcaccactgcaccccacctgggcaacagagcgagacttcattccaaaacaaagaaggtggggggcgtctagatttgggggccaaggcagggagtcccatcttgctggatttgctgagtcatcccaggaaggtcactcacactctctgggctctactgacaccacctcaaatgtggaaaagatagcttctgccagactgctactcactgaggtattgagctctctgggaagaaggggctgccttggccccagacaagtctcaaacatgtggtccttaaaggacacagaatctgtccttcagaaacatgctctatcgtccatgcacatcccagctcccactctgcacaatcccagcttgctgcagcctccacctctacaggattttgccatattcccatgctggtcttgaactcctaggctcaaggaatctgcctgcctcggccccccaaagtgctgggattacagggtagccaccgctgtgcccagccaaggatgtctattttgaaaaccatttcattctaaggtggtttccctttttttttttttttttttttgagtcttgctctgtctcctaggctggagtgcaataacgcgatcttggctcaccacaacccccacctcccgggttcaagtgattctcctgcctcagcctcccgagtagctgggattgcaggcatgccccaccacgccggctaattttgtatttttagtagagacggggtttcaccatgttggccacgctggtctcaaactcctgaattcgtgatccgcctgcctccgcctcccaaagtgctaagattacaggcccactgcgtctggcctggtttcaacttttacttgactctggttcctctttggggtgccccatctataaataagagatgtaggggctgggcgtggtggcttatgcctgtaatcccagcactttgggaagccaaagcaggtggatcacaaggtcaggagttcaagaccatcctgaccaatatggtgaaaccacgttctattaaaaatacaaaaacaaattagccgggcgtggtggcagatgcctgtagtcccagctcctcagaagtctgaggcaggagaatagcttgaacccaggaggcagaggttgcggtgagctgagtgagatcacaccaccgcactccagcctgggtgacagagtgagactccgtctcaaaaaaaaaaaaaaaaaaaaaaaaaaaaaaaggcgtaagtaggagagaatttagggtctaagtaccactatatctggggaaaatcactccagaaaccactctttggcccacagggccccctgtcatctggtccccattgccccataacctcatcctctttcctttggctctagccacgctggcctccttgctgcgccccagggcctttgtgtatgtggctaccctggcctggaatgttcttttccccttcaggagtgtgctccaatgtcaccttcttagcaaggccttccttccaactgcccaacttaaaatgaaccctccctgcctctgcctgcttaccctggcctgttttcctctgtggcccttactaccatctgatattctctgtacttttcttttctgtattgtgtattgtctgtctctcccccactaggagtcagctccacaggaggtagggattttgtgtgtttagtttacttctgtcccctggcctggcactctgtaagcccaataaatatttgtgggctgggcacagtggcttatgtctgtaatcccagcactttgggaggccaaggcaggcagatcacttgagtcaggagttcaagaccagcctggccaacatggcgaaacccagtctctactaaaaatacaaaatattggctgggcgcggtagctcacacctgtaatctcagcactctgggaggccgagatggacagatcacctgaggtcaggagttcgagaccagcctggccaacgtggtgaaaccctatctctactaaaaatacaaaaaattagccaggcgtggtggcaggtgcctgtaatcccagctactcggtaggctgaggcaagagctactctcagcctctgctttctcatctgtaaaataaggaggctatgccaggtgcagtggctcacgcttgaacccaggaggcggaggttgcagtgagctgagatcacaccattgcactccagcctgggcaacaagagcaaaactccgtctcaaaaaaagaaaaaaaaaaattagccaggtgtgatggtgcgtacctgcagtcccagctagttgggaggctgaggcaggagaattgcttgaacccaagaggcagaggttgcagtgagctgagattgtgccactgcacttgagcctgggcaacagagcgagactccatctcaaaaaaaaaaaaaaaaaaaatttgtggagtgactcatccttcttgtgcaggcctcggcccagctcatcagttggtctctgagcaagtctgtccttcactcaaacacccaccgccctgacctcttgcgtgtgtgggctcacagtgcaggctcctactgtggggcctttgcccacactgttgcctgtctgccgaggccctcgacgcactgtctctctgttacctttcttcattgcactcagcacaggtggaagttctatgattgattgcattgcttcttgattgattgcattgaatctgcccctctgcagtgcgtgctccacaagatcagagtcctcctgccttagtcactgccaggtttccagtgcccaaggaccgggctgagcacgcggctgcaccctgacatacttgcttactaaacgaatgaccaggaacttaacctgtcacctcttgtagacaagacccatccacgcttccccaggaagagacagagaggaggcgaggtagaggaatgcacttcttaaaggcagcacacagcccagccttacttgaggcctcttttcaatgcttcgaagatcttcttcacctgctggggcttcgggtctgcacagaccgaccccttccgcagcgtgccgtacatcttggaggattttgcaggcattcgcgatctcacggagttcctgttgatggactttctgtgagaagggttggagggcaagagaagtcagagaagggccctgacaaagccctccccaggggcaggcactttggaaatagtgaccagagccacagggagtcaggagacccggctcagtcccacccccatcaccaccaagcagtgtggtttccagaaagttatggagcctctctgggtctctgctttctcatctgtaaaattaggatcctgggccaggtgcggtggctcacacttgtaatcccagcacttcgggaagctgaggtgggtggatcacctgagatcaggggttcaagaccagtctggccaacatggcgaaaccctgtctctactaaaaatacaaaaattagccggatgtggtggtacgtgcctgtaatcccacttactccggaggctgaggcacaagaatcgcttgaacccgggaggtggaggtttcagtgagccgagattgcatcactgcactccaacctgggtgacagagtgagactcagtcttaaaaataaataaataaataaataaataaataaataaataaataaataaataaaaataaggagcctagatttgaggattaaaagaagagtaataaagcttttccaccatggctgccactggagagcagcagccatggctctgcgctaccctatggccatgggcctcaacaagggccacaaggtgaccaagaacgtgagcaagcccaggcacagccgctgcagtgggtgtctgaccaaatacactgagtttgtgcgggacatgatccgggaggtgtgtggctttgccctgtacaagcagcatgctatggagttactgaaggtctccaaggacaaacaggccctcaagttcatcaaggaaagggtggggacacacatccacgccaagaggaagcaggaggagccgagccaatgtcctggccgccatgaggaaagccactgccaggaaagactgagccccctcccctgccctctcccggaaatatagaacagcttgacaaaaaaaaaaaaaagaacagtaataaaaatctggtatcagaaatgaacttacaggaagaaatacagtcaagtagcccaaatgccaatgctctctgatcaccatgctctgcctgtgcaggcaatgccgtgtgggaggccaagtcatagtcctgtgctttacccttggggcagcatctgttggctttacctgcccagcatccatcccctccctctagtagtagcacctcaattttcctctggggcacctccccagctctgctttttatacttgtggtttgggggaaaggtagcctgactaatcaacatgcacacacacatttgcacatgcacacatgcacacgggattgtttggcaaatccacattccaggcctgcgttagtcaacatattctgctcccctgggccaagaagtatggggatcaagcctggccagtagccagccaggagttcagaattcacagaagggagaagtgttttttcccctggcattgctaacctggggaacatatacctgggacttccagcctcctccttttgccaccatgtagggaaactggggccaacacagagaggaacaaacagagtcagaccaaatctccatgacagtgagttcctggatctagctatgtctaaagctgaacctgcccgtggactttgcagttacatgagccaactggctctcttttttagcttaagccagctggagttgggagtgtggactggatgatcctaaaaactgcctttcagtggtgatggctgggtccctcaacatttagagatgtagcagcatctcaagactgattataggagtacgaggccagggcaccctcatcacagcacagagctggtttccctggcatctaagcctcttctcaggatcccataacttatccatgaggctggctgatgcagcctttgctcaccaacagatgtgttgaattctgctcttagccctctaaagccatcagccaggcgccctggcaccaggcatcacttaatgacaacattctcacaaaagagacatggtggaaatgactcttagatctaactttggcatcagttctctttttttttttttttttgagatggagtctcactgtcacccagcctggagtgcaatggtgcaatctcggctcactgcaacctccacctcctgggttcaagcgattctcctgcctcagcctcccaagtagctgagattacaggcatgcaccaccatacctggataatttttgtatttttagtagagacagggtttcaccatgttgtccaggctggtctcgaactcctgacctcaaatgatccacctgcctcagcctcccaaagtactaggattacaggtgtgagccaccgtgcctggctcagcatcagttattataggggactactggcccttctcttccaactcctcctcttcccaggggcgggaataacggtatgctggaagcagcttcaacccacccctaaaagctggctgaacaacaagagagaaggaacaggccctgaatagcctcgtgaagcagacctcccaacacacacacatgccctcatccaccccttggctctggactgcagagagagagagagaggaataaccaatctcaagtaagcacctgcattttgggggtccttttatcaaagcaacttcacctctacattaacaacacactacccaaggctctgtcttttcactggtaaaatgggaccacgtaatacatcagaggatggtgctgagaattctattagatgccaggcccaaaatgtggcacaaaggagaccttttacatgcaagctgttgttagaatcatcacatcctatctgtatctttcccctggctcacagcttagaaaacattaggtgcaggccaggcactgtggctcacacctataatcccagcacttcgggaggccaaggtgggtggatcaactgaggtcaggagttcaagaccagcctgaccaacctggtgaaaccccgtctctactaaacaaaaaattagccaggcgtggtggtggacacctgtaatcccagctactcgggaggctgaggcaggagaatcacttgaaccgggaggcagaggttgcagtgagccgagatcatgccacttcactccagcctgggcagcaagagcaaaactctgccttaaaaaaaaaaaaaaaaaaagaaaaaaaagaaaatattaggagtttggtaaatattaagctcagctgaacgggggaaaatacagtatcccaaggggattagagaacagagaacctggcccctgcaggcagagcgggatagcgagtgcacccctgggtgttcccagctggagacagagggagcaaaggtggagaatgggacctggtatgctctgggagtggatgcaaggagcaaggtttgacccaggcagaagtgggagtctgcagaggggcctggacctggggcctctctagttttggggacccaggatgtgtgagaggaggagaagggcagctcccagagaaagtccagcttccaacacctttacaatgacaagtaatgtctctgtagagcagagaaactaagctcaggccagggctagtgggctgctgaacagctgacaccacaagcccaagggcctcaggagcctggtgagaacacgtgagcctaagtaactgggggcacctgctgccgccaggagctcgctaagggctttatagaaatatctcgactttcacaaccaccctaggagacaggtattattcttattattattttgagatgaaatttcgctctgtcgacaggctggagtgcagtggcacgatctctgctcactgcaacctccgcctcccaggttcaagcgattctcctgcctcagcctacccagtagctgggattacaggcatctgctaccacgtccagtaatttttgttttttttagtagagacagggcttcaccttgttggccaggctggtcttgaactcctgacctcaggtgatctgcccgccttggcctcccaaagtactgggattgcaggcatgagccactgcacccagccatttgtatatatttaatgttaagtgatgctttccaaagcccacaggggctgtgctccctcttccccttgccctccctgaggccccatcacccacctcttgaaccgggccctccgcaagtttgccatcttgaggctggcagagacggtcagggctgcagactcgggaaaaggcaggtttctgagaggttagggaccccggcaggtgggcagcaggcagtggggcaggagctcgctcactcccagctcctgcctccagcccccaacaggtgtgcaccgttggcccagccccgcttccatccacctggggaccttataccctcgctgctgcagccacacctggatgcacctgctcccgggaaagctctgagcctagtgctccttgtgtgaggtttaacaggacaggctcagtggccactctgagagcccgcccacccggggaaggtgatgcacatgcagcctccagatggccaaatcaggcagcatgtctggcccaggtgtcacagaagccggggcaggaagagcctctggggccggatgtttcaccaggtctgggaggactcagtaaatattaaacagcccctggcatgccagacaagcttccagacgggcacgtgcaacctgccggccccagccctcacgtgaggttgctacagcagtccttctgcctggtgtggttggcagaggccttggtactcggctgttgcaagtgcaggctctggaggcagacagggccgggctcaagtcctgcacctgcccccagcctccaggcgggacaattataggactgactgcacaggcttcaggtgaagactccatgcaacaaggacgtgagccaaccatttacccaggtgcctggcggtgctggccactgggtgatgatgacaggcatgcactcggcacttgccaagctcaaattctgctctcagtgcttttgttttttttttttttaattgagacaaggtcttgctctgtctcccaggctggaatgcagtagcgtgatctcagctcactgtagcctccgcctcctgggctcaagtgatcctcccacctcagcctcctgagtagctgggaccacaggagtgcacaattacactcggctaattttttgtagttttggtggagacagggtttcaccatgttgcccaggctggtcttgaattcctgagctcaagtgatccgcctgccttggcctcccaaagtgctgggattgcaggcgtgagccaccacgcccgcctggcctgctcttggtgctttacatgtatggactcatttctcctgacacagtctttgaggtcaggccccctggtaccgtccaggaaactgaacttgcatcactcgcctctggctccagagtctgtgtgcttgacagcttcacaggcagggctggatatgagccgcctctttctccagcctcctctccttgaaacttaatggctgctatttcgttttcacacccacacttcttagccatcccaacagaggaattcccaagctgaggaggatgtcccagtggctcctggctcggggagtacctgcctgactgcctgggggagggagacctggctgaggaggggcaggaaagggggaagggcaaccatgcctgtcaactggggcagagtaggacagtatcggggcctggccctctcctccttcatcctcactgtttatcctctcatctctctatcctcccaccccccaggtccagctcttgggaaatggccttattatgtcaatcattcacaccttagtataaaatttccccaccaggttacttccccaagtgagccatctgactgtggagtaaaaatccctgtctatagtgaaaggggtttcaaggtgccagagtaggggtcaaggtggtgatgggaagagaaggggcatcagcccaccctctccatgcagagccctgccctcctgccaggttgtttgccttgacagtgcggctgcgcttcggcctgctcgggttaccagggaacaaggccagaaggtggggcctgaaacccaatcaggctccagccctggctccaagggttcagaccccagggagctcgacggagacaggaagttaaaaatagatgcaccgcttccccgtcggtgtgggcagcttcttccttgccctcacacaagggggcggcagaggccaaggccaggtgggggctgcccagggacctccgaaccagcccaggcccagcatcctctggcatccttgacaatcagatgggggacaggaggggtctgagatattagagccatcagggctgtctttcctagactaggacttggacactgtgggacccttgctgacggccagcgagccctggtgtcaaggggatggatcacctctgtcctccttcctcccaaagagctgatcccaggaatccaggaaggggccaacgagaggcagaggcctaccgtgggggcactctctgggcagagctcccctctagggcctgaggggacatgtcccatggatgcaggacattcagaggcccccacaggcctggcaggaggagagctgcaggcagggccagttgtgaaatttgtggggtctagtgcgaaataaaaatgcaaggctctttattcaaaatttatcaagaattttgggccaggcgcggtggctcacgtctgtaatcccagcagtttgggaggccgaggtgggtggatcacctgaagtcaggagttccagaccagcctggccaacatggtgaaaccctgtctctactaaaaattagctgggcatggtggcacatgcctgtgatcccagctactcgggaggctgaggcaggagaatcacttgaacccggcaagtggaggttatggtgagctgagattgtgccattgcactccagcctgggcaacaagagcaaaagtccgtctcaagaaaaaaaaaaaaaaaaatagccagtgtggtggcccatgcctgtagtcccagctactcaggaggctgaggcagaagaattgcttgaacctggaaggtggagcttgcagtgagcctaaattgcaccactgcacacctgggtgacagagcaagactctgtctcaaaacacacacaaaaaaattgtattaagaatttctatttggtgccaggcacagtggctcacacctgtaatcccagcattctgggaggccgaggcaggtggatcacctgaggtcaggagttcgagaccagcctgaccaatatggtgaaaccctgtctctactaaaaatacaaaaaaaaaaaaaaattaactggcatggtgaggcacacctgtaatcccagctactcaggaggctgagacaggagaattgcttgaactcaggaggcggaggttgcagtgagccgagaatatgccactgcactccagcctgggcaacagagcgagactctgtctcaaaagaaaaaaaaaaatacaaaaattagccgggcgtggtggcacgctcctgtaatcccagctactcaggaggctgaggcaggagaatcacttgaacctgggaggcggaggttgcagtgagccaagatcgcgccattgcactccagcccgggcgagagagagaaactgtctcaaaaaaaaaaaaattttgggaggctggggtgggaggatcatttgaaccaaggaggtcaatgctgcagtgaatcgagatcgcaccactgcactacaacctgggcgacagaatgacacccacaaaaatttctagagcacaacagcagagcgttcaatcaaagtacagagcacaggctacacgctcatgaagccgcccttgggtacagggtctgcagaccctacccctccttccagaccacacaagggtccctacagtgcttcagtggaccagccccactccagggcacacagctgggagagggtcacctgggccggatggccccctggccaggtaacccgcacagctgaccttcccagccttgattacagacccctgcaagaaagtgggggactctgataaagcccaggaagaggcagctcagaaatggttaagttgagaaacagcatcatttcctggccggtttatacttaaccccctctttgcagcacttatggagtgcctgctgtgtgcctttctcaggcagcacccactctttctgttctctgaggcttggagttggggcactgagcactaactgctctggagcctgggtcaaattcttctcgtcttggggcatcaacttaaacccttcccaggctcccctccactgagaatgtgtctcaaggcctcactgcagcccatgaggctccgcagggtcctcctccctccctgactgctgtcacgcatgccagccgcacacctgctttctgtcccttaaagctcattcccacccaggacatctgcactcgcagctgcctcccgccgccgaaggcttcccggcccacccccatctgcacacgcgcagatccacttcttctgtcccttcctgcctccactccccatgcccctgtctcgtcaggctctcccaggagaccatgggtgccctcccccacccccagttcagttccctcacagcactgccaccagctggatctgtctcaattatcactggcttattgtttgctgccatcagctcccaggacagcagggcctgggtctgtccccagagcccaggacagggccagagtaggtgctccgtgaatatctgctgcgtgaacagggattcctaaggtgcttccagctgggacactccaggatcttaaccctggggtcccggcaccaccacccatgggaagggagcccccagggaaaggttagtgagctgggagggctgacctcaggggggtggaggtggggtcctatccccgcagcaaatgcccctgggaaggagctcagggagcacacacaggagggacctggcctggtctggagctcaggggtcctcccccaggacctagcaggaagccaatgcctgcaggtgattcaacgggaactggaggtggaggagtggggtaggagctccagcgggaggacacacatgtgctgaggccctgaggccgggaggggagggaggtaggctgctggggccaggtcccaggggcctctagccaggagggcgctgggtttattctaagtaggttgggaatctttgcagggtttcaagtcggggaagagcatggtgggattttattgttgactgactcactgacctactgagttctgcactctgctctggctggggaccccgacctgtccaccccgttggctcagacagacagaggtttggccccttcaggatgtcgataaactgccccagtccccaggcctgcctgctcgtaaatggttccctgggggcttgcacagtgcctggcatgaggccctggagcgagggggcagcaggcctgagctcatcgggctgtggcctccagaagcagaaacaaccttcctcccagggacttagtacctaaagccggaggagacacaggacggggcagcaggcagggcctggcccggccagcacccccagggaactcagccacagggtcaatgctgccccccaggcccatctgtgccaagcctgctccctcatccggtaaccccccacagcaccagctgcaccggctgctggccctgcctccctcgtggttccttcccgacagccccgtgagcagggtgcacccacaattcccattgttcagatgaagacaaggctgaagaggtgaggtcacttgccccaggtcacagagccagaagaggtggccccattgcctagtcttccagacaggaagaacattccttcccaaccccgcccgtggaagacccaaccctgggccagttttgctgtgtgaccttgggccagtggctccacctatctgagcctctggttttttggtttttcttttttggtgtttttgtgggtttttttgagatggcatcttgctctgtcacccaggctggagtgcagtggtgtgatctcggtacactgcaacctccacctcctgggttcaaataatcctcccacctcagctttccaagtagctgggattacaggcatgtgccaccacatccaactaatttttgcatttttagtagagacagggcttcaccgtgttggccagggtggtctccaacttctgacctcaagtgatccgcccgccttggactcccaaagtgctaggattacaggcatgagccaccgtgcccagcccaattttctggtttttcaaaaaaatttttgtagagattgggttgtgctatgttgcccaggctggtcttgagttcctgggctcaagtgatcctcctgcctcggcctcccaaagtgctgggattataggcgtgagtcactgtgcccagccagagcctcagattttttatctgccaagtggacctgctaagctcaggcagatcaacttctggagactttgaaatgataactgttcaggtttcaaggaaatgataggtttatcccaacactaagaaactctgtctctctgtctctctctcaatctcaatctctctctctctctctctctctctctctgtctctctcgggctgcaagccggcctgagagtgggccttcgggtctctggcagcaggaggaggatgaccctgcccttccccagcccattaacaagccccacccctgcaccccgaaacaggacacggggggaacttacgcgatcctccggctctgtgcactgctgaagcctgcgaaggaggcgctccggcccacgacccccacggcccctgtgtccccaggggacaggaaccgcaacctcaccgacatggtggtcacctgcaaggagaggacaggagagtcagcctggcatcaccatccagcgagtgccgtccgcaggccagccaccttccaccaacacctacagacctcacaatggccccagagtgttgtgggggctggtactgtgcccagctcacaggtcagcaagctgaggtcccatgaggttaggggacctgatgggggacagtgatgggaatggaattcgaacccaggtgtctgtactctgcactctgtgctcaggtccttagtgccgggcaatgctgcctcccagagcaaggggacagcacctcctgaacacagccctctcaccccccgagcttctcctctcccctcctccagccctccctgagcacctaacacaggtgaactctgcaaggcaggccaagtccccccatcctcaagggctccagcccagcagggaggcccacctactgccgaacagttacgatacagagtccatgctggagttatgggggtcccagggggaatctgacccagccatgaagaggcgcccaagagctgagtaggaaggctgacgtggggtgaaggggaagggtgtctaaggccgagggaacagcctgggcaaaggccaggatgcatgaggggacttggtgtcatccagaaacagcaagaagctcagtgggctaaagacgaggtcagagaggccggcagggctcaggtcccaagaggcattggtagccccaagcaggggcttggccttacaatggggcaagggtgactgggagccatgggagggctttcagcagggggtggaaaagtccaattcacatgaagccagactgctggtgtcaagggctgcttccaccccgatccattgcccagtctccgacccgccctgcaatggggccaaccccgagccctggctgtcttctcttttttccaaaccatctctagattgagaaaatgccaccctatcccttgggaatataggtcagcatcttccagcaagggcagctggaaagttctgcttcatatctaacctaaatctctgctgctacagtttcatactttgctcctttgccagggtggtgtcaatccaaggattccagggaccccattgcccagacaaaacctacgaaaaagctccagtccacctcatcttcctgcacgatgagacccccatgttccaacatctctttcccccaggggccaagtccaccccactacacctctgctcacttgggggtctctgcctggaaaaacttcctgtatcgagccacatctgcccagcatctactactgcacctcctggcagatctgtgcagcctccacaagcctcctcctcccatatatcccccaccccacagccccacatgtgccgtacataggaaagcttggcaacaaagaaggtggacctgggctcaaatcccaactgtgccactcaggctctgggcctcagtgatcacaagagtaaaaggggaattcagaaagaacctcccacggagactgctggaaggaccaaggaaagcatgtcccgagagcccacagtgtgcaagagacatgtcggaagagctggctgtctctgtgcaattggctaagaccccagctctgcaggtgagccaggtgacccagataagccaggtgacccagggagagccaagtgagaagtgagcggcttctagcccggatggaggaaggtggcaagcatttgctgaccactcgctgtgtggcaagcctggtgccccatgagtggctacgaatccatgaacagctatgaacccatgcccagcagtgctgtgtacagatggggaagttgaggcatcattcatcaagtgctcattactaagctggccctgcactaaatgctttatgtaaattatgaaatccatacaaccctcttaagagcaggagcttttgatgatctaattccatagatgaggaaactgaggctcagagaggtgatgagactagcccaggagccccagcagggcacctgagcactgggtttagaacccgaggatgcccgatgtcagagcttgtcttacctgcggtcaggagagccttgcactggggccttgcccctgcccccataaagaggtcccctacagtcccctcctgtgctgtgctgagccagcttgtaccagctcccaacagtcaactgggccaggcacagtggctcacacctgtaatcctagcactttgggaggccgaagcaggcagattgcctgagctcaggagttcaagaccagcctgggctacatggtgaagccccgtctactaaaatacaaaaaattagccaggcttggtggcaggcgcctgtaatcccagctactcgggaggctgaggcaggagaatcacttgaacctgggaggtggaggttgcagtgagctgagatcatgccactgcactccagcctgggcaacagagcaagactctgactaaaaaaaacaaaaaacaaaaaacaaaaaatagtcaattgttaaatgttcaggaattttgtgagcctgttgacatcacgttggtggtttgaaatcagccacagtaaacgtatttacaccacagaaagcggcaagttctacaagttagggtttctgtctgctggttgttaaacacgtatgagctcctcactgctgttacccctatcagcacctatgcagggcctgagaagctgctcaaactgcttgatccccccagccaagccaggcaagagaataaggacggagtagggagggattcccaaaggtgagtagttgagacgtactccggagccagcctgggcactggagccggaaggggcttccccggcccctccctctgcaccttcccatcagaagccttctgggccgttcctggagcttcaccccagtcactccacttcaaggtcagagagaaggacaattgctaagcagttcctcccgatgcaaagctcaaaacaagccccaggtcctcctgctcagtgtgagagagaggacgacgaaggagggaaactaaggctcggagcagacctgcagaacctgacagcggattcatcactcatagcactgtgaggttcaatggccccatttttcatatgaggaaagaaaggctctgagaggtgagaggcgactcagggacacacatatttctttctttatttccttttccttctttctttcttttcttttttttttttttttttttagacagggtctgactctattgcccaggctggcgtgcagtgacacgatctcagctcactgcaacctccacctgctgggctcaagccatcctcccacatcagcctttcacgtggctgggactacaggcacacaccaccattcccagctaatttttgtattcattgtagagatagggtttcgccatgttgtccaggctgttctcgaactcctgagctcaagcgatccacccacctcagcttcccaaagtgctaggattatagccgtgagccaccgcgcctgaccaggacactcatttttcaaactgaagtctggctcttccttcttccacgtgccatggccacatggattggcttcctggctaaaccctcctcatctttcagcccagatgtcccctcccccaggaagccttcctggacacctccccactcctagctgtgtctggtgtttcctctggatgcccctgacctcctctgttatagtggactgtgaatggtgacttgtctatctctccatcctagacagggagctccctgcaggcagggaccaggtgcatggaagattcataacacatctttattgaaccagaaaacaatgaaggaaaggttgacgctgcttcccctacttcaccaggctgtgcagcccaagaggaaggtgctggaataataacagtaatactaatactaataaccactatgtgctagactctaaggcaaagatggacaaatgttttctgtaaaaagccagatagaaaggctgagcgcagtggctcacacctgtaatcccagtactttgggaggccaaggtgggtggatcacctgaggtcaagaattcaagatcagcctggacaacatggtgaaaccctgtctctactaaaaacacaaaaattagccgggcgtggtggcgcatgcctgtagtcccagctactctggaggctgaggcaggagaatcacctgaatccgggaggcagaggttgcagtgagccgagatcaagccactaaactccagcctggacaacagagctagactccatctcaaaaacaaacaaacaaacaaaaagccagatagtagatatttttggtttttcaggccatacagtttttgtcacaactactcagttctagcattttagagcaaaaccagctgcagacattatgtaaaggaattatgccatggctgtgtttcagtaaaactttatttacaaaagctgcagcagctgttgaggatgatgggtggccctgcctctgacccttgggtagccagcactgcctgctacctgctctgaggacttaaaattctcatttcattctcccaacaccatatgagacaagtactattactatccccattttgcagataaggaaaccgaggctcatgccaggcgtggcgactcacgcctataattccagcactttgagaggctgagatgggcggatcacttgagcccaggagttcgagaccagcctgggtctcatagtgagacccggtccccacaaaaaatacaaaaattacccagatgtggtggcgtgcacctgtagtcgagctactgcggcaggctgaggtgggaggatcattagagacctcccagcaagtcgaggctgcagtgagctgagactgcaccactccagcctggctaacacagtgagaccctgtctcaaaagaaggaaaggaaggaaagaaggaaaggaaaaaggaaaggaagaaaagaaggaaaccgaggctcagagaggacggaaatgagtcctccgaggtcacacaggtaggaaatgccagagctgaaactggaccggggcgcgctggactccaaagcctggcttcgggactccgctgtgcttgctcccgcagctctgctgaggacacgcccccctcccaggagccagacctcctccagcggggaagaggccccagaatggaaataggattgggagggggacctgccaagctagaaagatagccctgggtggtggccgagaaaaatcaagcccaacctcttttggcttcagggtgttgcagccccagcccctgtgggcccccttggggcctgcggaccgcgacagttcccaggcagctcagctgcgccccctcccggctgggcctggtggggctgatccatgacgttgacttggagtccagccaagcagtgtttcttgtggtaaaagaaacagacctccccctggatgattggggatgggatggccaggctgagacccacaatctcaggagccttcagcggacagctcctgacaagtccagtttgtcacctgcgaccaagggtgacattcctgatgtttaagcaatggcacagcagcaaatggaggctgggtgctggagcagggtcttgaagaccctgtcccctcccaccatgtgtcaccacccctgctggggctggcattaaccctttagctactggattgtgggcaggtctaggaggtccctggggaggcatcaggaagagaggaggaatgctcgggtggcttagggcagccctgggtaaccagcactctgcaggcatgagagacagtgcagagaccctgctgggccccagggcagagaagggaggcacagagtcatgcagttcccaaacctttggtggcagacaggacagcctcttctactccgtgtccctcgctgcctctctctggcctggcacttagaactgatgccgttcagacccggctggtgtgtgcagggagaggaagccagatgctcccagacactggggactgtcctgggcctccgtccccaaggtgtggctggaggaagcagagtctactcccgctaagtctgtccgctcactgctggccaaagctgccctgcgtctcctccccaccgccagccagagggaacctgcaatttcacctcatttagaggtaaaacatctaaatttaacgttatgggcttttggggctgggtggcttttatgcctgagtccctcacttagggctcctttttatccactcaaatgccagctagggcttagtttgtttataggagtttccaaaatagctcctttggtttcgcatgaaaggaaatggcaaaatagcccaggaagaggaatgtgagtttacacagaagacagacaggcgcccgaggaggcttctctgggaaccagttcgcctgtaccagagggggcccgagaaagtgtggagtccaacagtccaactcgctcattttaccgatgtcaagactaagcccaggatggtcacacaacttgcctggaccacccaaaggcgactggaagagccagaagaacccaaactactcctccctgccaaagcacaggcctcagctggagcccccctccagcctttgccctggctgtgtcctctgcctggcacacgcctcccttcccccaggtcttccctatcactctctcccagcttgcaggcctcacaaccaaggccacctcctcagagaggtcctccctgacccccttggctaacgtggacttgcccctcacccgtatccttcaaataactcatggttctgattgtcttattcatcagttaatcaagtatgcttctcaagaatcttcgctccagggagcagggggtttttctgtctttttaaaaaaaagtttttggggccaggcacactcctataattatgggctcacgcctgtaatcccagcactttgggaggctgagtctggtggatcacctgaggtcaggagttcaagatcagcctggccaacatggtgaaaccccatctgtactaaaaatacaaaaattagccaggcgtagtggcgggctcctgtaatcccagctactcaggaggctgaagcgggagaattgcttgaacccaggaagcggaggttgcagttagctgagatcacaccgttgcactccagcctgggtgataaagcaagacttcgtctcaaaaaaaaatttttttaaataaataaatacataaattattattattattatttttatagagatgggtcttgttatgtcacccaggctggtctcaaactcctggcctcaagcgatccacatggtgtgagccaccatgcccagcctgctggtttttaaagagcatatttaaatgaaaagagacaaatttaaaggacccttggtttaaatagagcaggttggaaccagcttcagggcagcccatggtcctggctctgccatcctccagaaccacctggagccaggaggggacacccaaggtgtctctgcagaggacagcggcctgacggatagacacacaatgagtgccctgatttgtgatttaagagaagaacaagcagctccttgggaagccccagtgtcccctgcgctccactgtcccaggactgcaggcaaagggacgcctcctgaccgcagaatagtcaacagcaggcacgggagtgaggaccgggatccagggaggccgcttccctctgtctatcagtctgcagccctgggtcccagctcactccattggggttttcccagataaagatgactcatgaatttctttgaattatccagagggcattttaattcaaatggccccatcactgcctcgtcaccactcccaccagccatgccaggggtcagccaggggtcaccttgaagacaaagcctctctttgggaaagaagcctttgaggccactgtggggtggctgtgtgtcggggcgccaggtgggaaggcagctggggcctgcccaggctagggaagagagcgtgggggtgtgggggatgaaggaagataaagatggggtagcgggagggagcgggggaagctgggcctccaagaagcacaggctgacttgggaatcccatctcaaacgtgcctcaccctggtctccagctgtaggagcagtgataaggatgaggacaggcaggagggactgagatgagatgagagcatttggagcctggagagagacccctgacactgagggagtgaggtgacctggtggtggctattccaggccaagcacctttgttcaactgtcaaaaactagaaacaggccgggcgcagtggctcatgcctataatcccagcactttgggaggccaaggtgggtggataacttgaggtcaggagtttgaaaccagcctggtcaacatggtgaaaccccatctctactaaaaacacagaaattagccaggtgtcgtggtgcatgcctgtaatcccagctactcgggaagctgaggcaggagaattgcttgaacccaggtggcagaggttgcagtgagccaagattatgccactgcactctagcctgggtgacagagcgagactccaactcaaaaaaaaaaaacctgaaaacagcaataatgccagtggtacccaacacggctacaggacttgtgcagtgccaggcattgctcaaagaattcactcattgaattcctggtacccaggaagtctggcctcaagcctgagctctgcccccgctgagcagaacccctctttctaaaccccggacactgggctggacacacagcctctcactcacccccacagctccccgggggcagggcactgttaccattgtacagaccaggaggctgaggctcgagatggagccacctgaagtggcaagttggtagcattgtacctccaatgactcaccaaaacgcctgcataaaaatccaggtgcagtggcactcacctgtagtcccagctacctgggaggctgaggcaggaggagcacttgagcccaggaagtttgaggccagcttgggcaacaccatgagccaaaaataaataaatacaatacaggtaaagtgcttgtgtataggcagtgtggtgcaggtgtgtgtacgcctgacctaggtcccaggagtgactaagggacacgcagagtggggctctccaatcagaagccctcactctggaattggttatgggagggtccctggacctcagcatgtaatgctttgctgtggaggctgtcctgtgtgttcagcagtgtccccacaccaggagcacagcctgtgacagcctggcacatctccagacactgccacacgtccctgtgctaaaggcatctcttcggacctgggctggagggttcattaacccgtatggtggcttaggcataattttccatgggcgaaatgagtagtattgaagacactatggtatttggttggctacagtattgctcgggcaccttcccctcacacgaacaggtgtgggactctggcagaccacacagcctgacacctacggagcggccctgggtctgcggctcccacagggcctctgccactccagccgtgacacacacacatgctgtcaccagcctaggatgtgcacaaagcctgtaggtctgagaccaaggacatgagcttggaggagctggctggattcctcagacctctggggcccgtttgccagagcagagccgagacctgcctgagacctgccttcattgcaaccctggccctgtggcacggctgcaagggaggagagaccgggtgaagggctgcttcccctttccatccaaaaacacacaaacaaaagacgcctgagcttggtgaacacacgcactggtcaggcttagctccatgcggggaggatgtaaattcaaacccaggtgggctgaactccaaagcactcttcggccaaccactggtcactggaatgaactgcccccaaccctctgtcatctcggggacacagaccctgcccccctccgcagggctggacagcagagcagcttccctctacaaaacggtcaaaaaggcaaagaaagacttccacaccctgccgctgcctgggagaaccctgagcttcctttctgcagtgacctctccattagacgcacaggcccacgcatgcgcccacgaacacatgtgaattacttctaggatcagaaggcaaaaaaatgttctttaggtcaaagaaaatgtgttattatataagagtaatgtattcattgttatagcaagttgtaatatgcacttcttttttttttttttttttgagacggagctttgctctttttgcccaggctggagtgcaatggcgcaatctcggctcaccgcaacatctgcctcctgggttcaagcaattctcctgcctcagcctcctgagtagctgggattacaggcatgcaccaccacgcctgggtaattttttgtatttttagtagagacagattttctccatgttggtcaggctggtctcaaactcctgacctcaggtaatccgcctgcctcggcctcccaaagtgctgggattacaggcgtgagccaccacgtccggctcacttctttttttttctgagagagagacagggctcactctatcacccaggctggagtgcagtggtgggatcacagctcactgcagccttgacctcctgggttcaagcgatcctcccatctccgcctcctgagtagctgggactacaggtatgtgccactgcacccggctaatttttttaaaatttctttagagacagggtctctctatgtggcccaggccagggtgcagtggtgtgatcatagctcactgcagcctccaactcctggactgaagcagtcctcccacctcagcctcatgagtagctgggactacaggtgtgagccccacacctggtcctatttcttattggaagggccactgcaggccaagatgctcggtgcccagggaagtcatagcacggccctgcccttgaccccttccagccatcctgggaatctgtccccagccacctccaggccacaggctccttccccatctcttccccacccaggagctgtgttacacagatcactttagcgtttcccacgctaaaccactgaaactgagggttttatctcccactctccttgctcccagttccgcatggccactggcctggctgagacagagccgctggaagtgcccggcaggacctctcacttgaccttcagcctcttacttaaccctcccaatgcagggcggtagcctccactgggtcctgttcagcccctactcctagaaatggtctggggggtaagggtggggccccctgcagagcccttggatgtgtgtttgcgccatggcagtagtacacccacccccttctgcttccgcagaacctggccggctcctccccatcccagggggagaggctcctcctgctcccacttccctcctttacatttggctactactcttaggggtggggctttgtttactttgcattttcctgattcctaatgagattaagcacatttccttaggtttaccggcttcccaatctcctcttctgggaattttcagtgcctattcctttgtccagttatctgccttcttcttcttgattgctgggagcggctgataaatcctagatgaccatcctttctcagttttctcccagcccctcaccttttaatcttaaattgttctctgtgggtgtgtgtgtgtgtgtgtgtgtgtgtgtgtgtgagagagagagaaacagggagagagatacaagcttcaaatacttatgtggccaaatccgtcacaggttttccttctgtgttttacaatttggaaactgctttctggtctctaagattaagttgctaatctgttaaccactggtgtttaattccctgggggagaagcttgtcttcccagccaggctgcaaagtcccccagggtatgtctccatctcccccctccccccatgaggccttagtcaagagattccactgctcctcagaaataccgtgaatttgtcccctccttcctgcctccacccctgctcgccaggaccaatctctgcctccctctcaccctctgccccacatgattaccacagtgatttaaaaaaaaaaaatccatcagaggccaggtgctgtggctcacgcctgtaaccccagcactttgggaggtcaaagcgggcagatcacctgaggtcaggagttcgagaccagcctgaccaacatggagaaaccctgtctctactaaaaatacaaaattagccgggcgtagtggcacatgcctgtaatcccagctactcaggaggctgaggcaggagaattgcttgaacccgggaggcagaggttgcggtgagccgagattgcaccattgcactccagactgggcaacaagaccgaaactccatctcaaaaaaaaaacccaaaaagaatagaaaaatgtccatcagggctggatgcagtggctcaagcctgtaatctcagcacttttttttttttttttgagatggagtctcgctctgtcgcccaggcggaagtgcagtggctggatcttggctcactgcaacctttgcctccaggctccagtgattctcccgcctcagcctcccaagtagctaggactacaagtgtgcaccactaggccaggctaatttttgtgtgtgttttttttttttttttagtagagttggggtttcaccatcttggccaggctggtctcaaactcctgacctcaagtgatcctcccgccttggcctcccaaagtgtggggattacagctgtgagccaccatgtctggccaaatcccaccactttgggaggccgaggtgggaagaccgcttaaagccaggagtttgagaccagcctgggcaacacagagagacccatctctacaagaagtgaaaaaaaaagttgggcacatgttctcaggaccccctgaggctatgtcttgggtcatggtcactcataaataaattgttttaattaaaaataaatgttgaaaaattagctgagcatggtggtatgtacttgtagtcccagctaaggcaggaggatttctttctttctttctttttttttttttttttgagatggagcctcactctgtcgcccaggctggagtgcagtggtgcaatctcggctcactgcaagctccgcctcccgggttcacgccattctgccattctcctgcctcagcctcccaagtagctgggactacaggcgcccgccactgtgcccggctaattttttgtatttttagtagagatggggtttcaccgtgttagccaggatggtctcgatctcctgacctcgtgatccgcccacctcagcctcccaaggtgctgggattacaggcgtgagccaccgcacccagctgggaggctaaggcaggaggatttcttgagcccaggagttcaaggctgcagtgagccaggattgtgccactgcactccagcctgggcaacagaatgagaccacatctctaaaaaaatttaaaaataaataaaaaataaaaatgtcccttagtttgtcactatattgcccaggctggtttggaactcctggcctcatgtaatcctcccagctcagcctcccaaagcgccgggattacaggcataagccactgcacctgaccccaaccgaaaattcttaaggcacatttttgacactaaaaacagtattttataactgctaaaatagatatgttaattctagtcttttcttgtgcacagaaacaaattaccactttagtttctcaaggagcacatgtatacatgttaaatgcattaatttgtttaatataaacatgaaatactttttataacctggattggtacatatttcttttcttttcttttttttctttgaggcaagatctggccctatcaccaggctggagtgcagtggtgcaatcttggctcactgctacctctgcctcccgggctcaagcaatcctcccacctcagtctcctgagtagctgggactacaggcatgtgccaccatgaccggctaatttctgttttgtttttttttgtttgcttttttttttttttttttttttttttgtagagacggagtttcaccatgttgcccagactattctcaaactcctgggctcaagcgatcctcaacctcaacctcccgaagtgttgggattccaggtgtgagccactgcacccagcccttttatttattttttattttttattttttttttttgagacggagtttcgctcttgtcacccagactggagtgcaggggcgcaatcttggctcattgcaacctccacctccgtggttcaagcagttccccggcctcagcctcccgagtagctgagattacaagcacacgccaccaagcccagctaatttttttgtatttttagtagagacagggtttcatcatgttgaccagcctggtctcaaactcctgacctcaggcaatccgcctgcctcagccttccaaagtgctgggattacaggcatgagccactgcgcctggcccccatttcttattatacagtagtttacaaaaaaatcccagcagccagctccagagaggccttgttctgtggtgtctaaggatggagcccaggcagggacggccaaaagctcgctacccctgcccaggaaggcaggagcaccgttgtgtcccgttcctatccctcaaaaataaatcacagccagctcatgtcataggacagagcctgttcgcaatccatcctgtgtctgcggattctcccaggtctgtaaggcagcagggagatgcggcctctcccactccacccaacacgtagccagggcgaggtggggccgggggagaggctgacattcaaaggcatctgagtggtaagaggtgagcgagtgaggtgaatggggactacgttagaaggaccctacgttagaagggtgaggcgctagggccatagcctaagggcactgggaaccctgtgggcatgcgcagttcaagcccatccccgctccctccagctgctgtccatccctgccacacctgaccatttgcctaacctagatccttcctgtcttgcatttcctcaagcatccggagcccaggactgctgagtcaaccctctggaatgcccacaactccccacaggccagccggccttgggactcccgcacagccacgtgagccggtggagccgggtctgtttgctagtggaggctgttaacagcacgggaagtggtcaagggttcaacaagagatgagccatctggtcctccagaggtaaacaatttacaagagacacatcaagccggcctgctgttctggtttttcttttgacagtgaaatatgcagtttctttttcatcctggtgcctattggagagggagactgttccaggcactctgaccccagctaaagcgcctccctggggcaggatctatgcagggaggcagaaaagtcagattttttttcacatcttctttgttccattcccaggactgagcaacttcatgtatttatgtatttatttatttatttatagacaggttctcactatgtcgcccaggctggagtgcagtggtgcggtcacagctcactgcaacctcaatgtcctaggctccagtgatcctcctgcctcagcctcctgagtagccgggaccataggtgtgtaccaccatgccaggggaatttttgtatctttggttagagaaagggttttgctgtgatgttgcccagtctggtctcaaactcctgagctcaagcgattcaccctcctgggcctcccaaagtgctgggattacaggtgggagccactgtgcgtggcccaggactgagcaactttaagtcagatggttaacctacatcatgaggaaagtggatttcctcccaaaggaacagacttattttctagaacccaaagccttgaatttcaagaacctttagccttaaatccatttcctgttggaagcagaccccctcctggtctccccaggtattgcaaccctgctctaccagccactataaatgcccacacaaaaggaacaggggctccattcctgatgctcagagtggagtcactagattctcaagcatatgagatatgtatgtggcctaacagcctgaaataaacagcttgtgctgggattgtaattctagagtttccaaaagtgttgcaaaatattccaggcagacactaaagtttgtgtactacaagctgtttattaattaatttcttatttgccaaacattcttgcttgggtctactgggagatgatttcgttgggaatgcatctccaattttgtaataaagatcaccagggaaagaaggcttgcttcataggggctcatattacaggaaatgtggctagcataggtagttcccataagaaaaaggacagtactaagttttgagctcatgtgaaaaagaaaagggggccgggcgtggtggctcacacctgtaatccgcactttcggaggccgaggcggacggatcacttgaggtcaggagttcaagaccagcttggccaacatggcaaaaccctgtctctattaaaaatacaaaaattagccaggcgtggtggcggacgcctgtaatcccagctacttgggaggctgaggcaggagaatcacttgaacccgggaggcggaggttgtagtgagccaggatcgcatcactgtactccagcctaggcgacaagagcgaaactccatctcaaaagaaaaaaaagaaaagtgacgtctggggaccaggattttgggactctttgcagacatgccaataacctgtgagatacacacccacagactgacacagaggtgagcagaggccttggagtcaacagaagttcaagtctagcctttgcctcattctcttttttttttttttttttttttgagatggagtcttgctctgtcacccaggctggagtgcagtggcgcaatctcggctcactgcaagctccgcctcccgggttcacgccattctcctgcctcagcctcccaagtagctgggactacaggcgcccgctaccatgcccggctaattttttgtatttttagtagagacagggtttcaccgtgttagccaggatggtctcgatctcctgacctcgtgatccacccgcctcggcctcccaaagtgctgggattacaggcatgagccaccgcacccggccacctcattctcactatgtgaccttggacaagtcacttatcctctttgagcctccagttcctcatctatacattggaagccactgaaattatcttacagttactttcagttgcgaggacttgctctttttctcttcattaaaaggaaaacacaaaatataatttatagcttatcctaccactttgtgctgctaaggttaaaatccagggtagtggccaggcgcggtggctcatgcctacaatcctagcattttgggaggccaagacgggtggatcacctgaggtcaggagttttagaccagcctcaccaacatggagaaaccccatctctactaaaaatataaaaattagctgggtgtgttggtgggcacctgtaatcccagctactcgggagactgaggcaggagaattgcctgaacctgggaggcagaggttgcagtgagctgagatcatgccactgcactccagcctgggtgacaatagcaacactccatctctaaaaaaaagaaagaaaaaaatccagggtactctatggtttcctggggctgctgtaaaaaaaaaaaaaaatactacaaactgggtggcttcaaacaagggaaacttattgtcttgcagttctggaggttagaagtccaaatcaaggtgtcggcagggccatgctccctctaaagcagcggtccccaacctttttggcaccagggacaagttttgtggaagacaatttttccactgaccagggtgggggttgggtgggtggttttggggtgattcaagtgcattacattcattgtgcactttatttctactactacattgtaatatataatgaaataattatacaactcacattccataatgtggaatcagtgggagccctgagcttgttttcctgcaactagatggtcccatctgggggtgatggagacagtgacagatcatcaggcattagattctcataaggagcatgcagccgagatccctcgcatgcgtagttcacaatagggttcgtgctcctgtgagaattgaacgcctccactgatcagacaggaggtaacacaagcaatggggagtggttctaaatacagatgaagcttcgcttacctgcctgctgctaacctcctgctatgtggcccagttcctaacagaccatggacaagtacaagtccatggcccaggggttgggaacccttgctctaaaggatctaggaaagaatccttccttgcctcttcctagcttctggtgatggctaccaatccttggcatttctggtcttgtagctgcatgacgccaatctctgcttctgttgtcccatggtgcttcccagtgtctctgtcttcacagctcttcctcttcttataaggatatgacggtattgaattagaggcagggcacaatggctcacacctgtaatcccaacactttgggaggccaagatggacagatcacctgaggttaggagttggagaccagcctggccaacatggcgaaaccccgtctctactaaaaatacaaacattagccaggggtggtggtgggtacctgtaatcccagctactcgggaggctgaggcaggagaatcgctcaaacccaggaggcagagtttgtagtgggctgagatcatgccattgcactccaacctggctacagagcaagccatctcaaaaaaaagaaaagatgtaggcccctgggaaggatgcctggcacactcagaggtgggacaatggtgacagtcctgacactttccctctggagagcatggacccctggtcttggccatgcagccaggcctggcccagcctgcctgtcccccacccccacccacagggactgggcccttcctgcccaggaactattctgattctgcagccctcaggctttattgcttttcctgcttaatgaggtgaggttcgctcagcccagtggcaattcctgtaaaagccatttggatgacccaatggggtgagtttacagggaagcgctccctgagggctaggctggctggaagcagatactttgcccccttccaaggacggtaatgaggtttgaggcttccaatgggggcaggggatgatctgggcgccaaaagccctggcctggggtcaaaagatctgggctccagccccagccgggctaactaggcagtctcctgtctgagctgtactcccctcatgggtgaaatggggatacaggcacatactttatagcctgcagtctgtgtgtaacagagaaccataagctggtgggtcggggagtggggctgggggttatttctcatggttctggaagcgaggagttggagatcagggtgactgcatggtaaggttctggtgagggccctcttccaggttgcagactatggtcctctcatttcatccccacgtggagggaagaggcaagagaacactctggaagttataagagcactaatcccattaatcccattcaccaggcctccaccctcgagatctattcacctcccaaaggccccacctcctaatcacagcacgggggtttgggttcaacataggaatttttttttgagatggcatctcacacagtgttgccaggctgtagtgcagtggcgcaatctctgctcactgcaacctccacctcccgggctcaaacaatcctcccacctcagcctcctgagtagctgggaccacaggtgtgcaccaccacacctggctaactttttgtacttttagtagagacgagatttcaccgtgttgctcagattggtctcaaactcctgagcttaagtgatttgcccacgttggcctcccaaagtgttgggattacagatgtgagacaccacatccaacctcaacatatgaattttagagtgacccaaacattcagtccatcacagtctcctgcaggattacagatgtataatcagtctgtaatccacaaagttctaagcaaaggaaaagaagtaccaatatcactattgctattgttattatcagcacccaagaccttccccagtctcagtgagtggaatattaagatgatcccaaagacgctcgacttctctaacccgtaatactcacaggttccacccctttgattgtgggcagaacctgtgaatattatgatctgactgccatggttaccttatatgacaaaagggagattagcctgggtgggcctgacctaatcagagagccctcaaacaggactggctttttgttttttgttttttttttgagaccgagtctcgctctgtcacctagactggagtgcagtggcatgatctcagctcactgcaacctctgcctcccgggttcaagcagttctcctgcctcagcctcctgttggctcttactggccaaggagattcaaagtatgagagggattcagcgtgagagagattttccattgcaggctttggaggtgaaggtggccaatacaggaggcctctagaagctgaaagcagccccccagtgacagctaggaaggaaatggggacctcagtcctatggccacacggaactgaatgaccttggaagtggatttgtccccagatcctccagacaagaactcagccggaccaacatcttgcatttcagccttgcgatgagcagagaactcagccatgccagactctggaccaacacagctgtgagctcatacatggatattgttttaagctgctgggtctgggatcatttgttacacagcaatagaaaaccaatacatactctgtcaaggaagcctgagaatggaaggcccctactcaatctaccctcccactatagtctggtggttagagacaagggctctggagtcagatggaacggtgttcgaatcttggcaattccatccactggctgtggaacgttgtccacactcccttcctcacctcttatatcctcggtttcctcatctgtgaaatagcagtggaaataaaatgcatggaaatcatcagagcagggtatgcatcgtaaggacacatagtaatagctcaagaaacactgtatatgttaaacattagaaacgagctgagaactaacaccaatgcacctgtgttcttcaatgcactgcctacacaccagagaagagggggaggagcccagatctgctgctctgggagctacaggccaattagggaatcaggaacctgaacagaaaaccacaacttcagggaaagtagatggtacatgtgttatgttattgtggacatggcggggcaaagacaagaccttaggtctttgaactccccctcggagtctggcacaggcctgagtggagctccctcctcaagacttcctttgcactggcttccctgaggaagcatttgcatttagggttctgctgtggaacctctttctcttgatctacatgaagcctgaggccaaggccttacacctgtaagggaggaggtggccctgggcccaggaaaagggtgggtccagtctcccagttctgtccctggcatgtactctccccaggcctatcccacccccaagtcctcccaggctccaaaccctgaggccccaccgactgtcactcaagaaatcaccgaggctgggcatggtggttcatgcctataatcccagcactttgggaggctggggcaggtgaatcacttgaggtcaggaattcaagaccagcctggccaacatggtgaaaccccatctctactgaaaatacacaaattagccaggcgtggtggcgggcgcctgtaatcccagctacttgggaggctgagacaatagaatcgcttgagcctgggaggtggaggttgcagtgagccgagattgcaacacggcactccagcctgggcgacagagagagattctgtctcaaaaaaaaaaaaaaaaaaaaaaagaaaagaaaagaaaagaaagaaagaaaagaaaagaaaaaagaaatcaccaagccctctctatacccataagcacagccttgaccgaagtcctgacggctgagcatgcagctcaaatccctggggagataccactgcacatacacgagggcggtcgtcatccaaaagacagaccacagcaagcgctggagaggatgtggggcaactgaaaccctggtacgctactggtgacatgtaagagggcgcagctgctttggaaaacagcttggcagttcctcaaatggttaagtatgaaattaagcaaatggttaaatgtaaatacgacccagcagttccactcctaagtatacatccaagaggaatgttaacatatgtccacgcaaaacccatacacagacattcagagcagcattactcatagtagccaagaagtaaaaacagctcaaatatttatcagctgatgagtgggtaaacaaaatgtgggacagccatacaaagggacactatagggccatataaaagggaccaagccctgatgcatgctgtgagacagatgaaccttgaaaacggtatgctaagtgaaagaagccagaaccagcaggccacagaaggtatggctccacggacaagcaagtccagagcaggcaaatccagagagacagaaagtggatcagtcattgccagaagttgagggaggggagaatgggagtcattactaataggtatggggtttctttctggggtaaaactgctctggatttagatagtggtgatggttgcacagctttgtgaatatgccaaaaaaaagaaaaaaacactaaattgtatacttttttttttttttgagacagcctccctctattacccaggctggagtgcagtggcacaatcttggctcactgcaacctctgcctcctgggttcaagcgattttcctgcctcagcctcctgagattacaggcgtatgccaccacacttggctaatttttttttttttcgagacagggtctccctctgttgtccatgctagagtgcagtggtgccatcttggctcactgaaacctctgcctcccgggtttgagcaattctcccacctcagcctcccaagtaggtgggactacaggcatgcaccacccacttggctactttttgaatttttttgtagagacagggttttgccatgttgcccaggctggtctcaaactcctggagtcaaacaatccatccgcctcggatatttctcactggcataatcagtgctgaaagatcattgaaaaggggcttgcatgatccagaggtcactgttatttaatgcgctctcctcatctcctgcaggttgtgacttcaatataccctctcatgagacctttcctggccccttatctgtaagtgtgaccaccgggaccccgtctcccaattccctcttcctgctttatttttctctttagcatttaataccatctgacattccaaacattaccttgtccttgtctggtgtttgtcaccccaactagaagtgctagggggcaagtactaggaagcagggttttttctttttctttcctttttttttgagatgaaatttctctcttgtctcccaggctggagtacagtggcgcaatatcggttcactgcaacctccacctcccgggttcaagtgattctcctgcctcagcctcccaagtagttggcactacaggtgcctgccatcatgcccaactaatttttgtatttttagtagagatggggtttcactccgttggccaggctggtctcgaactcctgacctcatgactctcccaggaggcagagttttttttttttttttttttttttttgagatggaggcttgctctgtcacccaggctggagtgcagtggcgcaatctcggctcactgcaagctcccaggaggcagagtttttgtctgcgtggttcactgctaagtccccagcactaagaggacaggacctaacacataggaggcactcagcaaacatccatgaacgaatgaatgaatctgtatctccagtggctttgtcctctcttatatcagctttgttccacatcttacacttaggaggtgattcaattaaacattgctttttgtgtgtgtttggtggggtttttttgtttttttgtctttttgttttttgagacagcatctcaatcttttgcctaggctggtgtacagtggtgccatcaccactcactgcagcctcaacttcccaaactcaggtgattctcccacctcaactccccgagtagctgggactacaggcacgcaccaccacaccagctactttttgtatttttagtagagatggggtttcaccatgttgccatggctggtctcaaactcctggcctcaagccatccatttgcccaactaggccccccagagtgctgggattatgggcgtgagccactgcacccggccaaccattgttgagtgagcaagtaaatgaactcatcaacgaatttctccctgggtagcgaagctcccgctttttgaggtaacccagacttttcatttgtatgtttcctgagtccctgactgtacattcttcctgcatattgtctccaggactaagagaatggagccttttgccaagaagaggttgcgttctcaggcctccagtttagattaaatagtggttttacaaggggaaacaaagtgacaaacccccagaagttgtggggagctgagacggggtgggaatagggttccccagggacaaactccttcttgtccccctgcccagcgccccagggcacactgcccagtgggtgaaagcagccagacacacgggctcactgcagttaccaagcaatcctaagtgtatcaagatgggcgcgctgacgacagctgcaccgagtgaatctggaatgaattggggggttgttaagatcgccgacttaagcctcttctcacaggaaaaatatttatttcactgagctctgctttttggaaagctgcgcctgtaacagtctgcatcgatctagcagagttttggctactgctgggttttgtctccctcctgtctcggttagcgtgggctgtgtgtgtgtgtgtgtgtgtgtgtgtgtgtgtgtccacagcacaccctcccattattaagcaatcagccaaaagactcagccaggacactctgctcttctttaaccagaaaaaagatgaacacgaactgagttcgtggcatgaggcacgagaccttcatgttttatcttcaaagatgcctgcttgaaactagcaattgtttctttccctttttatctagtaaattgctccctctacctcctcccagtttgggaaaaaaatacaagtatgaagaagaaagtaaaaatcactcctatggttaggttaggcttgactgcagaattgtttcctttttttttctttttttctttttttttgagacggagtctcactgttgcccaggctggagtgcagtagcatgcgatcttggctcactgcaacctccacctcctgggttcaagcgattctcctgcctcagcctcctgagcagctgggactacaggcccgcatcaccatgcccggctaatttttgtatttttagtagagacggggtttcaccatgttggccaggctgtcctttccttttctactctttggagtcgaggggcctgggtttgaatcctagctctgccacttgctggctgtgtaaccctgagaatcatgtcaccacttggaacctctgtttcctcatctgtcaaatggtgtaataatagtgcctgcctctttgattgttgggaggagtaaacaagagaaagtatatatagagcttagtgaaggttcagcaacaataaatgcaaatggtacctattttataggagaaatatatacaattttttatcttctttttcataaaacagtatagcgtatacagtttcctgtttcactgcctcattttagaggcagagtcttgctgtgttgcccaggctggcctcaaactcctgtctgtgctcaaatgatcctcctgcctcagcctcctgagtagctgggattacaggcacccaccaccatgcccggctaatttttgtacttttagtagagacggggtttcatcgtgttggtcaggctggtctcgaactcctgacctcatgatccgcccacctcggcctcccaaagtgctgggattacaggcgtgagctaccgtgcccggccaactcacaagcatttctaatgactgcaaaatagtccattgggggcccatccctacattagtttttaaaccgtttcctatggatggaaatagaagttgcttccgaaatattataaagattgctgtgataaacacctccagactcaaatcttggtctatgtttgaggctctgtctttaggatgaattctcagaagttaaattgttggtcaaatagtatgatcacttccaagagccttgatataccatacttagcactgcaagttgctttcgagaaagattacctacagatgtgtatgagagaaccctgtggccaagcgaggtggctcatgcctatagtcccaacactttgggaggccaaggtgggaggatcacttgagcccaggagttcaagaccagccttggcaacatagtgagaccccatctctccacacacacaaagaaagagagaggctgggcatggtggttcacacctataatcctagcactttaggagacctaggcaggtggatcacttgaggtcaggagttcgagaccagcctggccaacatggcaaaacctcatctctactacagatacaaaaattagccaggcctggtggcatgtgcctgtaatcccagctacttgggaggctgaggcaggagaattgcttgaacctgggaggtggaggttgcagtgagctgagatcacaccactgcactttagtctgggcaacagagtgagactcttctcagaaaaaaaaagagagaaagagagagagaacccatcttaccacatcccagctgcattgaggattattaccttttagttgttgttaatttgacaggcaaaatgacatctcattcttaaatctgcattaaaaaaatttcacccagtatttttctaatactagttttattggctacaatgtgttgagtgtttactacatgccaagcatagggtaaatgtcttttacttttttttttttttttttttttgagagacagggtcttgcctgttgcccaggctggagtgcagtgatgcgatcatacctcactacagccttgaactcctgggctcaagggatctttctgcatcagcctctctcttaagtagctaggactccaggtgcaccaccatgcctggctaatttttttttatttttatttttttgtagtaacagggcctcggtatattgcccaggctggtctcaaactcctgggctcaagtgctcctcctacctcggcctcccaaagtactgggattacaggtgtgagacaccatacccagcctccataaaatgttttaatcaaacttctgggtatgtacccaaaagaagcgaaagcagggactctaacaaatatttgtacatctatattcatagccacattattcatcatagcaaaaaggtgcaagagacccaaatgtccattgacagatgaatggataaacaaaatgtggtgtgtatatatgcaatgagatattattcagccttaaaaaggaagaaaatgttgacccatacgacaacatggatgaaccatgaagacattatgataagaaaatatgcccatcacacaaggacaagtgatgtatgatccttttatatgaggttcctagaatactcaaattcagagacagaaatcagaatggttggactgagcgaggtggctcacacctgtaatcccagcactttgggagaccacggtgggaggatcgctcgagcccaggagtttgagaccagcctggacaacagagtgagatcctatctctacaaaataaaactttttaaaaattagccaggtgtggtggtatatgcctactactcaggaggctgaggtgggaggattgattagactcaagagatcaaggttacagtgagctgtaattgccccactgcactgcagcctgggaaacagagcgagattctgtctcaaaaaaaaaaaattataatcaatctttacatgttattttataagatgttattattaccctccagccttctttaaaagatgatgaaactaaggctcagagagatgaaacacgttcctagagtcacatagcttataaatggtgaagacaggtttagatgccaggtcttactctccaaggctacgttatcctgcaaattctggtggacctgggaggtaaaggggaaatacaatcaagctctaggtggcagatggagttagcaagtacccagtgccaaacggaactgttggccctgagagctcagagttcagttctaaatttattctctctgaccttattgtggattctaaatttggccaaacaagttcttccagaccgattagtgacgtggatacattgttttgaagataaaacccttttcctggtatgaaagaaaaaaaataataatgcagcatttgcttgcagaagccaccctgccgctggttaacagccatctgaaaatgattctgggttttccacctgatggtggacacatgtgcttgttggccgatttcttggggacagtgattaaaaccatttcctgaaccgaagtctgaatttctcctcctgaatgaaccagaaacaaaacatcaggaaatatccaggcatgaaaattctaaccagggccgggtgcggtggctcacaactgtaatcccagcactttgggaggctgaagggggtggatcacctgaggtcaggagtttgagaccagactggttaacatgacaaaaccccatctctactaaaaatacaaaaattagccaggcgtggtggcaggcacctgtaatcccagctactcgggaggctgaggcggaagaatcacttgaaccctggaagcagaggttgcagtgagccgagatcacaccattgcactccagcctaggtgacaagagcgaaactccgtctcaaaaaaaaaaaaaaaaaaaaattctaaccagaaccaaacttaaaattctcccaaaattacaaattaagaccaaaataggcctctttgggtggtttccaggccagggaggagttatggggtcctcggataatcaccagctgagtcctgacttctctgggaaggtattggggtgactgacctgtttgtgaccccttctcagacaccctatctccaatcaggtggaggaggcacgtgacccacatggtctggccactgatgactgaacaagctatggacaccggaccccggagagaccattcactcactggccacgaacatgagttcagatacatgccccaaaaggatgagcctgggtactggattccctccctcagaaacgtgaatcaagagacacaggatgttcctgttggtccagatacttgagctaaaaggtgatggatacctggatgtggggtggtcattctggggagtacgtccatatagaaagaggagcaggtgctgtgggattctggatcccagtgatagagctaagtggctggatcaagcttcacctgaaacccactctacttgtcttagtccattttgtgttgctataaaagaatacctgcaactgggtaatgtataaagaaaagagacttatttcattttatagctctgcagtctgagacatttaaagggatggccttgacttctggcaagggcttgcacgttgcatcaccacacgcaggaaaagggaaaacagaagggagactgcaaaaaaggggaaaacctgaaggtcatcatagctttataataacccactctcacagcaatgagttagatggagaaccaattcagtctcacgagagtgacagcaagaactcactcactggtgagagggtagcacttccaagccattcatgagggattcacctccatagcccaacacctcccactaggccccgcctcccaacactgccacagtggagatcaaattgcaacatgagttttggtggagacaaacaccccctatccaaatcacagcactacccccgaactttccattacacgaaccaaagaatcttcctttaaattagtgtcattgggttttctgggatttacctttttttttttttttttttttttgagacagggtcttgctctgtcacccaggctagagtgtagtggcacaaacacagctcactgtaggctcgacctcctgggctcaagggatcctcccacctcagcaccccccacctatgccctcaaagtagctggaactacaggaaccaccacacctggctaattaaaaaaaaaaaattttgtagaggccgggtgcggtgtctcatgcctgtaatcccagcactttgggaggccgaggtgagtggatcacctgaggtcaggagtacaagaccaacctgaccaacatggtgaaaacctgtctctattaaaaatacaaaaattagctgggcgtggtggcacatgcctgtaatcccagctactcgggaggctgaggcaggagaatcgcttgaacgcgggaggcggaggttgcagtgagccaaaatcacgccactgcactccagcctgggcaacagaacgagactgtcttaaaaaataaaaaaaaaaattgtagggacacagtttcactatgttgcccaggccagtcttcaactcctgggcttaagcaatcctcctgtctttacctcccaaagtgctgggattacaggcatgagccaccacacccagcctaacatgtttttaataaccaaaagaaaataaacatctccatagccttgtgacacatccttttttaacctgaaattggtagagtaggtttctgattcatagaacccaaacaaacattcctccctaaagcaggcagaggctctttgggagagtttactttcaaaacagtgtccctgcaagtcccaagtgacaagttcccctttcctggtctgaagcattctgaggagaggcaaagaggttaaggcttagctgcaggaacacgctgtccccacgacaaccccttctcagcctcggaactgctgttatcagagttgtgttgtctcttgaaggtccggacaaagggtgaagccaggactcctgagtctaaagggcaggtcggggcctgggagagaaggggaagctggcctggggcagagatatgttttccatttcccctggggtcccgcgcaggacagctgctgtccatagccagttcagccaaccgtgggaggaatcacattcactcgacaggcaggcagtggcggcactgggatttgaacatggggctgatgggctccaggcgtggcacctgtgccactacagtgcggggaagctctgactgctgcagcctccgttgtcgccacatctgccctcgaatttcccttccagctggttctgcaatcagcagcccctccagacatccctgggaggctccaaggagctgactcctgatgaggaaaaggatcagccgcagactcactcctcctccagccacttccagacccacgggaggcgtgggtgtgacccagactacctgggagcatctgcttttgtctttatccagggcaggaccctctgaaggaggagccctcagagaagaagggaaaagccaaaaggaattaaaagccaatttccaaatggaaataaataagcagtcataattggccacattggtgaaattgggcactaagggccaggcaatgggctgtgggataatgtcacttgaggcttacggccacgctcagaggaaggtgctgaggtccagggaggttcaggcaggtgacatgactcacccagagccactggctggagagtggcagggctagcttggagcccaggtggtggacttcataggtgcagccgtgactgctgtcatccctcccatggggagttgttgcagagagtgagacacagcgccctaagctatttctccatctggtgtgcctggatgcctctgcccacccaggaccctcctctcgggtggcccaccactgcccttccatcacagttcataccttctctcgtggacccacaggggtgtccactggaccaggaccccagggaggatcccagtcctggccccaccactctctggctggtgacacgggggaagtcaattctttccaagcctcagctttctcacctgtacaatgggagtttgtgctagacaagaagttttcaggacggacacagtggctcacgcctgtaatcccaacacttggggaggccgaggcgggtgggtcacttgaggtcaggagttcgagaccagcctggccaacatggtgaaacctcatctctactaaaaatataaaaattagccagattgtcatagcgcatgcctgtagtcccagttactcgggagactgaagccaggagaatcacttgaaccggggaggtggaggttgcagtgggccaagatctcaccactgtactccagcccgggtgacagagagagactgtctcaaaaaaaaaaaaaaaaaaaaaagttttcaaactgctgactgcacctgtttgtaggccctgagctcaactgagtgagtcacacaggtattcactgacgtgattctgcctccaaggccacattttctccagtgcacctctgtccttcagcaagtgacctgaggctgggactgccacatgctgcctcccatcagcaccttacccagacctactgctggctacaacgtgcttaatgattgtcaggtggctcacataccctgttctgttcggcttcacagtgtctgccagcccgtggagtatggcacagtggctactagccagggtcaggcagtgcgactccacctctccaagcgccccagtgcagcgtctgatcatagggaataactctacctgcttcacaggactattctgtgaatactaattaggataacatatgtgaaggtcttggcgttgtgagcacatgagcccaaggtcagctccctaaaatgatgaagttcatatcacaagaggcccctagaggtcaggacagcctttcggtacctttctatggcaaacaagcggctggttctctgccacctattttctccccttcattgggcaagactgagctggcagaataatggccacatcagtatttactctctactttctggcttccctagattggtgccagccatttgtccccccatccaagacaaccctgatccccatccccagaaggaaaacacctcacctctctcacaatttgagaatggctgtcaactcgagcacattattagatttaattgtatctaatacttgaatacctaatatattactttctctctctctctcttttttttttttttttttgagatggagtttcattcttattccccaggctggagtgcaatggcgtggtctcggctcactgcaaactccgcctcccggcttcaagcgattctcctgcctcagcctcccgacttgctgggattacaggctctcgccactacacctggctaatttctgtatttttagtagagacggggtttcaccatgttggtcaggctggtctcgaactcctggcttcaggtgatccacctgcctcgacctcccaaagtgctggcactataggcgtgagccaccgcacctggccccaatatattactttcaaggacaaaaactgcaattacttttgcaccaacctaatatttaaggtaggacaccgtgaagcccagtgagatctctgtggtggacaaacagcgtggctgctaggctgtgagccctcccgcctgtctgctctccatgctgtgcgccactcctgagagctgggtcagcagtcgcactgttggctttgctctgacctcgagtctatttcttttccatgtgtgtgtgcagccgctgcctggagtggaaatctccactgagggacagaccttctttcaaggctcacatcaggcaggatcccacgggaaagggggctggctgagtcaggagggttctctgcctgagttcccgtgtgacattgggcaaatcactcaacgctcagagctgcgcatttttatctccatctgcttggagcaggaattgcaaagagtttcagctcaggttccaacgccaaggtgggagatattggttgctttgggtatagtgttgagatagattctgaggctgtgtatgggctcactaggaaagggtgctgtgtctgccatgaagtgggaaatcggtgggggaagaaaaaagaaacccggctgggcacggtggctcacacctgtaatcccaacactttgggaggccggggcaggaggatcacctgaggttaggagtttgagaccagcctggccaacatggcaaaaacttgtctctactaaaaatacaaaaattagccaggcatggtggcgcatgcctgtaatcccagctacctgggaggctgaaacaggagaatcacttgaacccaggaggcagagattgcagtgagccaagatcatgccactgcattccagcctgggtgacagagcgagaccctgtctcaaaaataaaacccaaaaaacaaaacaaaacaaacaaaaaaaccccatggtgctggccgggtgcggtggctcacgcctgtaatcccagccttttgggaggctgaggcaggaggatcacttgagccctagagttcaagaccagcttgagcaacatggcaaaaccctgactctactaaaaataccaaaaaaaaaaaaaaaatgctggacgtggtgatgtgtgactgtggtcccagctactcaggaggctgaggcaagaagattgctggagcctaggcctgtctggctaacttggctctaccttggctcagagccccctcttcctttttttttttttttttgagatggagtctcgccctgtcgcccaggctggagggcagtggtgtgatctcggctctccgcaacctccgcctcccgggttcaagcaattctcctgcctcagcctcctgagtagctgggattacaggcacgcaccacgacactgggctaattttttgtatctttagtagagatggggtttcctcatgttggccaggctggtctcgaactcctgaccttgtgatccacccgccttggcctcccaaagtgctgggactacaggcatgagccactgtgcctgccgggtgggtttcttatggcgaatgatcccacaccacttttcagtgcacgtagttacatggagtagaacacagacagtcacacctccacgttcttttggccaccatgactggttcaaccaaggaatctgctccaagctaggtgaaggaaaatcagccctaaggccccccgtcgccacgcacctcactgtatccagctatacctaaagccaaaccgaatcccagacatctaaattttatgagccagtaaattcccttctttgcttaagccagtataaatcagggtcccatcccttgtaatgctgagtcccaaggcccagactctgggcctttcgtttttccattcaggccccagaatgaagaccaaggaagggtttattaacatgacagtgaacatctagggccttatatacatttttcttcaattcagccaagacaagaggcctagaatacagagaaaggacacccatttcttttcttttcttttcttttcttttcttttcttttcttttttgagacggagtcacgctctgttgcccagagtcacgctctgttgctggagtgcagtggcgcaatctcggctcaccgcaatctccgtctcccgggttcaagcaattctcctgcttcagcctcccaagtagctgggactacaggtgcctgccactacacccagctaaattttgtatttttagtagagatggggtttcgcctgttgctcaggctggtctcgaattcctgacctcaggtgatccacctgccccgacctctgaaagtgctgggattacaggcgtgagtcaccacgcccagcctaggacacccatttctttgtttgttttgtttgttttttgttgttgtttgttgtttttttgagacggcgtctcactctgttgcctaggctggagtgcggtggtgccatctcagctcactgcaacctctgctgggttcaagcgattctccctcctcagcctcccaagtagctgggactacaggcgtgtgccaccatgcccagctaatttttgtattttttgtagcaatggggtttcaccatgttggccaggctggtctctaactcctggcctcaagtgatccactgccttagtctcccaaagtgctgggattacaggcgtgagtcaccgcgaccagcctaggacacctatttcttcaaacataggaagaaacatcttatctgcatgatccctcctggggagctatcttacggtcttatgtgataaggtgacctctcctttgggtgagtggagtaaaaaagcgggcgaggtatctggaatatgcttctatccctcctaacctcccctacaaacaaagctttcctgaatgccttgtccttagcttcctggactctgaacctagcttggctaaattttctttttaaagcatcagcataaatcatgaataccttgggaagggaacattaaccatcagccggcaaagttaaaattcccctccagcccacttaaatggactgaaacctccaccccatccccaaacgagcctccctggccttgtccttgaacatttcaaaatcgggtttctgctttaagttctttaaactactttttttttttttttttttttttttgagagggagtctcgctctgttacccaggctggagtgcaatggcacgatcttggctcactgcaacctccacctcctgggttcaagtgattctcctgcctcaacctcccaagtagctgtgattacaggcacccgccacaacgcccagctaatttttgtattttcagtagagacggggtttcaccatgttggtcaggctggtctcaaattcctgacctcgtgatccgcctgcctcggcctcccaaagtgctgggattacaggcgtgagccaccgcgcccggccgctgctttaagttcttaacacgtcctcaccgcggctcagctcactgtacggcccctgcatagagaggggagggcaggggccatgatactgaactcacagctctgggcatttctgaagtctggcccttgaagcttttcctagagcaaattgttttcttctccccttcaggaaactgaaaattcacacagcagccgtgggagtcagagtagcaaaggctttgagatcacatagacctgggacacgtgcttgctttgtgattacgggtaagttccgtagcctctctgagcttccatttctctttctgtggaaaggggatactaatactgcccactgtgagggctgtttctgagattccatgctgctgtgactagcatctgcctgactagcagaggatagttacagtgtcagcgtccatggccctctcatgagactggggcagggggtgggaagggtgtttgggacaccctgggaaccttagcatcattctgccatgggagtatgacctgctgttccctggctgccctcagtctgaggcttgctctgccagtcccgggagaactgtccactcatcatcccggcagagacagatctctttttcgctgtgcacaggtggggaaactgactctgcccagtcacctgagtctgttgacagaggcacctggccatctgtatcctggtcctcagctctgagaccagcaggaaagagaggaggacattcctaatgggggacacagtgaccttcctcctcctgcccctgatgctcccaccactgtggtcccctggtggtgccaaccactcagactccagaagctgagtcccctctcagtcccatgaacaggcaaagctgcttcctgcagaggccccaacctttgcgcctcctcctcagagaatctgattctccctcctcagtgcggttcctttcccacacacacccacacaacaatccagactcagagaatggagtgcctcaaattaggggaaatggccgggcacagtggctcacacctgtaatcccagcactttgggaggtcaaggcgggcggatcacttgaggtcaggagttcaaggccagactggccaacatggcaaaactccatctcccctaaaaatacaaaaattagctgggcgtggtggcgggtgcctgtaatcccagctacttgggaggctgaggcgcgagaatcacttgaacctggatggcagaggttgcagtgagccaagatcaagccactgccctccagcctgggcaacagagcgagactccatctcaaaaaaaaaaaaaaattcaggaaatgatgaggctgcacacacacatgcacacaccacacatggctcatgcatgcacatgacatgcattcacatgcacacatgcccatgcatgtatgtgttcacatatgcacacacagcacctgctcacatgcacacacaggacagtcacacacatgcacacacacgcatgcacatgcacactcacatatacattatacacatatgtacacatggcgcgcacacacccatacatgcatgctcacacatgtgcacacatggtgcacactcacacacccacacatgcatgctcacacatgcacatacacactcccctcttcacccagccaccccgctattcattctggatccccttacccaaccctggttcaggaccacctctcctgacccctaggctaggtcaggccactctcctgacaccctcattactcataggctttctcttcagcacttttaccacgattgtgactaattacatgtgtgatcattttggtaccaggtaatattaatagctcgaaaaatattactgggctttcctctttggcctttctgggtaagtagcccttcccctctcaggcctgaggcacctggctacctggaaaatatttgaatttgtacagaaggaataaagaggaccatggcagatctagttcctgatcatcaacacagactttgctatgagacagtaggtttagaagtcaccgctgcgcactgaccctctgggggcttgggaggaaagtgctctgagaccaccctccagcagcttaggggtggggcccctggaggtgcagcaagttgagaggaaggaagccctggtgtttcgctttccttggccacactggtcccctccgggccaggatgggctcaatgtgttcttgctcaggtaggtgacacctcattaagacaaggggcagagggacctgcagaagggtctgggagtagatggctcaggtaggggtcagatgcagtagagaagagggggctctgaaaaaaaaaaaaaggctgggcgcagtggctcatgcctgtaatcccagtactttgggaggccaaggcgggtggatcacctgaggtcaggagttcaagaccagcctggccaacctggcgaaaccccatctctactaaaaatacaaaaattagccgggcgtggtggcaggcgcctgtaatcccagctactcaggaggccgaagcaagagaatcacttgaacccgggaggcggaggttgcagtgagctgagatcgcaccattgcactccagcctgggcaacaagagcagaaactccatctcaaaaaaaaaaaaaaaaaaaaaagaagagggcgctctgagccaaggtagagccaagtcaaccaggcaggcggaggcccagagcatgagttttacctactgccggtttcggccaaaatgccagaaagccaagcagcaatcttgggcatcggacttggctagaaatccctctcctcctgggaagtctcgtcatcaacacccagacacccccacccccacccacccacccagtgccagcttagagaaaagctgggaggagcagaaggaaatttgagaccaagcattacctaaaggcctaaagtactggatcagattaaattaaatctagttctttttccttgttgccctatgagtaggctttgtgagaaatatcagatccattgcaggaaataaagaaaagacatgttctctgcagacccacatggcaggtgagtaaatgtacagcatggatatccgtcaccagcggtgcattcccctaggcaggcaccacaccgtcctgtggagcattgtgttagtaggcgctcagtaaacacccatgaagtgagtcaatgtatgattaaattccaaccctgcgtggcagcagacaggtggctggtctctgggactggggaagaacaaggctctgtatgtagttggcttcctctggaaggacaggttttaagtcagatccgactgggttcaaaccttggcttggccaaggcagcttctagcatggcctccagtgatcccacctcctggcctgagtgtgggtggacacttctgctatttatttatttatttgatttattttgagacagagtcttgccctgacacccaggctggagtgcagtggtgtgatctccgctcactgcaacctccacctcccggcttcaagtgattctcctgcctcagcctcccaagtagctggaaccaaaggcatgcaccaccatgcctggctaatttttgtatttttagttgtttaggatttgttttagttgtattttagttgtttagggttatttttagttgtattttagttgtttagggtttcaccatgttggccaggctgatctcaaactcctgacctcaagtgatccacccacctcagcctcccacagttctgggattacaggcatgagccaccatgcccagccatgggtaggcacttctaatgagcagaatatggcaaaagggacaggatgtcacctccaagattacgttataaaagacagtgacttccacctttctctctccctctctctcacatgagcacgcgcgcgtgcacgcgcgcgcgcacacacacacacacacacacacacacacacataacttcttggctttcttgctttgacacagcaagctgccatgctggagatacccacatagaaaagaattgaaatcagcctccagccactaatagatagataactaatagcaatagataactaatacagccactcattagctctgccctcagaccagttcttaacctgtatgtgtgtaccctcatctgaaaatgggcataatagcacatccccaccatacaggctaattgtgaggaccacgaaaatgaatggatgggtggatgggtagatgggtagatggatggaaggatggttgggtgggtgaatagatgaatgggtgggcgaagggatggatggatggatggatggatagatggatggatggatggatgagtgggtagatgggtggatgagtgagtgggtggggatgggtaaattggtggatggatagatggatgggtggaaggaagaaaagatggatggatggatggatggatggataggtggatgagtagatggttaggtggataggtggatgggtgcgtggatggatggatggatggatggatggatggatggatgggtaggtgggtgggtgggtgattggatggatggaaggatggatgggtggatagatggaaccactggctggagccgtgtgaatatcacagaatcaggaagtgaagcccaatcagtaagtcccgatggggctgtgaataaccctcactgagcagctgtcacaaggctaagcacctggctgtccccctaggaaagcccctcaccaaggtgaagctctacctccgtcctcacttcacccgcagcccgttcctcctggggctgcaaaggaccagtgcttagagctacctctggtcagaagccagcagagtcctacagtaaaaggggttggggccccctgctgagctcagtactgaagaggaggcatggccaggcagcccagcaccctctgccctccacccagcaacccccaggctagattctgccatccttttctcattgattatgttccccatgaggctgctcttgcccaaaagctggcccagcttgacaccacagagacaaaccaaccaacagccacagcatctgatagccccagtaactgactcttgtgggaaggccgcggccagctggcctgagtcccacagcctgaccatggctccgtcagtggccagtcctgggggcaacagggacacaggggaagggtcaggccccagctctcatggtgtaacagataccagctccaagtcaggagaatggactttccacctgcatgcacgtcacagtgcccagaaccctaacagacatgcatcagacttgacaccttccccacccaccaccccaggtttggctgcccatagaggcgcacacctgtcctcccatctcctcctgggctggagccatgtgagcagaaggggatgtgaagacagatccttgatgtccacaggtgcggggactgcttgccaacccatggcaactcacctgtagcgcatggagatttgggggtaaacccagtgatgctgagtatgtgggctgcccaagctgggtggcaaccaaccccagcattgaatgtgctgagagctggaccggtggatgtccccactgccctgaggcaggtccaggagaaggctcctacctgctgtgcagagggcaaggtaagtcttgtccttgatctacagccagaagacagcagggctgcttctgtctgcgtcccagcctccactcttctctagataccatcaccaccatgacaactgcagttaacacttagtgaagacccctaggtgccacgcgcccatgcaatacccacagacccctctgaggtaggccctgtaatggtccctacgttagggaggggcggtcccaggcccagctggtcagtgagggaggtaggatttgaacccaggcagcctggctttggggcattgctctctgccacgtggccggttcctacacccttgccagctaccccctgcaaaggtggccagcctggctttgtccttcaggatcctctgatctctctcaggggcctccaacccacccactggctctccctgctgacaaagcaactatttcctggccccaaagccccagtctctggaaatgaccctccttccttctccagctcatggctgtcagaggctcctaactgcacccacccccgatcagccaaagccaattactccacgtccaagacacaggcgtgttaaaatgtaaacggccattcatcatctggcagcgtgaccgtttgcccctatcaggccccagtccggcctcaccacgcctccatgctctcctcagcgtcaaagaaacagccttgtcctgccagggccttcgccaggcccggcctgggaagtcagggctctctgacccaatggagcgaatcgttgcgagcatttatttaatagcattatcttgatgatgaataaatcacaccttcatgaaccatttttccatttgtagccccaagtcaagactcccaaaatgttaccagatgtcaggcatgaaatatacacccctggcaagctctgccatgcacaggagtcatgctgctttcaatccacgggagagccggacacgagcgttccaaggcaggagcagaactccatgttggccattataaagacaagattccttttcccccgctttttatagcctctctgggtaagatgtgtctggaaggaggtgtgggccaggaaagagcatatgtctgatgcctgggattccaggacagaaagtacagccgactccaagctcttgggatgggattggagggtctcaaaaccttgccagctttggagtcagagagaaaagagtcccaaccccagatttatcatttgctaacaaatgtgaccttgggcaaatcagctcacctctctggccctcaacagagataatcctgggacctatttcacagtcatggagaggattaaatgggaagaggaataaaaggagtttggagaagtgcccaggacatagtatgcactgagcaaattccgtagtaagaggagtattagtaatagctactattgattaggtggtgttgtgagttgaacagtgttcccccaaaattcatgtccacccagagacacagaatgtgaccatttgtggaaatagggtctttgcaaatgtaattagttaagatgaggtcatactagattagggtaggccctaagtctaatgactggtgtccttattagaagaggataggggctgggcacagtggttcacacttgtaatcccagggctttaggaggctgagacaggaggatggcttgagcccagaagttcaagaccagcctggacaacatactgaaacccatccagtctctaaaaaagaaactaaaagccaggtgcagtggcttacatctgtaatcctagaactttgggaggctgagacaggaggatcacttgaggccaggagttcaagaccggcctgggcaacatagcaagaccccatctctattaaaaaataaataaataataaataaaattaaacttaaaaaatttaaaaattagccagccatggtgggaggattgcttgagcccaggagtttgaggctgcagtgagctatgatcaggccactgcactccagcttgagcaacagagtgagatcctgtctaaaacaagatgggacacacaggaagtggtggtgcaaagatggtgcagccgcaagctgaggaacaacaaggatccctgaccaccagcagaagctaagaggcaagaaaggattcttccttagagtcttcagagggaaagtggccctgctgacaccctgatttcaaacttctagcatccagaactgtgaaagaacgagtttctgttgtttgaagccacctagttggaggtgcttcattacagcagtcctaggaagctaatacaggtggttaccatgcactaggttctctgcattataaatgcatcatatgtgtgaattcacctaaatcctcacaacaactgtaagaggttactataccatgttacagagagagtgatcaagactcagagaagttaagggactcatagctggatctagatttgaatttggtctatctggtctaaagcccacttttaaggaccaactgtgtatgccaagtgctagagccacttccttgctcagtcctcaccgaccacactgtgctatctttattcacattttgcagttgaggaaacaggttcaggcaggtctgtccaaggccaccctatttagggtctgacaaagccaggttcatctgactccaatgccaacgcccatgctgttgaccagaccatccctgccaacttcccaatatgaatgctttgagtggctctcggcccccgggctgtggaacaccagcacaccagtgcctggagggcagcagctgtccagcaaatgtctgctcattcatttgttcacgcattcagggcaagtcgaacggcagacggggcaggagatccagggccagcatcgatggtgcagggagccctctggccccttaaatatcctcagacaatcccagaaatcattcctgggtctaccttatgtgggttttctagaatagctactgctgaactgtagggtagtgagggagagacacaaatacaggcaaaaccacacaacagcgaagattccataagggcaggagtgtttttccaccaggaaacaagaaccagttcatctgagttccttcgccttttgtcccaagacacaaaaatgtcaaaaatgtgcaagggctctggccacagatggatactgtgtctcaccccgacgggctgcttcctgcatggggctgaaggtcagggtgaaggttgctgccctgagagtcaggggaagttggtctgcctcctgctgtgtcacgtacttgccatggtgtgtgggatgaggcccatcatctcccagaattaagctgtagctgactataaaaccacaggtgagggctgggtgtgggggctcatgcctgtaatcccagaattttgggatgctaaggcaggaggttcgctggagcccaagagttcaagaccatcctgggcaacatagagagaccccgtctctactaaaaatacaaaaattagccagacatggtggtgcatgcctgtggtcccagctactctggaggctgaggtaggaggatcacttgagcccaggaggtcaaggctgcagtgagccgtgatcatgccactgtactccagctggggccacagagcaatactcagtctcaaaacaaaataaaaaaacccacaggtgaggtcacatcaggcttttcccctttattctccctaagggctccacaacatcagaaatgggtttctctatcagtgcatcctccagattctactttttttttttttttttttttagtagaggtcttgcttatacccaggctggtttcaaactcctgggctcaagcaatcctcctgcctcattctcccaaagtgctaggattacaggtgtgagccacccacacccagcccagatactgggccctgtccgtcaatccatttgcagtcaccaagcaccagctgcgtgcaccgcattgtgccaatgtctggaaggatgctcacaactatcaacacagataactaataatatcaacaataccacagtgtaaatgcaaagcaatatgtgcctggtctcatttaattctcacatcaaacccttgggatacatatcattagcaccctcatttgctagagaaaactcagttctgagggtggatgatttgccaaggccctgggaattcggactaactcccttcataggtggctgcaagtgcctgtggcccagacattcccatagataggtcattttctcacaccagcttatatttcttgtgccagacacagggtccaaacccatttgcattacgtctctgagacttcacaagaccttcctgtgaatttgttaccattattattattattttcttgttttacttttttttttttttttttttttagaccgagttctgctcttgttgcccaggcctgggtgcagtggcgcaatctcggctcaatgcaacctccacctcccgggttcgagcgattcttctgcctcagcctcctgagtagctgggatgacagacacacaccaccacacctggctaatttttgtatttttagtaaaaatgggttttcaccatgttggttaggctggtctcaaacgcctgacctcaggtgatccacctgcctcggcctcccaaagtgctgggattacaggcgtgagccaccgcgcctggccttttttttttttttttgagacaagatctcactctgtcacccaggctggagtgcagtggggcgatctcagctcactgcaacctctgcctccctggttcaagtgattctcctgcctcagcctctcaagtacctggaattacaggcacgtgccaccacgcccagctaatttttgtatttttagtagagacggggtttcaccatgttggccaggcttgtcttgaactcctaacctcaactgatgcacctgtcccgacctcccaaagtgctgggattataggcatgagccaccgcgcctggccttattattcgtcttcttagtctgctttcagatgaggacacggagccacaggagttacaagggtggaggtgctgggaagtcaggaccaaaatcagcctcctgactccccatctcattttctcaatcatcatgggttttgccccccaagaagagaaccagccaccatgggtgctaaaccggtggctgatatagcaaagtgtgttggagcagagatcccagcgggcttcctagaggaagatcacaaaaaatgggcagagcccacaaggcacagtacaggtttcctctctccagtccacataagggcattcaccaggaacctgggggctgggtggccttggcccaaccctctgaaactcaccctgtggctcctcactcaccagatggacacagcaggaatctgtcccacctggctcagggagggcctacccccacctcccaccccaccccacaggcctgtttgcatgccaggccagagttggccacatgcccacatatctctcctcgttctgcaggctccgggaaggaaagtccaaggccaaggttatcatggggttcacataccttaaggggtgggtggaggggttggctcacaagctacaggttattcaatgcagtgctattcgtgatcacaaaagatcggaactgatctcacgtccatcatcaggggactggactaagatattttggcacaaccacatacgactcaagtgtcaagggaggaagagtgggggagtcttgaataaataacaaaagctggcgttgacacaggactttgcacatggtggaggctccttgcaagtgctttgcatgttattaactcattcaatccttacatcaccccaggaggaggaaccattattatctgtttaaaatgcctgtaatcccagcactttgggaggcccaggtgggaggatcacttgagttcaggagttcaagaccagcctgggcaacaaagtgagacttcatctctacaaaaaattcaaaaaattagccaagcctggtgatccacacctgtagtactagctattcaggaagccaaggtgggaggattgcttgagcccaggaattcgaggctgcagtgagccaggattgcaccactacactccagcctgggtgacaaagcaagatcctgtctcaaaaaaaaaaaaaaaaaaaaaaaaaaaaaaaatatatatatatatacacacacacacacacagagagagagagatacacatataatattttaaaatatatatacctcaaaaaatatatatataatatttaaaaatatataaaatgagggtgccacttggttgagtttatggttaaaaaaaagaataaaatttaaaaaagaggcaccaagaagtgaagtttcttgccccaggttcatggccaacaaacagtggactgggccgggcacggtggctcacacctgtaatcccagcaatttgggaggctgaggtgggaggatcgcttgagttcaggagttcgagaccagcctgggcaacatggcaagatcccatctccactggtgcagtggctcacgcctgtaatcccagcactttgggaggctgaggtgggcagatcacaaggtcaggagatcgagaccattctggcaaacatggtgaaaccctgtctctactaaaaatacaaaaaaaaaaaaaaaaaattagccgggcgtggtggcgctcacctgtagtcctagctactcgggaggctgaggcaggagaatcacttgaacctgggaggcagaggttgcagtgagccgagatcgcgccactgcactcgggcctgggcaatagagtgagactctgtctcaaaaaaaaaaaaaccgtctctactaaaaaactgcaaaaattagccaggcatggcggcatacacctgtagtcccagctacccaggaggctgaagtgggaggatcacccgagctcaggaggttgaggctgcagtgagccaagatcacaccactgcgctccagcctggcaaccagagtaagatcctgtctcaaaacaaacagacaaacaaacagtagacctggaatttggtgcaagcagcagggccagatccatgcttggtcctctcctcccagcatctctgttttgtcctgggtccctctgccaggagctccctggaacccgggaaggaagagaagcatgcagacaagcgtcagcacccccaccctccgctggccttggggagcaggtgtcattagacgaggctcaactgaagcctgcatctgaaacagattctcataactcaggcgctgtggtagccaacttctctctacagtcaattacggccagcggggcccactgattatttttatagcctttcctggagtcatgacaaggaaaactaaatgatccacaggacccctttcatcactaacagccgggtttcacggttgggggtggaggaaggaaagaaaaatcacttttttccccactttgagttaatcaacagaactcaagtctgggcagccaatatgttggtgttgagaaaagctgttctcaagcagaactaattggcaacagaaatggaattttcttccccacctccctaaaaaacataaacatgctttatcccagagaattacccttcagaataggtattgcagacgtgtcgtgtgcagccgcctgtgcgaggctggtaatctcacgccgacctggccaaaggctgcctgtgctggttacagctcaaccagagcagcctcttacgcaatacaatggtcatgaaggtcagtggcccaaaccagcccagccagaccagagtggacacttgctttcctgatgcccagcacctatctcctgctcctacgaacagcctttggcttttgttgggtcggggggtgggagggcaccctgatttgcaggtacaagtgtgagtggcattgataccccctcaactccagagatgagctctgacaggcgtaagccaaagaacatattccggggaaatttcaagaaggggcatatgacctaacaagaaacaatagctggcacagtggctcacaccttaatcccaggactttggggggctaaggcgggtgaatctatttcagctcaggagtttgagaccagcctgatcaacaaagtgagaccccagtctctgcaaaaaataaaaactggctgggcgtggtggtgcatgcctgtagtcccagctacttgggaggctgagatgggaggatctgcttgagcccaggaggtggaggctgcagtgagccaagattgcaccactgcactccagcctgggcgacaaagccaaactctgtctcaaaaaaaaaaaaaaaaaagaaaagaaaagaaaagaaacaataaggcactagaaaaaaaaaaacatataatgaggcttctggaaaagatagctctttttattttagagaaattgaggttcaaagacgtgatgtaactgctcagaggtatacagtgaggtggtaggggatccagggtttgaacccaagtctgtaggactgaggagtttgcaacccttcactgcaggcgctactgaaaggcagcataaaccttggacgaagccagaagagctggattcaaacccagttctgccatttactccctgtgtaatttcaggcaagtcacttaacctctctgttcctcagtttccatatctgtaaagtggggcttctaagggcacctccatttgcaggatctgagaggtaaataattaacagcaatatctgtaaagtgcatgcaacagtgcctgtcacggaccaaggattcgccccttcctcaccacaccgttccccacacgcgttgagaaccagaccaaataaaaggaggtggaggggaggaaggaaaagttgatgttatcagatctgtaatccctacgccatgtgttcctttctgtagcacagctgccaggcttgcctctcctgcaggagaagctgtgccacaaagatgtgggacgtcacaaacacgcagcccattcaaggcttttggacattccagccccgtccttgatgtcagtcaagatctagggcaaattccacccattcaggtggcaaaaagtaagatgtttgacaaatgccatgtgtagagggtggcttgtgaattggtacaaccattagaagataattcagcatacgatttcatattccagcaattctacttccaggtacaaacttgagacacactcctgtatgtgtgcaataggacagtacaagaaccctcaaagcagaaccgtgtatgtagcaaacaaaactgacaaatggaaacaacccacatggtcatagacaggaaaaataaatgctggtatgccatggaatagtacacagcagagaaaagtgaatgaacaagtgataagcaattatatcaacgaattttagcaataaaatgatttataaaaatgtaagtgcaggggctgggcaccatggctcacacctgtaatcccagccctttgggatgctaaggcaggctgattgcttgaggccaggagtttgaggccagcctgggcaatatgcaacatggcaaagccccgtctctacaaaaacgtagccaagtgtggtggtgcacgcctgtagtcccagctaccagggaggctgaggtgggaggatcacctgagcccaagaagtcaaggctacagtgagctgagattgcaccactgcactccagcctgggtgacagagtgagaccctgtctcaaaatatgtgtgtgtgtgtgtgtctgcatgtatgtgccagaagacaagatatatctttacgtaaagttcaaacagcagtaaaagtaaatgatatattattttggcatacatgtaagtgataaaactttttttttttttgagacggagtttcgcactcatcgcccaggctggagtgcagtggagcaatcttggctcaccgcaacctctgcctgccatgttcaagtaattctcctgcctcggcctccctagtagctgggtttacaggcatgcaccaccacacctggctaattttatatttttagtagagacggggtttctccatgttggtcaggctggtctcgaactcctgacctcaggtgatctgcccgccttggcctcccaaagtactgggattacaggcatgagccaccgtgcctggtgataaaactatttttttaagcaagggaaattgagaagatgaaaatgttctggaaatggatggcgctgataattgcccaacattgtgaatgtgcgtaatgccgctgaattgtacccttaaaatggctaaagtgataaattctatccacaatttttagaaaggcaagggaaagctaaacacagaattcaagatagcagctactaccacagtgagagagggagggaggcaagatgggaaaagagttcggaagttgatataaaatggttgtctgagttccagcacgcaggtgggaccatgggttcacaggcatttatcattttataaatagctataaagagattgttagatggaagtgtaggtggggctgttcaggtgccctttcagtatgtcattatggaattatgaatcattcaatcctacttactttttcttttttttttttctttgagacggagtctcactccattggccaggttggagtgcagtggtgagatctcagcttgctgcaacctccagctcctgggttcaagtgattcttgtgcctcagcctcccgagtagctgggattacaggttcatgtcaccacacctgtcttatttttgtatttttagtagagacgggctgtctctactcctgttggtcagactggtatcaaactcctgactgcaggtgatccacctgcctcggcctcccaaagtactgggattacaggtgtgagccaccacacctggtcaattctacttacttgaggtccatttttaaaattctagaggaggccgggtgcagtgtctcacacctctaatctcagaaactttgggaggccaaggcaggtggatcacctgaagtcagtagttcaagaccaacgtggccaacatagcaaaaccctgtctctactaaaaatacaaaaattagttaagcgtggtagtgtgcacctataatcccagctactcgggaggctgaggcaggagaatcacctgaacccgggaggcagaggttgcagtgagccgagattacaccattgtactccatcctgggcgacagtgtgaggctccatctcaaaaaaaaaaataaatccctaccttcaggaaactcacattccagcaggggacacttaagaaaataagaatatatatgtatgttagatgatgagacgtgtgtggtaaggagaaaaataaaccagaaaagggatgaagaagaccagggagtgaaggaagctgtaattttaaatggagagtcaggatggcctcgctgcaaaggtgatgtttgtgtaaagacctgcgcgatatgaacaagtgggccacttggatatctgaagaatgagcacccaggcatagagaaaagcgattgcaaaggtcctggggcaggactgtgcccgacctcaagaacagcaattgtggggagtgggaaggaggagagataaggttagagaggcctgggccctgcaggccttgtgggccgtgatgaggactttgcctgtgctctgggcaaggtgggaccagggctggagataggaggtgtcctgaacagagaaggaactggatctaatttcattttaacaggaccctgctggctgcacacggagagtagaccaggagggaggcaagaggagaagcagagacactggtggggaggcaactgcaatagcccagagagagacaccatggccgctgggaccagggtggagggagcggaggtgacagagctgtcagcttctgggtgcaggttgacaggggagccaacggaatttcttttctgttcctctttgtttttgagacagcgtctcattctgtcactcaggctggattgcagtggcacaaacatggctcattgcagcttcaacttcctgggctcaagtgagcctcctacctcagtttcccgagtacctgggaccacaggtgcatgcaaccacacccagctaatttttaaaaatatgtttgtagagacaaaggtcttgctatgttgaccaggctggtcttgaactcctggtctcaagcgatcctcctgccttggcctcccaaagtgctgagattgtaggtgtgagccaccacgtccagtgtagaatttcttttttgctggaaagtgggagaggctgggctctatttaagtgtttaagggtcaagaaagtttgagacctggttataaagtagagacatggccatccaaactgagcccttcttgagagctgatgatgggatagaatttttttttttttttttttgagatggagtcttgctctatcacccagtgcagtggcgcgatctcggctcactgcaacctccgcctcccaagttcaagcgattctcctgcctcagcctcccgagtaactgagattacaggagcccgccactgcgcctggctaatttttgtatttttagtagagacggggtttcaccatcttggccaggcttgtcttgaactcctgacctcgtgatccacgtgcctcggcctcccaaagtgctgggattacaggcatgagccactgcgcctggcctgatgggataaaattttttaaaaaataggctgggcacggtggcccacacctgtaatcccagcattttgggaggccaaggtgggcggatcacctgaggtcaggagtttgagaccagcctggccaacatggcgaaacccccgtctctactaaaaatacagaaatcaggcatggtggcatgtgcctgtaatcctagctactcgggaggctgaggcaggagaatttcttgaacctgggaggcagaggttgaagtgagcaggatcacgccactgcactctagcctgggtgacagaacgagactctgtctcaaaaaaaaaaaaaaaaaccctcctcttctaggacttctgtgatgtgggcattaaaatgaatgttttaggtcttcatgggctcacatggaaaaatgtccaggacacctgttggttgaaagaaggaagatgcagaataaaatgtatagaatgatcccatttttgaaaattaaaattacgtgacaaagaaaaaaataggaatgaagtgaatgaatggcctgaaagcatagacgcctggctctttctttgttttttttaagaaggagtctcgctctgttgccccaggctggagtgcagtggcgcaatctcggctcactgcaagctccgcctcccgggttcacgccattctcctgcctcagcctcccgagtggctgggattacaggcgcccaccaccatgcccagctaattttttgtatttttagtagagacggggtttcactgtgttagccaggatggtctcgatctcctgacctcgtgatccacccgcctcggcctcccagagtgctgggattacaggtgtgagccactgcgcccggccaagacaacgggctcttaacaggggtggcccagggtgagtataggagctactgaggtttaaactcaggcgcgcccttcctacctcgcaaaacaataaaacacgcatgcttggggccgggcatggtggttcatgcctgtaattccagcacttttggaggcctacgcgggtagatcacctgaggtcaggagttcgagaccagcctgaccaatatggtgaaaccccatctctactaaaaatacaacaattagccaggtgtggtggtgggcacctgtagtcccagctactcaggagctcctgagacaggagaatcacttgaacccaggaggcggaggttgcagtgagctgagatcgcaccactgcactccagcctgggcgacagagcgagactctgttaaaaaaaaaaaaaagaaagaaagaaaaaaaagtgcacgttttttagttctcttttaaactgctgtgggcatggttctcctcttgtattgcagttgcgtttctcttagctaatgtcccacctgggccttgtccttggcctggactataagagagcggaacttgagaatgagaaatattttcctctcgtgcttgctggcttaggcccttaaaactggaaagggcccacctggctcctagagtttctaaaaatagcaagctatctgaacttttcctataggtttggcttagccgttcctctgacttgttccaagatgccatttctgttagggcatcattcgctgtgcatgaaaacaaaggatggcaggagacagactagaaacggaagaggactaatcgggagccgctgcggacagaatccagaaatgccctgcaaatgcagacacagtggacgcaatggagagtgcataccagggcctgtgtcgctggtggagctggggcccacatgccgctagtgtagacaggatctctactccacccgatctctctgcatccactccagtgcttcgggcaagagagaggagtttggctgctggtttaagtgagatggggaaattgaaagatttgcatccaaggcccatgcctggggtctgaattcctttggaagaggactgaggactgttcaggagacgatttttgacaatccagacacaaccatagatgctgtggaaccagtggtatgctggcaaaggtttagcaaccagctctccaagggaaagtgagtgtgtggtgcacaagtgtgcatgggcgagtacatatatttgcatatccacacacacatatacttcggtttattataaattgtattgacgtaggctgggcgcagtggctcgtgcctgtaatcccaacactttgggaggctgaggtaggtggatcacttgaggttaggagttcgagaccagcctggccagcatggtgaaaccctgtctctgccaaaaatataaaaaactagccaggcatggtagcgggtgcctgtaatcctagctatttgggaaggtgagacaggagaattgcttgaacctgggaggcggaagttgcagtgagccatgattacgccactgtcctccagcctaggcaacagagtgtgactccatctcaaaaaaaaaaaaaaattgttttgatgtaaatgatgtgcagcacacaatttacaaataaaaataaaacttacaataccttttcttttataaatgtaatataatcatttcactcacaggtagcagttttgttgatttttgcccccagcaaaatctgtaatcaacctatggttacaattgatgaaggagtgtaattcttcagaaataccagttaatattttcctttctaaaaaatttctaattatttgtttatgtatttttatttttttgagacagtgtcttgctctgtggcccaggctggagtgcaatggtgagatcacagctcatggcagcctcaacctcttgggctcaagcaatcctcccacctcagcctcctgagtagctaggactacaggcacgcaccaccacactcggctagttttttctcaaattatttgtagaaatggggtcttgttatgttgcccaggctggtctcaaactcttgggctcaaatgatcctcctgtctcagcctcccaaaatgctggaattacatgcatgagtcaccacactcagccttgactacctttgtttttcatagaatttattgaattgtaagttcatataatttaatttttaacaatggtgtgtttagcaacccgttcacctaattcctgaaaatctgacaatcagctttcacaagctggcacaagctgcctccagcacacctctgtctggggacaacatggcaaagaatatcaccgaactgaggaggaagccattctcttcacatctgcccagaacccagggtatctcaagcactaaacagcgggaagctttgggagtttacagagatggcaccatggacgctgctgtgctgggcagggaagcatctccaaatggcctcagaggaaagaggaagcaggaaggatgaataaaactagagactggttcacaaaggcactcgaaatacccctttggagctccccaggatgaactgggggaccctggggggagcactgaggttctgatggggaaaacctcagcaaccagtgggcatctgggccaaatcacttagcacaaacgctgagccacaaaatcatgatacgctttcaacaacccattaggcacctcagaagctgcagggccatagggttgttacaaccgacacccatgcaggtggtaccacaggccatcagtccttttccccaagtccaccttcattcccgcctcctccagtaccatcctggacttctctagggaagtggtggggagatttactcctctccaaacttcttttttttttttttttttttttgagacgaagtctcgttctgttggccaggctggagtgcagtggcacgatctcagctcactgcacctctccctccccagttcaagtgattctcctgcctcagcctcccaagtagctgggactataggcacgcaccaccacggccagctaatttttgtatttttaatagagatgaggtttcaccatgttggccaggctagtctcaaacacctgacttcaggtgatccgcctgccttggcctctcaaagtgctgagattacaggcgtgagccaccgcgcccagcctcactccaaacttgatcttactctcagacatcttactctcagacgcttaagttctcagttcggaacttaagcgctcttcaaccagactcatggaatctcagggttgcggagagattttagaggtttcctgaaatagtccctttgttttaaagacgaggaagctgagagaagggaagtgacttgctcaaggtcacagagaaaatccagggtggaactgggtagggtgaccaattgtcccagtttacctgggactgggggggcttctggacaagttgctcccagatctgagaccacaactcagggctgacttgtccccaaggtgggtggtggggggttcacagccagtccctgaaaggaaaggaggcctggatcagtacagagctgctttgggatggaattttccaagggaagaaaaaagaaaaggccacatctgggtgctgggacctttcactctggcccgatgcctggaaccccagggattccccacctgctgtgtgtttcctggcccttgagtgtaacctgcaccctccctttccgtgccagggagacacgagctgactttatctgtctcttatctcttggctgctgccagccacagctgcagggatatatatgcaaatagcttacgataatattaatatgtgattccccccaggggaggcatgtggaaagcgctgtatgcgtttcacaattctgtttcatccaaaaacactgcacgggcccagagtgattcgaaacagattttctgcaaaggcaaaataaaattggaacaaaacctagttgaggcatatgccagtctccctgcccccagctctctccacctctgacatattaaccctcttctctcatgcccccaggagcctcctacgacaaggcagcaaatctaggaaattgcactgggcactcttcgttcaagcctggagcccctgccccatcccagggcagccagcctccaccctgggctgacacatcctttagagagtaaaaggctgcttgccagtgtcagcctgtcactccttctgtcccacctctgcctccttcctgcaggtaatgctccatccatacctccttctccttcacccctgctgcttgggataattgcagaaccatggagcacagaatacagaatactgggggtgtacaggagagtttagccaaagcaagtcagaaaaacctaggtcttttttcgtttctgccactgaccggctgtgtgacctcagcaagtcacttcacttcgcccagctgctgtttcctcagggtacaatgaggacaccaataatacttaccctgcagggggcttaccgggatttcccgagccgacgcttcaaaaatgcctacacagtgcctggcgtatagcagatacacaaggaatagctgtcatcatgagaatctcttaaagatcacctagttcaaccactgttttagaaacggacaaatggaggcctgcagagggcaaataacttgcctaaggccacacagcacgataccgccatcccatctcagcctcaacccaggttccctcctccggccttgggagctccaggtggcctgtgaggaacggctgcctcctcctgtcacccccagctccagaagtctgtccacacaaggcggcgtcacggcacacatggggagcagtcacttcacactcaccatcgagcaggtctggacactcgagtgcagtcccgccgccctccttgcagctgcctcactttccctattgccgccagcaagcgtctgctcccatctggcccgggactcccggactcgagctagggctctgcaaattccatccacactggccaccagccgctggtcccgctctctgggaagatcgccttgaggacctgctgcgccccgagtcttccttctggtgcagggaggccggtgccctgccgggctctgataatgcagccgggactcttatctggcctgtgtcagggtgcaggcggccatggagctggggttccaggaagccctcctggggccccccagccggccccgctccccccggatgccgcctgctgctctggacgcggccgattgcttgtcagtgtcactcccagctctgccggggggaattccatgctggcccccagcaggcggggcccccaccccttcacgtcccaccccccactcccattttggcaaggggactgggaaaaggcagctaatttcaagtccgcacagcgtttgtggtcgtgtcctgaatcctccacgattaatcacagagcatctgatttctgctttgcctcagagaggggcggaggggacgcctggaagtttctgtttactccattctgcaccaggctgcgtgctaatcacaaacagactgggacgcagcctacccctcctaaactgctcttggccaccccctccctcctccagccctctccttcctcttcttaccttgtcactttcctccagccccttcctcactctttctcctttccctcctttctttcccctttcccatctgtccgcctcttcagtccagatctgatccattgcacaccccttccttccgtcctgggtttcccccaagcccctttccccctttgcgcctcccacttctcctagattgagagtcagcttggttctttcctttacatccattagtgagggtcaggctcttttgttatgtttttttttcttttgtataacttaattatttcagggttcggggtgggcgctcgccccttgcccagtcacactggtgtgtgtgcgactcctacaaagttaacagtttctccaggtcaaggggtgggatccaggcttggtgatgtgcacaatttcttttgtccacttgacacatctctgcgtcctgattctgctcagggacggacccaagaacaaagcagccatttaccgcctccggaggggaggccagccctgtggcacatccagggccttggaacacctagagacagatttctctccctcgccttggctcctttccactctgcagctagtgtggaaaagaaaccagaaataaacagcaccaaagaacaggaacggacacccctccccattaaagcacacacacagactctgaagggtaatttggcaaagacctctgaaaaccagagatgagggtctcctactacttatgcctgtgcacaggagacaggcacagagatgcttgctgagagctgcttatcataggaaatgatgggaaataactgaaatgctcatccaataatgactgcttgaacaagatgtgaaagatatggtacatcaggcagcggttttttgttttttgtttcctgacaatgggccttgtctgtcatccaggctgaagtacagtggtgtgatctcagctcactgcaacctccatctgctgggctcaagcaatcctcctgcctcagcctcccaagcagctgggaccagagacgtgacccaccatgcctggctaatttttttaaaacattttttgtagagtcagggtcttgccatgtttcccaggttgggatgaggcagcaaggtacttttttttcttatttttttatttttaaaaataaagatggtgtctcactatgttgaccaggctggactcaaactcttggcctcatgtgatcctctcatcttgttctcctaaagtgctaggattacaggcatgagccactgtgtcagcttagccagcagttttaaaagagctatgtctgtattgaagagcagaggtggatctccaagacatattactgagtgaaaagggggtcagcatgatacatttggtagaatgctgattgtgtaacattccccctttacacacataaaatgaaacactgtggaaacacttagacagcaagacaggctggaaggatgtaaaccaaactgagttgctacctctgggaaaagagtttgggagtgacgcttttacctgtaatcctttcatttctaaaagtgagaatagattggtctgttacttttgtcccagccatcttccttctttttaaaaaatgtgttttattttttatttaaacggagtctcgctctgtttcccaggctggagtgcagtggcacgatcttggctcactgcaacctccacctcccaggttcaagcaattctcctgcctcagcttcccaagtagctgggattacaggtgcctgccaccacgcctggctaatttttgtatttttagtagagactgcttttcaccatgttggccaggctggtctctaacccctgacctaaagtgatctgcctgtcttggcctcccaaagtgctgggattacaggcataagccaccgcacccgacccatctatcttctttggggacattgcacccctatgtggagaaaatttcatcccaaccgtttgcttccttggactaaaataattctaccataggtcaggtcagaaataaacagcattctgcaggaagcagtggctcatgctcctgtaatctcagcactttgggagcctgaggtgagagggctgcttgagggcaggagtttgaaaccagcctgggcaacatagtgagaccctgtctctattttttaaattaataaaataaaataataataattaaaagaaagaaagaaacaggctgagcatgggggctcacacctgtaatcctagcactttcggaggccaaggcagacggatcgcttaacctcaagagttcaagaccagcctgggcaacatggtgaaaccccatatttaataaaagtacaaaaaaaaggccgggcgcagtggctcacgcctgtaatcccagcactttgggaggccgaggagggcagatcacctgaggttgggagttcgagatcagcctggccaacatggagaaaccctgtctctactaaaaatacaaaattagccgggagtggtggcacatgcctgtaatcccagctactcaggaggctgaggcaggagaatctcttgaacccaggaggtgggggatgcagtatgctgagattgcaccattgcactccagcctgggcaacaggagcaaaactccatctcaaaaaaaaaaaaaaaaagtacaaagcaataattagctgagcgtggtggctttcacctgtagctccagctacttgagggggctgaggtgggaggattgtttgagctcaggaggcagagtacagtggtgcaatctcagctcattgcaacatctgcctcccgggttcaagcgattctccccgctcagcctcctgaacagctgggattacaggcacagtgagatcccaccaccatactccaacctaggtgacagagtgagaccccgtcccaaaaaaaaaaacaaagaacacccccagcccccaccaaaaagaaagaaagaaagagaaaagaaagaaagaaagaaaggaaggaagaaaagaaagagagcgagagacaaaaaagaaaagaaaagaaaaaaatgaaaggaaggaaataaggaagaaagagcaatccttaggggtgaacccagaaattctgcaaacattctagtttgaatcacctccggttagatgtccagacccatgagccaacagtgacttattccagagtgaaattccttcagggtaggagagccatcgagttagtttgtagtgggctgaagtctcctggaaatgaggtcggcagatatatattggaaagcaaagatttggtttcaggaagcaatatcacctactctaactaataaaacacaaaaaccactttgaagcattttcaaggaatgaatatgaacaagttcagacattatgcaaagggcagttgagaaagccatttcatttcagccacttcccaccccctcactgactaaatatatggccacatgcatctcaccgacaggacgggcaaataaatggcccttgtgttcatgacaaggagctgtggatagaattctgcagtgtgctcttttctgtccatcacttgttaaacgcctgccagctttgggaaaacagctaggggagttactagacaagacaaatgatattccccacagccccccatcccccacaaccaccaccaatcagggcacccagccctgaccccatcttccagggcagaaggaagctccaggtttggagcccggcagcctcaggtctgggtttccagccttcttcggatgtggcacagccagacctttcagtgtttctcaaagtgggcctcccgaaggggtgccacccaagctgactttagatgacacacagactgggcactaaacactgaatctcatagtgagaaagccatttccctcctatgaccatgctggttcaatgccatttggccgggagaaagtctcagcttgagctagcctgtctttaacacctaacattggccaatctccctttttaacaaagagaaagccggccccacgcttaggtcattccactgctaacagcatctagctagaactgtgtttggcaattgatcatggttttccatgaacattctatttttttggtgttgttttttttccagtttaaaagtgaatccaccagataagggaaaagctaacaaaatcctaataaagtataaagttaaattaacaatagtgtaactataatggttcattggtcttgacaaatgtaccatagtaatgtacgatgaacagttaagaaaaacaataagaaatccgtagagggtggatagagccctctgtactatctttgcaacttttttgtaaatctaaaactattctgaaatagaaagcttatttaagcctggttgcagtggcccacccctgtaatcccagcactttgggagaccgaggcaggtggatcacctaaggtcaggagttcaagaccaacctggccaacatggtgaaacccccatctctacttaaaatacaatacttagtcgggtgtgatggcgcgggcccagctacttgggaggttgaggcagaattgcttgagcctgggaggcagaggttgcagtgagccaatatcgtgccactgcactccagcctgggtgacacagcaagactccctctcaaaaaaaaaaataaaagaaagaaagaaagcttatttaagtacctttagtgccccctaccataaatctatgtttttttttaagtgtatatatggagagaaataaagagaaagcaaattgtaagctaggcgaggtggctcacacttgtaataccagcactttgggagaccaagggaggctctcttgagtccctggagtttgagaccagcctgggcaaaatggaaaaaccctgcctctattaaaaaaaaaaatacaaaaacttaggtgtagttccagctacttaggaggctgaggtgggaggatcagttgaacctgggaggttgaggctgcagtgagccatgattgtgccactgcactccagcttgggcagtgtctgtgcagggtctgctgggcaacggagcaagaccctgtctcaaaaaaaaaaaaaaaagaagaaagaaaagaaaaagcaaattgtggcaaaaatgttaacaattggtgaatctagctaaggggctatatggatgtttttcacactattctttcaattttcctgtaggtttgaaatttgtcaaaatgaaaaattgtagggggaggacgttaatcaatttaaatacaaatattaagtacataagagcccaggttgcaaatgaatatggccaaagttgtgaaggtgggacctgagttggtggcatttggtggaccctaggctacaagatagcctggcaaatagcagggacaactgaaatgattttttttttttttaaagagacagggtccttgaactcctggctcaagtaattctctcatctcagcctcctgaatagctgggactacaggctgaaaccaccgtgcctggctaattttaaatatacatatatatatatacagagagagagaaagagaaagagaaagagagagagagagagacggagtctcgctgttgtcggcccgggctggggtgcaatggtgagatcttggctcactgcaacctccacctcccaggttccagcaattctcctgcctcagtctcctaagtagctgagattacaggcgtctgccaccaggcccagccattttttgtatttttagtagagatggggtttcaccgtgttggccaagctggcttcgaactcctgacctcaggtgatccacctgcctcggcctcccaaagtgctgggattacagacgtgagccactgcacccggccttctttttatttttttgagacagaatctcgctctgtcacccaggctgaagtgcagtggtgagatcttggctcactgcaatctctgcctcccaggttcaagtgattctcctgcctcagcctcctgagtagcagggattacaggcgtccaccaccacacccggcttttagtagagacggggttttgccatgttggctaggctggtcttgaacttctgaccccaggtgatccacctgcctcagcctcccaaaatgttgggattacaggcatgagccaccccggccggactatatatatattttagagatgaagtctcaccatgttgcccaagttggtctcaaactcctggcctcaagtgatccttctgcctcggcctcccaaagtgctgggattacaggtggtgcctggcctgggatgatattaaacgacctcgcaagtccctgagcacccacacccactctccattaccccagaagcttcaccatccatgagggttcccccacataggtgtccttggagagtgcagagggcatttcaagagctcaaagcatctgtaagccttgtagtgagtcgagggaccaactttcatctcccaccccttgacaaccagagagtccctctccctctcccaagcctccacatgcatacactctccaaatgctgcagcatttctcacactgtcaaatgatttctgcacctctattcatcctagagcattctcatcctgttaagagggcaggaatattcatcccagagtctagaacaaggaagaaatactcaagagtggccaacacctgtaatcccagcactttgggaagccaaggcaggaagattacttgagcccaggagtttgagaccagcctgggcaacatagcaagacccccatctcaacaaatactttttaaaaattagccgggcagccaagcacggtggctcacacctgtaattccagcactttgggaggccgaggcaggcagatcatgtgaggtcgggagttcgaggccagcctggttaacatggtgaaaccccgtttctactaaaaatacaaaaacttagctggggtggtggcacgcacctgtaatcccagttactcgggaggctgaggcagaattgcttgaacctgggaggcagaggttgcagtgagccgagatcgtgccactgcactccagtttggacaacatgagggaaactccatctcaaaaaaaaaaaaaaaaaaaaaaaattagccaggcatggtggcacgtgcctatggtcccagctactcaggaggctgaagtgagagaatcttgagcctgaggagtggagcctgcagtgagctgtgatggaaccatgcactgtagcctgggtgacggcaaaaccccgtctcaaaaaaaattttttaaaggaagaaatactccagtgggagacagacatataaataaggacccacggccaggtgtagtgtctcacacctgtaatcccagcactttgggaggctgaggcgggtggatcatttgaggtcaggagttcaagaccagcctggccaacatggtgaaaccctgtctctacttaaaaaaatataaaaattagccgggcagtggtggtgtgcgcctgtaatcccagctactgggaggctggggcaggagaatcgcttgaaaccaggaggcgaaggttgcagtgagccgagatcacgccactgcactccagtctggacaacagagtgagaccctgtctcaaaaaaaaaagaaaaaaaatagggacccacaaaaccaagtgctcagtgcaggggcagagcagtagaggcagggggatggacctctgcctttgaggaccaagggggtatcgcaggaaattatgtcaacagggtcttgaaggatgagaaaacagaaagcttccccgatctttctagattgatactctgacctggccctcaagggagggccatgcccggcagcttaagggtcctgcagagccttttggtctctgaccccaaatccactggaacaatctcagtccttttaaggtgccagcctctctcctgtgtcctgtggttcccccagcctggatctctgtaggtcccacccaccttgcctttcacctggttaataccttaactcaacccgctggaatccagctaaggagtctcaatctcccacagccttctccaagcccccactctgggcacagtgctcctctaccaagcatcctggctgccccatcagggcagaactgggtgagcacatggaccctggagttccatcctggcttctccgcttctgagctgcatgactttgggcaagtaacttggcctctctgggcctccatttcctcatctgtaaaatggggatgacaacagtgccgcattgcgctgctgtgagcattaggtgaaataatacttggcttctcgatgtgtatacagaccagcagattgggcatcccctgggaggttgctggtgcagcatcccaggccccaccccggaactacagaaccagattctgcaatttttttttttttttttggagacagagtctgactctgttgcccaggctagaatgcagtggtgcgatctcagctcactgcaaccctctgcctcccagcttcaagcaattctcctgtctcagctctcaaggagtagctgggattacaggcacatgccaccatgcctggctaatttttttgtatttttagtagagacagagtttcaccatgttggttaggctggtctcaaactcctgacctcaggtgatctgcccgcctcagcctcccaaagtgctgggattaaaggcatgagccgctgtgcccgacgtctgcattttctcaggatctctaagtgattcacatacatgttaaatgtgacaagcactgaaacattatatgtaaaatactgagactgcctgacacatacttggctcctattaaatgtatgttgttgttatcatcatcatcatcatcatcccacagtattgcctgttttctcatcctcctccacctgagaggaaagaccacagagggagcatttaagccagccctagtcagaggagaatcaccaatcccagtggtctgaacatgaatgcctgcaaaccttgccaccaagggctacagtactctgtgtcacgactgccatgggcaccacggcatccttgtgcctagagtggagggggagcttgataaacgctgcgtgattttaagtcatttgtctaattcacatggaaaagccagactggaaccaggcaacatcactcttggctgagcccttttggactcattacttcccaatgctcaagcatcctttggatgaagagcagagacagagcctgagtttggggagaggattaggggatggtgcttaacagaaggaagagtctccaaacctattctacttggtaaaatccatcatttgcctaaggataatggcacaaaaattctcccccatgatcaaccccatctaccttctgccctgatgagaatggtcagattgctggagtctttctggagataaatattctaatccatcactactaggcgtctccgctactctcatcttcacccatcctgagcctcatttcaggcccctttgatcccatgtgactaatctatcagatagaagtcggttctgtggagctggtgaggcctttggaatgacaagctctccctctggcctcaacaaggaccgtaaaccttggttcagccgaggaatgaatctgccctgaaatctgggggccttatcagttttggagattagcaaaggccgagtcctgacctgaaagaaaatcccagacactcgccacactccctttgggactctgcaaagtcaaattttttcagaaaccaattccagttaagtaaatagtttctgcacatgagtgcccacagggttcctcagaggacctgacattctccacttggtgactgtcatttccttacaaacacaacattgaaagcgatctttgcattcccaaaatgattccgccagctgaggaattctacaattcttcttgagttcaaggctgccactttatttattgtgtgcttttatgacaacagcccctaaatgcatcctgtatgatttgataagggcctcttggccccactgcccccatcccatgtgtgtctttctttgccacaaatttccagcacactgttcaaatatgtaccacctaaattgaaccctcatgctgggagcactaatgggacgccccttcaaagcgactttctgtaacccaacagtttacatgttgctggaaacaatggacttaagcacacaatttatttgtgttggctggtttcatgctggttggaatctgctttggggggaaaacaaactctgcatctgtttagatttataatttatattgaaagcacaaatacctcataatagggctagaatgagacccagttatgggcaggagtcaccatatatgctggctttgttctttcatgaatgcactaagagattacaaactgcctttttttttttggagacggagtctcactctgtcacccaggctggagtgcagtggcacaatctcagctcactgcaacctctgcctcctgggttcaagcaattctcctgtctcagcctcctgagtagctgggattacagaggtgtataccaccacgcccggcttttttttttttttttttttttatttttagtagagacgttttgccatgttggtcagggtggtctggaactcctgacctcaagtgatctgcccaacttgacctcccaaagttctgggattacaggcgtgagccaccgcgcccagccgacaaactgctttttataatatttaagccatcctctttattcccccacgcaacccgccgcctccatccctgagaaacatctgcggcaggggccgtgccctgcctgcctgcctgccctctacacaagcactctgatctggctcttttccctgctgccctgtggaggggcctactttgtgcatagtcctggtacccaacatttgggggcttcccgggggggccagccactgttcttagtggcttgcatcaactacctcactccatcctcaccaccctcccaagcaatggcatccccatgatcagggattcctccatgatcaggatgaaactgaggcactttcccaaggtcccacagcttataagtgacagagccaggattctaactcaaagggtcttgctctagaatccatgctctcaaatcttaggtgcttttgcagcaaaatctacagaataagtagctggattgctccattgccttgacttttcattgcagttgagttggaagagaaataaggcaagtggcaagaaaataaaatatcatgcttaaaataaaatatcataaccactaaagcaaaatgagatcatgcttcccaaacgaaaccaaacaagaccaaaacaaaatctggaacagaacatattcacctgagtgcagtggctcacacacctgtaatcctagcacttggggaggccaaggcaggagattgcttgaggccaggagtttgagaccagcccaggtaacataacaagacccccatctctacaaaaaatttaaaaattagccaggcatggtggcacatgcctgtagtcccagctatttgagaggctaaggcaggagggttgcttgagcccagaaggtcaaggctgcagtgagccgtcatcgcatcactgcactccagcctggccaacagagagagactctgtctcaaaaaaaaaccaaaagggccgggcgcggtgggattacacacctgtaatcccagcactttgggaggccgaggcaggcggatcgcctgagctcagaagttcaacaccagcctgggcaacacggtgaaaccccatctctgctacaaatacaaaaaattagctgggcatggtgacatgcaactacagtcccaactactcagatgctgaggcaggagaatcacttgaacccaggagacagaagttgcagtgagccaggatcgagccactgcactccagcctgggtgacagagcaagactccagctcaaaaaaacaaacaaacaacaacaacatcaaaaccctaatcttcttcaccttcttcacctccatcttcaggcccagacaaagagatgccaagaccagaggggaggctcaggctcccagaggatcctccatctgtaagaaagagccacaggtttcaggacaaggggcagaagagcgtattccagggagcttgctgcctgaatcactacaagcagcgtcccagtaaacaggcctcctggaacccgtgcatgtgccagtgctgcctctctcatcaaaggtgagcctatctctccaaccacctgcagcaggttggcactgtgacatgctttgacacacagatgaggtggaagtgactgtgcaccactttggaaccaggcctccactttgcaccttccacctctgtttttactttttttggaatttcttcttttctttttctttcttttttttttttcagatggggtattgctctgttgcccaggctggagtgcagtggcatgaccatggctcactacagcctcaaactcctggcctcaagcaatccacctgcctcagcctcccaaagtgcattagctaccatgcctggcctgtttattggaacttcaagaccacaaatgggaaagaagctgggctagcctcctggaaggtggaagcccggctgggcacggtggctcacacctgtaatcccagcgctttgggaggccgaggcaggcagttcacctgaggccaggggttcaagaccagcctggccaacatggtgaaaccccatatctactaaaaatacaaaaattagtcgggcatggtggtgcatgcctgtggtccaagctacttgggaggctgaggcaggagaatcacttgaactcgggaggtggaggttgcactgagctgagattgagccactgcactccagcctaggcaacagagcgagactctgtctaaaaaaaaaaaaaaaaaaaaaaaaaaaaaagtgtgagctgaaagagccggtgaagtgacccattgcaagaggagggaagaatgcttgaggctgaggggaagaacctgcacaggtggttcttaccaggaggggttaggggaatctagaatctggctccattttacatataaatacagagcactttttgcatagttttaacaaacactaaattttcctggaatgcagtgaccatgtaaattgagagaggcctgtgcttaacttcgttcaggaattcaccaagcactgttcactgctctggagtaacagtcctggcagcaactccacccagccgcaatgccccacacctggatctttctgcaatggtcgctgtcacctgcaaagtgtttccacctgtgagttcaagcacctggatacttcattagaacttccagcattaaagtacatctgatttgattataagtgacctaccatttaatctcctcgattttatagtttgagaattacacatagatgttttcatgatctgagtatgtaggttatattatttatgaatttcatttcagggtagacaaggaggcactaggtctggtagggctgaaaccacaggcatcttcaagcacctcctttggctgtgtgagaagatgaaccaggctgacataagaactaacaagaggtatggagttagagctcagagggccaggagatgatgtcagaggaggatgtggggaaatcagagccctcatgcactgctggtggggatgcaaaaccatgcagccaccatgaaaaatagtctccagattttcaaaagtttaaacatagaatacaattttttttttttttgagacagtctcatgctgtcgcccaggctggagtgcagtgacagtctccactcattgcaacctctgcctcccgggttcaagtgattctcctgcctcagcctcctgagtagcggggattacaggcatctgccaccacatccagctaatttttgtattttgttttagtagagatggggttttgccatgttggccaggctggtctcaaattcctgacttcaggcgatccacccgcctcagtctcccaaagtgctgggattacaggcgtgagccactgcgcccggcccatagaatacagtttgaaccagcaattctactcctaggtatataccccagagaaatgaaaatatatgttcacataaaagcttgaacacaaatgttcatagcagcatagtcataatagccaaaaagtggaaacaaccaaaatcttcatcaactagggaacgaataaacaaaatatggtccatccgtacaatgtgatgtgattcagccatcaaagtatgaactactggccgggcacggtggctcatgtataatctcagcactttgggaggctgaggcgggtggatcacctgaagtcaggagtttgagaccaggctggccaacatggtgaaaccctgtctctacaaaagtacaaaaatgagccaggcatgatggcaggtgcctataattccagctacttgggaggctgaggcagaagaatcacttgaacctgggaggcggaggttgaagtgagccgagatcatgccattgcactccaccctgggtgagggaacgagactgtgtctcaaacgaacaacaaaaaaagtatgaactactaatacatgctacaatgaatggggatgaatcttgaaaacattttggtaagaacagaagccagacacaaaagtccacctcttgtaagactccaattatatgaaatgtccagaataggcaaatctagagagacagaatgtagaggggtggctgccgggggctagggctggggatagtggggaatgatagccagtgggtctggggcatcttttgtaagttacgaaaatgttctggaattaaatagtgatgatagttgtaggactctgtgaatctaaaaaccacatccaaagctgggcgtggtggttcatgcctttaatcccagcactttgggaggctgaggtgggaggatcccttgaaaccagcctgggcaacagagtaagaccccatctctacaaaaaaattaaaaaattagctgagtgtggtggcatgcacctgtagtcccacctacttgggaggctgaggtgggaggatcacttgagtctaggaggttgaggctgcagtgagccattatcgagccactataccccagcctgggcaataaagcaaaatcctctcttaaaacgaacaaacagctcacacctgtaatcccagcactttgggaggccgaggcaggcggatcacgaggtcaggagatcaagaccatcctggccaacacggtgaaaccccgtctctactaaaaatacaaaaaaattagccgggcaaggtggcagtcacctgtagtcccagctactcgggaagctgaggcaggaaataggaaatggcgtgaacttgggaggcagagcttgcagtgagtggagatcgcaccactgcactccagcctgggcgacagagcgagactccgtctcaaaaaaaaaaaaaaaaaaaaaaaaacacatacgaaaccaaaaagtgcatctgtaaatttaaaaaattgtaaaaaaaggaaaacaaaaaagaggaatcactgaactgtacaatttaaaggggtgaattttatggcacgtgaatgatatgtcaaaaagcaaagatgaagctgcagagataaggagggcacacctaggctaatctggagccattgagggctttaggcatcacagtggcaatacaggtttgcgttttagaaggatcactgtggaggatgaactggagatgggcaaaaacagacagctttaaaaggtgacgaagggggccgggcaaggtggctcacgcctgtaatcccagcactttgggaggccgaggtgggcagatcatgaggtcaggagatcgagaccattctggctaacacggtgaaaccccgtctctactaaaaatacaaaaaaattagccgggcgtgttggcgggcgcatgtagccccagctactctggaggctggggcaggagaatggcgtgaacccgggaggcggagcttgcagtgagcggagatcgcgccattgcactccagcctgcgcgacagagcgagactccaccaaaaaaaaaaaaaaaaaatggtgatgaagggtgaggcatttggaacaagcccggctttgggcttgagcagctggtggaggcggtgccattcacaggaatgttggcagcatcgtgttgggagcagtttgcactaacttctgtaacagaggtgcaatcacatacagggttgataagataagagctgcggctgggagaaattacttctgacttttggcatccgggaaggcatttggaagaggtggcatttaagcagaactttgcaggtcagcatagggcatacaaaaattcgaagggcagcctaggaagaatgagttgcaccagcataggtatgggggctaggaaatgcccaggtctgctgggattgtttggccaggtaagatgagaaacaacaattatgataacaaaactaaccaaaaagcatatccttccatttttcacaacctctctgtgaggcagtagcatcttttaataggagccaagattcaaaggagtccaggtgacatacctaaggttacacaactatgaaggggctggccagttttgtttatttgtccattttaagagacagggttggctgggcgcagtggctcatgcctgtaatcccagcactttccatttattctcctcgaggcgggtggatcacttgaggtcaggagttcgagaccagcctggccaacatggcgaaaccctgtctctacaaaaatacaaaaatttcccgggtgtcatggtgggtgcctgtaacaccagctactcgggaggctgagacaagagaatcgcttgaacccaggaggcagaggttgcagtgagccgatattgcaccactgcactctaacctgggcaacagagcaaggctctgtctcaaaaacaaaagagacacggttttgctcttttggccatgctggagtacagtggtgtaatcataactcactgcagcctcaacccccccaggctcacgtgatcttctcacctcagcctcacgaggagagggattacaggcatgcaccacaacaccagctaatgtttaaaaaaatttttttgtaaagatgggctgggcacggtggctcatggctgtaatctccacactttaggaggcctacacaggtggatcacctgaggtcaggaatttgagaccagcctggacaacctggtgaaaccctgtctctaccaaaaatacaaaaattagccaggcatggtggcatgcgcctgtagtcccagctactcaggaggctgaggcaggagaatcgcttgaacccaggaggcagctggagatcacaccactgtactccaacctgggtgacacagcaagattccatctccacaaaaaaaaatttttttttttttttgagatgaagtctggctctgtcgcccaggatggtctcgaactcctgggatcaagagatcctccagccttagcctcccaaagtgctgcgattacaaacgtgagccaccgcacctggctgctggccagtttttaatctcaggtctgtttgaaaaataggtacacaggtgagttcatgccaacttgtggcttgcagaccttatttttacagttaataaagtcattcttcctcttgaactagaaaacactcttctctgcatctctgttttgtattacacattccaatctctctcatctttcaatacgttttcttgagggagaaattgtgttcactgtttgggaaatgtaatctgctctacacaggagatgattaaggactcttgacacttatatgtagggatggagagtatgtatattttaggtgccagagaaaccataatctgtgaacaatatatcaattggggtgatgacagctgcttaatattaaatacgagatgtgggttctttctgctgcttaacctcccttactttgctctgagcaataaccatcaaaaacaaatacatattcgttgaatttttgtttcattctgtttgcattccagctgttgagatataatcctttttatataatacattttaaaaaaatatttgaatctttaccttgtggttttaacagccatggaaaaagtcctggctgggtgcagttggcttaatgcctgcaatcctaacacgttgggaggccaagacaggcggatcacttgagctcaggagttcgagacctgcctgggcaacatggtgagacctccctggtgtctacaaaatatttaaaaattagctgggtgtggtggcacacacttgtggtcctagctacttaagaggctgaggtgacaggattgcttgagcccaggaggtaggggctgcagtaagccatgtttgcaccactgcactctagtaggcaatagagtgagacctttgtctcaaaaaataaaaataaataataggccggggggtgggcggctcacacctgtaatcccagcactttgggaggctgaggcaggcagatcacctgaggtcaggagttcgagaccagcctggccaacatggtgaaaccctgtctttactaaagataccaaaataaaaaattagccaggtgtggtggcactcccctgtgatcccagctactcttgggaggttgaggcagggaattgcttgaacccgggaggtggaggttgcagtgagccaagaactcgccactgccctccagcctgggcgacagagtgagactgtgtctcaaaaatagataaataaataaataaataaataaatttaaaaaataatagataaaaaggctgatttaagggccccatcccaggcccagtgaatccaaatgtccaggagagattgttgtgtttcttgttgtcgttgttttgtttttgtttttgtttttttgagacagggtcttgttctgttgcccaggctggatgaagtggctcgaatatggctttctgcagcctggacctcctgggcttaagcgatcctctcgtctcagcctcccaaagtgctaggattagagccatgaaccacggcgcccaggctactctgcatcctgaccaaaccttaacatggaatctgtgttatttttgtggctgacaccaccagtgccatttgttggttccctctttgccagataaaggtaaagttgtgtcgtgctgccttgggtctgggccaaggtagtctcggcctcttagaaccatatagattttgactgatcaccccattcactcataagtgcagactacatgccagaactattttgtttttgttttgaaacaggggctcgtcgtgtcacccaggctggagagcagtgacacaaccttggctcactgctgtctcaacctcctgggcttaagcaatcctcctgcctcagcttccggggtagctgggactacagatgcatgccaccatgcgtggctaatttttgtatttttttgcagagactgagtccctctaagttgtttaggctggtcttgaaatcctgggctcaagcaatgctcccacctcggggtcccaaagtgctgggattataggagtgagccactgagcccaaccaaaactattttagatactggaaataaagcaggaaaaaaactaagtgtatgtctttcacagagggcttcggggaacttaggttctagcggggaagacagacaaagcaagtaaatatgtccagaatctgtcctgaagcagagagctgggggcttgagggagtggcagaggcaacttcgaaggacctgaaggagggaaagggtgtgggagctagattgcataaaggaggaaagatcacaggagatggaaggctattgtaaatttagcattgactctgaatgcgataagaagctttcaaaaagctttgaccggatgagggacaccatcagacaggttttaccagaatcctttctggcttgtgcagaatcaactggagaggggagggtagatgtggagagaccagagaagagtctactataatagtccaagcgtgagatggtggtggcttggaacagggtagaagatgtggacgtggtgagaaatagttggattctcggtatattttggaggtcaagccaacaggactggatgttgagggttgagagaagtgaaggagtcagggataattcctttattatttttatgatttatttatttacttatttttatttattttattttatttatttatttatttttgagacggagtttcgctcttattgcccaggctggagtgcaatggcatgacctcggctcactgcaacctctgcctcccgggttcaagcgattatcctgcctgggtagctgggattacaggcacctgccaccatgcccggctaattttttatattttcagtagagacggggtttcaccatgttggccaggccggtttcaaactcctgacctcaagtgatctgcctgcctcggcctcccaaagtgctaggattacaggcatgagccgccacaccaggcctgattgattgattgattgattttgagacagggcctccatatgctacccaggctggtctcgaactcttgagctcaagtgatcctccttccaaagtgttgggattatggggtgtgagccaccacacccagcctggggataattctaatggtagtcatctgcaagatacaactgcaaagatggagctgtgatctgcttcttgatgaagagggaggtggggagttcagtgtggaccatgttaagtgtgagatgcctactagacagaaataatggaagggccgagtaggcaactatatatgcacgaatggagttcaggggagaggctggggacagaaatatcagtgtgaaggccaccagcacacaggtggtattgaaagccatgacctggatgagatcacctggaaaagaagtcaaagaagagaagaggtgcttggacaaggaggtcctcagcattcagaagtgggggccaatcacagcttcactccttggctgggcactatggctcacgcttgtaatcccagcactttgggaggctgatgtgggaggatcgtttgaatccaagagttgaagaccagcatgggcaacatagcaagatagtatctctacaaaaaaaatttaaaaattagccaggcatggtggcatgtgcctatagtccaaactaccttgcaagttgaggtgggaggatcgtttaagcctgggaagttgaggttgcagtaagccatgatcatgccattgcactccagccagggcaactagtgagacccggtctctaaaaaaaaaacaaaacttcactccacagatgggggatctgaacgtgatcaatttagtcaccaatctctggacctcctttggtgtgctgagagtggaggagagcggaaagagaactggatttacgtccaaaagacctgccctctgtcatttactgtgggaccctaagcacagcatttcacctcttgggaaatgctgtggaaaccaaaggtggggggttggggccagagcctggagaccttggaaagaactgagtactatgctaagggagggggaagggagggggcagggcaggttgctgcccctgtagccctcagcagaggcctcctgtaactcctctggatgtggcttttagttctggcaggaggtgatgagtgtctgacctggggatgctgttacatgctaacaggggaagaccagcatgttagaggttgtttttttgttttgctttgttttgttgttttgagacatggtctcactctatcgcccaggctagagtgcagtggcatgatcatagctcattgcagcctccaccccctgggctcaagagatcctcctgcctcagcctcccaagtagctgggactgcaggcatccaccaccatgctggttaatttttgtattttttgtagagacagggtttcgccatgttgcccaggctggtctcaaactatccgcctgcctcagcctctcaaagtgccaggattacaggcatgagccactgcgcctgcctgtgttagaggtttagaatcaggcagccacttgaatatggacagtgacggagaaagagggttcaaaataaagttagagtcctggatgactggagagatagtggtgctgttatcagagatggattacatgggagatagagcagtggaagacaaatgataatacttaggacacaaagagttcagagagggattaaagtgtagggagtgtccatggaattttggtacatggccacttcttgtccttaaatagcctccaaacccacagaaacattatctttccatatcaccctaaagactgtgcagcagtgatgagtaaaatgactctgacctcaattaaatcaaaattctaggaatacaccagctcctttggagtttcttactaacgctcctttctctgtctctgattccccacttgcagctcagacagtgccctctgttggaaacctcaaccacaaatccccgtcctcgactccatggcgagaaggacctagaaggaaacaaacacctcccaggagcctttcacacacattgttctcattttatccttgcagttgcttggtgaggttactgtgtccaacctgggcaaactgaggcagctgccccaatcacagccagagcggagctgagatcggaactcaaggcggctgccttcaaagcttgtgcttcactccctctacctagctgtagctgtaggatgatttgacaagggacttgaagatacaatctcaaggacagaggtttgtttttttttgtttttttgttttgagatagagtctcgctcagtcacccaggctggagtgcaatggtgcgatctcggctcactgcaagctctgcctcccgggttcacaccattctcctgcctcagcctcctgagtagctgggactacaggtgcccgccaccatgcctggctaattttttttgtatttttagtaaagacggggtttcaccgtgttagccaggatggtctcgatctcctgaccgcgtgatcagcccgccttggcctcccaaagtactgggattataggtgtgagccaccgcgcccggctactgttgattcttttttgttggttggttggttggtttttgagacagagtctcgctctgttgctcaggctggagcgcagtgtcccgacctcagctcactgcaacctccatctcctgggttcaagcaattctcttgcctcagcctccctagtagctggtactacaggcacatgccaccacgcctggctaattcttgtatctttagtagagacgaggtttcaccagaccttggccaggctggtctccaactcctgacctcaagtgatccacccgcctcagcctcccaaagtgctgggattataggcatcagccaccgtgcccagcctctgtcgaatcttaaactaaaaaattaaagtgtgtattttgtatgtctttgaggttttaaaatcttatttttctggtaatttatttttattatattttacagcagtatccacctgcaacagttggacaatttaaaaaaccagtactttagcactctgagaggcacggggctgccggagagagaagagttgtctaaactgaggaaggtagccaggcgcggtggctcacgcctgggatcccagcactttgggaggccaagagggcagatcgcttgagcccaggagttcgagaccagcctggacaatatagcaaaaccccatctctatttaagtttaaataaagaagaatttaaagaaaaaataaggtgtggcaggtcctccatgtttggtgtatgaatgaatacatcactgaaggaatgacgtatgagtgtgagagaatcagccacatgaagaaaaatgcccagaatccaggtttctcatttagagccattcaaagggtgagagcttaggatgtcaagttcatcaccagacttgatatgcacatcactaaacctgcacccttctgattttaaagatggaggtgggagacctttctcccccaagtcatagaactgatcaacaaagaaaaaaaaataccaaaaagagccacatataaataacaagcaatatttactgctcgtgattttaaaactcagactaggttagtagactaagataaacattctccttaccattttcaccaagtaacaggaaaaacacagcccatatgcacaaacatcctattttaaggactgctggtttttgggttttgttttgagacagggtctcactggagtacagtggtgcggtcatggctcattgcagcctcaacctccctggctcaagcaatcctcccatctcagcctcctgagtagctgggacgacagtcgaatgccaccacacctggctaattttttaattttttgtagagacagggggttgcccaggctggtcttgcactcttgcctcagcctcccaaagtattgggattacaggtgtgagtcaccacatccagtcaaggactactgtttgaagtggaggcttttgaacacacttaccctgggatgatgaaactgaagagtgagcaggatttagccctagggtacaagttcctcaactaccttgaagtgcttcaactgtgcaggaaacaccttccacctaaagtttctgcctctaaacaggagcaaagatgccccactcaagaaaagttccaggcacaccttgctccgttttggaaattcccactggcactttccagaaacaagtaggtccctttaaacttaaaggcacctggggccaggtgcggtggctcacgcctgtaatcccagcactttaggaggctgaggcaggcggatcacctgaggtcaggagtttgagaccagcctggtcaacatggcgaaaccccgtctctagtaaaaatacaaaaattagccgggcatggtggtgcgcacctgtaatcccagctacttaggaggttgaggcaggagaatcgcttgaacccaggaggaggagattgcagtgagccgagatggtgccactgcactccagcctgggtgacagagtgagactccatctcaaaaaaaaaaaaaaaaaaaggcacctggaatatgaaaattgcatttttttttcctgcaaagttgtgcagtagaaagcaatgtcagagtagccctcagtcctcatcccaggctactcccattcttcttggcataaatcttttaggcaaacctatttattctcccctctaaagtgtcaatttcacatctgcaaatgggatcataataataatagtacctggattaaggtgaggattaaatagcaaaatgtgtgtagaacccttagcttgggcctgacacagtgagcctttgatgaacacaagcttggggctgtctctaatcacaagccaaaatagaaacccagagaagtctggaccagtgacagataccatttattcagcatgtgccatgtgccagaaacagtgttaagatctttattagctgttgggatgcttttcttttttctttttttttttttttaagaaacagggttggctgggcgtggtggctcatgcctgtaatcccagcactttgggaggctgaggtgggtggatcacttgaggtcaggagtttgagactagtctggccaacatggtgaaaccccatctctactaaaaatataaaaattagctgggagtggtagcaggcacctgtaatcccagctactagggaggctgaggcagaagaatcacttgaacccaggaggcagaggttgcagtgagcagagattgtgccattacactccagcctgggcgacaagagcaaaattctgtctcaaaaaaaaaaaaaaaaagaaagaaagaaaaaggaaagaaaggaaagaagagaaagaaaagaaaagaaagaaagaaaggaagagaaagaaagaaacagggtcttgctctgtcacccaggctggactacagtggcacaatcatagctcactgcagcctcaaaattctgggctcaagcaatcctcccacaccagcccctcaaagtgctgggattacacacatgagccagcatgcccagcgctagtggaattccattttttctttttttcctgtgtgtgttttttgtttgtttgtttgagacagggtctcactgtgttgtccaggctggagtgcagtggcacaaacatagctcactgtggcctcaacctcctgggtttaagtgatcctccttcctcagcctcccagttagctgggactacagtcatgcaacaccacgcctggctaatttttgtatcttttgtagggatgggatttcaccatgttgcccaggctggtctcaaactcctgaactcaagcaatcctctcctcagcttcccaaagtgctgggattccaggtgtgagccgccacacccagtttggtagaattcttagtacaactctttggagtagctactctcagtgtctcattttattttactttttatttatttatttttgagacaggctctccctcttgtcacccacgctggagtgcagtgacatgatcacagctcactgcagcctcgacctcccaagctcaagtgatcctcccacctaagcttcccgaagagcttggaatacaagtgtgtgttaccacacctggctaattttgcagagatgaggtctcactatgtggcctaggctagtctcaaacgcctgggctcaagtgatccttccaccttgacctcccagagtgctgggattccaggtgtgagccactgtgcctggccctgcatctaattttagagagccagaaaggtgaggtcccctgtccaagctctcccagctcagagagactccctgccttgctccccatcaccccacttgcatgacgttcatgctgccctcttctgtcctcttctgtgtttctcagcctgaaagcgtgggcatcaactctggctggctttgttgttgttctcaagcttctgtcatcattggtataattttacataaacttggcattcctttaaatttcagaaaatatgttcacttcttaaatatctcctgggggagataagagttctataaatgatttcgttctccccgccttcgtgttgaacttaaaaaggcgaagtcactggatctccgttaacaagtcatgttgtttattggtttattttcattttggaaactcttctccatggttaaccactcttcctcctccttaaaaattcccatgaggaattcggatcagacgctggggctgtggggcagatccccgggaggatatcatgtttctagaaggctcctggaagccaacaagcattgcaacctgactcttaactgactttttacctgtaggattatctcggggcaggaggaaaaagacacaggcaagctttctggtcccaaataaaatgatgtatttcgtgaaggaagaaagttttaaactaataatagaaattcatttgaccataaaaaaggcaatataaaagggtaaggactctggaacccaactgcttgggtttcaataccacacagctctgccacttatctgtgtgatgctggccaagctatttaacgtctctgtgcctttatttccaatctataaattgaggatgataacagtacctaaatccatatgttttgatgaagataaaatagggtatacaagggactggaaggtttcttgggactctcaggactataactgggaaagtcacaagcaaactgatatgtgcccatcaccttaagatgaaatgagaggccgggtgtggtggctcgtgcctgtaatcccagcactttgggaggccgaggtgggcggatcacttgaggtcaagagttcgagaccagcctggccaacatagtgaaactctgtctctaccaaaaaatataaaaattagctaggcatggtggtacgtgcctgtaatcccagctactcaggaggctgaggcacaataatcactttaacctaggaggcgggagttgcagtgagccgacatggcactactgcactccagcctgggtgacagttagactccatctcaaaaaaaaaaaaaaaaagatgaaatgagagtgtatatgtacctttattttatttatctgtttttaattttaaaataattttttatttattaattaagatggggtctcactgtgttgcccaggctggtctcgaacctctaggctcaaggagtcctcccactttggcctctcaaagtgttgggattacaagcatgagccaccaagcccagcctacatgtacctttagaaacaacacctgcacattttttttttttagacggagtctcccactgtcgcccgggcatgatcttggctcactgcaacctccacctcccaggttcaaataattctcctgtctcagcctcccaagtagctgggattacaggctcctgccaccatgcccggctaattttttgtatttttggtacagacggggtttcactgtattggccaggctggtcttgaactcctgaccttgtgatctgcttgcttcagcctcccaaagtgctgggattacaggtatgagccaccacgactggccaacacctgcacattttaatgctccttcatcttttctgtttctattcgtggctgcctccagccatggttgattccttgccatttgtaactatggtcctcatttcctcaatatccactctgcaggggcccatgatatgccttttattcctatcactacactgacttgtttcccaaagttccaaatacatgtcctggccagtcacgggacagccattaagagaatttattaagtgccaggcaaagagcttttcaacaaatccttcagacttttcttcttcctcaattttcaggcgacacgtaacttaaaggttaaaatggggatgataatagtctcctccccttgcgtgaatgcccacaatggtttttgcttatctgtccactcctcctctgtctcttaatagttgaagagcctggtgtggtggctcctgcctgtaatcccagcactgtgggaggcagaggcaggtggatcgcttgaacccaggagctgaggccagcctgggcaacatagtgagactccatctctacaaaaaaataaataaaattaggtggacatggtggcacatgcctggggtcccagctactttggggggctgaggtgagaggatcgcttgggcctgggaagtcaaggctgcagtgagctgtgattgtgccactgcactcctgtctgggcaacagagtgagactgtctctaaaaaaaaaaaaaaaaaaaaaacacccaaatagttgaataatatgaattatagtgacaattttttgagagcttactatgtataatactaggcactatatcaaaccccttaaaaatatctcattggatccttatgaaaaatccaaggaataggtaccattattatccccattttacagatgaagaaactgagtcaggaaggccagctcacttcccctagtggcagaatcaggacttgaacccaagtatgactccagagtccttgctccaagcatttcactattctgtttcctcttccttctcctgcctcaactgtgctttctggacaagtttctgccttgatgacaaggctctgagcaggaagcctcacctcttcaagactcagtctgctcttcttttttttttttttttttttttgagatggagtcttgctctgttgcccaggctggagtacagtggcaccatctcgactcaccacaagctccacctcctgggttcacaccattctcctgcctcagcctcccgagtagctgggtctgcaggcgcccgccaccacgcccagctaatgttttgtatttttagtggagacggggtttcactgtgttagccaggatggtctagatctcctgacctcgtgatccgcctgccttggcctcccaaagtgctgggattgcaggcgtgagccaccgtgcccggcctgctcttcttttttttgaacaatataaacatggtgtattaacaccaaatagttgtgaggatggaacgcttgtgaaatgcatagcacagtgttcccagccactgtgatcagtattatagaagaattttgattattactccatcagtatgttcctgttgtagactgaattgtgttccccaaaaagataggttaaagtcttaatctccagtacctgggagtgagaacttattaggacatagggcctttgcagatgtaataaaactaaaatgaggtcaggcctggcatggtggcttacacctgtaattccagcactttgggaggccaaggtgggtaggtcacctgaggtcaggagttcgagaccagcctggccaacatggcgaaaccccatctctactaaaagcacaaaaatttagctgggtgtggtagcaagcacctgcagtcccagctacttaggaggctgaggcaggagaatcacttgaacccaggaggtggaggttgcagtgagccgagatcatgccactgcattccagcctgggcgacagagcaagacttcacctcaaaaaaaaaaaaaaaattaaaattaggtcattagagtagtcctaaatccaatcgctggtgcccttataaaaatagacacagaaacagacagacagacagacacacacacacagagagaacaccacgtgatgcatgtgatgatggaggcagagctcagagtgattcggctgccagtcaaggaacactagtgattgctggcagccacagaggctgggagagaggcacggaacagcctgtccctcagagcctccagaaggaaccaaccttgccaatacatagatttcagacttctggcctccagaactgtgagacagcaaaattgtgttgtgttaagccacccagcgtgtggtactttgtgaacaaatacacttcctggccaggcgcagtggctcacgtctgtaatcccagcactttgcggggccgaggcaggcagatcacttgaggtcaggagttcgagactagcctggccaacatggtgaaactctctctacgaaaaatacaaaaattagtcaggcgcggtggtgcacgcctgtaatcccagcgactcaggaggctgaggcacaagaattgcttgaacccaggaggcagaggttccagtgagctgagatcaagccactgcactccagcttgtgcgacaaagcaagactctgtctcaaaaacaaaacaaaacacacacaaaaaacaaatacagttcccttccacagcctaagtccagaccttcacattctgtgcaagttcctcttccaagggcctcttcaaatgcaggcctgcctgcagctctctttcctcaaatctgtcttaacacaccaatttctgactcccgggtcaaaaacctgcgatgacacctgaatacttacatcagtatttcctaaagttgcttgagataaggatcaccaggatgacagtccaaattacaggttccctgctaggtgtggtggctcacgtctgtaattctaacactttgggaggccaaggcaggtggattgcttgagcccacgggtttgagaccagcctaggcaagaaggtgaaaccccatctgtacaaaaaatacaaaatattagcccggtgtggaggcgcacacctgtagtcctagctactcaggaggctgaggtaggaggcttgcttgaacctgggagggcgagactgtagtgagtagtgattgtgcaactgcactccagcctgggtgacagagtgagaccttgtctcaaaaaataataataattataggtttcctgggccccgctccagactaccagacatgagatcacagaagaggcgcttggaatctgcatttttaataagcacccaagacaattcttttcctcagtcacatttgggacactctggcctacaagataaaatctggaagagactaaagatcttgcctcgatgatctctataaaatggcgccagcctccccattcaaatgtcatctcccaaggcttcccactgtctttacatccctccatgtgaacagcctgcctcactgtcctcaccttgatcaacctctgctcaaacctttgttcttgccattctcctgcccagaacacctcttccttttctcccatcatctaggtctgattcagatgccacagatcttaaaattatttctaattgttccaagatagcttctcaatgacctcagaataaaattcaatgtccttgtcatagcctgcaagaggctgcatgatctggccatggtcggtctctctctctctcttttttttttttttttgagatggagtcttgctctgtcacccaggctggagtgcagtggcacaatctcggctcactgcaacctccacctcccgggttcaagcaatcctcccacctcagcctcccaagaagctgggattacaggtgtgtgccaccgcgctcggctaatttttgtatttttagcaaagatggggtttcaccatgttggccagggtggtctcgaactcctgacctcaagtgatctgccctcctcggcctctcaaaagtgctgggattataggcgtaagccaccatgtctggcctcagtctcattttaagccattcttctccttcactccaagctccaggcctggtcgggtacagtggctcatgcctctgtctaagcaaaggcatgtacacgtgcatggatgcacacacacaagcacacacacaacacacacacacacacacttgctccactcatttcactcactgtaccctgtttgattagttgccaacatttaaaaatcaagaagtttcacataaaaacgtccagtctctaactggatgcagtggctcatacctgtaatgccagcattttgggagaccgaggagggaggatcgcttgagctcaggagttccagaccagcctgggcaacatagtgagatctcatctctacaaaaaaatataaaaaactagccagttatggtggcacacgcctgtagtcctggctgctcaggaagctgaggtgggagaattgcttgagttcagggtttcaaggctgcagtgagctatgattgcaccgctgtactccagcctgggcaatagagcaagaccctgtctctgaaaaaaacaaacaaaaaccatccagcctctcttaaagaatcagatctgcccacttcaaagccctccttcccacgcagctggagccatatggactggaggtgagtcccttctgcggggcggaagctctggtcccctgcagtccccacccagcctctccttccaccccacattggtgcacttgctgactgtctctcacccttgtaacctgggcatttagcctgtgcctggctcttagctacaccttaataaatatgtgctgaatgaatgaaaaaatacatgaatggatgccttccctcctccctaaaccccccaggccacaccacttatttggccatttaatcacagccttccttgcaagtctcactaatttgctgccccactgcctgcctcctcagtagatgttattaaaacacaaatctgattctttcattccccagttttaaatgtgtggagtctcccagcataaactctgcaccatggcctccgaggcccttctcaatctgcttcccacctacttttccagtcccaatctccagagagggcccccacccagcgcacacccacgctctacgcgctggctggggaatacaccatgttctttccctgcccccacaccactgcctgtgaagctctgtctcctggaatgcctcctcccctccgtgcctctagcaaactcctactcattcttcagccctagcactaagtcacttcacccgtgaaacactccagaccccccctgccccggggctgacttagtcattctctctctgctgctcccactcttctcctttcatcccctggccttagcactgagtaatagcttaaaatagcagctggtgctttctgagccctgttgtgtgccaggcaccaagtgagctttatctcccttaatcctcacgccccatcctgagtcccggccccctaaacctgcagaaacacaaggatcactttctcacctccaatgtcccagagaagccatcttgctaccctattttaaattttctttctccctccactcctcactccaccacctcaggcctcccatcccacttcccagctttattttcctccatggctcttatcacttacacactatatacttaaattcatttatttgcaaatgtcagctccaggattttgtctttttttaacactacaatttccttaacatctggaatactacatggggccgggtgcagtggctcgtgcctgtaatcccaacactttgggaagccaaggtgggaggactgcttgagtccaggagttcgagaacagtctgggcaacatagtgagaccctgtctttttttgttttgttgtgttttgttttgttttttgagacggagtcttgctctgtccccccggctggagtgcagtggcgccatctcggctcaccgcaagctccgcctcccgggttcacgccattcagtgagaccctgtctttacaaaaatttaaaaattagccaggagcagtggtgcgaacctgtagtcccagctacttgggaagctggaacgtttgctggaggtaggaggatcacttgagcccgggaggcagaggttgcagtgagctgtgatcatgccacggcactctaacctggacaacagaatgaggctctgtctcaaaaaaaaaagaaaaaaaaatagactagtacctggcacataatagatactcaatcagtaataattttttttttttttagatggagtttcactcttgttgcccaggctggagtgcaatggtatgatctcagctcactgaaacctctgcctcccgggttcaagcaattctcctgcctcagccctccgagtagctgggattacaggcatgcaacaccacacccggctaattttgtattttttagtggagacggggtttctccatgttggtcaggctggtctcgaacccccgacctaaggtgatccacccgcctcggcctcccaaagtgctgggattacaggcgtgagccactgctccaagccttataataataatttgttttaaaaaaagaatagagacagagtctcactatgttgcccaggctggtctcgaactactgagctgaagcaatcctcatgcctcggcctcccaaagagctaggaaacaggcatgaatcatcacgcccagcctcaatcaataataattaaatcaaagaaggtagatactattactaccttcattttacctgaggaaacaaagattgagagacaagtgtccagggttccacagcggggtggtggcagaaccgcatgtgacccctgaatggtcaagtctagtgcccgcctccttagctgctgtgcccaccatctccaggggagtttatggttccctctccatgagtctgacttctcagctcgaccctgagttccttggaggcaagcactctgtcgcgttcatgtctgtttctttgtctgatccatggtaggtgctccaggaacgtttgttggagcagtctgtccatggaaggtgcagtgctcaacggcaggaatcaatcacagtgtcattctttcgttgttgttttcctttatctccatgcacaatgttatacatacagttggggctcattacatacatgctacattaatgaattatattatgacagtaggtaataaaaataattagacagcaataatgacaataatatgtaacacttagggcatccttactctccgttgggcactatcctaagtgctttgtatatgaattaaaacaattcattgtcttattatgctcattttacggatgagaagacagaggctcaaagaagttaagaacttgcctaaggtcacatagttagaaaatggcagaggcaggactcaactgtatgtatctggcttgagtcatgctcttaatgattgctcttggcctctctgagggatgtctactgagaggttacccggtgtgaaaacaaaaagaagcatttatttattacacatttccattttatttcaaggaactcctttcaaaggctttggtaggcaacattatttgctaaatgaaacccagtaatatctgtaccagacttgatggtttgcagagcagtttcatgtatggttcctcatctgagccctgcaacaatctggtgaggtaggcattgctgtctacttctgtttatagaggaacagaggagaaatctgaggctctgagtggttaagtgaacagggtcaaggtcacccagacagcaaggagcagagcaacgactcaaataaatgtctatcagtttaaaaaacaaagatctgatgcctccaaatatgaagttatttcatgcaacttaaaatcaaataagtaaatagcagcttagccagtttctggcacctggtaggtctcataaatgttaactatcaactatcttcatcaacacctcctgggaagtggaatagtttggctgatgactgcagcctgtctgttgaccctgatggaaagattattattttcattccagttcatccctggtaatgttgaaataatgatcaatctccattatccctggagtaccatagaatgttatgagctggaaggggttgtggagatgatctcatcaggtcctgcatttacagatggagaaattgagtccgagagaggggtcagaaagcaaacccgtggcagaccaagccaagggcaaggcttaggcaccgtgcctggcacatactgcctcctgcaaagctgagtttttacctaaaagggctctcacgtcctaaaggctacagaaaacaattcattcgtctctctgtctgtgagcaccaccaccccagctccgcgcaaaaagcagtacagtattataagctattaaccagaaaacagatcatgtgacttaattccacctctgctaaagggcttaaaatgcttcagtgagtagtctgatattcgtaaatatacacttcaactatttctcaaagaatgattaaccagctccatcagaattggaacttgtgcaatcaaggagaaaaagagctggcaagagaaatttattgaaaaaatttttaccagcattacagatgacttcttgccaccttttttttttttcctaagagttagaggaagaaggaaaggaagaagaatcattacacaataatgaattaagaaaactaattgtggaaaattacaaactcctttcacctcacaaggtagctttcaaacaaacacaacagggtatttgtagaacctaaagacacagacagtattgaaaaggagcagaaagcaggagtgtaaccttcactaacttctttcagagagtggagaggcctgacagtgtatgggcgtgattatctctggtagcccattctggactaacgattctgtgaacctataatttagagagtccataatgtcatatgttcaccttacttatctccctaacccactgagtattaattctcccaggcaggggactagctttttaggccacttgtaagtcttgatcagctttagcttgaggatttgggggtggggagggatgatggacagaaataaggttagggttagccttcaaatggaagaaacgggaatataaaatcctcgtctgtgctgatcatgcttctcaagaaaggctgaaattcaggcccagtgaacacacttgtggccttaacatctctcagaatgaaaggattttcttccttcacaatacctttatcaaattccaactattttctacttttcttccttatacaacccaggcgcacgggttgaaataattttccttaagaaatccaggaagctctggcctggccctccctctagaaaggaaagtccaagtaaagagggatgccacacctggggaagggagagaggatgtgacgacacctccaggaatgcagggcccacgcaggtgcactggcacccacgaacttcctgataaatcagtaccgataacaggagtaaaactcaaccacccaacactcactcacacagagctggggtgctgctcccagggtgtggccttgccaatcagggagaggaggaggagacctaagaacggagctctctaaaggtggtgacatggtatctagtccagccatgatcagagtgtggtctctgggagtccctgagacccctttacgggggtctctgcaaggccaaaactgctttcacaaaactaagatgtcatttgttctcatcattcccattgtctcacgagtatacaatggagttttccagaagggacaagacatgtgatgacatcatcactctgatgactgttggaatgcatgcttgtgtactcccatgttttggacacatccgttttaattctaagataaatattgaaagacattacacataaacaaagtactttggggtcctccatgatttttaatagtgtaaaggggtcttgaaaacaaaaaggttgggaactgctgtgctagtccaaacaggggagttacaggccctgacatgcactttatttccggctgaacttgagtcacctcctatgtgctttcaaacagggggtggaggcagcttgcttatttattatacagcttggattggtgtcctttccacctgtgctgccacaggtggccagaaaaaccttaaatcctcccacaaaacgtctggttacctgaatcctccagagggaaaaaaatgagcttctcgcctttgaacccaagtggggcaaagagcctgcagaagggacaccctcagtggcagcacccagcaaagacccatctgagtacccgctgggagtcgggttctgtgccactcaatgccagcaaagcacaagccgtccctgcgccttcgggagctttcattctaggctggtggcagattactcacaaaactcagatgcacacaaaaatgggaaacctgtaacttgtaacaagtgctgggcaacaggggtacaagtgttaggaggcctccgaggtgggcagggagatgaggggaggaaggtaccctaaccactcttcttgccaaatctcaggttggaccttcccctccacctccattcccctgcccccttcctggcttgcaggtttcaacagctcttggattcccgggtcccacagggagaccttgggacctgggaatctcctccagccaaaagcttcagtcttctcctctcctccccatgacccacagggtctgtgtgaagagaggccgggctctgggacgttcagagaggaggattcagcgttttgttgctctgggacacagcttggtcactccgggaaacgaacacaacctagaggctgtcatttgtagaaacagcgaatggccaaggaatggcgggaggagggaaaaggaagacttttaaagaaaaaaaaaaaaagccctgaaagactggactagaaatcctcagggaggctgggcctgcaaggagccttcccgcgcctcagcccactttccttccctctcgacctgacggacttaaggcgtgcagagtctcttcggacaaaatgaagccaagagagccctaagcttctcccccagcaaccgctgcagaggcgggaaaacttgaattttgcaaccaagagttgcagcgggacgcctaagcaacgataaggggcggtggaggggcgtcgttgggggctgcagcatcccaaagtggaagcgggaagggggcccggctggaaccgaatagccccgcagcgcctcggcaaccggacgggcggcgcatccaatcccctggaccgtgcgtgtgactggcgcgcgctaagcggcgcgagccccggcggagccgggcaaccaggcgcgcgctcgcgcgtgcgcaaaaggcccacccagccgagcccttcttcaggtgcgctcgcgcttccggccggcctccccgcgtgccttcccggggcggaaactccagcacccgcgcatgcgccttctggctctccggcctgaagcggggcggagggccatggcttcaggtgatcccgcccctccctcgtagcgcaggaccaatcgtgcggtggtaggcggggttttgaggaggcagcccgcccacgcaccgcgcgaggcgtgtatcgattggttggcgccgcgggcgcaggtgcgcgctttctattgggtgtgggcggaacgcgagggattgcggcatcttcgggggctgcaggtgagcgcgcgcacgcgccgcggctgtggtccgctcgggtgcgcgcgcgcgggctcgcgggggaggcggcagagggagaggttgcggcgcttgtggcctccgctccgccccctcctctcctccagcgctgtcgccgtcgccgccggggcccggagggagggagctgcttccccgcctgccgcgccaccagtccgaccctcggtcccgccgtgtgagcagctggtggagtggagctcagcgcggacgccggagctgcggccgccccctctgcaggtgcctgtgaggaggcgcccgggccgcaaccgctttccgagatccccagtcgcgcactcgctccccgcgctcctgaggggccgcccggccggaggaggccgtcgcggggctcggcgttcagcatgaaccgcagccaccggcacggggcgggcagcggctgcctgggcactatggaggtgaagagcaaggtgcgcggggcccgggctgggcggagcggcgggcctggggggccggggcctgggagaggccgggccaggctcggagcgccgggggaggcgacgggctgagctgccccggggtctggacggtgcggtcgggagactgtgggtaataaacttgccgaggagggggtggcgggggtcagggggcgctagtgtccgcccctggcccgggcaggaagaagacctagtccagcatttaatctcattccgtaaatctcattcccgtgttcacggacgggagtaggggccaaggtatatccaaggatggcgcacactgagtgaaatgcgaggctgctcaaaaggtgtaggagaatcctgcctgctgggctgtgagtaaagggccctggaccaccccgttgttcccactttctgtggttaaggggcgcatcgagtggcgaaggagagagcccagtgaactaaacagccctttaaaagttcgctttgcttcctgctggcgctctttctagcactaactttggtatgcatttaatctgtaaaattagtactatcaccttacgttggagtagcactttacagtttgactctagatgctcttttcattccatcctgctacctactcacatcaagtgcttttccccttgaccaacggtatgccaatctgctgataattacttcggtattcactgaatttctaaatctcaaggctcagtgagcagggtagtctgtagggagggattagttagggaatgccttccaaagggggttttgagctggaatttgaaggtgatcggcagccaagggaacactttcagcaagcgtttcttgagttgaagagttaaaaggagcttagataatctagcccaattctctgagaagactgaggcttagaaaggttatgacttcctcaagctgtttttttgcaaagccttcatgcctttttaataacttctagacattgcagaatacaaaacaggacactggctgggccctgagaacatttaaaatagaattgagaaggccaaaacacagaaaaggagaaaattgaaagtatatcaatttcaaaaaaaaaaagtaatggagcatcatagatggtaagactactaaggagtatgtaaaatcaaggagtgatttgagtgaggtacagtggagtaaggaaagcttcctagagcctctaggtagaatagttttattgtctagggttgataagcaaagttctgtaagtttctgtaactgagaatcacatcgagaaaatcgacattcgtttgtaacatcattaaaaaatgtgatttgagtctgggcgcggtggctcacgcctgtaaccccagcactttgggaggccgaggcgggtggatcacctgaggtcaggagtgccagaccagcctggccaacatgatgaaaccccatctctactaaaaatacaaaaaatttttagccggccgtggtggcacatgcctgtaatcccagctacttgagaggctgaggcaggagaatcgcttgaatccgggaggtggaggttgcagtgagccaagtttgcaccattgcactccagcctgggcaacaagagcaaaactccatctcaaaaaacaaaacaaaacaaaaacaaaaacggcttggcacttacatgaggattggcactagtttcagaattagtaagaaaagacgtgtagttacagcaatttaaggaatgtgcatgtccatgtgtcctctgtgcacagcatagcaaattgaagtgacttgcttgagctatagcgttaagatgacccaaaatacatagcagaacttttcctttagcggtatggtggcagtagaggttccatgcccagtggttgaaccttcttatggcatttttgttataagtttagtttggatttgtgggagttgaggttatggaaagaaaaacacttgtgatattgcataatcttaaaattttaagtttatagccctaatcttggtagcaagtctttaatttttttccacagaaaaaaatgagtaggaattctaagtatactgataaatacaatcaaatagtaatttatctctagtactaagaaaccttgagtgctttaaaactggaatttcaggctttttgcctttctcttgtcaactgatttgtgaatctttcacttacttctgtctaaactacatgttgtatatttgaactgccatactgcactttcagctaactgtgtcttttaaatagaatcatacactgattctaggaacatgtgctgaatgaagtcggtcccactattctagctgttgacaaataggcaagatataggtagtgagtgtttctagtatgtctatgacaccttatatgtttcaaatatatattgctgatacatttattttcagtagattgaaacatttgtcaccttaaccatttaaaaaatatttggaagggtttttgaaacagtattttctttgacattgctttagtgataccacagctttttacaaaactgattgctaagagtttataaccaaaactaggtagtgtgccggtccttttttttttgagacaggatcttgctctgtcacccgggctggagtacaatggcacgatcacggctcactgcagcctcaacctcctgagctcaagcgattctccgatttcagcctcctgagtagcaagactacaggcgtgcaccactacacccagcttatttatttatttatttatttatttattttgtagagatggggtctctccatgttgcccagtctgatcttgaacacctgagctctagtgatccgcccgtctctacctctcaaagtactgggactacaggcgtgagccactgcacctagctggtccatttttctcttactattttcaatttttttttatctttttagagacagggttttgccatgttggtcatgttggtctctaactcctgagctcaagtgatattcccacctaggcctcccaaagtgtttggattataggcattagccaccacactgggttccggtccatttttaggatctctttttcttcatataaacagtaatgttggccaggcatggtggctcacacctgtaatcctagcactttgggagggcaaggtgggcggatcacctgaggtcaggagttcaagaccagcctggccaacacggtgaaaccctgtatctactaaaaatataaaaattagtggggcgtgatggcatatgcctgtaatcccagctactccggaggctgatgcaggagaattgcttgaacctgggaggcggaggttgcagtgagccgagattgcgccactgcacttcagagcctgggtgacagagggagactctgtctcaaaaaaataaaaaaatgcaataaagcagtagtgtcaacattattatcttcacacgtggaagggaaaaatagtaatgataaaagaatggagaatgtaaatatacctatagttcaatttgtggtaccagctagtatgtgacttttctttggtaactgttttatcttcctaattgtatctctagtgttgggaagattcttaatcaataatcttgatgatgtcctttaataaccctggaacagtctttgagtcataaaatttcctaattattattcataggcaaatagactatgaaaattaagtttgcatttctagaatgtaccaacagacactgggggaagggagtccatacacattctggatggctagggcaaactaggctatgaaacagttgtaaatggttcacaagtgaataattgctgattgaatcttaattttgtctcttagtgtttttgttcatgtaaaaagttcccttaatcctattgttgtgttgcaagaagcataacaatttctcttgggtttttttttcccatgccaatattggcaaaagtgcaaatataccatgaagccatacaattttttattgtttttatcataacagttaagcaagagaaaatattgagcgaagaaatttcatccaaaagctttaacaaaaacattgaagccctaaaatgttaaatgatcagatgttattcccattcatacatcaggggaagtgataaaccctgtggatgaatcagcaagcactagcaacttcatgttgtgataccagaataaagaaaatggaggagaaactgtgacttttgataacatcatgagactaactgatatgaagggtgttccctgagtttttatttactttgaaatgtgaaggtgtgactaaactttttgagagccttaggtatgagtcaccttattttcttgacagatgttagtgtttatgtttcaggaatgtgttttgggaactattttaatttttgttagaggtaagaggtgtttttagtgagttttgatgttaaaaccactgaggagtatgggtgtaagcagagcaggtgaactttagatagagcaaaaccagtgaatccagatgtcccatgggacctttgggaaaatgaagtgacatatttgtaaactcaaattattatggtaggggctttctctacatgatgcttaaggctgtaccaacagtatttctcttttccttttttctctgggacataatatttttacattagtatttcttgctagtaatagataggtggaagaaatatgagttcagtggttaaacacattaggcaaacgttcgtttaaatatttttaaaaaccaacatagggcttaaatgagcctttaaagtgctggtctccgcagtgattcccaagagcataattatgtagcgtttctcaaacttacatgactgggacactttttgaggaaggcagattaacttttcttaggtttccacgtttgaggaaatgccatgttattcccacagtgttataaatcctgtttatcatggactagatgaagccagtccttagtgttttggttttttttttttttttcttttttgagacggagtcttgctctgttgcccaggctggagtacagtggcatgatctcgactcactgcaacctctgcctcccagattcaagagagtctcctgcctcagcctcctgagtagttgggactacaggcatgtgccaccacacctggctaatttttgtatttttagtagagacgggttttgccatgttggctaggctggttttgaactcctgaccttgtgatcctcccgcctcagcctctcaaagtgctgggattacagatgtgagccatcgcgcctggcctcagttcttagtgttgaataagagtcacttttaattatttgacattgggaaaacagaggtgtagggaaacagacttcagaatcagaactgtgaaggtaagtattgggcatgatggaggctgtcttcctccccattccgccccatttgtgtgatctcttaatacctccctgaagtaattattctctttacccactaattggtgagcttctggagcaggctcgaggctttcaatctctagggcctagcactgtgccaaacacataaacactttgtgcgttaattggatagttataggacatacatttgatgtattactgaagcttatttttttctgcattaacatagggaagatcataccttaacgccacgtagctcacagttctttttgtatattttgctgttgattcttaccacataccatgaaatcctagttccatttatgggggaggacacttaaatgctttcctttggtcaaaataaggacttggacaagtctttggtaccccatgatgcacctgaggagagcattgccgtcagagtctgggctccagacagggtttgagctgagtcactatgcagaacagtccgcagtaaggcctaggtaccccagggatagatagagttgagcctgcctctcttgaaaggaatgctcttcagagacacagcagtcaggaggcacattcttgtgcctttcttaggctttttaaaatccctgatagtaaggttcttcacaatagacaatctttccttaattaaaaatacttgctctgctcgttaatttttctatggcatgcattttcaaattgggtccttttacttttttttttttttttaagtaatatgtttgttacgtttatagtttggagctgaatttcgtcggttttcgctggaaagatcaaaacctggaaaatttgaggagttttatggattactacaacatgttcataagatccccaatgttgacgttttggtaggctatgcagacatccatggagacttactacctataaataatgatgataattatcacaaagctgtttcaacggccaatccactgcttaggatatttatacaaaagaagggtaagtatcactgtttagaaaaattgtgttagaaatagaaatagtgtattttccccactgaaaggatacccagactttgccacaaacttagtgaataaacattttgtgtgaatcttcttatgttaactaacatgtgggttaaaacatttgtgatattgttggtttaattaatatctttatgcttcactaagtgtactttagaaaatttatatttctagttacttttgtgttaacctctttggttttatttttccttaagtagaaattgggaatttattgaatattgggaatttattgaatcttcactttatcaaatggattattctccactcagaaaaatgtgaaaagagtgtgactttggaatccaaagcattcctgttttttggtggcaaccaactttcaaaggctgtatttaccagttaataaataccagaaacaaagccatttaatcttcctgagtctcaatgtctgcacctatagaaagattataatattttgtagaattactatgaggattaaatgagctaagtgcagtgccctggcttatagtaagcacccagtaaatactttctttcttttacttttaggatactttttaaagaaattgtataaaactagttaattatctggaaaatgaggtgggaagttactattgtggaaggatgtaaacactgatattaattagtcttccaaaaaaattgaaatcactatttggcaataactttctttctttctttttttgtaaagactgggtcttactatgttgcctggtctccggtgatcctccagtccctgcctctcaaagtgctgggattataggcatgagccaccatgctcagccaagaattttcaaatgtattttgagtcctaaaactttttttttttaatctcgtagcctttgtgtgtgtatgtatgtgtgtctgcagataggcagggtagggcttattatggtatgtaccattttttcctttctcaattgtaaatgaagtggtttgggaagccagcatgagagcatcaagcctggtattgggataaattaaagacttacggtatttataagccaacccagaaagtagcttgagagcggccaggcttggtggctcacgtgtgtaatcccagcactttgggaggtggaggcgggcggatcatctgaggtcagaagttcatgactagcatggctaacatggtgaaaccccatctctactaaaaatacaaaaattagctgggcatggtggcacatgtctgtaatcccagctattcaggaggctgaggcaggagaatcagccaggaggtggaggttgcagtgagccgagatcgtaccactgcactccagcctgggcaacagagcaagactcctcaaaaaaatttttttgaaaagaaagtagcttgagagaatgggtggggattatctttgaaggtgaaaactatttctaatcagttgataagcattagaccactcccagggctctggaattccactgattatgtatctttgctttcctgggtttggaggaactaaagtccaccaacaaaataaacctccaaggataacctctgcctatatcacttgactattttacaaaatactttcacacacaaattaatgttcccaaagtttcctgagatggatctcaaaggtaattaacaggaatgcgatataatgagagtatgaccttaggaagattcagttggctgttcaggatgaattggagtgggcagcagtcttacagtagagagccaggagcaggcggtaaagaagtgaggagactggcctagaagtagaggggaagggtggggggaggggagaaggcagtggcgggaaggtaggaggggaaatacttgggagtcattgcactcactgtggctgctttgcagtgaaggagagtccagcagagcatatcttgatggtttgagtctgacagctgggacagtgtcatgaacaagcagagtagattgatttggaaaagaaaattatgaattttgtcttaggacaaataatcttaaccagtcattcagaagattagaaatggtagacaaaagttcagggtagaaatccaaaaactagttagatttgcaagctttttgaaaagtgatagttaaaattttgggagtagacataaaggctatctgagatgaagaccatggatagaaccttggaaagctatatatagagtgctggaaaaggaggaagaatttaaataattatggttgaataataggcctttcttgttagcaattgtaattttctttaaaaagttagttgctgtttggatgtgcattcaaatatagagtgggtttttaaagtattgccatgtgacagaattttgttggattatcccctttggtagaaagattatgacagttgagttataccaccacatgttttgttaatggaattatactcttgcatgattatggaattaatcctaacatcttttaagggtagttatcttttatttcctttctaagtttttatttattggtggtataatttttattgagacctttgatggtttttattgttgtcataggaattacaacttagaaatatgtttctatgtgcaaatgttttctatttattaatggtaaaatgtccaatataattgatagcccttagaatttgatttagaaataggcaattcaacagaaatattttagattttaaaaatataaatttaatacaaatatgactttagcaaaaatgaaagtaggtagtcagttcattcctgcttaaaaccctctgatgatttcccattgcaaccagaataaaatcccttctgatttggacttcccaacctcatcttccctcattctctcactccctcatcacagtcagccacactggcttccttcctgttcctcagacttgatgagcttgtttctttttttttttttttttgagatggagtcttgctctgtcacccaggctggagtgcagtggtgcaatctcggctcactgcaacctctgcttcccaggttcaagtgattgtcctgcctcagcctcctgagtagctgagactacaggtgcatgccaccatgcctggctaatttttgtatttttagtagagatggggtgtcaccatgttggccaggctggtctcgaactcctgacctcaggtgatccacccgtcttggcctcgaagtgttctgggattacaggtgtgagccactgcacccagccgttagcttgtttctgtttctgtgctcttatgcttggttattcttaaggacacttcaccctcggttcttcccacgtctgcctcctcctgcttagctcagataagtttgtcagaggagtctcttctgactaccctaactaaagccctccaccttcccacctttaccacatcatcctctgaagacctggaaatatcttatttaagaatatgttaacttgtttcctgtctgtctggtttaccatcaggtcgcagcatctaaatctggcagacttacttagtgtactataatgcatgcactcttttttttgtggagtggggacggagtctagctctgtcccccaggctggagtgcagtggcgcgatctcggctcactgcaagctccacaccattctcctgcctcagcctctgagtagctgggactacaggagcccgccaacacacccggctaatttttttttttgtattgttagtagagacgggatttcactgtgttagccaggatggtctcgatctcctgacttcgtgatccgcccgtctcggcctcccaaagtgctgggattacaggcgtgagccaccgcgcccggccgcactctgtcttttaagcaaagttgagcagatgcttaactagaaatctgattttatgtaaaccttaatgaacatttaattcaaggaactaatataaagtatgacattaagtatagttacattttactgcttgattacagcacattttctgtttgctttttgatttcagttaggcatcagtaaggcagaagttacacttaatatgtactggtgttttgttttgttttgttttaagtcttgctctgtcacccaggctggaatgcaggggcgtgacctccactcactgcaacctccgcctcccaggttcttgtgcctcagcttccagagtggctgggactacagatgcgtgccaccacgcccagctaatttttgtatttttagtagagacagggttttgccatgttggccagactgttctcaaactcctgacctcaagtgatccgcccacctcggcctcccaaagtgctgggtttacaggtgggagccgccgtgcctggccccaagtgatttattttattttattttattttattttttttgagacagagtcttactctgttgcccaggctagagtgcagtggtgtgatctcggctcactgcagcctctacctcctgggctcaagcgattctcctgcctcagtctcccaagtagctgggactacaagcgtgtgctaccatgcccggctaatttttgtgttttcagtagagacacggtttcacgacgttagccaggctggtctcaaactcctgacctcaggtgatccaccctcctcagcctctcatagtgctgggattacaggtgtgagccactgcgcctggcccccaagtgatttttgaaaagcaaattgcaaaaccattttaaaatttaaaactatgtgatcttttaacatctgatactctactaaaatttctttaaagtgaaagcttacaattcaatgtgtaaactactttatagtctgaagtttaagatagtgttgttggatatcttgaaaaatttttataacaatttattgttagaagaaaaaccccatactctattcctagagcagttatcatgggagcaaaaacaaagcacaagaaacctggtatcttaaaagttattttcatgcagaggatcccaatcccccattccctgttaagagtattagagtttatcctaattgattcgggagatggggaagagaaggtacagaatagactttctgctctcattgttgaggttattgctgtgcactaaaaatttttaaaaaaatatttaaagcttgcgccttttaaaaatactcaggtcattcctgtcagtttggaattcagccagggaaatgtgtatttttaaaagcttcccagccagtcctgataatcagccaggtggaggatctgttgatgtgctacagaacagacccctctccagatctagtcagaatctctacatccagacttcttgctataacaccgtctgtttttgattgacaccagacacatatgtttacctcttcgatttattctcgttttattaggaacactagaaaggctttgctttaaactttgtctctcatagggcatgcccttacacagatgtgactttgtggcccagatgctggtaactgggcatctaaatcatctcttagattttgtgcattggacattattttgtaggtgtcttttaaggttacatttttatgaatcagggtttaaagttgtctaaggaatatacattttagtagtaaattgtaaattatagttttaacaaaagatatggcccagaaatgaaaaaaataaattacagcctgtaatcccagcatttttggtggccgaggcgggcgaatcacaagatcaggagatcgagaccatcctggctagcatggtgaaaccgtgtctctactaaaaatacaaaaaaattagccgggcttggtggtgggcgcctgtagtcccagctactcggaaggctgaggcaggagaatggcatgaacccaggaggcggagcttgcagtgagcctagatcgcgccactgcactccagcctgggcgacagagcgagactccgtctcaaaaaaaaaaaaaaaaagaaattgtggagtaacatctcagtatgtgacaccagttactcacaacagaaacgtgggtgtcacctttgacacatacctattttttagtcagtcaccaagcctattaaaactgtgttctagttatttttcagatttgtctccccatttccatgtcctctgctccaggccaggtgccatccaaatttactgaagtagcttcttttttttttttttttttttttttctgagaagcagtctcgctcttgttgcccaggctggagtgcaatggcgtgatctcgtctcacggcaacctccgcctcctgggttcaagtgagtctcctgcctcatcctcccgagtaggtgggattacaggcatgcgccaccatgcctggctaattgtgtatttttagtagagatggggtttctccatgttggtcaggctgcttgcgaactcccgacctctggtaatccgcccacctcggcctgccaaagtgctgggattacaagtgtgacccactgcactgcgctggctgcagtagcttcttgtcctccccctccacgtccttctccagcctgcagccggagtgagctttgtagaaaaaccaaatgagttcactatcactgtcttcccttaaaatccttgattttcttccctttgcccttaggctaaagtctgtaaactttggtacttcccaggaggccctgtttgtctgtttggcccctggctgcctctgactcagctcctgactccctccctccctccctccctcctgcttttcaccctctgttctagctgtattggatttctttgtctggccctccctcttctggatattgtcgagtcctgtgcctggaacattcttcttgccttctactattagcccctggctggttttcctcacagaatcacttccctggagaagccttgccttactcctacaagccaggccaggtcccctttacatacttccccagcatggtgtgcttatagctctcagcacctttgttataatttacttagagtatttgaaattatttgttagttgccatctcctcttttagattgtaagcaccacgaaagtagacaccatacctattttattcaccaaatctgtaccacagagcacaattcctggcacatagtcagtgttcgttaaatatttggtgattaatttttctgtattaggaatgaaggggtctgcaaaatttgaatatctaatttgctttaagtgatatttaatctttttaaagttgccagatctggctgggcgcagtggctcacgcctgtaatcccagcactttgggaggccaaggtgggcggatcgcccaacgtcaggagttcgccaccagcctgaccaacatggtgaaaccctgtctctaatacaaaaattagccgggcatggtggtgcatgcttgtaatcccagctactcgggaggctgaggaaggagaatcgcttgaacccaggaggtggaggttgcagtgagccgagatcgtgtcattgcactctagagcgaaactccgtctcaaaaaaaaaaaaaaaagttgccagatctatctcatttaaccattttatattagagcaagagttggcaaactaaggcctgttggctgcttttgcatataaaattttcttggaacagggtctcaccattgcccagattggagtgcagtggtgccatcttagcgtacttcagcttcgacctctcaggctcaagtgatcctcccacttcagcctcccaagtagcttggactacaggcacaaacaaaccaccatgcccagctaatttttaaaattatttttgtagagacagggtcctgctatgttacccaggctggtcttaaactactaagctgaagcagtcctctcacctcgcccttccaaagtgctgggattacaggcatgagccatcatgcctggccacataatattttatggattgtctgtggctgcttttacaagagtgattatatagcctgtaatacctagacatttactgtctgactcttgacagaaaacggttgtcaacccctggattagaacattttaaaacattatttcattatttgatttcttcctctgatcttcaagtggggcataatcttgaactttgttgatggctgtactataatggttgctgttttgttactgtatggggatactgatggagcttatgtagaagtttttttttttttctagatttgctttttactcactgtgaagcttttatgtcttacatctgcctgccacccacaaatggatccttaccctttgctctgaatgtgtggtttatgaccctctatgagcaaaggaatgagattactaggcttttcagaattaatgtttaaagagtaagaggttcagagggaagccctgcaggataagtgaagaacagccactatttgtgtgtaagaaagtaagacatccagtttgactatttggaggccttctaggtggatccttgtctgttcagttagccgagatcattggctgaagaaaaggcttgggataaatgcggtgctgctgtatcagcccatatcatgtactgttgcataagtgaatttatacaagtggacagttgctatgatcaagttttcaaactttccatctcattctgagtttaatgctctgatagtgttcaggtagaaagtcaactccaattccttgtggacattcacctttacactttaacaccctgaaccctggctttctgccaaaatattttctttcccagtggctggaaactgattagctagatgggagaacaaaggtggctttgtactggggcatattgcttttgagaatttagcagagagcattcaaatggagtctggatgtgatgccaaattatgcagatttggagtttattttggttaggtttcccatgagtaggtatgtaggcaacgtaatactgttctcagtttatatggtctggaatttcccttataaatgttatataggctttccttattgattgttttaaaacacaaatatgtatgattttgagaaaacacattaccagaagactattcttgataggtttttttgccaaaaagattgttgtaccaatggatttatatccaaagccatattataaatacatttctgtctctgtaagagcccaatgcaaatacttataaatgattacaagtgtccccaaggggaaaaaaatgccaaaaaaataagatacccgtaaccttatatatttatctgaaactaggttttgaagagtgttcacgcagcatcagaaaagaatactaaagctccccatactctgacataattgatacttggcattcattattgtgacttggaagatactagcctcgtaagaaaacctgggctctagttctttctgtgtaacttacgttgtacccttaatttattggttataaagtgaagatgataatagtttagcaatgagggggtttaggattaaacaagagaatatgagttgaagcgctatacaaacgcaagatggtgagattggtgttttctgtggcagcagctgagactaggattttcaactattttgtggaggaggagggaagccatttattttttgttgttgtcttttcttttctttttctttttttctttctttctttttttttttttttttttttttgcctagccactggaaaaccagggagaggcattattgaagttgttgtgttttttttttaattcatgtaaatttcactttttagtttatcctcattgtagttatttttgaaaatactattttaacttttgtttctgctgttagtttcattttctgttttacctctcattctctgatgaaatgttttgtttatagactatcttccttcagccatataatttaaccatatctggtgttaggtgttctgttttcccttttagtttattatttaattaggcggcagtatttaaagatcgcaagattttgcctaaaaacaagactttctggcatgaagaaaatctgcgaggaactgagaagcagctatgccatctaaatgaggcaggagctctccagtttgccagagtcctactacttcctattgtctgtgtcaccaccactgaggacaaaataccattgaactttatgcatagtttttcacacagtaaagaaaaaagttaaaactccacctttgcctctttcaaaatgaaaatgagagatcaagaattcctgctgggcgaggtggctcacacctgtaatcccagcactttgggaagctgaggcaggtggatcacctgaggtcaagagttccatcaagaccagcctggccaacatagtgaaaccgcatctctactgaaaatacaaaaattatctgggcatagtggcgcatgcctgtaatcccaagccacttgggaggctaaggcaggagaatcgcttgaacctgggaggcgggggtggcagtgagctgagatcatgcctctgcactccagccaggacgacagagcgagactccgtctcaaacaatagcaacagaaaactgagggagagtgtttatttgcagaataccaaaattccgaagtgtttgtttgatatgcatcagcatcaattacattatctgcccactcagcctctgatattggtatatgattttactctctgatttaccttgagaatcaaatatcccacttcaagtatttgagttgaatatgataaacatgcaaattgcaggcgtgtttttgttttgttaccgaggctggagtgcagtgatcatagtgcgctgcagacctgaatcctggagtgaagccatcctcccatctcagcctcccaagtagccgggactccaggcagacgctacctaccacacctggctaatttttttttacttttcataaagacagggtctcacgctgttgcccaggctgggctcaagtgatccactcaccatggcctcccaaaaaagcactgggattatagacgtgaggcaccacgcccaaccacattacaagttttttaaacaagtgaaggaaaaatgtattttaagtaactggtttaaaatgatgttttaaggccggacacagtagctctcacctgtactcctagcacattgagaggctgaggcgggaggatctcctgaggccaggagttcaaaaccagcctgggcaacatagcaagaccctattcaaaaaaaagtaaaaatacatatatatttaatgatgtttaagaatatgtaagatctggccaggtgcggtggctcacgcctataattccagcactttgggaggccgaggtgggtggatcatgaggtcaggaaatcgagaccatcctggctaacacggtgaaaccccatctgtactaaaaatacaaaaagttagccaggcctggtggcacacacctgtagtcccagctactcgggagggtgaggcaggagaattgcttgaacccgggaggcggaggttgcagtgagccgaggtcacgccactgcactccagcctggtcgacagagcgagactccatctcaaaaaaaaaaaaaatatgtaagatctatcatagtttcatttgccatatttaatgtttaaaagtgaatgagctctatcaaatttaacttcaacattggtttattttgtgatgtgtatttgagatggccacctagtggttttttctggtatggcattttactactgtactagattatgatctgattagaataagcttattagctagtttgtttatataccaaatatattttgagttatcctttctgtacagattcagctgcaagtgaatagatatttttacagcatttctataattattttgttttatttttaaacagaagaagcagactacagtgcctttggtacagacacgctaataaagaagaagaatgttttaaccaacgtattgcgtcctgacaaccatagaaaaaagccacatatagtcattagtatgccccaagactttagacctgtgtcttctattatagacgtggatattctcccagaaacgcatcgtagggtacgtctttacaaatacggcacggagaaacccctaggattctacatccgggatggctccagtgtcagggtaacaccacatggcttagaaaaggttccagggatctttatatccaggcttgtcccaggaggtctggctcaaagtacaggactattagctgttaatgatgaagttttagaagttaatggcatagaagtttcagggaagagccttgatcaagtaacagacatgatgattgcaaatagccgtaacctcatcataacagtgagaccggcaaaccagaggaataatgttgtgaggaacagtcggacttctggcagttccggtcagtctactgataacagccttcttggctacccacagcagattgaaccaagctttgagccagaggatgaagacagcgaagaagatgacattatcattgaagacaatggagtgccacagcagattccaaaagctgttcctaatactgagagcctggagtcattaacacagatagagctaagctttgagtctggacagaatggctttattccctctaatgaagtgagcttagcagccatagcaagcagctcaaacacggaatttgaaacacatgctccagatcaaaaactcttagaagaagatggaacaatcataacattatgaaaccgtggtttgaatgttttcagagtgaggatgccatgaggacttgtacatttggctagtttaaaagcatatatacctctgaccagtgacgtggaataggcatgagacgagtaacgttgcaagcttacaatattattaaagtagtagtttgataattgttaatataaactttggtggatcagaggtgaatttaagtccaaaacaaaggggcctttgctgatgaagttacgtgcttttgctgttttgtctgtggagaatcagatgttaaagcacattcttggaactatgtgagaagactagatcatttctgttggaagtggttgcatatttaacctgctgtgcagagcccagttaatttttcctttaactgtatttttaaaattctaatgtgaagtctgattctctcttgtggtacattggggacctcagctcttaaaggtctcatgttcccaatattttattttgattttttttttttttttttttttttttttttttagtgactgggtctcactctgttgcccacactggaatgcagtggcatgatcacagctctctgcagcctcaatcccctgggctcaagcagtcctcccacctcagcctcctgagtagctgggaccataggcacataccaccacatctgtctactttttgtattttttgtagagacagggtttcgccatgttgcccaagttggtcttgaactcctgggcttaagcagtcctgcctcggcttcccaaaatgctaggattagagccaccatgcccagcctattttgatttttgtttttttatgttcctttctaataaattgtaacaaatgatgttctcaagtacatttccagtttcttttcttttctttctttttttttttttttttttttttgagatggagtctcgctctatcgcccaggctggagtgcagtggcgcgatcttggctcactgcaagctctacctcctgggttcacaccattctcctgcctcagcctcccaagtagctgggactacaggcgcctgccaccatgcctggctaatttttagtagagacggggtttcgcagtgttagccaggaaggtctcaatctcctgacctcctgatccgcccgcctcggcctcccaaagtgctgggattacaggcgtgagccaccgcgcccagttgtgcatttctggtttctaagaatcaaaccacttggctgtttttaggagttacttcccatgttataaagctgaggaagctttttttttttttttttgagacagagtctctgtcacccaggctggagtgcagtggtgcaatctcagctcccgggttcaagcaattctcctgcctcagccttctgagtagctaagattacaggtgtgcgccaacacgtctggcttatttttttgtatttttagtagagatggagtttcaccatgttggtcaggtgggtctcaaactcctgacctcaagtgatccgcccatctcctcccaaagtgctggattgcaggcatgagcgcctagccaggaagctatcttttcttgagttatgaaactttgcaacagttgttcaaattggtgtttgtccttcctatagctttcatattttcaaattaattctgtatggctatataatttatgttttaaaaggcaattctcttgactttggaaatatggaagtctctcctttaacctattcttgttcccattcccagtctcatttgaaatcattccttttattgttagtgtgtgtatttttgttggtgtgcttttaatgcatccaagtatgcatcattttggataaaaaatacatccaaattaagatgttttaacacataggacaaacttgtgcactttttatgccaaaaaaaaaaaaaattgggttttccttcatgggatttctagaaacactgcctacactttatgaaaactacatagtattcacctgtgacaggtagagtttatcactattaattttatgaggctatttattactttccaatgcatccacttagaacaagctaagagtaaggctgctaactttaattccttgcctgattttattgtacagtgtgcacaagcacaatggtatgcttgtatatagaaactaaaaatactatgaagtacataagttccctatggcttatggagagttatttattaattaactttatggtagggctagtatgaatacctttttaacaattgtgtgctattacaacaatgaagattcaaatgactccgctttgaaggatgttttctctatatggtaaaatatatatgaagaagtcttgattacgtgaagatcacttgactcagaatacttcaatgtattttgttcacattaccactaagcatattatcagtaaactattaactgactgcacattatgtaatacgttgtactttttgttgaattcaccgaagttcttccatttatatgctatttttaatggcattccggctttaacattctgtgagtcttacaaatttgactcttgaatggcaaaataatgttagtatgtagaaggttaactttcatttataatataagtggtgcaggggttcaacattttaagtaaaaatatttttacacactacctctctctttttttttttaaagttttaacatcagaacttttgggggaaaaactacttcagggcttgactttttgtacaaattttaactgtaaaatacagatttatcttgtacgcattcatggaaatggaaatcaaagctgctattgctttttattttaattatcctgttaagggtatctatcaatggtattttcaagtagatctctgtttcttaaattattggtgaaataattgattactagatatattgtaaaaccaatagatcctggttatacgataaaatatcagctcattggtaggctgaatcaattatttcaagtgcaccttattaacaaaagtatcagtggatccaacataaaattttatagtactaaatgtcaagcctaactgtgaattttgttctgtatcttaagtaaatttatgataatgttctcgagctatcaacaaaatatatgtacttttgtgagctatgaattttctaattaaattttacatgctataacatgatttttacatgaatgatactttgtttataactatcaaatgtcagtattttactacaattttattataaagtgtacattatcactaaatgaacttcgattttaaaaatcaaattagctttagttgtatattattttttacaaataaagatagacttgtataaaggctactttcttgtttgaaattatatgaaaagttgcccacaaataccaggtgcccattatataaaataggtagggagaaaacccttgagttttaacaagatccttgcttccttaacttttaattgttaaaagatggaccccaaattgtatgtgcactttttgcaactgtgtatgaccatatggctatgggctggatggtaacttttaaaatgtggttaattctgatagtgtgaaaggttatgcaagctattcacccaaagttatctttaagattatttgaaactagtttgtaatgtgacagcttatcttctgaaattcaaattcacttagttatacttaattaatattaccatctatctagtatggcctatgttgattgaattcaatttatactgaaaaacttaaaatgtctgagaaaaaggccaggcatggtggctcatgcctgtaatcccagcactttgggagtctgaggcaggcggatcatgaggtcaggagttggagaccagcctggccaacatagtgaaaccctgtctctactaaaaataaaaaaaaaattagctgagcttggtggcgcacacctgtagtcccagctacttgggaggctgaggcaggagaatcgcttgaaccggggaggcgagggttttggtgagctaggatcacgccactgcactccagcctgggcaacagggtgagactccatctcaaaaaaagaaaaaaaaaggtctgagagaaagaacaacctttcctgagccatttctaattccaaattagccaccctgtcatcagcttagttggtcattgcactaactcttctgccaacaagtttagaggacaataggacaatcctaattccttccctccaagttaaaaacactaaaaatcccgagtataaatggaacatcgtgcacacagaactcttcacacctttgattgggttgcattcagtacccgatattcatctctgggttttgagtccgtgaaacaatggtgcagaattaaaacatccctttcattcccaaaaaatgaccccaatgcaatttgcatctttgttttttttctttttttgagatggagtctcactctgttgcccaggctggagtgcagtggcactatctcggctcactgcaagctccgcctcccaggttctcgccattctcctgcctcagcctcccgagaagctgggactacaggcgcccgccaccacgccctgctaattttgtttgtatttttagtagagacggggtttcaccgtgttagccaggatagccaggatggtctcgatctcctgacctcgtgatccgcccgtcttggcctcccaaagtgctgggattacaggcgtgagccaccgcgcccagccttgcaatttgcatcttaaatcactgttgcttcctagtttccagtgctgagtaagagcttgattaaatttgattttgaggaaaaactaaagttacaaaaatttaccaaaaaccagacctctctgttctgcctttaggtgctcaagtgtttaacagcaactgacagaaccacttctgattgtgtttcccttcttttagtttgatgtggggtttaaattggaagtatgtataccagcgacttggcagctgagttctaagcacagttttgggagtgttttgctgttaaacatggaaagcctttgtttttatcttgtgatggcatatcacgtgatgatgatggctgttatctgtagggtaaagcaaaacccagtgcctcctagctatgatcacataacatgctaaatacttaagtactctcagaaaagatattttggaaaccaaaataagtcttcattgcccaaacgaagtatatgtgcagtcaaatgactgtcattgggtggataactgggcattagaaggtaaatataaaggaaattaatcggttaaaagatccttaatgccgggcgtggtggctcacgcctgtaatcccagcactttgggaggccgaggcgggcggatcacgaggtcaggagatcaagaccatcctggctaacacggtgaaaccccgtctctactaaaaacacacacacaaaaatattagccgggcatggtggcgggcgcctgtagtcccagctactcgggaggctgaggcaggagaatggcgtgaacctgggtggcggagcttgcagtgagccgagatcgcgccactgcaccccagcctgggtgacaaagtgagactccatctcagaaaaaaaaaagatccttaatatgtctaccaaattcttccctaaaaacaagacttagataatattttaaaagctaatgtgtttatccagttgctttacaacacaattgtattttataagttaatattaaaattcaatggagtttgtattttatttacaaactataggtgtttttccacttataaaagctctcttttgggaattaagtttactctgaaagcagtattctctgtgtaatagaaaataaagaaaatttaatacccttattatctagttcattataatcccaagggatggataacaagataatacagcataagtaaagataactttttaaaaataattttcagtcatataaataatgtgcaaattcgttctccatatttaaaaaaaagtacagaaaaagctaaagtcttttggcagtaccatgcacatttatccataccatattctgttacaaaaaggaattgtggcttaaaataagagtgactataatttataatccaaattgggacacttttgagaatgaatgggtttgccacgaactatgccagtagaacaggctcggaccagatctgtctcaggtagactgcaatatgggtcaccctgttatagggtctctcaaaattttttttaaaaaactgcaatacacagtaagaaatgcattgaacactataatccaggacacacacactatgttttcatacagtaatgaaaaatgctctgattttctatttcacttttgtaggatgtgtattggaacattccaaaaacaatgtcaggatgccctgtttgaaaacactgtgaagtgctttacttttcacttgagatatttgccatgggaaagactatcatatttttccctaaaggagaataaaggtactgtattatctgcttgctagcttttttgtttgtttgtttgttttgaaataatttccaacgtagaaaagagctgcatgaaaagcataacctttgtccaggttatatcctcatttgctatctgtgtattttttcctgaaccacttcagaattagttaaagagattctccccttttatcccctttagacttaggcatatattttctaagaacaaggacattctcttatattttttcttatacaaccccaattatcaaattcaaaaaagttaacattgctacaatattatctaatatataagcaatactagaatctcatcaattgacctagtgatgtcctttacagaaattttttccttttatccaggatccaacccagaataagacattgagttgtctcatctcttttggcccctttaatctggagcagttcttcagcttttctttgcctttcataatattgacatttctgaacagtaaagataaattgtttcatagactgtccctcagttggggtttatctgtttcctcataattagattcaagtggctgggcgtggtggttcacacctgtaatcccagcactttgggaggccggggcgggtggatcacttgaggtcgggagttgaaaagcctgcccaacatggtgaaaccccatctctactaaaaatacaaaaaatttagttgggcttggtggtggacatctgtaatcccagctactcgggaggctggggcaggagaatcacttgaacccgggaggcggagattgcagtgagccaggatcacaccactgcactccagcctggatgacagagcaagactccatctcaaagaaaaaaaaaaaatagatttaagttatgcgtttttatcaggaatattacataggtgatgttatatctttatttcaccatgtcaacaggtacatcatatcagtttgattcaatattggtttatcaagtgagaagtgatttggaaaaaataaaataaaatatattgccaggtctggtggctcatgcttgtaaccccagcacttcgggaggctgaggtggaaggatcatttgagcctagaagttcgagagcagcctgggcaacatagggagaccccgtctctacaaaaaatacaaaaactagctgggcatggtggcatgcacctgtggtcccagctactgaggaggctgaggtgggaggatcgcttgggcccaggaggtcgaggctacagtgagctgtgagctatgagtgccactgcactccagcctgggtgacagagaaagccctgtctcaaaaaataaatgagatgttctaattattcttgtgctcattaaaaacgtgaatggagccaggtacagtgactcacacctgtaatcctagcactttgggaggctgaggggggcagatcacttgaggtcaggagttccagaccagcctggccaacacggcgaaaccctgtctctacttaaaatagaaaaattagctgggttgtggtggcagccctctgtaatcccagctactcaagaggctgaggtaggagaattgcttgaacccaggatgtggaggttgcagtgagccgagatcgtgccaccgcactccagcctggatgacagagctagattctgtctcaaaaaaaaaaaagaaaaagaaaaagaaaacctgaatggatccagatgaaagacatgtgttttctatatccatgtgttccgcatctttgattgttttccttttgaagaaacaatagaaaatggtgacctggcaccagtattctcgaatgtcctttgcttaaccacatttctgaactcagtaatgactttctctggcattggtctgaatgaaaagaaagcacccaaatgatacctaaatctgtgactaatggggctggtcagtagtcagagtgttcagagtgggaggatgttgccttgggattctttggcttgtgaatacacctaactccaattgacgtctaacttagattcaaaggaatggattggctcgtgtaactgaaaaatcagggctaagatttcagcacagatcggacacagtgccatctgatagaattttctgctttgtccagaggggagtcactagcccccatgtggctgctgcatacttgaggtgtggctagtgcaactgagaaactggatttcaaattacatgtcattttaattaatttaaatgttaatagccacatgtagacagtggctactgtattattttacagcacaaactggaatccctctccatttcttgcttttgttttcccctgttaccttttttcccttaggccaagtccctccttatggtggcaaagatggcctccagcaaccctggcaacattccgtcacattaccaaccacctggcagggagcctgtcttcccccatggtgacagccaaagcccagagaccaccctcactgaccctgtctcagtcatgtgcccatccctaacccaatccctataactcctaattgtcctagtctgggtcatgggcccaattctggacctattgagggagggatggtcccctaaagaaaaatcagggatcagccaggtgcagtggctcacgcttataatcccggcactttgggaggctgaggcaggtggatcacctgaggtcaggggtttgagaccagcctggccaatatggtgaaatcctgtctctactaaaaatacaaaaattagtcaggcatggtggcggacgcctgtaatccgaactacttgggatgctgagggaggagaatcgtttgaacccgggaggcagagtttgcagtgagccgagattgcagcactgccctacagcctgggcaacaagagcaaaactccatctcaaaaaaaaaaaaaaaaaaaaatcagggatcagggttctgttaccacaagaaagaggaagaactacaggggagggaacacagtgggtatcacttgcagctttttttcttttttcttcgctctgttaccaggctgaagtatagtggtgcaatcataactcactgcagcctcaaactcctgggctcaagcaatcctcccacctcagcctcctgagtatctgggactatggatgcgtgccgccacactcagctaatatttttcggagagacagggtctcactatgttgcctgggctagtctcgaactcctggcctcaagcaatgctcctgctgccttgtagatttagagtatttgggaacacattttttataaaatgtcctgcacaaagtaaattggggacagagagcagtgctctatcaaaggaaaatggtggaaattaaatacagagaccagtggcagtgttctacctttaaaggaaaaacttaaaactcctgacagcgactatactaggacttctgttttcaagtgttattgcttattttgattctattttaaatacatctgctgagatgggcagatcacttgagcccaggagtttgagcaacatagcaagacctcatctctacaaaaaatttcttaaattagccaggcatggtggtgcacacctgtagtcccagctactcaggaggctgactgagacaggaggattgcttgagccttggagtttgaggctgcagtgagctatgatcatgccactgcaatccagcctgggccagagcaagatttgtctctaaaaaacagaaaagaaaagaaaagaaaaaaatatatatatatgaaataaatctgacataaattgaatatataaagaatatataaatgcaatataaacttcaatctgaaatggcagtttcaaatcctattactttcaaagtatagaaatgataggaccatgggtctcagagaggaggttgcaaattcaaatgcccaaagggccagagtggggcagggcaggtggggctggtaaacaggagatgcccgcccccagcaaggcaggggccaccacattcgatggttgtcatttgggtatgtgtgggcccagtgttgtcagctcttataacttttttttttttttttttgagactgagttttgctcttgttgcccaggctggagtgcaatggcacaatcttggctcaccgcaacctctgcctcccagcttcaagcgattctcctgcctcagcctcccaagtagctgggattacaggcatctgcaaccatgcccggctaattttttgtatttttagtagagatggaatttcaccatgttggccaggctggtcttgaactcctgacctgaggtgatccacctgcctcagcctaccaaagtgctgggattacaggcgtgagccaccacgcccggccctgcttatccagattttcataagaaatgtccttttttttttttttttttttttttgagacggagtctcgttcttctgccctggctggagtgcagtggcaagatcttgggctcactgcaacctctgcctcctgggttcaagcacttctcctgcctcagcctcccgagtagctgggactacaggcacgtgccaccacgcccagctaatttttgtatttttagtagagacgggctttcaccatgttggccaggatggtctcaatctcttgatctcgtgatccgtccacctcggcctcccaaagtgctgggattacaggcatgagccaccgctcctggccgagaatcccccttcctaaattggtaaaatctgattcatcagaattgcaattttgatcaaagccagtaactcctcacacaaatccttctatgtgtgcagaaagtgagcgtctgaaaactccaggcggagtttttgcgctaggttatctaccagaagaaaggacaagaaaggctagaatttgactaatggttccaccccccagattgtatcagcacagcattcctctttcactcagtctcttagcaatgcttgcaactacaaggaaacagcattcataccattgtttctaagacctgaagcaggttacattcaaacccagcactgttcttatagaacataagagttttgttcccaggctgcttctctgccagcatgtgatacccttcaataaatggtaggtaagttgcatatcaggttttctcctgcattcccagagggcttcagctgctgtctcaggtatgaacccaaaatgactcaggcaaaaatgtgtatgcttagtgactcagaaactaaatcattaacttggtaagtacatgcacgggtaaggaggaattcaaggagagacttagaacataggccttccagtaatgccactgatgatgactgcctgagtacagcaacgctgaacggtgtcacttctcaggtggaccagtgacgaaccctagaatcaccaagaatctcaaatcagtcattctcaggagcaacaatccacatagggtaatttacaaagaatgctgatttcaattgtttgaatccttacctggtgaaacaagaaaatgtggaaaaagctccttgactttaaaaatacacacccacacacttttttttttttaaagggacaagggcttgccgtctcccacacaggctcgtgggcggtggtgcgatcatggctcactgcaacctcgaactcaaggattctggcaatcctcccacctcagcttcccaagtagctgggactacaggcatgagccatcacacccggctaattttctttttttcttttcttcccctcaccccaatttttttttttttttttttgagataaggtcctgctctgtcgcccaggctggagtgcagtggtgtgattatggctcactgcagcctcaaactcctgagtccaagtgacctcacaccttagcctcctgagtagctgggactacaggtatgtgtcaccacgcctggctaatttttgtattttttgtaaaggtgaggtttcactatgttgcccagtctggtctcaaactcctgggctcaagcaatctgcctggctcagcctcccaaaagtgctgggattacaggcgtgagtcactgtgcctggcctccacatgactttctactagttgattttaaactgggcatatgcatttacacacacacacacacacacacacacacacctgatctgcctagatgtgaaattaaacttctagagcacacgcatatacacaacgccagacaatatgggaacagtgattacaaacaaatcccactagaaaatgacaaactgtaataatttttcagtccccttttgaaggcaagaggtttataaacctctgcaattcaattgcaacacatcagggttcttctggtgagctggcctcagtgtccttcctccacccccagggtgccttggctcatgttcacagggcccatgcccagtagggctggcatgtgtttccaacagccgagcagacagggccagcagagagggagaaaataaacggtaaagggagacgcgccaggagagcaggcagaatggccgggaagctggccaaacgggagaggctgaatgggcgacatcagcccttgaccaggcctcagctatcccagctgtccttcaccactcactgtgtggataccaggaggatacaagccccctttgcctgggcgtcaccaagaatccataaaccacgcagtttatttttatttttatttaattttatttttttagatagtctcactctgtcgcccaggctggagtgcactggcgtgaccttggctcattgcagcgtccacctcctgggctcaagtgattctcgcgcctcagtctcccaagtagctgggattacaggcacctgccaccacacccggctaatttttgtatttttagtagagatggggtttcaccatgttggccaggctggtctcaaactcctgtgctcaagcaatccactcacctcagcctcccaaagtgctggaattagaggcgtgagccactgtgcctggcctatttttattttttgaaatagtcttgctttgtcacccaggctgggtgcagcacaaataacacggctcattgcagcctcgacctcctgcgctcaagcgatctttcctcctcagcctactgagtagccgtgtgccacaggcatgtgccaccctgcctggctaatttttttttttttttttggagatggagtcttactctgttgcccaggctggaatgcagtggcactatctcagatcactgcaacctccgcctcttaggttcaagcaattctctgtctcagcctcccgagtaactgggattacaggcgcatgccaccacgcctgactaatttttgtatttttagtagagacggggtttcgtcttgttggtcaggctggttttgaactcctgacctcaggtgatccaccagccttggcctcccaaagtgctgggattacaggtatgagtcaccgtgcccggccgcctggttaatttttaaattttttgtagagaccaggtctcaccatgttgcctatgctggtcttgaactcctgcgctcaagcttcccaaaaggctaggattacaggcttaagccacggtgcctgcccatgtggtttttagaccagcaggttctgtagagcaaaatgttcatgattttgaaggatgacaaacctgacagaggaggcaacgccaccttgacattcctcagtcgtagtgccacagtggtctcgtatttcaaacctggttagagtttgtcctcttcaggagagtttgtgtggctgttttgcagtggaggagagatgacaaagctgataatgcttatggtgtgggtattttctttttctttccttatttgctttgtgaagacaaataatggttaaggatagataaaattaaccgggtgtggtggtgcatgcctgtaatcctagctactcaagaggctgaggcaggagaatcgctagaacctgggaggcggaggttgcagtgagccgagatcgcgccattgcactccagcctgggtgacagagcgagactcagtctcaaaaaaaaggatggataaaatatttaacagtggtcatacataattcattcctgagtcgacacccatttccaggccagcagttcgctctcaattaggggttctcagaacacggaaccaccgtgtctccttggtagactgccattgtgcttatttttactcttttcttcctaaggctaattgtttttaccttttccttgttgagtactcattcctagatgtttttatcaaaggcaacaaaaataaaaattataggcaggactttttttgtttgtacgttttttgagacgaagtctcgctctgtcgcccaggctggagtgcagtggcgccatctcggctcactgcaacctccacctcccgggttcaaacagttctctgcctcagcctcccaagtagctgggactactacaggtgcccaccaccatgcccggctaattttttttttttttttttagatggagtttcactcttattgcccaggctggagtgcaatggcacaatcttggctcactgcaacctccacctcccaggttcaagtgattctcttgcctcagcctcccgagtagctgggattacaggcatccactaccatgcctagctaatttttgtattttttaatagagacggggtttcacagtgttggtcaggctggtctcgaactcctgacctcattatctgcccgccccggcctcccaaagtgctgagattacaagcgtgagccactgcacctggccaattttttgtatttttagtagagatcgtgtttcaccatcttggccaggctggtcttgaactcctgacctcgtgatccacctgcctcagcctcccaaagtgctgggattacagctgtgagtcaccgcgcccggccagggctttttgtattcatgtctgggccttaaggtttaactcagagcttcagagacataactgggaaggaaaaatgtatatttgtacatataaatattgtgtaagaaaagtaaatcagttaaggaagctgtgtgcccacagaagtaatatgtgattttaggagaaattttagaaaaaataattactattcagagataaccactcaagtttttcagcatatgcgcacatcaaatgtatattcatattagacctataaaattattctgtagtttgctttttttagaggacaatatattgcacctatcctttctctgtcagtatggctctgcatcatttataatggcttcatcgtatttcactgtatagatgcaccattattttgtaaaaccaattccttattctgagctgttttcattcattcgccattatgaacagtgctgtggtgaacaactttgtaaatacatccttttgttccttgtccaattatttccttaggataaaaggaatctttggtcaaggtgtacacatttttttggaaagggagggggtggtttatgaatatatccaatttccttccagaaacgttgctctaatgtacacacttacagggatatgtgtgtctttttctccttgaaaacaccagattttattattattattattattattattattattactattattattttgagacatcaaaataatccagctccatcacccaggctggagtgcagtagtacagtcacagttcactgcagcctcgacctctctggctcaagcgatcctcccacctcagcctcccaagcagctgagactacaggcatgcagcaacacacccagctaactttttttgtagagacagggttttgccattttgctctgggtggtctctaactctgggtttcaagtgatcctccccttcagcctcccaaagtgctgggatcacaagcgtgaaccactgtgcccagcgcaccattgattacattttagactttatttagatagcaccagttttccactaatgtccttcttctggcccaagacctaatccagaatactgcatcgcatttcatacccattctttgttacagcttcataatatgtaaccaatttaatttatttaacaaccccctattgttggacctttgggttatatcaggttttttctgtttggttttctgttttgagatggagtttcactcgtcgcccagactggagtgcagtggcaacatctcagctaaccgcaacctctgcctccagggttcaagcgattctcctgcctcagcctcccgagtagctgggattacaggcatgtgtcaccacaccctgctaattttttatttttagtagagacagggtttctccatgttggtcaggctggtttccaactcctgacctcaagtgatccaccggcctcagcctcccaaagtgttgggaacaggcgtgagccacagcgcctggtctctgatggatatttttaaaaaaatcactgtggtattcatgtggggcagagggtgagggggaggcagggattagtcctggcaagcaggggtggaggcgggaaggagtggacaaattcaaggtatttctgaggagcagtggaatctcttgaccaaggccttcttcagcagggagatggagccctgtcctgagggactttgcagcctggctggtaagacaagcttcttccccagggaattaaacaccagtggttaacagattagcaacttagagacgagaaagcggtttccaaactctaaaacacagaaggaaaacccgtgacagatttggccacataagtatttaaagcttgtatctgtctctctctctctctctctctctctctctctctgtccctctcccccgcccctcccctctgtctctcacacacacacacacaaacacacacacacagaacaatttaagattaaaaggtgaggggctgggagaaaactgagaaaggatggtcatctaggatttatcagccgctcccagcaatcaagaagaagaagacagataactgcacaaaggaataggaactgataattcccagaagaggagactgggaaaccggtaaacctaaggcaatatgcttaatctcattaggaatcaggaaaatgcaaagtaaacaaaggcccacccctaagagtagtagccaaatgtaaaggagggaagtgggagcaggaggagcctctccccctgggatggggaggagccggccaggttctgcggaagcagaagggggtgggtgtactactgccatggcgcaaacacacatccaagggctctgcagggggccccacccttaccccccagaccatttctaggagtaggggctgaacaggacccagtggaggctaccgtcctgcattgcgagggttaagtaagaggctgaaggtcaagtgcgaggtcctgcagggcacttccagcggctctgtctcagccggcccagtggccatgcggaactgggagcaaggagagtgggagataaaaccctgtttcagtggtttagcgtgggaaatgctaaagtgatctgtgtaacacagctcctgggtggggaagagatggggaagtagcctgtggcctggaggtggctagggacagattctcaggagggctggaaggggtcaagggcagggctgcgctataacttccctgggcagtgagcatcttggcctgcaggggcccttccaataagaaataggacctggtgtggtggctcacacctgtagtcccagctattcacgaggctgaggtgggaggactgcttcagtccaggagttggaggctgcagtgagctatgatcacaccactgcaccctggcctgggccacatagagagaccctgtctctaaagaaattttttaaaaattacctgggtgcggccgggcacggtggctcacgcctgtaatcccagcactttgggaggccgaggcgggtggatcacctgaggtcaggagtttgagaccagcctgaccaacatggagaaaccccgtctcttctaaaaatacaaaattagccgggcatggtggcgcatgcctgtaatcccagctacttgggaggctgaggcaagagaatggcttgaacccgggaggcggagtttgctgtgagccgagatctcgccattgcactccagcctgagcaacaagagcgaaactccgtcttaaaaaaaaaaaaattagccgggtgcagtgccagagtagttccagctactcaggaggctgagatgggaggattgcttgaacccaggaagtcaaggctgcagtgagctgtgatcccacaactgcactccagcctgggtgatagagcaagaccctgtctctctctcagaaaaaaaagaagtgcagattacaacttggtataataatgaataattactattatataataacacattttatttgacctaaagaacatttttttgccttctgatcctagaagtaattcacatgtgttcgtgggcgcatgcgtgggcctgtgcgtctaatggagaggtcactgcagaaaggaagctcagggttctcccaggcagcggcagggtgtggaagtctttctttgcctttttgaccattttgtagagggaagctgctctgctgtccagccctgcggaggggggcagggtctgtgtccccaagatgacagagggttggggagagttcactccagtgaccagtggttggccgaagagtgctttggagttcagcccacctgggtttgaatctacatcctccctgtgtggagctgagcctgaccagtgcgtgtgttcaccaagctcaggcgtctttgtttgtgtgtttttggatggaaaggggaagcagcccttcacccgctctctcctcccttgcagccgtgccacagggccagggttgcaatgaaggcaggtctcaggcaggtctcggctctgctctggcaaacgggccccagaggtctgaggaatccagccagctcctccaagctcatgtccttggtctcagacctacaggctttgtgcacatcctaggctggtgacagcatgtgtgtgtgtcacggctggagtggcagaggccctgtgggagccgcagacccagggccgctccataggtgtcaggctgtgtggtctgccagagtcccacacctgttcgtgtgaggggaaggtgcccgagcaatactgtagccaaccaaataccatagtgtcttcaatactactcatttcgcccatggaaaattatgcctaagccaccatacgggttaatgaacgctccagcccaggtccgaagagatgcctttagcacagggacgtgtggcagtgtctggagatgtgccaggctgtcacaggctgtgctcctggtgtggggacactgctgaacccacaggacagcctccacagcaaagcgttacatgctgaggtccagggaccctcccataaccaattccagagtgagggcttctgattggagagccccactctgcgtgtcccttagtcactcctgggacctaggtcaggcgtacacacacctgcaccacactgcctatatacaagcactttacctgtattgtatttatttatttttggctcactgtgttgcccaagctggcctcaaacttcctgggctcaagtgctcctcctgcctcagcctcccaggtatctgggactataagcgagtgccactgcacctggatttttatgcaggtattttaggtgagtcattggaggtacaatgctaccaacttgccacttcaggtggctccatcctgaagagcctcagcctcctggtctgtacaatggtaacagtgccctgcccccggggagctgtgggggtgagtgagaggctgtgtgtccagcccagtgtccggggtcactcagaaagagtggtgtctgctcagcgggggcagagcacaggcttgaggccagacttcctgggtaccagcaattcaatgagtgaattctttgagcaatgcctggcactgcacaagtcctgtggccgtgttgggtaccactgacattattgctgttttcaggtttgtttgtttgtttgtttgtttgttttttgagtcagagcctcgctctgtcacccaggatggagtgcagtggcgccatcttggctcaccgcaacctccgcctcctgggttcaaacaattctcctgcctcagcttcccgagtagctgggattacaggcatgcaccacgacacctggctaatttctgtgtttttagtagagatggggtttcaccatactgaccaggctggtcttgaactcctgacctcaagttatccacccacctcggcctcccaaagtgctgggattacaggcatgagccaccgcacccggcctgtttctagtttttgacagttgaacaaaggtgcttggcctggaacagtgaccaccaggtcacctcactccctcagtgtcaggggtctctctccaggctccaattgctctcatctcatctcagtccctcctacctgtcctcatccttatcactgctcctacagctggagaccagggtggggcacgtttgagatgggattcccattcagcctgtgcttcttggagacccagcttccctcgctccctcgtgctaccccatcaccctccactcccccatgctctcttccctagactgggcaggccccagctgccttcccacctggtgccccgatacacagccacccccacagtggcctcaagaggcttctttcctggccgggtgtggtggcttacacctgtaatcctagcactttaggaggccaaggtgggcggatcacctgaggtcaggagtttgagaccagcctgaccaacatggagaaaccctgtctctactaaaaatacaaaattagccaggcatggtggctcatgcctgtaatcccagctactcaggaggctaaggcaagagaatcgcttgaacctgtgaggtggaggttgcagtgagccaagattgtgccattgcactccagcctgggcaacaagagcaaaactctgtctcaaaaaaaaaaaaaagaggcttctttcccaaagagagactttgtcttcaaggtgacccctggctgacccctggcatggttggtgggagtggtgatggggcagcgatggggccatttgaattaaaatgccctctgcataattcacagaaattcatgagtcatctttatctgggaaaaccccaatggagtgagctgggacccagggctgcagactgatagacagagggaagcggcctccctggatcccggtcctcactcccgtgcctgctgttgactattctgcggtcaggaggcgtccctttgcctgcagtcctgggacagtggagcgcaggggacactggggcttcccaaggaagtgcttgttcttctcttaaatcagaaatcagggcactcattatgtgtctatccatcaggccgctgtcctctgcagagacaccttgggtgtcccctcctggctccaggtggttctggaggatggcagagccaggaccatgggctgccctgaaggtggttccaacctgctctatttaaaccaagggtcctttaaatttgtctcttttcatttaaatatgctctttaaaaaccagcaggctgggcatggtggctcacaccatgtggatggcttgaggccaggagtttgagaccagcctgggccacatagcaagacccatctctataaaaaaaaatttttttttttgagatgaagtcttgctttgtcggccagtctggagtgcaatggtgtgatcttagatccctgcaacctccacctcctgggttcaagctgggattataggcgtgcaccaccacacccggctaatttttgtatttttaatagagacggggtttcaccatgttggccaggctggtctcgaactcctgacctcaggtgttccacctgcctcagcctcccaaagtgctgggattacagatgcgagcccgtaattacaggcatgtgcccagccctaaacaatttttttttaaaagacagaaaaactccctgccccctggagttaagattcttgagaaggatacttgattaactgatgaataagacagtcagaacagtgatgagctctttgaaggatatgggtgaggggcaaggccacgttagccaagggggtcagggaggacctctgtgaggaagtggccttggttgtgaggcctgcaggctgggagagagtgatacagaagacctgggggaagggaggggctacacggcaatcactggttgtactgagaagtcattttgcacatgtggaaatatatttctgaagtaaattcctagaagagggattactgagtcaaaaagcatatgactttctaattctgatagatactgccaacttgtcctctttggggtgaaccaccaaagacactcccatctaccaaagacaagagtgcctgtttccccacagctttgccaatcctgtggattggcactaatctgatggttgaagaatgtatcttatgcccgtctggggtggctcatgcctgtaatcccagcactttaggaggccaaggcaggcagattgcttcaggtcacaagctcgagaccagcctggccaacatggtgaaacctcatctgtactaaaaacacaaaaattagccaggcatggtggtacacaactgtagtctcagctactcgggaggctgaggcaggaggatcacttgacctaggaggcagaggctgcactgagctgagattgtgccactgcactccagcctgggcagcagaacaagacttcatctcaaaaaaaaaatgtatcttattaagaatgagattgaacatctctttatatgattatgagctacttgaattatcttttctttctttcttcctttttttttttttttgagatggagttttgctctgttgcccccactggagtgcaatggcgcaatctcggctcactgcaacctccgcatcccgggtacaagtgactctcctggctcagcctccctagtagctgggatgacaggcacttgccaccacgcctggctaattttttgtatttttaatacagacggggtttcaccatgttggccaggctggcctcgagctcctgacctcaggtgatcctcccacctcagcctcccaaagtgctgggattataggcgtgagccaccgcacctggccttgaattatctttctacttgaattatcttttctcccaaccaactgttggtatcctttgctcatttgatgttttccttataaatttctagaagccttttttttttttttgaaacagagtctcgctctgtcacccaggctggagtgcagtggcacgatcccggctcactgcaacctccgcctcctgggttcaagcgattctccttcctcagccttccaagtagatgggattacaggcgcctgccaccactcgcagctaatttttatatttttagtagagatggtgtttcaccatgttggccaggctggtctcaaactcctgacctcatgattcgcccgtctcgccctcccaaagtgctgggattgcaagcatgagccaccgtgccctggctctaggagccttttaaatatgaaaaagattaacttttttatttttttgagtcagagtctcgctctgtcacccaggctggagtgcagtggcgcaatctcagctcattgcaacctctgcctcctgggttcaagcgattctcctgcctcagcctctgagtagctgagactacaggtgtgtaccaccacacccagctaatttttgtatttttagtagagatggcgtttcaccatgttggccaggatggtcttaatctcttgacctcgtgatccactcgccttggcctcccaaagtgctgggattacaggcatgagccactgcgcccagcccgaaagagattaacttttaactatgatatgtgttgggaaatatttttttcccagcttgtcatgttactttgactatgatatgtgtttgcaaatatttttcccatcttatcatattacttttctattttctttttcccccatcttatcatattactttcctaacaatcaactttactgaggtatgatttatgttaataataaaatgtgctttgaaagtacagtttgatgaatgttgacaaatgcaatacacccatgtaaccaccaacacaagacacagaacatttctgtgactctaatgttattttagaatatgagtataattgttttggccatggaaaaacttttctttttgtctccctctgtggcgcaggctggagtgcagtggtgtgaccacagctcactgcagcctcgaactcctggggtcaagcaatatctctctcctcagcttcccaagtagctggactaaaggcacgagccactaaacctgactaattaaaaatgtttttttgtagagatggatttctccatgttacccagtctggtcttaaattcctgagctcaaaccatctctttctttttttttttttttttgagacaaagttttgctcttgttacccaggctggagcacaatagcgcgatctcagctccttgcaacctccgcctcctgggttcaagcgattctcctgcctcagcctcctgagtagctgggattacaggcatccgccaccacacccagctaattttttgtacatttagtagagacgaggtttcaccatgttgaccaggctggtcttgaacttctgacctcaggtgatccacccgcctcggcctcccaaagtgctgggattacaggcatgagccaccacgcccggcacaagccatctcctgcactgccaaagttatgggattacaagtgtgacttacggcttctgcattttgtgttgtagtaagagatgcttttacattctgaggtttttaaataattcattgtttacttctagtctatttctgccttttttttttttatacattttgctcttcgatctatttgcagtacagcctgaggttggtgtaaggtttgagtctaataattttttttctaggggtgtatccagttgtttctgccttgcttgaacaaagtgaactaatagtagttcacgaaatctactggtttataatgtcacataccaaaggcttgtgtctttaaatctatctctagacttggtattctgctttctcattctgtctctccaaagatttccatatatatatatatatatatatatatatatatatatatatataaatataaatatattctatatattcatatatatatattctatatattcatatatataaatatattctatatattcatatataaatatattccatatatataaatatattccatatatttatatataaatatatatcatatatttatatataaatatatatcatatatttatatataaatatatatcatatatttatatataatatatatcatatatttatatataaatatatatcatatatttatatataaatatatatcatatattaatatatatcatatatttatatattaatatatatcatatatttatatattaatatatatcatatatttatatataaatatatatcatatatttatatataaatatatatctacattttttgagacagagtctggctctgtcaccccagctggagtgcagtggtacgatctcagctcattgcaacctccacctcccaggttcaagcgattctcgtgcctcagcctccatagtagctggaattacaagtgcaggccaccacacccaacgaatttttttgtatttttagtagagacggggttttgctatgttggccaggctggtctcgaactcctggcctccagtgatccacctgtcctggcctcccaaagtgctgagattacaggcatgaaccaccacccccacccatttccataccattttaattattgaggatttatagcgagttttaatattgggtaggtctaacctcctatcttagtttactattgtttctgtaacttaatagcttaaaacaacatagatttaatatcttacatttctggagggcagaagtccaaaagggttctcatggactagaatgaaggtgtccacaggattgtgaagtctcctctctggagactgtcagggaggctctgctctctgccctttccagcctctgcaggcagccgggtgttccctggctcttgctttccttccttcagagccctcagtggctggctgagtctttctcacgctgcctccctcttccgcttccaagaatccctgtggttataatgggctcacctggataatctgcccatctcagcagtaactgaccagcaacctaagttccacctgcaaccttcattccctcttgccaggtaagagcatattcacaggctccgggcatcaggaagtggacaactctggaggaccattattctcccaaccatgtccccgtcattgtttttcctctttgttttgagacagggtctcagtctctcattgtcacccaggctggagtgcagtggcgccatcatagcttactacagcctcatctcctgggctcaagtgatcctcctacctcagcatccagggtagctgggaccacaggtgcatgccaccgtatccagccattttttaaaaattattttattttatttattattattattattattatttttgagacggagtctagctctgtcaccgaggctggatgcagtggcgtgatcccggctcactgcaacctccgcctcccgagttcaagtgattctcctgcctcagcttcccgtagctgggattacaggcatgcaccaccaagtctggccaatttttgtatttttagtagagatggggtttcaccaagctgaccaggctggtctcgaattcctggtctcaagggattcatctgcctcagcttcccaaagtgctgagatcacaagcatgagccaccatgcctgtcctgttttatttgggtgacattaaatctatctattactttaggaaggacatgataagcattttcatttggacagactcctctcctcaggactatttacaatttacctaatgtaagtcttgtaaatctctgacgtggcatatgcctagtactttatcttataatttgtgtcttttttttcattctgtgttctcttgggttgttattctcctaaagaaatcagtctatttaaattttctgcctttccaaattatattttcccaggaaattagccatcgtatccaagttgtaaatttcaaatgtaagcagaacagtctcctattattatttacatttcttctatttctatagttatttccccctaatcatttcttattttgtgcatttgagccttttgccttcttttcttgattaggttagcttgctttttgtttcatttttcccccctccaaagaagcaacttttggatttagtcatttattctgctctattttctctctctccttccttccttccttccttccttccttccttccttccttccttccttccttccttccttccttccttccttccttccttccctccttcctccttccctccctccctcccttcctttctctttctttcttgacagaatcttgccctgtcaccaggctggagtgcaatggtgcaatctcggctcactgcaacctccacctcctgggttcaagtgattctcctgcctcagcctcctgagtagctgggactacaggtgcatgccaccacgcccagctaatttttgtattttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttttgtatttttagtagagacggggtttcaccattttagccgggatggtctcgatctcctgacctggtgatccacttgcctcagcctcccaaagtgctgggattacaggcatgagccactgcgcatggccgctattttctattttaatactgtctggctttatctttattaattcctccaatctcccttgatttattttattcttttcttatttctttatattttatttactcatgtagggtttttttgtttgtttgtttttgtttttttttatgagatggactcttgctctgtcacccaggctggagtgcagtggcacgatcttggctcactgcaagctccacctcccccggttcacgccattctcctgcctcagcctcccaagtggctgggactacaggcgcccaccaccacgcccggctaatttttgtatttttagtagagacggggtttcgcagtgttagccaggatggtctcgatctcctgacctcgtgatccgcccaccttggccttccaaagtgctgggattacaggcatgagccaccacacccggccactcatgtaggtttttaaggatataaattttcgtctgaggacatttttatttgaaccccgcaggttctatatgttgtttttattatttttatttaatgtgctgcaacttttttttgtgcttgctctttgctgtaagagctgtttaagaaagtcttggtcaggaggggtggctcatgcgtgtaatcccagcactttgggaggccgaggtgggaggattgcttgaggccaggagttcgaaaccagcctggtcaacatagcaaaaccctgtctctgcaaaagaaaaactttaaaattagctgggcatggtggcgcatgcctgtagtcccagctacctgggaggctgaggtgggaggatcacttaagtcccggaggacgaagctgcactgagccgtgatcacaccactgcactcagcctaggcgacagagggagaccctgtcttaaaaagcaagaaaagaagaaagtccattattaaggtcttttaataactgccctgtgtcattgctttgtgattacagagtgctgtctgtgctattttcattctgtggaattttcctccaaatagctcactatggggtcagtatttatgactgttccattggtactggagaggcagagtatgttgtatattttcagggttctcagcttaaaatatttgtagaattctgatcttttgcattcttacttatttctgtccacttcatctgtcatgatatgagaggggtaattattataattttgtgatttcaattactattattcaaaactttgctggctaatcttgacagctaagttcactaaacataagatgcaagttgagctcaaaaatgttaaaatgtaggggaaggaaagtgtcttcgaatcaataggataatgcatgtttgtttcagcaaatcaactgtgggatgtttttacattttacaagaaaaatcccactgcaggtctagtttgtgattttgttaaatttgtagatttttttcttttttttttttttgagacagtctcactctgtcgcctatggtggctcacacctgtaatcccagcattttggggaggccaaggcaggagaagcctggagtgcagtggtgtgatctcagctcactgcaacctccacctcctgagttcaagcgattctcctgcttcaacctcccgagtaactgggattacaggtgcccaccaccatgcctggctaatttttgtatttttagtagagatggggtttcaccatgttggccaggctggtctcgaactctcgacctcaagtaatcctcccacctcagcctcccaaagtgctgggattacaggcgtgaaccactgccccgggctaaatttgtagattcttttggggaatagctggtagctttatgaagtggagccttctcttcagcaaatatggtgtttccccatttctttccttcttcttttatgttccttcatagttttacggttttcttcttcaggctcctatacgtttcctgttaggaatatttctagggattggtctttgttctcctatgaagggggtatttttaccactatgtcccctaactggttgttgttggtttatagtaacttcccctcctgcttcttttttgtgtaaagttatttagtaaacagctccctcactatttccaattggttaacacttccagagggataagacaatagaggatgcttcctttttacaaaaatgccacccatatttcataacgaagaataactttttaaataacagattaatttttgtccttgcaaaagtaatatatattcactacacagatttataaaatatagagggatgccgggtgtggtggctcacgcctgtaatgtgctttgggaggccaaggcaggtggatcacttgaggtgaggagtttgagaccagcctggccaacatggcaaaaccccatctctactaaaaatacaaaaattagcagggcatgatggcctgtgcctgtagtcccagctactcgggaggctgaggctgaagaatcgcttgaacccaggaggcggaggttgcagtgaactgagattgcaccgttgcactccagcctgggggacaagagtggaactctgtctgaaaacaaaacaaaacaaaattagccagacatggtggcgtgcacctgtaatcacagctactcaggaggctgaggcaggagaatcgcttgaacccaggaggcagaggttgcagtgagccaagattgtgacactgcactctagcctaggtgacagagtgagactctgtctcaaaaaaaaaaaaaaaaggaatgaagtactgatacatgccacaacatggatgaaccttgagaacatgatagtacgtgaaagcagtcaaacacaaaggccatagagtatatgatttcatttacatcaaagtatccagaagagccaaatccatagagacataaagtagattagtggttgccttggaggtgtaggggaatgggagggttgcagagtgatgataagtggggtttctttttgggcgcatgaaaatggtggctgcacagctccacaaatttactaaatataccattgaaacgtatactttaaataggtgaattgtatagtatgtgaattatatctcaataaagctgttaagaatgattcacaaactctactcattcaaaatatgtcaactctactctgccagatggtgagaacacggccctgaacaagaccaaggccgttcttgtcttcacaggatgctattctggtgaacttcctctggaactatattctatatccttacaaagaaaatacttgtcttgaacttctgagctcaagtaatccgcctgccttggtctcccaaagtgctgggattacaggcgtgagccactgcacccagcctaattgacatttcttgaagaatagcagtcttcaggtgattgaacaaacctgcctattcagaatctgcattttaacaagatccccaggcgatgtcattcacctggtacattccttttttaaaagcttttttctttttgttgtttttagagacaggactcattatgttgcccacgctggccttgaacctctgggctcaagagatcttccccactcagcctccagagtagcaggcgtgcaccatcatgcccggctcattgaaatttgggaagcacagatctagaggtcaaccttttatccaaagcagaaaccctatgtgatttcaattgtcaaactttatgtcaactctctatgcaaagcacaaaccccatctgtaccatccctatgtatcaggaacaggctgggaagtgacaattgaactctgctagaattgtcccacctgtcgggactcactgtgtggagatcccacctgtccacttgcgtgtgtctcacctttactttatttttaatttttatttttgagatgggatcttactctgtcacccaggctagagcgcagtggcgaaatttcagctcactgcaacctctgcctcctgagttcaagctattgtcatgcctcagcctcccaagtagctgggattacaggcgctcgccaccttgccaggctactttttgtatttttagtagagacatgattttaccacgttggccaggctggtcttgaactcctgacctccattcacctcagcccctcaaagtgctgggattacaggtgtgagccaccgcaccaagcctattttatttttatttttgagacagggccttgctctgtcacccaggctggagcgcagtgccatggcggccatgaacgtagctcactgcagcctccatctccctggctgaaacaatcctcccatttcagcctcccaagtagctggaactacaggtgcacaccgccatgcctggctactttttttttttttttaatttttagtagagataaggactcttgagctcaagagtgtcgaactcctgagctcaaggaatcctcccacctcggcctcctttgggattgcaaacgtgagccactgcaccttgccatttcacctctagacacccttttccttatttccaggtaaagtcagcttccctttggcagtgcctctgtatttgttttctactgctgcctgacaaatcaccacagacttagcagcttaaaacaacacacatcggccgggtgtggtggttcatgcctgtaatcccagtactttaggaggccgagacaagtggatcacctgaggtcaggagtttgagaccagcctggccaacatggtgaaaccgcatctctactaaaaatacaaaaaaaattagccaggcatggtggtgggcacctgtaatcccagttactcaggaggttgaggcaggagaatcgcttgaacccaggaggcggaggttgcagtgagccaagatcacgccattgcactccagcctgggcaacaagagcgaaactccatctcaaaaaaaaaaaaaaaaaaaaacaagcaaacaaacaaaaaacgacacacatgttatctcggtttccctgggtcaggggtcttggaacgggttacctggatccttggcgcagggtctcacaaggctgccatcagggtgttggctggggctgtctgaggctccaggcctcttccaagtgcattcaggtagttgacagaacttagttcctgcagctgtaggtctagggacctcagctcctggaggcacctgtagctccctgccacatggaccccaagggcaggccacagccatgaatgctcactttcttccaggccagcaaaggcctgtttctctgccttcctccacctctaaaccctcctttaagggcttgtctgattaggtcagacccacccaggatcatctgttttttttgttttgtttttgtgtttgtttttttgagacagtctcaccatgtcacccaggctggagtgcaatagcgcagtcatggttcactgcagcctcaacctcctgggctcaagcaatccgcccacctcagcctctcaagtagctgggactacaggcatgcaccaccacacctggctaatttttgtcattttttgtagagacacggtttcaccatgtttcccaggctggtcttgaactcctgaactcaagcgatcctcctgtctctgcctctcaaagtgctgggattacaggcatgagccacaacacccagccataatctcccttttgagtaactcaaaataagctcatcaggagtctaatctcaggagtgatatcccacgtgtccactgatccagcccaccccggaggggagggagttatacagggcatgtccaccaaggggcaggaatcttgagggtcattttggaatcccacttccctcagcccctgtgtagcacagcaccaagggatgccactcagatggtcatctatgtgagtggtgcggcgaccagcctgcacagccaagccggtggtgcttctgtggcttttgtctctctggatcagttggacttctttccttagaagcctcatagaattcactgaatctttcttcctcgtgaccttccttcagatcattcaagctttctccaggcaaaacagctccagcttcttcaaactggcaccatgtgacatgactttagttttaatttttctctttttaaagtttttaaaaataatagagacaaggtgtcactatattgagcaggctggtcttgaactcctgagctcaagtgatcctcctgccttagctgcccaaagggctaggagtacaggcatgagccactgcacccagccaacatgagatgactttatattcagtttctcaacagacccagatgcacagttggtgatgataaaataaaaacttcagctgaattaaatttaagagagtttaattgagcaatgaacaatttgtgaatcgggagcctctcaagccggagtaggctcagagactccagcacaaccacatggtggaagatttatggacaggaaaagggaagtgacttacagaaaatggaagtgatggccaggagtggtggttcactcctgtaatcccagcactttgggaggccgaggcggatggattgcttgaggccagaagtttgagaccagcctggccaacatggtgaaacccctgtctctactaaaaatacaaaaattagccgggcgtggtggtgcacgcctgtaatctcagctattcaggaggctgaggcatgagaatcacttgaacccgggaggcggaggttgcggtgagccgagattgcacctctgcactccagcttcagtgacagagcaagaccctgtctcaaaaaaaaaaaaaaaaaaaaaagaaaatggaagtgaggtacagaaacaatcagattggttacagctcagcgtttgccttatttgaacatggttcaaacagttgactacatttgattggccaaaattcggtgattggcacaagtgtagactacggtctgtttatacctccacttgttttgttttgttttggttttttgagatggagtctcactctatcaccaggctggagtgcagtgccttgatctcagctcacggcaacctcctcctcccagattcaagtgattctcgtgccttggcctcccgagtagctgggactacaggcacccgccaccacgcccagctaatttttgtatttttagtagaaatggggtttcaccatgttggccaggctggtctcgaactcctgacctcaagtgatcctccctccttggcctcctaaagtgctgggattacaggcatgagccaccatgcccacgcaacacctccatttgttatagttcactgtgtacagagaaacctttaagccgaacttaaaatatataaggaggcagttttaggctaatcttgatttaacagtgacaaatactttggcagtgtcacctgttttcttatgtatctatccatcctctttgcccttccttgaaaacattctagtttgtcaacatttcacttaaaatatagtatttattgagtgcttactctttgccagacactgtttgaagcagcatacataatgagattgttcttattgaatttctttttttttttttttttttgagacagggtctcgctctgtcacccgggctggagtgctggagtgcagtggcatgatctccgctcactgcaacctctgcctcccgggttcaagcagttctcaagcctcagtctctcgagtagctgagattacaggcacctgccaccatgcttggctaatttttgtatttttagaagagacagggtttctccatgctggccatgctggtctcaaactccgggcctcaagtgatccacctgcctcagcctcccaaagtgctaggattacaggtgtgagccaccatgcctggcctcattaaatctttttagcaaccctgtgagttgtatcatgccattttactggagaggaaagtcaggcacaaagaagttaagtaactccaccaagatcacacagctcataggtggggagccaaaatttgaacccaggcagtttgagtctaggacctgtgcagttagcccctatgcaatgctccctcccgaagccactctctgtacccagaaggggctgtcctaggaccagggatcattctttcttggcccctctgctttgcattctgtattcttcttagtaaacatcctcattcccatttgctttttagcagctatattatttcattgccttaaattgaactcagagtccctttaaaagatctgtgtttgtcacgtgaactactgaaaacaaggcttcccacatcctcattaaggtaaatgcaataaaaaaagtttttttttttggctaaattttttaatgtggttgcttttggtcattgtttcaaccagaggcccagctcagctttttatgttattgatatggcggcagatttcacatagagcagcatctcatttacaaagaacacagaatgccatgccatggactccagagatggaaaagtcctttgaggctgggcacggtgggtcatgcctgtaatcccaacactttgggaggctgcagtgggagaatggcttgagctcaggagtttgagaccggcccgggcaacatggtgaaaccgtgtttctaacaaaaattacctgggcgtggtggtgtgcgcctgtagtcccacctgcctgggaggctgaggtggaaggattggttgaggctgggatgtctaggctgcagtgagccgaaatcagtgccactgaactccagtctgggccacagagagtgagaccatgtcaaggcaagaaaagaaaaggtcgggcacagtggctcatgcctataatcccagcactttgggaggccgaggtgggtggattgcctgagctcaggagttctagactagcctgggcaacacggtgaaaccctgtctctactaaaatacaaaaaaaattagccgggcgtggtggcgtgcacctgtagtcccagctatttgggaggctggggcaggagaatcacttgaatgtgggaggcagaggttgcagtgagctgagattgtgccattgcactccaacctgggtgaaagagtgactccatcccacaaaaaaaaaaaaaaaaaaaaatgaaaggaaaggaaagggagagaggaaaggtgtgggtggggagagagagagagaagaggagaaagaggagaaagagaaagaaggaaagagagagagaaggaaagagagagagaaggaaagagagagagaggaagaaaagagagaaagaaagaagtctttagaattttaatgaaaggccaggtgtgatggctgatgcctgtaatcccagcactttgggaggctgtggtgggaggatggcttgagcttaggagttcgagaccagcctgggcaacatggtgaaaccccgtttctacaaaaattacctgggcatggtggtgcgtacctgtagtcccagctacctgggacgctcagatgggaggattggttgagcccaggaagtcgaggtggcagtgagccgaaatcagggccactgccctccagcctgggccacagagtgagaccctgtcaaggcaagaaagtcaaggcagagagaaaggaaagaaggaaggaagggagggagggagggagggaaggaaggaagggaggagagagaaagggagaaagaaaagagagaaagaaataagtccttagaatttaatgaaaggccggttgcggtggctcatgcctgtaattccagcacttttggaggcctaggcgggtggatcgcctgaagtcaggagcttgagaccagtctggccaacatggtgaaaccccgacttatttaaaaaaaaaaaaaaaaagaaaagaatcttgctgaaagaagagagaaagaagttcttagaatcttaatgaacaaaaactcaagtttctgaaacaagaaaacaaatgtctcaaatagtctaaagaatacggttttttactagggtgtttagcaattttcttgcagattctgatctatctctatgtgatataataggtgcaaagctcaactgctccactcagcggttatgtgtgggggcctcattttctccagctgtgggattgggaagcaagtcgattccttttttataattttgaaatccaggaaacgccaaaaccgttagctttctttcccatcagtttggcagaaattcactgaggtgaagagacgggaggttatttaaggcctctatttagctcatttaaggtgaatatccacacactttgctgagaaatacgatcagataagaggatgctgccccagctcccatgggacttgtatgtgctttgtattagccttctacaatccacagagctcagattctgaaacacgtctggccctagcggttttggatgaggggtaacacctgtaacacccagaggtggctgagagcagtgaatgagaatccacggacagcactgaaattcacaccttggggaacctctgatgtccctgtatctggccagtagtttctgccacttactgtttagatagacgcagagaaaacaagtagggacacaatttcggtagctggaagggagaacattccttcgccctccaactaagtgactctcctctcgcttctcaaggccaaggaagctctgccgtaaggctaaacgcgacactcagggagcatttggaatcttgccctgtggcctcttgcctctaaagctgcaagaccctttatgtggctctgctgtggaagggaaaggagtagagaaaaactactcaaatgactgcagagatgtagaagctttccttatcagggagagaatgggaagctgcgattgctgtttcctgttactgtagtgaacatttcaaaattatgacataaaaatggtttttgtttctttttttgagatggcggtctcgctctctcacccaggatggaatgcagtagtgtgatcacggctcactgcagcctcaatgtcccaggctcaagtgatcctcctgcctcagcctcctgagtacctggaactacaggtgcatgacaccatacctggctaatttttgtaatttttgtggagatggggtttcaccatgttggccaggctggtcttgaactcttgagctcaagtgacctacccaccttgggtggccaaaaatgttcgtttatgtatttatttatttttgagatgaagtctcgctcttgtcccccaggctggagtgcaatggcgcgatcttggttcacggcaacctccacctccctggttcaagcgattctcttgcctcagcctccccagtagctgggattacaggcgcctgccaccatgcccggctaatttttatatttttagtagagatggggtttcaccatcttggccaggctggtctggaactcttgacctcaggtgatccgcccgcctcagcctcccaaagtgctgggattacaggcgtgagccactgtgcctggcccaaaaatgttttttaatatctgggtttttattgttggtggtggtgttggggtgtttgtttgtttgtttgagacagcatcttactctcttggccagactggagtgcagtggcacaatctcggctcatcgcaacctctgcctccgaggttcaagagattctcctgcctcagcctcctgagtagctgggattacaggagcaagcaccaccaagcccagctaatttttgtatttttactggagacggggtttcaccatgttggccaggctggtctcgaattcttgacctcaagcaatccacccgcctcagtctcccaaagtgttgggattacaggcatgagccaccgcacccagccaatacctgtttttaaactatgcttctatgtagatgggttgtgcttgaaattatttcactagtggggaaacacactaagtaggagagcgacttcacattttatttattttttcagagagaggtgcccaggctggtctcaaactcctggtcccaagcgattcttccccctcagcctcccacagtgttgggattacaggtgtgagccaccgcctgtcacgtgttctttagacagtggtgattgtcccaggacctacttgcctcacagggtgtggtggggatccagtgagggcatctatgcaaagagcttagaacagtgcctggcacatagtaagggctcaggacacattaacaacgaatatggttttagagatcggggtcccagacaaagctatgccagtgctgaaacactgtcgatcggaaccacctaggagcaccttttaaaactctcaaagccaaggccacaccccacaccataaattaagtcacagcctctgggggtggggtctgagcatcagtattttctggaagtttcccaggagttttcaatatgcagccacgtttgggaactgtctggtctagaactttgtgtgcctgaggcctgcgctgggagaactgactttaaaaagacacagacaggcagtcattttgtagctagaggtgaagcagatggcgtgggggcagaagggtgtgggacctgggacccagcagggggctacggctcccacgggccttcgagcctggcaaccactggcacccccactccccccaggctgggatggagccactgtctgcacccgaggaggcctccagagcaggaggcgggagcagcagctctgagcccggcttgggcaccagagggagctcgtggggacgcgccacggctccatccctgcagctggttcaaactggtttgggcagggtgcggcctgggcgggctgcattccaggcctcaggctcgcggctgtccggggcctccccaagggctgcggacctagggcagggagcagcaggggcagggcccccgggcaggagcccagcaccctgagaggctggggagatgtttaaaaactcagtcctctttgtgtaaaatcatttacttggcctcccatgggggtccctgactaaggctggcagcgcggcggagcccctggatagggttattcccagacatcagtgtgcattagaatcgaagcagagcttgttaaatgcggaggcccagtgccccctctcaccaaagatcctgattcagaacgtctggggtgggcttctgggcatccatatttttagcaaaatatttctaaggtacaatcacatattcagaaaaaaaggctagaaacaaaatgattgtcaaccagccaacctggcccagggtatgaatcgctgggacacttgtgaaggacacagagaccccttccccagacctcctctttccccagggaagaggatttgggtaatcagcacttttagctaatatcccaggctttttttttttttttcatatgggcaatttcctttttctttttttattttatttttttgagacagggcctggctctgtcaccgaggctacagtgcagtggaatgatctcggcttactgcagccttgacctctaggctcaagtggtcctctcacctcagcctcccgagtagctgggaccacaggcgtgtgccaccactcctgtctaacttttgtatattttgtagatacaggagtttcgccctgttggccaggctggcctcaaactcctggcctcatgtgatccgaccgcctcggcctcccactcccaaagtgctgggattacaggcgtgagccaccatgccagcctggctttttttttttttttttaaatgagtcattttagacattcatacagttttggtattgctacaaacatcagccgaagaaataaaacattccgaatattgaaatccctctcagccgaacacctgacgtcaggagttcaagaccagcctggccaacatggcaaaaccccgtctctcctaaaaacacaaaaattagtcaggcgtagctgggtgcggtggctcatgcctgtaatcccagcactttgggaggctgaggcgggcagatcacctgaggtcgggagttcgagaccggcctggccaacatggtgaaaccccgtctctactaaaaatgcaaaaattagccaggcgtggtggtgggcacctgtaattccagctacttgggaggctgaggcaggagaatcacttgaaccctggagaaggaggttgcagtgagccgagattgcgccactgcacaccagcccgggctacagagactccgtctcaaaaaaaaaaaaaatattaggcgtagtggcatgtgcttgtaatcccagctacttaggaggctgaggcaggaggatcacttgaacctggaaggtagaggttgcagtgagctgagatcgtgccactgcactccagcctgggcgacagagcgagactctgtctcaaaaaatatatatatattaaatccctcttgggctgggtgcagtgcctcactcctgtaatcccagcactttgggaggccgagactggtgggtcacttgaaaccaggaattggagactggcctggccaacatgttgaaaccctgtctctactaaaaatacaaaaattagccaggcttggtggtgcttgttcctgtaatcccagctactggggaggctgaggtaggagaatcgcttgaacccgggaggcagagcttgcagtgagccgagattgtgccactgcactccagcctgggcaacaaagcaagactctgtcaaaaaacaaaaaaaagaaagaaagaaagaaaagaaaaagaaatccctccctcccatacccctctccagtttcttctcccccgccctaaagtaaccacttttggaacatggggtacgtcgttcccatgcacagctttgtacttttgctccatctgtcggtgtccataaacaatatacagtgtggttctgcgtgttttaaaaactgtgctaatggcacagtgccctacagagccttctgcaacacgacttttcttccttagctttatgtttctgagatttatccaccaggagaagtttgctgtgctcaggtcaatttggtgatctgaggccagtcctgggctctttgtgggagatgcctagccagcaggcaagggcaagggtctgagaccggctcccaggggatggcgaggagggctcagagcatcagggaaatcatgacaatgacgaatggccgagtgtgggctcagtgagttcctataaaacccttaagcacttgaggcccaagtctttgccaagaattttccagaaaatgactggcctgaaggcctggatatttggatagggagaaattagcagtggacagatttggaagtgggaattgtgcagtgatggactacacaaaaggcaggtcaaacatgtgttgtttaggcccctacctagggtggccaactacaatataaattcagatttaatggagaggaaggtgtgggacgtcctatatatttatttgcacccttgataccagcccctcctttttaaaaaacaacaacaacaacaaaagacagagtttcactgtgtcacacaggctggagtgcagtggtgcgatcataactcgcggtagccttgaactcctggcctcaaacaatcctcctgcatctgcctctccagtagctaggactacagttgtgccccaccacatcctgcaattttaatttttttttttcttttagagagatggagtctccttatgtttgcccaagcagctcagcctttttttttttttttttttgtgaggcgatttaacatttaaagaaaagtcagcaggcagggggcgctggcccacgcctgtaatcctagcactttgggaggccgaggcaggtggctcacctgaggtcaggagttcgagagcagcctggccaacatggcgaaaccccgtctctactaaaaaatacaaaaattagaattagtcgggcgtggtgacaggcgcctgtaatcccagctactcgggaggctgagggagggggagaattgcttgaacccggaatgtggaagttacagtgagccgaaatcgcaccactgcactccagcctgggcgacagagcgagactccgtctccaaaaaaaaaaaattaattaattaaaaataaaaataagtcatcaaacgaaaaatcaaaacttcagacttgtcttatacctatttgccttttagtactttcctcattagcactgttggggtgggagatgaggcgcacctcgctctcttcagccccaaggcttgtaaagggtctatctaggccggcctccgagggcatggagggagtgggtgcggttgtgaaatgtagtgcgctcaatagtttcctggtgaagtttattttaaaatccgcaccgaagaggaagacgaggaccgtcacactcggccttccctaaattccaggaccctccgcccgatgcaaactagatgctttagtaggatgggaacgggtggggggcgggcggctttgggcttcctctaagctagcgcctctctaacccggacgcccgttagaatcacccggggagttttagaaactaccgatgcccaagccccactccgaaggattccaacttaatcggcctggtgcgaggcctggcttccgggcttttaaaagcttcccggggattctattttacggccgggtccggggccgggagcctgtactctaccgggattccgatggggaggggtggcttgccccaatagttctcaaatttagctttgggtcaacaatctggttggaaccacctaacaaacatcaaaagatcctgatgcccaggtcttaacccagagacggtgtggtccaggcttgggaaattctaaaagagctccaggtgactgccatctgcaagcgagtttgcaaagcactgatgcccaggtgctgcgggggcgggcgcagcgcgcgccgctcgccactgggtggcgctgcccgctcggcccggcgctcctggagctgcgagccgcgaccgccgggagcgcacctgccccgcctccgccaggcggtccgcggggcatgcagcggaccgggggcggggctccgaggcccgggcgcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggtaggggacggggctgtggagttggaggagagggttctcgcggttaggggtccgggctccggaccctcggcttccccggagcatcctctcgctcccggagtggggggcccggggattccccccttcctgaagggtggctgcggggcgccacgcagagatgtgcagcgggtcgtccctgctcgctcctccgggcgacaccgggccccggaggcccaggctcgctttccctccccacccgggtcccccagcatccgccgggtcctcaggcgccgccctttgccaggccggccctgggagaggcggaccccgggacctctgctgccccggctacctccgagcggtgcccgggccgagcggcgcctcaggctgcggctgtgcgggccgcgctgcgctgctgcagctcggagcgaaaacaccacgcctctgtctgcgctttctattttaaaagcaccaagtgaaaagcagatctaaaacgagaccctctaccttccggctggaggcatctgtcgacgctgttgtgaaaaagttatttgtctgagttcactaggagttatttacggtcagaaattcaacccattctctttttaaaccacaaaagcagtacaggagtatttaacataaaggctatgcacccctttctcttttctctcccaccccaattctagttttcttagaaaaccagcattaactgtttggtataaatcattccggacatttaaaatgcatttacaaatgtagatatctgtatctgcctaggcagagtattggctcatgccagtggtcccagcattctgggaggctgaggcaggaggattgcttgggatggggataggggacggggaagagtgaggctgcagtgaggcttgatcatgccactgcactccagcctgggcgacagagtgagacatttaaaaaaaaatctatctcgccaggcctggtggctcacgcttgtaatcccagcactactgggaggccgagacgggtggatcacctgaggtcaggagctcgagaccagcctgaccaacatggtgaaaccccgtctctactaaaaatacaaaaattagccgggtgtgtaatcccagctacttgggaggctgaggcaggaggatcgcttgaacctgggaggcggaggctgcagtgagctgagatcagccattgcattccagcctgggcaacaagagcaaaactccctctcaaaaaaaaaaaccataaaatatctttccatatatatatatatacatatatatgagttttctcttttttctttttctttttctccatatatatatatatatatatatatatatatatatattttttttttttttttttttttttttgagatggagtcttgctctgtcaccaggctggagtgcattggcatgatctcagctcactgcaacctccgcctcccaggttcaaggaattctcctgcctcagcctcccgagtagctgggactacaggcgtgtgccaccatgctcagctaatttttgtatttttcagtagagacggggtttcaccatgttggccaggatgatctctatctcttgacctcgtgatccaccctcctcggcctcccaaagtgttgggattacaggcgtaagccacagcgcccagccatctccacatatttttaaaataatttttgaacagacgtttttaatttttttttttttgacagggtttcactttgtcacccaggctggagtgcagtgacacaatcatagctcaatgtagcctcaacctcctgggctcaagtgatcctcccacctcagcctcccgcatagccaggaccacaggtgcgcaccaccatgtcaggttaacttttaaaacaaagttattttgtggagacgagatctcactatgttgcccaggcgggtcttgaattcctgggcccaagagatcctttggcctcagcctcccaaagtgctgggattataggcatgtaccaccatgcctggcccat

SEQ ID NO: 28 - DNA, 114089 bp, Homo sapiens
gaccccaaggtaagtgaatactagtatatgtggtcctcaatatggattctctttgtatgtaattggaggtgctgtgtcctttagcagactgcaagccttctgagggcagtgactagggctcccgcataaagcacaccccacccaggaggcttcaagcacaatgtggccactggaaggaaacacttctaggtgctgctagaatcccaggggctttagtgaaactctctctttcctggattcctcctcagtggaagcagaatacacagggacactgctccctccactctccacccccagcctctttttataatgactcttcctgtctgtgggctacttcctcctggggaacagaaggtctaggaggcctctgaattggcaccagcgccctgtggttaacttgtgtctggcagcaaaagctgctggtccctaggatgcagcaatcacctctaaatgaggtctgcctttgctacatttaaggactgtaacaattgctttttctcccttggaaatataaccttagagatgaactgctcttgattcagtaaacgtctgtgccagtttccttagaggctaccatgagaaggtactagcctccttccacaaactcaagaggaaagcacaaacctgcaatcattgcccattttcctaagtccctgcatagggctgaggccaagggcagaggctgggccgggactctagaaggcagcagggaggtgtgttgggtctgagttgtttctggattgcaagtgtcattgatgcatatttaataccaatgacactgctctgctgtcactatcagtgccccatgcaagccttggggacatcttaaggaaaaaactggcataaatgatcccataggtgtgtccctgtgaagctgtgtttaaagttctcctagattatatttagatcctggcatggcttctccagttatggaactgtgtgtactgctgtttggttcttgccaggtctggtttttcatggagtcagggtgtgggcttagaatgctgatctccacacttggtcatgctgcttgcctttgccaagctagatgtgctaaaggagtgagggatcaggagaactctgttcctggcccccagtaagcaggtgctgccagttcacactgacacgcaccgctgaagagcataaaactataaaatggagtttctgcctcagtttccacatttgtgctagatttctgttgggactgctgcctcattgactgtaaccctcatactggctgttgttccccccaaaaccctctcagggatggaacctagagctagctgtacctccatccgattggtgatggaggaaatcacagttttattctcccctggctccagcgttgaaatcaggcagccttggtctaaaacattaactcagagccagtcacctcaccttctgggtttcagttgcttcgtctgtaaactaatgttgaatattttaatcctttcccactattttcttctgagctgtaatttgcattcagtaaaataaacaaatcttaagtgtacagcctaatgaatttctatacattcacatacctgtcatccaacccaatatagagaatacatttccagccctccagaattatcttgttccctaacctaggtaatgccacacccccatagggaaccactgttttggagttcatcaacatgagtagttttgcctgtttgtgaatgtcatatatatggaatcctacagtatatactgtttgcgtccagctttgtttgttcaacatataagttttgaggttaattcacattatggagtgtacagatagccagtccctttctgttgataaatagtattccactgtagcagtacaatacaacaatgtatccattctactttggatgtcatttgggttgttttcatttggagactattacaaataaagctattaccaacattcttatgtgggaatgtttatagaaatatgcattcatttctcctgcgtttattccatggtccagtaccagggatttaagcaccaaaattcattccacacttaagttcctcatcagcacattttgatgcccagaggcacctgaggctcagcaggttctacatggagtccatcaccctcatcactcagccctgacaatccctccaggctcagggctaaacatctcctccagggctacaggccagccatcctcagcttctagtgctttgaatatgccttattctccttctatcttcctggccttcagaataaattaaagtcagatgattacatcccctttatacagaaatatattctagaaagattaaaaactcgaaggcaaaacaaaacaaaacaataaaagtgctagaagaaaatctgaagtatcttttcatattcttgctttggttgcctaaaagtgtaataaggttaaaagcaaggaagaaagactgaaataaaaattaaaaacatctctatataaaaagagtataaagaagacaaatctgttaaaaactaaataaatttatttagtttattctttactactaatgtgtcgaaaaacacatattatccttaatacgcaaagggctcttgcaaaataataagagatgtgtaaagctccccaaagaaaaaaatgcataaagaagtagcaactggtaatataaaggtccaataagcaagaaaaagttgctcaacataatcaatcaacaaagaataacacattaaaacaagctattattttttactaatcagattagttttcagacaattgatggttttgggaaattagacctctcatatgctcttggtagaattataaatcaatacctcttttccaagaagatattcctatgatgatcaaacaccatataaatgtggccaagtaattcaatttctaggaagatgtcccaaggaaatggttgtatatatacacaaagatatgtaccagcctgttcataacagaagtgcataaaaatttaaaacctgaaacaacccaaatgcccagaaataggaaaatcatgaagtaaagtagggtacatacatataatggaattatatgcagccattaaggtgattggataaatatgtctttatcatggagagctgttcatatcctttttgagagactgaagtaggttgcaaaaaataagtcaagatatgattccattattgtgcatgtgcgtgtgtgcacacacatgcccacggcaagtgtttggaaggtgttctattcagggtaagtgaacctcagtaacctcaaagatttaacacaagaaagatttctttttcgctcgtgtcacagtcaaaaatgaatctgcagggtggctctgcttcactttgtcattgaaaagcccaggctccttctatcggtggctccactgtcccaaagagtcttgaagtccccctctggaccctctgtatctcaccatcagaagagggaagaaacagtgggggtggggtgtttacagggccagggctggaggtgactcatttcttcccaaataccactaaaacataaccacagggtaacccctaactgcaaaggggctgagaggtgtagccttgctgtatacccagcaaccgcctagtctccttcacagaaagaaacagcaaaattctaacatgattaggtctggctagaaatatttgggatcaactttgctttctcctttcactcttccacattgcccagacttttcccaaaagatgtgggctacttttagaataagagcagaaaagcccaatacagctattgccagccttccatatttgcaggttctgcatctgcagattcaaccaatcatggactgaaaatatttgaagaaaaaacaattagaaataacaatacaacagtaaaataccagcaaactaacacaggaacagaaaaccaaacaccgcatgttttcactcataagtgggggttgaacaatgagaacacatggacacagggagggtaacatcacacactggggcctgtcaggaggttgttggggggacaagggaagggagagcattaaggcattaagacaaatacctaatgcatgaagggctcaaaacctagatgacgggttgatgggtgcaggaaaccaccatggcacatgtatatctatgtaacaaacctgcacgttctgcacatgtatctcagaacttaaagcaaaataaaaataataataatacaaataaagaaatacagtaaaacaactatttacatagcatttgtattgcactgggtgttgtaagtaacctagagatgatttaaagtatacaggaggatgtgtataaattacatgcaaatacgacctcattttatatgaagaacttgagcatccaagaattttagtatccaaggagggtgccggaaccaatctcctgaggatactgagggtcaaccgtatttccattctgatggctttgcagaggaatcagacagtcctccactgtaaatcaagctgcaattagtgccctggtgttctggcgccccgggtccttcgtgttagagctgggacatgaagacagcacccgagaagaagggggcctgaaatatccctggctgcccttcacatctcaaaagacacagacactagtccccaaggcagctcacagcccacccacctggaactttctccatgcctgggaggcctcaaactgagaagcaaaccccacgttgctgtgtgacagggcctgcttctgtccgcctaggtgcacaagtgcatcccaccactcagaggaatactccccacaccaccatttgtcactgtcagcccagggagcaattatattccatccggccagaaataaacagacaccagcatcacacaggagatgacaggcagacacactgcctctgatgcacacacgtttttctcatgcccagctgtgactgagcctctgggcacagatgcagcccagagcctggtgggaaaagcaaatcaatgagggcccttagaggatctcgtaagctctctcaccacttgctcttttcaggtagaatgaacgaatttggggaaaagcctaacttttaaattaaacagttgtaaaacttctgataaaaatgccattaaagaaatttatgagattaaacacatctctatggcttctcctgcagatcagcctgtgggtctgaaggcctttggatcaaggggatgagcgcattggtgtgggagccggggcagggagtggggtttgagctcctgcagcactgcttaacagctgtgcagtcccagctgggtcctgtaaccttcctgccttccaaagggcaatattaccacttgcccttcctccctgcttttattaatgcaattttctctgcttcatatacactcctacatcctccttatggcagagacgacttgctctctcccaaattcactctcaccttccatcacacagggctgtagctaggaagcagctactcagctagagagtatatttcctaccctatgttggctatgtgtggcttcaagacaaggcttttttacattgtgcacatgtaccctaaaacttaaagtataattaaaaaaaaatagattcaattttatttatttattttctcttttgagacagagtctcactctgtcacccaggctggaggtctgtggtacaatcatggctcactgcaacctcaacctctcgggctgaagtgatcctaccacctcagcctcccaagtagctgggattacgtgtgtgcagcaccatgcccagctaatttttgtatttttcatagacacgggttctccctttgttgctcaggctggtcctgaactcctgggctcaagtgatcctcttgccttggccacccaaagttctgggattacaggcaccgcagccagctgactttaacgtttttaagaggagctttaggttcacagcaaaactgagcagaagattcagaacctcaagactagttttcaccaatgaaatgggaacagaagtgatggctgtgactcccaggccctgccctaaagtgccttgcaggtgttcctccaggcacattctctctttcagcttgctggggtggaaatgagcaggacaaacttggaagccatgcactgaggatgtaagtcagggctgctgtccacctaggtgaccgagtgaccaagtaaaggactattgctcctgttgccaatccaacataccacactgaatgcaatgaggtatctttgattgcatcctggaacagaaaaagcatgtaagtaggaaaaaaacacaactgattaaacctcaacaaaatctggtgttaacagtaacccacaaatgtgccatggcaatgtaagttgttactatttggtaaaactgaataaagagtagatggggactctctatattatcttcgtaacttttccatgaatctaaatttattccaaaagtaaatgtttattaagaataatttttaggcagggtgtggtggctcacacctgtaaccccagcactttgggaggccgaggcaggtggatcacctgatgtcaggagttcgagaccagcctggccaatatggtgaaaccccatctccactaaaaatacaaaaaattagccgggcatggtggcaggtgcctgtaatcccagctactcaagaggctgaggcaggagaatcacttgaacccaggaggtggaggctgcagtgaaccaagatggtgccaatgtacttccagcctgggcaacaagagtgaaactccatctcaaacaaaaaaaaataaaagagagagagagagagagaaaaaaaacgatttttaaaatagctgtattgagccattgtgcctttgggtctatttattactgcagccacgcctaccctaacaaatgcacttctcttcacctgtaaagctcctagtcacattttaagacttggctttgacattatctccattaagaagcttcctgtgattaccagggggtgaggtactgtacactttcttcctcgatcacacccaagagaagtaactcatagaactgcctatttcccaagccacattgaagtcttccttgagtcagaagccttgtctgcttcacagctacaacattcctcatggtgttcagaaatatttgtccaatgagttaatgccagcctcacctatttgttgtgaacattcactataccaaccagaataaaactgcttcattaactctgaagcactgcacagatgtaggggatgattaatcagttgcaaagtatttattgaacaacagacctgttttataattgtgatatattttcctggtggcctggagtgtatgcattgatacatggcacttggtctcatgattctgactgtcttaattagtattgatgaggcaaaatggcttaaatagtcaattcaatgccatctgttgaacacccaaagaccaaagacattataggtgtgggtttgcttttttttgctttttttttttttggagacggagtcttgctctgtcacccaggctggagtgcagtgacacgatcttggctcactgcaaccgccgcctcctgggttcaagcaattccctgcctcaggctcccgagtagctgggattacatgcacccaccaccatgcccggctaatttttgtatttttagtaaagacagtgtttcaccatcttgggcaagctggttttgaactcctgaccttgtgatctacctgcctctgcctcccaaagtgctgggattacaggcgtgagccaccgcgcccggctgagtttgcgtttcttgaatgcctactggctgccaggcaaacatgtgttgggggctttcactcctattatttcactgaatcccagtagtgaaatactccaacgttggtattattatcctccactttacaggtgagaaaattgaggagcagagagaacaagtgatgtgtttaccactgctcacttcgtaagtggagctaggtctccgaagtccacctataacctgcttcttttcaaaacagcatcttgacatatgattgatcgccaggctgtgctaagaactgtcataaaaataaattcaatttcttccatgcccctctgggttggctctcaaataaaagctgaatgccagaactcaaacaaacttccataaactgaagtccagttgttgaagctgggacttggggtcagaggtgaccctcctggcctacagagagctgtctgagctgctaaacccaggatgcttcaactgtcctggattcatctgggaataagaattatttcggctaggcacggtggctcatgcctgtaatcccagaactttgagaggctgaggtgggtggatcacgaggtcaggagttcaagaccagcctggccaatatggcaaaaccctgtctctattaaaaaatacaaaaactccccaggagtgatagcagatgtctgtagtcccagctacttgggaagctgagcagaagaatcgcttgaacccgggaggtggaggttgcagtgagccgagatcgtgccactgcactccagcctgggcgacagagcaagactccatctcaaaaaaaaaaaaaaaaaaaaaaaaaaaaaaaaaaatatatatatatatatatatatatatatataatttcaactttcatgccatgccagtactgctctaagtattttacacagcatagctcacccaacccttacaaccctaggaggagactactatgattccaatttcaaagatgataaaataggctcagaaatgttagtcaaaagttactgtgagtaaatacttcactatgaaattagatgctcaatgtctcctttcccaatagactgcaagccatttgagggcagggacagtcctgccttattcttcttcgtatctaaagtgtacatcacagagtcctgcacgcagtagctgcataataaataattgttgaataaaggcatgaaatgataaaagtcatacaaaatttggggagccacagaatctctggaaggcctgtaatgaatcaactaatgattgttgctatcacgtgaatatcagccaaatgcctgagtctgcaccctgtctataaactcactcctgcctgctcctctccaccagcctcaccctcaccagtccatgcactttctgagagcacccagggaggcagaactcctagatgccaaatgagaatgggttccattcagagctctctgcaccagagccatgctatgctccaggcagaaagaggcagagggctcttagcctgattctttcacacaagatcacttggccctcagttagcatgacttgtgttcaaggtctcaaaagttcccccaagaagacgtttatcatcatttagccacatttatgagctaaataaatgttcatttatttatttgtgtattcatgttgtatgtcactgatattttgtgctcggttccttacatagcaatagctgactattgcaaactactaagtctatgttacagaagaagacactgaagaccagaaggtttaagtaacttgcccaacattttatagaaagaatgaagctagtatataaatttaggtctgtctctaaagcagacaggcttctgctaccccacatggctccctctgtcctttggaaggacatccagtccttatacctggcaggacagccagtgtgtgtcgccagtgtgtgtcgtcagtgtctggggcatctctcccatctgtacctccttgacagtagcacaaaggtgacccttggacagatgctgtactgagtcaggatgtcacacctggaaacccgccgtgtccctgctgagtaactacccttcactccagagctctcctcggcacataaggatattcctcactttaatgtgtaaatgccattccaaatcagcaaccaaatccaccagccaggggagctccaggtgattaatgcatctctcaggtagtgaaaaccacttaatcttcagctgcaagtttctgactccaccaaacacagatctaatcgcccacaaatgcactgcctgatgggtctttattgcttaattaccaaggtgagaggctcataattaataagccatttactcctacatttagatgtctccagaaaatgtagccaaagattttccaaggaaattcacattatttgtcatctttatatctcttggtacctgaattggtcacctatctcattggtttctaaacttttctgcctacaactaaatatgagagggagagggaaaaaaagagacaggaagaggagagagaagatttcccctcttcctcctgactctatttttcatttataaagacccttgtgatacattgggcccacctgaataatccaagctaatcttcccatcacaagatctttaacttaattgctttaattaacttaattaacttaatctataaagtccttttttgcagtgtaaggcaacatattcacagattctggggattagaacacggacatagacattttttatcgggggtgggggtgggttattctgcccaccctaatgttcagcactgcaacaacctaagccccccacagaagaaaatggttaaataatctctccccacacattgcatgtgctgccattaaaatgcttataaagaactcttagaacatggcccatgctgatgctgtaatatttggtagaaagctgggcaaatttcaaaagtattacgctttgcataacaagtgtaaaaagcatgaacaatgatgaacaaataagatgacagggaaataataattcctatttattgtacttggtagttgaatcatgtacacttatttgtttctgtctgcatttttctaaataggaaagaaggatagagaagaggaagagagttgaagatgctgcattgctcgaggaagaggccatgagccaaggaatgcgtacagcttccagaagctggaaaaggcaaggaaatggattcgcctctagatactacagaatgcatcctgccaacacatcaattttagcccagtaggatgcatttcagacttctgatctccagaattgtaagataataaatttgtatgatttcaaaccactacgtttgtggtaatttgctacagcagcaagagaaaactaatccaagtgcccttgtgaatgaaactgttcacgtagttcagatttctattacaacagatctctagaagtggaattactggatcagaggatgtgactgttttgagagctcttgactagatgttgccaaactgctatccaagaaggctgaggggcaactttggtagatgatccaggaagaggaccccaacccccactgccccggggcagtcattcacttctttccatcttagtttcccacacccttgtccaagccatgccctcacctcccctggaaagaatgccccagccccttcactggtcttcccacttcgcctcttggcagccacagcttgtgtcccacatatcagccaggagaatctcattaacacctgagttagagcctggtgctctcctgtattcgtttgagctgttataaccacataccatagacagggtaatttattagcaacagaaattcattgctcacagttctggggactgggaagtccaagactgagactccagaatatatgatgtctggcgagggtctgttcctcatagatggtgactttatgcatgctcacagggcagaagaggccgggggctccctcaaacctcttttacatgggcactaatcccgttcatgggggtgggatcctcctgacataattgcttcctaaaggtcccacctcttaataccatcaccatggggtttaagtttcaagatatgaactttggggtggacacaaacgttcagaccatagcacatccttcattgttttcccattactctttgcataaagaaaactatccctgccctggcctctgctggccaccctctggcctcaccacccaccaagaaccctcaccccttaccttctctgctgtggccacatgggtcttcccccagcttccacccacaggccatgctctcatttactccagggccctggcacatgcctggaatgctctcctcacattcttgttggccccaacatctctcccttgtcctttcgagcccatataaaatgcacctttctcaggaaagcccccttcacctctcaggcaaggtccacttctcatgcattcccatactgtattcttctccttcatagcactcatcatgattacaattaattaactttttaattagttgtttagcttttaatcaaagtttggtatctatccaggaacttgcacatagcacaatctctatgaactttcacaaactgaacacacctgtgtaaacaccacctggagcaataaaacattctctgccttctcgggcatcccagaagctcacccatacctcttccagttactaagtcccctaaggcaatgcctaccttgacctctaacactagagataagtttttgtttttttttttttttaacatctaaacacaattgatagccttttttttttttggcatatatgtctccattaaaatataagctccataagagcaggacccatgtctgttttgtttgccatcctattcccaatgtccagcaccttagctcaacaaatatttgtcaaattacagaatgaattaattaacaactaattaatgttgtaggaattgggcaacaaggtgtaggaggtacagtgagcagggtgcccacaggaagatggaagtaagagaaacaaggtgcatctagccaaggaggggccagcaggaaggtcaaaggaatgcccctggctgcacaagcccagcctgcactgggcaaggcaagcaccctggccactaggggccttccacagtggcatgagtccaccccccacccacccaacctccaactccctgcccatgatggtctggataagatacccttcctccatagataggagcttttctggaaggacacaagctgttgagctccagagagggattgtccttggcaataaagagggggcattagacagtgttgtggtgagaataagctggcatctgttggtctcagactgggagaaattgtagcctgtagcccaagtttgaattgaaggacactgactgggtgactaccccatgatctaagttctgatttcaccagatcctgcttgcctccctactttccctccttccttccattcaaacttctgtccacacttatcagagcaggttctcctatgtgggggatgatacaaccccgttatcagcacagtggtctcaaaatggcaagacggaccctttctttctttctttttttttttttttttgagatggagtctcactctgtcacccaggctggagtgcagtggcgcaatctcagctcactgcatgctccgcccctccaggtttaagcacttctctgcctcagcctctggagtagctgggattacaggcccgtgccaccacgcccggttaattttttgtatttttagtagagacggggtttcaccatcttggccaggctggtcttgaactactgacctcgtgatccaccacctcggcctcccaaagtgctgggattacaggcgtgagccaccgcacccagcaagatagactctttctatgcttctgactgagggcagtttgggctcccaagttggagaagcattgagcctgcctatgtgggttgcagagccaggcagagcatttgacatttccggttggagggccatggcagccagtattttatttaaaacactcagagtttacagtcaaaaacccgtgagtctgaacaaattctttaactggcaattccctgcaaagggctctgcagtttgcactatttcaatcatgtgttcaatcaaaagggtattggagacgtaactgtacattatcactattgacatttcccagcctactccactttggttaaaaagaaagtgtccaaagatgccacttaataactttgggtatcatgaaaatgtcactttggcaagcagaaaagtggatttacacacccaccaaaggtgacctgcttagaaagagacagcagggattgtttcctggcctccaaaagagacagtgcacccaatgtccctgcaagttaccattgctccaggggatggagggagggagaggaagaacaaagggcagtggcagcccaggtgctactcagcccactggagcaggctcgggtggacagaaaggcttctagggcttcagcaacaaagctggggtgggggtaggggttgggcgaagaaaggtgatatggtttggctctgtgtccccactcaaatctcatctcgaatggtaatccccacatgtcgagggagggacctgttggaaggtgattgcataatgggggcagtttcccccttgctgttctcatgatagtgagttctcaagagatctgatgggtttataagtgtttggcagctcctcgtttgttctctctctctcctgccatcctgccatcatgccatcatgtaagacgtgccttgattccccttcatcttctgccatgattgtaagtttcctgaggcctccccagccatgcagaactgtgagtcaattaaacctcttttctttataaattaccctgtctctggtagtatgtttatagtagcgtgagaatggtctaatacacagggaaaaaggaccgactggtgcaaagctgataaaatgactgcatccggttctggagtcccagatgggggtaacacacacatagaaagacgcaggaaggtgggtcccagccaagagacccgtcccttggtcaaggtgatggggggcagcaagtgatcctgtggcccggtgaaagcaaggtcaaggttttggaaggaccgtcaagtgttagcagagctacagctggacagagaaggaagaagaggggccattttcccagaggagaaggctgtgaagagccagccaggcaaagtggcagggctcagttaaaaaccggtagaatggcaggctgaggcatggctgcaaagactgggttatccccttctccacttcctgggtttccatctcagcaacacgcaccaacctccacaatctaggtggcaacctcaaatctttctgtaacctcacttcccacagtgctttgcacctaacccaggggcagacaaatattttctgtaaaggaccagacagtaaacattttaggctttgcaggctctgtttattggaacattcaccctactcaactctaccgttgtagcgtgaatgttccgagaaaacttacaacactaggcagtgggccacatttgatgcatagaaaactgcttgccaacccctgatgtaacagattgccaaggcctgtcgatgttaccttctaaagatctcctgaacctgcccacttttctccagcgcccacaccctcgccacactagtccagccacaatcttctgttgcctagatgaccccagcagctccctccccgcctgcctcctccattctgctttcacttttgtctcctctacccagcagccagagtgagcatataaaatgcagttctgatcctgtcacctctctgcttaaaactcttcagaggttcaccatcgcttccagaaaaagatcaatactcctgacgtggcaacctgtcgagactcaggaccgctaggaaatcagctcttgtttacccctctatccattacactacgatccagctggggtaagtgcctgttggagcatctgcatgagttctccctcctgggcctttgtccctagataatctggcaggggcgcactttctctccattaacaattccacccttccctctcctcattttgactcatctcagtttaggcatcacttcctctgagcaatcctccctgatgtcatgaggcagtgctgagtgccttctctggaccctctgtttacttgcctgttaaatcctgaacatctggaagggagtcgtgttcagcaacatatctacgccttgcagcacggtgcctggcctgcagctggtgttccgtaaacagctgctgactgacgggatgcatcggtgagtcaatcaattaactctctctcacaataggaggatgaagctcagagaatatccaattggccatccttccccagaggccagaaaatgctgtggcttgagttccctggggctttgcctgccctggttgggatggctttctgccccagagttctctggaacttgcaagtctggagttttctgacccaggagttatctgtgtcagaaaaagaacctggctttcagaatcttctgtgtattataaggtggactaaggtttagaaagacacaaaggaactaatacgtttacacattttcctgggtaaaagcataagtaaattctcaatcatcttttctttagtatgattattcatttattaatttcttcacttatttattcattctacaagtgtcccctgagctcccaaggggtttctgcccctcaactagctgcttcatccacagagatggctggtacccaattcttgccttaccgtcagatgaggaagacagtccattttgatacagtgtggcaaatgctatcataaatgaatggtcagggacaatgtcagggagtaaaatgagggagagtaaaaatgacaataaagtacacaagaaagttcaggtcaagcagtattttagaaacaagtagacttaacaagctgaaaagaaaacaggccattaccaaggaagagtatatagaggcagttaaaaataaaagtagataggtcaggttaatgtcaacaatcgctataacagaacagtaaagaaacatcaggctctttacaaaattggatcacagaagcataatatggtttgcaaggaaatcaactagcattaaaaagattcactcccccaaaatggccatgcaggtgccagttttggccacacctctgcacaaggcggatgagcaaacctggtgggagggatacatcgcagaagccagcatgaaaggaccaccaggctgtgctgcaggctcttccaagggaggggctaaggggacacagacggagacccaggcatgcaggtttgagaacactggaaggagtgaaacctgttgtttctctcctgacctggatgcaacagagtaaataagatgatactgcagactggggatgtttagctcctctcttaatgaaactgcttcaaagaggtcgggggagtattcccttggcagtgattgtggttaaactgggctaacggtgactgcctagactgctttctccatctagttcggccaccacagagggtcagggctacccagactaccggccagggaggaaggagatcaacagcacggagatgtgtgtgtctcaaattaaaaatggtctggccagatgcaggcactggcatgctcagggagaagcagtctaaccaaacaagagaaaaaccttcagacctgagcaaggctgtgtgtgtgtgtgtgtgtgtgtgtgtgtgtacaggcatacccagtctaaccaaacaagagaaaaaccttcagacctgagcgaggctgtgtgtgtgtgtgtgtgtgtgtgtgtgtgtgtgtgtgtgtgtgtgtaggcatacccacatgtgtgtgaattcccattaggaggtgggacgctagcaaactggaaggcagagcccatctgaccctgagatcctcacactcatgcaaccttaatgccaagacaaactgaatggttgattgtgtcaactctcttgttttagggatgggaaaacaggcccagagtgggaaaaggagttacctcgagtcaaccaggagagtctacgagttgagattaggattgatccctggcctttctggaagcacactaaccagggattcactccttttgcttccaggacacactctattatttaatcctcatctcaatctcccagtgcagggtaaatggagaaaattatctccatgttaagagtataaaagctgaggctcagagacagtaagtatttttctgagggtcacagaactaatcatggtgcagatgtgattgcaatgaaggcctgtttaactccaaagcctttccactgtctcatgttgtctaatagatagccagcaaatgtttcaaacttaacatgtttgaaactgaactgctgatcttccccaataaacctgctccatcgacattcttccccatctcacttggcagcaatctcatccttccagttgcccaggcctagactcctctctttttctcacttccactaccaatccaccagcaaatctgttggctggatcttaaaatatatccagaatcaaaccatttcaaccagctctccctttgcagatgtcaccatctgccctatctcggatctgcaatcgcctcctacagtctattctcagctctgtagctggagtgatcttcttcttatgcaagcaactcatcttactctctgttcagaaccctgcaacagcttcccatttcatgcagagccaaagcctaagcccttacaatggcctttgagtcttgcaagttttttttttttgggggggggtcggtttttattatactttaagttttagggtacatgtgcacaatgtgcacgtttgttacatatgtatacatgtgccatgttggtgtgctgcacccattaactcgtcatttaacattaggtatatcttttaatgctatccctcccccctccccccaccccacaacaggccctggtgtgtgatgttccccttcctgtgtccatgtgttctcattgatcaattcccacctatgagtgagaatatgcggtgtttggttttttgtccttgtgagagtttgctgagaatgatggtttccagcttcatccatgtccctacaaaggacatgaactcatcattttttatgactgcatagtattccatggtgtatatgggccacattttcttaatccagtctatcattgttggacatttgggttggttccaagtctttgctattgtgaatagtgctgcaataaacatgcgtgtgcatgtgtctttatagcagcatgatttataatcctttgggtaaatacccagtaatggcatggctgggtcaaatggtatttccagttctagatccctgaggaatcaccacactgtcttccacaatggttgaactagtttacagtcccaccaacagtgaaaaagtgttcctatttctccacatcctctccagcacctgttgtttcctgactttttaatgatggccattctaactggtgtgagatggtatctcattgaggttttgatttgcatttctctgatggccagtgatgatgagcatttttttcatgtcttttggctgcaaaaatgtcttcttttaagaagtgtctgttcatatcgtttgcccacttgttgatggggttgtttgttttttcttgtaaatttgagttcattgtaaattctcgatattagccttttgtcagatgagtagattacaaaaattttctcccattctgtaggttgcctgttcactctgatggtagtttcttttgctatgcagaagctctttagtttaattagatcccatttctcaattttggcttttgttgccgttgcttttggtgttttagtcatgaagtccttgcccatgcctatgtcctgaatggtaatgcctaggttttctcctagggtttttatggctttaggtctaacatgtaagtctttaatccatcttgaattaatttttctattaggtgtaaggaagggatccagtttcagctttctacatatggctagccagttttcccagcaccatctattaaatagggaatcctttccccattgcttgtttttctcaggtttgtcaaagatcagatagttgtagatatatggcattattgctgaggtctctgttctgttccattggtctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaggaaagtcattggtagcttgatggggatggcattgaatctgtaaattaccttgggcagtatggccattttcacgatattgattcttcctatccatgagcatggaatgttcttccatttgtttgtatcctcttttatttcattgagcagtggtttgtagttctccttgaagaggtccttcacatcctttgtaagttggattcctaggtattttattctctttgaagcaattgtgaatgggaattcactcatgatttggctctctgtttgtctgttattgatgtataagaatgcttgggatttttgcccattgattttgtatcctgagactttgctgaagttgcttatcaactaaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccgagtcttgcaagttcttgtctccaggtacattcctgacttactctcctcccattttctccttcacacactcagctctaggccccctagcttccttgctgttctttgaacattacaagcatgctcctgcctcagggcctttgcaatggctggccgtatactagaaagtcttccctcctcccttcttcctccacccttcatgatccacgcgactaaatctctctcatctctttcaagtctttgtcaatatatcacttcctcaatgaggcctactctttaaaattattaaccacttctactgcaagaatttccaatctgcattctctctgctgcgttttctcttactaccttttagcataccatgaactctactcatttattatgctaattggttattttctgtctcccacatgaaaatgtaagcaccatgacggaaacgatttgtttcttttgtttattggtgcatccaaacctagtaagcagctgacacatggcaggtgctcaatgaatatctattgaattgcactatctctctaattggtggctgcataaaaaaaaaaaaaaaaggcttaaactcacaggagaggaaatttttctaagtcacaaagtcatttttttaaacattactccatccctaagtcttccacagaaggagctgaatgtgtaattttgacaaatgagtttgcatagagaaggaaataaaacatggaatgagactatgaaaggagttcttgggaagagaaaattgcattgcctttaagtaggaaaaggaaagtaatatttaaaagcaaagatgtttaaaacatcgcaattgtaggtagaaataactcagaggttgaagggggagggtgctgcaagatgcagtggaattctttcttatctgggctcctgcctaaagcattactgggcaattgacaggccaaatcaataagcaacttaaattctggtctaaaggaataactgaaatgaatgcacaacagcacagggaaacaaatcggcacttggaacaaaaaaggggctggaatgctggctttgactggcttgttcaccccagtgaaaccagcactccaggttacttgctaagtgctgtgatgattataataatggtggctttgtggggagagtgtcagcgcagccctctttccctcctgggtcccagtagatggatctgaatctggtctgttctgtggagagaagagaggagggaagcacctgtcttggtcttgtctgcaggctccctttcctggggtgtgaaggagctcctgcaggcttggtgtggagggctggtcccaaaggcaaggcctggggtggaggcccctggggagaagagaatgaacctcaaactcagggttggccagacgaagctctgaggctagaggtggaatcacaggctggaacacactgtccagaattcagatggacagagacaggatcacagcaggtcaccaacgaactggaaaaatccaagccacctgggctgccacctatagttgtgcacaaaaccacaggtcaagggggtgagtccgcctgaaattaaattagcctaggggccactatccctcacgtgggttgagccagttcagagggagggacatctttttgcaatctgttcacaaaaagaggttaccttttcaaaatttgcacagagactccccaaactctggcaactgtggttatctgtgatcaccctttagtggtttgttttgtagagtcaggcatgctctggtcaagagaagctgcaggaactggaagaaattaactctgatcttctcagagctcgcccaaaaaactggacctatagagaaacctatggaacatttcaggcttccttttcccaatccaaatttgagctacagatttgagccccaaattaatccccaaatggttctcctactgattcgttcatttcgttcatccaggtattcacagggttactaagaagtgcttgtcctcggtcaggccaggaaagagagatgacagacttggtcccatcggcaaactctttacagacaaaaaatccacctcactcatctctacagctccagggctcagcacaggggctggcacatgaaggctccctttccttaccttttcctggcacatgcaaatatatgttttttgagtatataaatcaatgaatgatgagaatatcttgcaactccttcaaaccgacaggtccacagagatgatcttgctcctgaccttgacaacagaaatacattcttagagactctgtagtcctaaatagaactttggggaatccttttaaaaatcaaacgcatacttggtaggagaactgacaatggcaaccagttgctcagagttatttgctcaaaggcctacctgcctcctaagcctcactgttcttcattaactgtcaggggttaaactttcaagagctactcccaaaagagctgcaggaaaattctgtctaaacagccatgcaaaagtgtctggggatcactacggacagaggatgatgacagagggcccatgacattgggccttgtcatggctgaacactgaccttccactgtcatggctgaacactgaccttccagtgcctacagcttttaaaaagagtaaaaactatgttcatgggtacacaaatacaaacatgcactcccccacacacacacatacatggacacacacagaggcatatcatgcattatcttctctcattcatcgatattctcaaatggcttattacacagatttacattcacaaatattctattatgtaaatgtaaatctattctattatgtgaatgtaaacctatataatatatttagccattttctcagttggatattttggttatttctatgttgtcacaattttaaatcacattgaaataaactaggcccctttgactcctttctttctctcttactccatgtggtagactaaatgtggctgctaagtttatttctcccactatgtcttccagccaattctagatttgagtcaattctagagaccaccatggtggagagtgcatatgcaggcacgccagttaactgatctggctgagcccagccctccagccatccctgccaaggtgtcaatgtgagtgaaaccatcttgaactctgcatattaacttattctccagctgaatatcaccaagagacctgtcttctgatgctacatggagtggaacaatctcccagctgagctctgtccacattcctgaccacaaaatcatgagatattaaataaaatggctgttgttttaagcatcaaccagtcttctcaatgctgccacaatcctcacaatggcccataaatctctacgtgatctcccactattctctttgatctcatctttggccttcccatggctgaacctgctccagccccactggcctccctgttcctccctgaacataccaaacatggtcctcccacctcacggcatttgcacttcctttcccctctgtgaggataatcctcccccagatgtcagcacggcatggtccctggcttcatgcaggcctttgcatacatttcagtcaatcagagaggtcttctctgatatcttacctaaaacaggagtccttttcttccacctcagccctctggagagccagggaacacctctctctccttatcatgctttatttttcttcataccactttcacaatattaatatttatatgtttattgtctatttagacctcctctcctccccacaaataaatgcacattctttagtacgaattctccgcaaacagaaacgttgtctgcttttatcattgctgtattcccaggacctaaaacagtgtcctgggtgtaggactgatcaataaatatttgtaaatgaatgaatgaattaattagcacacgttcttggatagaaatctctctattcatttctaattattcctcaaaataagttcctatgagttaagttgtggaggtgtaggaataacacatttcaaaatcttttagcacatattggctaaaattccctacagacaggctgcactggtgcttacccatcctgctagggatgtgtaagagtgctaatttccttgcatcatcaccaatataggataaagtcactcaaaaatatttgctacgtggatacatggaaaaaaatggttaccctttattttaacttaactttcttgatcctgtgtgaactgaactccttgttccacgtgcttattggccactacaaagtaagttccttgacagcaggggtttagatttgctcactgctatcccagcatcccagatagagtctaggatataagagatacatgataaatatttgtagaaagaatgaattaatatagatgttttcttttgttattgaaaggctattgactcatgtgtcctctgagaagtctgtctcttttttcttactgacttgaaataactccatgcatatagaatattttactgtcatctaggttgaatttttaatgtgtcatttgcactctattttgtatatgctattttttgacattcagaaattctagcattttatgtagttacatctatcattttattttagttcctctatttggtaccatgtttagctacagtcataatagttaacactgtatagcacttcccacatgccaggcacttttctgaggattttacatacattgtttattaaattcctacagcaatcctataaggtagacactatcattatctaatcatataaagaaactgaggcaatgagctatgaaatcaatcatctcctgtacaagattttatataaatttacctgtagattgctttatgatttcagtttttatatttgtgattattatgtaataatagaaatctattgggttactccatggagaagtgagggtctaattattttttcccaattaattgtcaagtgctccaacacagtttattgtaacaatatgtaacatgtctgtaacatattgacatatatatatgtatgaatagacatatgtatacatacatacaaacatatgtacatgaacacaatcacacactatatagcatttgctggtattcttactcagctcacttgtactgtcggtcctttttagttgtttagtaatttttgtggtgtgttcagtgaatcaaatttataaaatagaaatataaagaagaaacataaaaggattaccagcgattccctacaaatcctgattaaaggcacgttcaatgttgttctcatgaaatatgcacctgtcaaataaaaacataagcgcctccaaattgcattataaatgcacaatactttttggaaacagtttgcttcagaactttggcagccacaataataacacacacaagcctgtttcaccccaaaggaaatatctacaatacaaggatgtttagctccatcatttttcactgctttgggtttcttgcaaaaccattttgatttcagttgaaactaatgacagcaagcagtttatggtcaggttcacaaagtacatttctacccctgctgtggggaagggatcacaagaaaatagcttccagtaggttacgactcatctagctcccaaagtggggactcctccaccagagcctgcattttccactttttgccacactcagagaaggacttcgacctcaacatgtgatccagataaagagcatcctcctacacaacctcaaggtaataataacattttattggtatcttgtacatccgttggcattggcatttatatttttattcctatatcttcttatgtcaaagagagcatgctatacatcctgttcccaccttgcttttctcttaatgatttatttgaaaatggtttgtcattcatttctacagctgaataatagtttgctggatggctataccccatgtatataacccgagacagggtgaccttttgtggcccactgcctggcacttggcttggtctaacaaacagaaccttcatgcaccaagctggtcatgccaccaagtcagcgcagtcattgggagtgagtggtatgtgagtcctggctccctgaatgccctgatggaccccatggtccagccacactggctgggtccctgtaagcttagcctaccttgcctgagagccaaggaaatcccatcttctgcctcaccatcctcaaccacatttcagcaccaatgcaagatccagtacagctgctggaatccttgtttcatccagggtggacatggcagaggagtcagcaaccattttgtgccccagtgttcttcagataagttcccactcatgacaaactctagcccatactgcaactgaggtcccaaacatgcaattgcattgtttcccacggtgggctgggtcacttgctactgcaacaaggcagaggaaggacagcatcccagcatttacagacacattgcccagcatggggtctggctctgccagaatccaccgaaaggtatgagccctttatgaactagctgcactctgccctttggtcataagataaactcatatcttgacccaaggcagagccctgacatcagcatcagatcaaacttttgtctcaccacagagcaagccctgaccctggtcagactcaactctgacccttgcacggcctgagccctgacttgggccacggactgcaacccgaccctcagactcacgctgagtcatgacccagatcacagacacagctccaagccccagacttatcctgagccctaaccctgggcccagactcagccctcaccttggctgtgactgagcccagctggctatcttcaaatgcggtcacacaggaggtacttggcacagtaggcagatggctctgtgtgagccctgcctcggctctggatggtgcttatgatctactgcctatcacgagcatctagtatcttgccatggggaagaaatctcagtcccacagacctgagttcaaattctgccactgtttagctgggtgactttgggcaaattacttctagtccatcaaattagatgccttctgaagaaaccatttataaaatgggcacaaaatacctgctgtcatgatggtcatgattaaattatatgattgtaaagtacccagctcacagtagatagagttcatccctttccccagtaggcatcttgtcagctgcagctgaattattggtataggaacaagccctccagagctgtgctgtcctatactgtggccaccaaccatatggggctattttaaacaattgaaatgtggctggtacagccgggcacagtggctcatgcctgtaatcccagcactgtgggaggctaaggtgggtggatcacttgaggttaggagcttaagaccagtctggtcaacacggtgaaatgccgtctctactaaaaatacaaaaattagccaggcgtggtggtgcacgccagtaatcccagctactcaggaggctgaggcaggagaatcacctgaacctgggaggtgaaggttgcagtcagctgagactgttttgtgccactatacccagcctgggcaacagagccaaactgtccccaaaaaaaaagcaaataaatcaaccaaccagaaaaatgaaatgtggctggtgcaaactgagctctgctataaggaacacaccatatttcaaagacaaaaaaattcagaataagaaaaagaatgtaaaatgtatcattaataagtttttaatgattatgcatttaaataatatttgaaatatattagatcaaataaaatatactactagaattaattgcacctggttcctatttttaaaaatatagctactagaaaattttaaattacatatatggtttgcaggtccagaggtctgggaagagcagttcatgggtaataaagacagttaaaacagaaacaagagcaacagtaaaattaatacctaactaagtgtttattgtgtgctgggcacggcactaaacacttaagtcctcacagcaacctctgaaggtaggccctactactgtccccattattgagatggcacaactgaggcaccaagacgtaaagttatatggtccaaggtaaagagccagtaaaaggcagaaataggatttgagtccacaacacctggatccagaacctatgtcctagaggaaatgacacattcattaaaggctgcctcagtaaagtgcttcctacaaatgagtcacccacagggaagaaacatgccctggatcaattaaatgctgtcattgagacatgggcagcagcgaaccccactctccaagctcttacctacccacattgctaggcacttcactgcccatcagactggttggcactcaacagggtctttatggaggtgggggagttctctcatttaatcttgtgcatttctcagacatatgccaagttatctttatctggagaatcaaagaggacagctccttcaaacctttttagctttctccattagcaagaggtacctctgagagcaaaaatgataaactcaattgttcaaaaagcaagttccgttcttcaatttgtgtgccagtcataaacacagcaacttccatttgagcagaaatcccacatttcagcagaaatacttaatgtgtcatttctcctgcatccatcttcttcaaagcacttactttagaaagtagagaaggaaaaacaaactctaataacctgtactttgaatgggagatgggaactttatgataaagaactcaaaatgctttattgacatggctgcacacatcccccttcagctcctgaaactgctcctgagatgagaaaactttcctaggagccttgcaactcgacttcacacccagctaggctctgggggtaggatgcacactcactccagctcctgatctgttttgatcagccagaagtcctagttcaagtctaaacccagaatataaccatcttttttatcttaaatcatgcatttacaaatatctggcaaatacatattgagcactgtggcagattatattttccaaagatggtcatgaccacgccacttatcccacaagttcttacaatgtgatcttgtcactccccaccaggaggtggagtttatgtcccctcctctgggacctgcgtggacctttgtgatgggctggaccaatggagtatggagaacaggcttctatgtgacttctgaagctaaacataaaagttacaacaagtcatgaaagagaaaagcttttgctcttggagcccagccactatgctgggaggaagcccaagccacatgaagaggtcagagataggtgttccagctaacagccccagttgaggcccccaggtggcagccagcattaacctccagacttgtgagtgaggagtctggcttatatataactccagctctagccactgtcttatgcaaccacaggaaggagcccccaaatgaagccacctacctgagctagttatggttcatcaaaaaaataagacataatgaaaaatacattactgtcttatgccactaaggttctggtgacttagcatgcagcaatagataactggagcaagcacctactatgtgccaggcattgtgcaatctgctttaacaacagttgaagcagactttgtccctgaccttaaggagaccatagcttagtggggacataaaaaagtaaccaatcacaagcctgcactgtatgaacaggtgacagaggggcatgcaagatactttgggaacaaaccaggcttcgggaatgtaacaaggcctgaggacatcagggaagcatcctcagaggagaagattgtttaattgagtcttcagaaggagtcagtgtcaattagatgaaggaaaacagagcttttcattcattctaaggaattttgggaaaataatgtagcaaaaatagatagaaaaaactatgagaaagcctgctcacttaaaaacatattataaaacctcaataatcaatacattaataattaaaacctcgataattgattggcttattgacagaccatttgactaatgaaacatcaaaaagtgcagaaatagatctaaatgttacagagatttagcgtgtgtgtgtgtgtgtgtgtgtgtgtgtgtgtgtgtgtgtgtgtgtgtaatggggcattccaaagagggacttttccagaaatgcattgtactgcatgctatatacaccaagataatatccaaatgggtcaagattttaaatgcaaaaagaaatcccaatccactgaaattttagaagaaaatacagaaaaatagaattttagaaagaaaataattttgtataactttggaagtatctaaagtcttttttaaatcaaaatccagaaatattaagggaaagattgataaatttgactacatgataaaaaaaaattgtgtaatgccaaaagaaaaagagagggaaagagaagccttaagctaagtctaaaaacaaagacttctatgaaggttgaagataggtacaatgtcaacctgaaaaactgcagcttctccttagcaatcctaagatatctatagcttcttgaacctcttacagagggcctgaaacagagtagatgtttaataagatatattgcatgatcctgttacagaaactctcactaagatggaagttctggtttaatcttgactcagttatgtgacctggaacataaatgggtatgtgcacacacatgtgttccatgcactggggggaagtagagcaggtgattgcttccctactgccctaccacctcattcctggaaaaaacacatcaccactttcaaggtaatacattgacgcagtgatcaagactgccaggcaaggccacagaggcagcattaaagcaagcccaagaatcaggcattgttctatggatctcactgttcccctaacctgaggctcacttcttcaaaagtcaggatctggctgcatcttgctgaacctcaattttcccatcagtacagtaaaatgggcacaatgaccatggcttcagaaaccagttgagcatttaaatgagaataatgtatataagagaccgagcactggtggaggatatagcacaaacttcgttcttagtctctgtggccaccagagtcattatggtcatggtcagtttgctggagattcttttttttttttttttttttttgacatggagtctcactctgttgcccaggctggagtgcagtggcacgatctcagctcactgcaagctctgcctcctgggttcacgccattctcctgcctcagcctcccgagtagctgggactacaggcacccacaaccacacccagctaatttttttttttttttgagacgggtttcaccgtgttagccaggatgttctcgatctcctgacctcgtgatcctcccgcctcagcctcccaaagtgctgggattacaggcatgagccaccgcacccagctttgctggagattctattacgataaatatgtaggccaggcgccgactggataaataggcaacctccacttgtgcttctctgtctggaggagtttcttgcctttaaggtacattgcatagatgaacagaacacattaccaaagatgcacaggaacaaaatgaaagcatcaagaacaccctgacctgctactcaggatactgggccataggccccactctcatgatttcaggctgagagataaggagctgttaaagctggggttttgtttctcattcctccctaaacacagtgaagcttgggaggcattaaatggatcaagcatttttcagaacaaggtagagaaaaaaagacgtggaggtatgtcatgcttagaaaacacaaggctagcccctctgaaggtgctgaccgactccctggagtttactatttgtgtagaccttacaaagctcaagtttggggtgtctgcctgtcagtttctgcttcctggtttccatcatgaggcctctgaggactccacctaaccatgttatccagtccctgccactttaaatcaaggatctgaaaggcagcctctccatttagctgacaggagaggcagctttcaagagtcttctgtatcctttgtcagtgaaagtcacatgggggaataacccaaacttttcttccctttccagtgtagtgaaatggtaagtttcaagcatatgaaaaactcagccattggaacatcatggggtcgattaagccagtaatgactcaaaccaaagagctggggaatcttccgactaagtaatagggtagtgaatgcacagaaaggcagaggcaaaaaccgaattgtagcatctagttcatgagcctttgcatgactttggtctcaacaccggcacagtaatcatcatggaatctcagaatcactggaggagcaggatcccccaaaacccatctctgtgatcgctattggatgccaaaatcctccgcacatcttcatctagtggtcacccagcctctgatagcctccaggcttgaaactctactctgaaatattaagaagggaagctgtgttcaccactcagacacccactcctatttcacctccctgaagaaaccttccctgtctgccctctcagtcactctctaataccttgtctgactttgccttcttaatagatgtgttaggtgctgacccaggcatggaggttctgactgtgatgtcatgtagcttacttattgccatttagactgagctggcgagctcatttatctaatctgttaaaaccagatttggtggaaagtgaggacctcaatatttccacatttgctgacaaccttaaactctcatcgaagagtgggaagttgttgcttggaatcacattaagattaataatgacaatagagataatgacaactgcaaatatagcaactctcccactcacaatggcagtcccgattgcacaaagaatccagtaccaggaagggacacattttaagctatcttggaactgtttcctaatctgtgggataaagatagatcaaacaccactttgcattttttaaaccttgaataaataggtaaatagcccctttgttaagtaggagaaaatattgggaggagacgagtttaggcttctcaatatgtttccatctcattggccagcaggtctatggttcagagagaggttgaagctggagacagggatttcagaattatctgtagagtctcttggttgaggccttgggaattaatgaaattgcagtaccagagagtaccggaggagaagggaagtggggagctgtcctagagaacaagctagaatagaaacagtcaagacagccaaagcaggagtatccggagaccaacgtgaagggaaagaagtgagagacatgtggaagaggtggcaactcctgccaaaggggattaagaacaaggagttctaagaactttctgcagggctgttggttggagacgctgcctccatgcaaatctcatttgccgctgtcaatccagatcctgtcccaccacgaccatttctgagaaacagactcaagacatgaaaaaaaaccctctttctgtaaaattggttcgtgaaacagactacaggcattaatatcctttatgagtgacaatttagggccaatatttacactttgtaatgttcgttctctttctctcgggacagaaaagaatgttgccaatatcaatgaataaacattaataaaatcaaatataatcttgttccatctggaatcaacctttaaaaaaattcttaacatctgtatataatatacatacacctctatgtacaatagggaaatcagattttgcctgagagatgtgcacagtatttaatgccaatttatttggttccaccttttctccagactgctttagaagggtagcgtccctagaattgagattctgaattagtttcctctgactctcaggtacagaatgtccagctcaagccaagacatatcaaatatttatccactcccagattttcaaaaatccagctttctgtctcctcctgcagctgacctcctctggcagaaattcagcctcaaactgggagaaatgagtggatcaccagaatcaaagctgacgtcagtggtactgtgggttggtgtatgacgtgggaaccctgacaaacagaaatgaatgtttataaatgttagatctcaggtctgcaaggaaagatcttgctgtacttcacaaatggacttgctttttaatatgtctcctgtttcaggacaagtaatgttggtcagaactctgggggtgaacctaggggctcgtaccacttggggctgcgttgtcactcctgtcctcagcatcgcagaggccaaactgtacccagatgagaccccagggaaagagaaaagaatcttgggcacgggggtcattattcaaagaacctggtgtagtgcgtgggagatactgcatgcacctctaactcagacatatcattaattcacaccatccctcttgtgcctactaaaccaggatttctcagcctcaccaccattgacattttgggccagaaaattcttttcttgtggaactgctcagtgcactgtaggatgtttagaagcatccctggcctctacccagaagatgccagtagtactgtcccggttgtgacaagcagaaatgggtccagatacggtcaaatgtcctctggtgagagggtagcaaaatggcccctggttaagaactactgcagtgaattattcaagggaccatgagtgaagttttgaataatccacacctgagctaagtggtgccagagagatacttgcaggacctcagctttgttagtctgacatctctcctataagcccaccgactggagaccccaagcatgctgcagcccctacctaacagatcttcatttattccattacaggctgtgggcagcatttcttcatttcagatagaatcttccagagtttaggaacagagcaggctgccttctctcctcttgccaggaatttcagtgcgacattgaacatgtcactggagtttgcttgttgcaaggacaaacacttctcctggcacctcacccccacacctgcctagagacaaggctgcccaggctgtttaaagggaaatcagtactgtgccaggcctgtccaagtgaattttttctttgagcaaatacccctgcctacttgttcatttttaaaaccataggtcttcctggtgagggggcttcaaataaactacaacaaagagtaaagtctttatcccttagtaggaagagaagaagagcctccaacaataatttattcattcatccactggtaataaaggcagggctgtgatcacaagagaggagatacagacttcttggtctcaggggatttgcaaggcccagagtgtccagtggtatagatctatcaaggagaagcttccttggtaaacttagtgcctactgatccaggaaggaatatgtgctgctcacttcatccctctgtctccatgtcccacctggtaaaaatcagtcctgacaataccaaaactttgccaattctacttctgaaatatctcctggctcagatccctccatctttgcagttcctaacgtattaatagttcaggtatcatcttcgtttgttcctctgaactaatgtaattgctttctcatgcctttccttcccacttccatacggaataccacggcggtctttgtaaaacccaacagaatgagaaaacgctcatatccctcctcaccaaataccataaacaatgtttgaaaataaaaacaaaattgtcacgtggaagaaacaaaaacacttgcaatgtttgtaacagaaaacctaatatctatatttctgactctctcctggcttccacatatgtgaagaactctcacaaatcagtaagaaaatgccaaaaataggcaaaggccatgattaagcaaataccaaaaatgaatttttaaaacgaaaaatacaaatatgagaaatgtgcaaccttacttctaattgagggccacaaattaaacaagtatattttaacctcttagattagcaaaaatgtaagaggttggcaacagcaggtgttgacaaaaattcacaaaaatgggagctctcataatggttggaagtgtaaattggtgtataatttatcaaaggcaattttcctacattgtgtttgttttctactgctacataacaaataactataaatttagtggcttaaaacaacacacattcattttctcacagttttagtgggtcaggagtccaggcagaacttaactgggttctccgctcaaggtcccacaaagctgcaatggaggtgtcagccagggcttagatctcatcttaggctgagtcttcttccaagcgcacataattattggcaaaattcatttccttgcagctgcagactttttgaggcttgcttcttccaggctagcaggaaagagggtctctgacttccagactcttttaaaatgtctcagttgattaggtcaggaccactcaaaattaactctgttgattaaagtcatctgattagaaaccttagttttatcccaaaatcccctcacttttaccatatattgaaacatattcacaggattgacacccattgcctttgccatattctatggcgatatggtttggatctgtgtccccgcccaaatctcatgtttacttgtaatcccaatgttggaagcagacccagtgggaggtgactggatcatggaggcagagttctcatgaatggtttaacatcatcttcccttggtactgcatagtgagtgagttctcacaagacctgattgtttagaagtgtctagcacctcctccaacctctctttctcctgctctggccatgtaagatttgcatgcttccccttaattccgccataattttaagtttcctgagatctcctcagaagccagactgatgctgccatgcttcctgtacagcctgtggaacagtgaggcaatcgaacctcttttctttataaattacccagtctcaggtatttctttatagcagggtgagaacagagtaatgcatatgggttagaagcaagtcacaagttccacccatgcccaaagggaggggattaaagaaagacacagatcatcagagatcatcttataattctgccaacagcatatatagaccaaaacttaaaatgtttacaatctttgccatagtaatctcacttgtaggactatatcccaaagaattaagtggactagaacatatatatgcccacagaagccttttcatcattctgctatttgaaatcatgaatatatatactatagtagcaaccccaatatccataaaaatgagttcaaataatttatgatatatgcacatggcctatcgtatagctgttaaaaaaaaacacaagtgatcaaaaggtatttaagtaaaaagagtgctatgatgtattaagaggaaatagcaagtttaagtccatctacacttatatttatatataactgtgaaaatgaacctaaaattgtaaaataacatacagctattagcagacagtatcttcaggtatgggaatagatggcaatctttattttctgtgtagtttttatggtgtgaaactttttgaaatagctgtgtattccttttataacaagacacaacaaaagagctgttttttaaatgcgagagtattggtttgtaaaatgagtagtgtacaaaatagtatactcaagggcatcttatgttttgtaaaatatagatgagaagaagaaaacttgttagggaagacacaaaattttaatagaggctagatagacgttggtattatgggatgtcttgaggttctattttagctgttttctgcatttttccaatacaacatgtacattattttcatagtttttcaaaccaattcctgctatcttttttttaagtgtagaaaaggaaccatacatagggaaaaaaaaaatagccaaatgcagtctcacttccctggtctccaggcagagatggcctccaacatctgagcactcactgaccacagcttcctcccatggcttaacagtgccttctattgtggctgcctcgcccatcaggctgtaagggtactgatggcagcacccctcgttcacctctgcacctccagtgcctgtcacagggcctgccacagagtacttcacggcggctaaataaacgaatgaagaagatactggcaggctagaaccttgtaagcaaatcaaagtgttccaacaatcatcttatttgcaatggtgaaggatggagttgagggagcaaactggaggcagggagacaagatgccctggtttattaggagtaagatattgaggacctggtggcaagggagcagcagtgcagatgcaccggaagtggaaaggacagaattcagggaataatgggagtaagtgtccacagcagccaagcattgagggtaatgcccatactctggcttggacaactgggtggtgacatttgcctgaatatggagcaaaagcttttgagagagaaaacatgacaacttcaggtttgaacacacagggtttgatgagcagagacatctgggaggtgccacaaggagctccttatgtcatcctcccagctgtcaccacacacagggttgattctgcaaaccaccggagcttaattgatgcatgtcttctgagtaaaattcatctatccctcctcagggatgaaatgccccctgccttaggattctgtgacttcctcaagcccagagagatggggtgcaatgggagggttgagttacagtgtcaggcactgcataggctaaggagctccagggtctgctactctgctatctgggaagatgctcatttgcattggttccctctgcagtgggatgattttgtccttcatttgccttccctggatgatgcaggctgcctgcatccccactctgaaaactctttacacagaactggccgcacatttcataaagccatgagtgatgtcaaagagcatgtacaatggggagaagactgactctgggcattaattttacatttgtaatcaggggatcttaatcaaatgccaccaagctaccattgcaagacagccttccacaaacaccaccccttgcacagctcaggttctgcctggcactcaaattatctgcaaaatggtccctaccaccgtgcccacttatgccccaggcctctccatggagccacatccagtttcctaagcttactacatcactctttgtgttgtcctctcagccttgattgcccttccagatgtaacctaactagttcagccctctgcagccttcaaaacctagctcagtcatcatctgtcctgggggatctttcatttttattttttaaaattttacttattttggtttttgttgttgttgttatttttttgttttgttttgttttgagatggagtctcactctgtcacccccactggagttcagtggcactatctcaactcactgtaacctctgcctctcaggttcatgcaattccctttcctcagcctcctgaatagctgggactacaggtgtgcgccataaagtctggctaatttttgtatttttagtagagacggggtttcaccgcgttggcgaagctggtcttgaactcctgacttcaagtgatctgcctgcattggcctcccaaagtgctgggattacaggtgtgagctaccacacctggctgggattttttattattattattttttacatttttaattttatagatttaaaggtacaattgtagttgtgttaaatggatatattgtacagtagtgaagttggcttttagcgtccatatcaccggatagtgtacattgcgccgataggtagtatttcatctctgaccctgctcccaccctcctaccttttagggtttccaatgtctcttattccactctgtacgcctgtgtgaacccgttatttagctaccagttataagtgagagcatttttgactttatgtgcctgagtcatttcatttaaaacaattgcctccagttccaaccatgttgttgcaaaatacatacttttattcttttatggccgaatagagttccatggtatatatgcaacacattttctttatccagtcctctgttaacggacactaaggttggtttcatgattttgctattgtgaataataccacaaggaatatgtgagtacacctcctggcaatcttcaacccctttctaacagggtgggtttggatccctctgtcctgagtcaatgtcaaggcactgcattgaacctttctgtttatgattctgcatctctcacactactctgagttcgtaggttgctgtgccttgtctcagtaccatgctcagctccatccccacatctaccatgttatgtactagtgagtggtagctcccgcctgatagaatgagctactctccatagtggaaaattctttcccattgattccaaacagtgcaaaagaccccctttcagaatgaaatttgagggtcacctttggctcttctctgctgcatctccaacatacaatctgccttctacctgcaccatcacccctttcattttcccattatattattccagtggatgcaagtgattgcaaattaccatctcacccgtcacaaaagcattatctacaaatcgctttgtaggccatcaagcatcagcacatgtcacgattatctgggtgctcataaaatccttgtgagatttgaaggccagaaaccatcttccacattttacacacaagaaacatgaggctcagtaaattaatctagtcagatacaaagtttagactgcaaatcaagacttgtaattctcagacttggtctttttacatgttacctccattaaatagtctactataagagttcgttagggatggtttactctacaagaaaaggatccttttgtttttctccagtgcctagtttgggacgcagcacaacaaatcaataaatcaataaatcattactaaattaatgaatacatctcaataaatcattactaaattaatgaataaataaatgtccctttgcatcatgaccttagttttctcatctgtaaacgagcatgtttaggtgtgctggttcccaagaacatctctggcactcttttgtctctagctatcaatttctggctagcagactgactgtcaggcggaggtctgtgccgggcaggatgcaggcatggtgaacaccaggtgccctgggtgtgaataacaagcaacaaaaactgaactgagaccatttatgaaaataataatgaaaccacacattccttgataccagaaataatacagggctccatgccttgttaccggctctgcttctcaatgtctttgccatcccaatgtcgttcattcccactttgcctgaagtccatttttggtacagaaatgtaatttagtgggtggcttttcccacaactctgggccactaacacattcattttcttctctgcttttaaagtttatgttcctttgtgcacaacaggcagcacatcaccactttcctgcaaagtcacaggcaacagagaaactcctaaaagctcctgcaagtcttgggagagactggagcatttccattaagaccctcatgctactagattgttcttaggaacccctcagaagattcagcaacatgcaaagtgacttgtagaatgggataataatcataagggtaataaacgcctatttgatagtgcttactttctgccggacactggtcaaacggctttctatatatcctttcatttaactctcctgacaactctgtgagggaaatgctgtcaatatctctatgtttcagaggggagatctgaggcatagtgacattaggacactctacaggtcacattattaggaatgggcaaagccaagcttggaacccaggcagcatgattccagagcaaatactcttaccactatgttctttttttctcctatagctacatatgctcctctttcatgaagccttcctggccaccccacaaacaatgctaaatactagatggtgacagaacaaggagcaggggcttcacagtcagttagaactgatttccacccctggctgtgccaaattacttatatgattgtgggcaaattgaataacctctttaaatcttaacttcctcatttgtaaaatggaaatgataaacatttcacagtaccttggcaaacacttaagacttaagagtcagtaaatgtcctgcatgctctgaaatgggaagtcccaaggcagaacagaggggtgctctgttcccttcactcctcattcatttattcatttattcacttacccaacaattctttaatgagcaccaaccacataccgtgcattgcctggggtcctgggaaggttcctgttctcacggagcttacagtctagtgatgagtgacagaagttaaaaggcaaatacaccaatggcacacacaatttcagagacaatcagcgcaagaagacaataaacaggagatacgagtgatgtagtaatggtatgctggggaggagggtgtgagggagagaactgctttagactggcctgggagatatttgagccgagactaaaatgagcaaatgagcagcatcagccagccaagtgaagatccagggggctaggggtggggtggagaggggacaaacgatttagacaaaggaaatgacaagtgcaaaacgcaaacaggcaaaaaacttagagggttctaggaaaccaaataaggccagtacggctggagcatagtgcatggccaggagaatagaaggagatgagctttgagaggctggtgcgactagatcttgctgggccttgtgggccatataaacaaggagttcggatttcattgtaagtgcaataggaagctcttagggcattttaagtagggaactggcatgatgtgatttatgttttcagaagctcaatctcgataagaagtgaagaatggataaaaggagtggaatacatttagaagtggaacctggagattgtgataaatgttagacctcaaagcttcactccatagacggacaagaatgacatttcttctttatccccgtagatgtgtttcccaagacatccaggagaggatattggcgcaaacagtgagtcatcactctccacccaccttccagactccctcctccatgcatatccagctcttctcaacctggggctcccttagaaaatccagacaaaacaattgccacagagccaacatcttccttttccctttgtcttatggtaaaaacatatttgtagaagcaaatccaataataaaagattagcacataaatacactgaaaagtaagatcactgacaaatacaccaagtgtcggcaaacagttctcagtgtcttggcacatgcggagcccatgttgcaggtggcatcaggcagacatggggcctaatcagaactcccactgaagctggacggccttgagtcagcaatgttctagttaatatctctcctccatttgtccccccgctctgcatttcctggttttttcaacagagtcatctggggaaaacccacacattttatgatattttgtcttccccttcctctctgttaaaataaatgcctgtcacatttgatactcatctgaattactgatgttgggcatgagatggtggggccatgcgatccctctggagacaggaatctggtttatttggatccccaggagctcatgaatactgtgagttaggcttttggctcttaaagaagagagtccataatatcccagaacaatgcctcagtagcagatttagttctcttttttttttctcctgattgtgttcctttttacctagcactaatgtgggtggctatggtgagagaagaacatgctaggaagaggttctctcattttcatattcttctcatgcacacatccactagggagctaggtggagatgcttgcaccccaagagctctgggcccagccactcattggaatcaataagccttcctaagggtttagagttgggggaactgaggcccagtgatgttctatatctctcttctataccccgaagacattgagttccataattgtaccatactttgcctggcatggcctgcactggcatggctcatgaaacatgataggggcctgcccagttgacccaggccccccttgaggcttggtgtgtgctgagagggtgactcctgtttcaggcattgacaagaaacccagtccaggggtttgtgttgctgacagcaggcaagctatcagcaggggtgtctgatataggctgtgagactccaaggtcaaaggaggaaaagcatctcagagtctctgtcggttggagagggcagagatgaaagtagaactcatggagtgaggcgtgacccaagcactacagggagaggcacatgcaaggcacaggcctctatgaatgcctgaggagtccattcagaatccagttagacctgccccggagcaggtgaaggtgggtcacgtggtcagagctggacccatggctgaatccattcagccactttctgctcaggccaggactgaccccaggacacagcctgcagtaggggagctcactgcccttgcttaggggcaggcaaagagattcaaaagccaaggggggcctggtaacactgacatcccaggctcagttctgctcatcagtccctgagtgagaaaagctgcaggtcttcaggcccttgtcactccctgctggtgttaatttactcacttcttagacgtctccgcagaaaggtcaagggctagatgagtaatcatggctgagctaatgcctcagcctcagccatcgattctcgacctcaattttcacaaatgtctcactatcttatccaaatatgcttcataccttggaggaaagggtgttcctggtgaagtttgcaaatgattgatttaagtggttgtggctttcagaaactggcataaaaaagaatgtgagcaaagaccgatctgcacaggaaccaaccattggatgctgctgtggggaggaatgtggataccaggaaacgggctctctccccctcctacaggagcccagagcctcctacctcagtccaccgattagagggtcacaggtttcaggatgcatcagaattacctggagaatgtgtcaacatgcaggttccagggccctggccctagagtcagattctatagatgtggcgcaagacccagaaatgtcatgtggccacgatccttcatgagcctgatggaggcatggtctcagagccttgctgctcaaagtgtggttggtggactgcaggcagtagaacagaaatgaagaatttcaggctacaggatcagaatctgcctttaacagaatcgccagtgattcttgtgcacgatgttgagaaatgctggcttagaccacattgtgagccccgttggctcttctctgggcccagatttttctctggctgtgttttgtgactccacttcactcacctctaattccctgagggaccccttccaccccaagataaatagaactgaccttctgggccacacactcttgcagggagacatgtacacacacacaggcacctaccaaggctgatgtggtagggccagcccagcagatctgggacctcagcaaagccaatctgagggcaagagaatgagaacagaaaaagtatgggggctacagccttgccaactgctcacagatttcagcaaagaaaacagcaataattaattctgccaatactttttgagcacctgctatgtgccaggccctgggggaatgacagccgccattcatataataccttttggttgataaaacatgttcactccattctgtcagtgaactgcacatacgacagagaaatgagcctgtgatatagaaagcatgatccccattttacagatgatgaaactgaggctccaagaaactgagttacttgtccaagatttaaaaatagcttttgagctgggatccccacttttttggctttcttccctcacactcaatgtgattaatttatttgctctacatggtcatttgagcattacccccgacatttttttctgccttttctgccatgatgactgtccagcatggagaagcattgtgtccagttgccactgaatttccattagatggggccactcatcctgaactacaagtggcactgagtatgcccatgctcacagcagctattcatcatagctaaattttcatcacagctaaaatgtggaagcaacccaagtgctcatggatgaatgaatgaataattaaaatgtggcacatacatagaataaaatattatttagccttaaaaaggaaggaaattcttacacatgctactacatagattagccttaagctaattgaaataagtcaatcgcaaaaagagaaatattatataattctacttacatgagacacttaagagtagtcaaaatcatagagacaggaagtagaatggtggctaccagggggtgggagaagagggaaatgaagagttcgtatttaatggacacagagtctccattttgcaagaaaaagagttttggagatggatggtgtgaaggttgcacattatcaatgtatttaacgctactcaactctacatttaaaaatgattaagatggtatattttatgttacctgtattttaccacaatttaaaaaaatgggaggtggaggaagagattctaagcagcttcctgtgtaaaggccagatcttggaactggaagttaggactgagccaccaatcatgaacggaatgaccactgggactgcacagaaatatattaatatgtcagccaaacccaagattcagaggctgagcagggatacgcaagacattgctttgaagtgttgattccttatcactcatcagtgaaaattcttaaacttggagcaacaatgaaatgcttcctgaacacaagaaaataaaacaacaaaataaagaacaaaacaagccctgaacatgcctgaaccaagaaagccaggatgtgagggtgatgagcatgagggtgtgggcatgggcggattgcatggggctgggagtgcacagcgggggagcctgaatgagcaggcagagggacctgtgggcgcttgcttttgcttccgggtcttcttcattatcatgggcccggggaatctgagagggtctcacagtgcccacagccttacccttatcccaggtgcaactgctgatcctccctgaaacaccagctcataagggcatcctcatgtggaccagaagcaatgacactggccgtgtgtcacagcttacagagcatcttcatgtgccacccaatcatctatgccctggtgggagtactatctccactcattttacagatgatgaaactgagactcagaccagtaaagctgtctgtccaaggaataaccagagggtagacttgcatccagactccaggctccaaggcccaaactctgcatctggcacctcatggtctcatgtctccggaataagtactcaatagccacagctgaggtgcctcatgcatcatgggcagccacagcccctgccccagtccccttgtctgatgaacacacatcatgatgccactctataaagaggaccgttgccagaaaggattaattcattaatgaatatgaggtctctggaaacccagaacgtgatgtaaatacccgtgctgtcaaagctgcctctctgttgcagaatgaaaagcaccaaaatccctccattgtccttggataatagctttgatttggggcagggcaggaggaaggagactctgtctgggggataaacaatgctgggatgttccaacatagcaggatttgcacacaggatccagcagagatggcgtgcttttctcaatattgtctgggatatcaaatgggaagactggaacagccaggggagatttggatgcctgagatctggagctgctggagctgaaggaattgatttccaactagatttctcacacgcctcgtgcttgggctggatggctgaaggtcagcccagctggcactgtcacctggagcacggacttagggtcttgccatggggtccaggcttctcaccgcatacagagtgagttctgaaggagaagatcttcaagggaacaagtgtcctaagagaccaccctcaaatgccatgtggttccaacttttctcaaggggaaggtacagttttagccagcccagacccaagggaagggatcagagacattcttgatgggaagagtgtcaaagatttgggggccatgttttaaagccatcacagggaaggacgtcagggtttggtataggattgagtttgaataccctagtcccagacacccaccccgtctctatgaggaagataatacagaacactccaacacttttttttcttttcatttttgagacagagtctccttctgtcacccaggttggagtgaagtggcgtgatcttggctcactgcaacctccacctcctgggttcaagtgattctcctgcctcagcctcctaagtagctggtactacagacacacatgaccatgccgggctaatttttgtatttttagaggagacaggatttcactatgtgggccaggctggtctcgaactcctgaccgcaaacgatccgcccgcctcagcctcccaaagtgctgggattgcagacttgagccaccgcacccagcccccaacactttgaattaaaccattttcatccttgaggcataagttttagggtccttaaggaacctaggtccttgcctttatttattgatgacaaaactgaagccacgagaggacacttgttatggccaatgtcacatgtctgctaagtgtcacagccagtgttcaaaaggaggctgctgactccaaatccaacactgactctttgctcccaggtctggctgctatagcagctgggctgcctcgttctttctaccaagatatggaatccatctttagagctgagtaaccagctgcaaaccagagccttccagcttctcttcctctaggagaagggcaaggaacagggcggcccagggatgtgtgctgtctagggaggctgtaggctggcagacaaataagagcagatcagctgacccccactccccccagggcgggtctatgatgggcaattggataaacacattcagaacaggatgaatgtgcagccgagcgtgagcacattttaaaatatacatttcacctccatatgcagatcccagtgacatgtgacaaatgtgctgtggcctccaggagctgttctccaaggaggcacttatttcatttgactccaagcatccaacctcaacagatggcagaattcagatgggtggcgggaagcaggcttcaattactgcaggaagactcaagttagacaatgggaagaactttccttctctggaacaccagcttttttcagcgactattttgcaatgtgatacacagactcaacatagacactttcacgtgaataaaagtgctctctgtagaaatggggggaaaaaaacctggttgatagaaacttagacttttagctcagactcccagattttctgcaatacactcattccacaaagggtgtcacccttgtgagcacttttggcttaaatgaaggctcagtgtctctttttggagagcagacaacatgttaaggacataaatatgtagatctgcgggtttacttgttttgttttttttttttgtttttttttttgagatggggtctcactatgttgaccagtctggtctcgaacttctggcctcaagcaatcctcccatcttggcctcccaaagggctgggattacaggcgtgagccaccatgcctgacctgaaatatgtagatttgaacttgaaaacctgagaactgaagccctgtaaccttttccaaactaatctgtgagacaggaaggggtttagaattatataaataagtcacctgcttgtgtgtcaggcacattttttctttttctgttgttgttgtgggggataacaccctttgtgagataaaactcacaaccatacaattatacaattcatccatttaaagtgtataatgcagtgaattatcgtatattcacatagttatgcagccatcattgtaagtcaattttagaaaatgttcattaccccaaaaagaaattccatacccttcacttccacacaaactctttgcctaggcaaccactaatcttctttccgtgtctatagacttacctattctgaacattgcaatacactagtctttcgtgtctgacttctttcccttatcatgttatttcaaggtttgtctatgttgcagcatgtatgccttcattcctttttattgtggaaaaagtgttcactgtatggatatgctatatttaatttatccgatcatcagctgatgggcatgtgggcggtttctattttggggtgatcatgaatactactgctatgagcattcatgtacaaggtttcctgtggatgtatgtcttcatttatcttggatatggacttagcagtggaattgctgagcatggaactgtacatttaacttcttgaggaactcccaaactgcttttcaaagaggctgaccatgttacactcacaacaacagtgtatgaggatccaattttttcacattctctccaacacttgttattatctgtctttttcatggtggccatcctactgggtggggaggtgcttcttttatgttatctcatttcatcttcagaacgctgccataagggcaggcactaccatcccaatgtacagatcacaatagtgaggctccaagaggttgagcctgtcaaggttgcaaagctggtaaagaggcataaagatgtgttgtcaggtttgcctgacacctctcccacttccctgtatcccagtccactctcaggcccgtcacgccacctgcatagccctctccatgtgtttatctttgtgttccacgtgtgactcattgctgagatggtcaggaatgacagcgactgaactttctatccaaactcaccttccttccctgagccttgagatggaaccatcccctcctggctgtgggcattccttctgtcaagggtgagagccagcccagactgccatgaaataaaccaacatgcttctcttccccaacccctccatcagtgcccagatccagccccactaggctccacctggctccatagctatttcacccacctcttggagcacatgaggctcttgcctggtccatcaatggcttcagggatctcccacatcagacttccaggaaatctccctttggttcaaaaaatcgtaatgaacaggaccctaaacaacctagcacctcctaagacccatgctgacatgggcccttggtcgtgagttgcatcattcagcctcctgctgaatgaggtcagcacctgctggacccacccatctcctgactcttccccttccccaccacacaggaagacaactgatgcagggagcatcagtgtcaggtgtgttgtatttatgtgacgcacacagttccctactctcccaccattgttcttcgatatatgacaaaactcccaatttgtcaaatgcttaacagcagtcaggaaaatgtattctccacacatccaccgagcttttcattttgcacaactgtcagcaagaacagtttacaaattttctgtcatggagattctgaaagaatggggaagaggggagaaacaccccccaccccaaccccttctgtgagtcacagcctcaacttgacagaagcccaggcagcagctgagactcccctgttacattacacgtcatcactctttgcatttaagcccattttccatgcagccatttctgaatgcatttctgtttccatcaaatccctccccatggtgtaaaagtaaatattagacagtgccctcctcctaaaagaccttgtatttcaagctcaaaaaagtctcctagagggactcagtagtagacagctgtctgctccacagatgccagccagcttccctggctgacatgcaacagattatcatgcaaacccagaagcctcaagcttttaagacattatatattgaaaatatacactgaatcatctttaacagaaaaaaaaaaactaaaaccaaccaaaatttccaaagagagacaatcgattaaataaattatgataacccccaaaatggaccatggtccaccatggaaagagtgtttctgtggtgtgggaatgtggttaggatatgttaactaaagcaagtttcaaaactgtatttacagtatgattcccatttagtaaatgtatgtatgtatatttatgcatagggggaaaaaagaccagatggatagacaccctaaatgttaacactcaagagattatctgctttttaaaaagatttttattttcatgtattttccacattttcttccatgaagcaaaaactttttttgaaaaagttgtttctgctcaacagtctattcatggaccattccaaaaactttaaacttggcagactgcggccagttgtacagtaaacataatttacagcccaatggctttctggcagtgagcactttttcattcacaccaggtgatgccatactgaacagcagctgtccatatgattttaatcacagtaacttttgaaaccacaacttgcagtgccccttattttgttccattaaaaagctgtcttttgaagctaatgagcaaattctctgagaactggaacctagcaaatgctgaatcactgggcgaatagcccgttaaatccatactagttatgcagctctttgaagacacacacagcttaggtaacttgaaacttccctctgagaatatataagatctctggttatcatatgtaaatgtaagtcaatgcctaacaagaaatgattatttgcaaataccttggctatgatctaagttgcagatctaatttgaggagtagcagagtgatcactttagcacagacctggaggctaagattaccctttacagggaaatcctgaatagggttgagacttcccaagagacagattctatgagctactcacaattacaactgtctaagctgaaagaaaatttcaacactaaatcccttagtctttccttttcctttctattcagtctcttctgttttatctcctttcctacccaccttgaatatttcttgagctatctctttaataatacttttagaatgtgctttcaaaacgtttgctttcagtccttcacaaccacttgaaggggaaaagaaggaaaaggacaaaaaaatatacatcccttgtgtatgagtttgctagagctgctataacaaagtaccatagactgggtggggggtgggggcttaacaataggaatttatcatcctattgttctagaaactgaaagtccaagatcaaggtgtcagcagggtggattcctttgaagggctgtgaaagaatctgttccatgcctctctcctagcttctggtggtttgctggcaatctctggtgtttcttggcttgcagaagcatcaccctgatctctgcattcaatttcacatagcattctccccaagtgcatggctctgtctaaacttcccctttttgtaaggacacctgtcacaatggatttgaacacccccaacacacacacctaatgaccttatcttaatttaactgcatgcacaatgaccgtatttccaaataaggtcatattctgagatcagagggttaggacttcaacatataattcaggtccatagtaccttgtaccaatccaaccacaactttctttgaacctatgccccaatcagggtcctgagcactgctggagaaaactgtacaatctccaagtgatagcgtgggttccagtgtcagccgagctaacactcctttgtcaccacccccttctattccccactgcagcttttttcaactttcaccatgctcctctattccctcaacttcaggaaatgatcttacctcctacttcacagaagcaaacagaggccatcccaaaagaatgttctgaccaccctgcaatgaattatttccctttacttgctgtgttagttcattttcatgctgctgataaggacatacctgagactgggcaatttacaaaagaaagaggtttaatgcacttacagttccacatggctggggaggcctcacaatcatggcagaaggcaaggaagagcaagtcacatcttacgtggataggtggtctcaggcaaagagagagcttgtatagaggaactctcggttttttttgttgttttcttttttttttttctattttttttttaattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacacgaactcatcattttttatggctgcatagtattccatggtgtatatgtgccacaatttcttaatccagtctatcattgttggacatttcggttggttccaagtctttgctattgtgaataatgctgcaataaacatatgtgtgcatgtgtctttatagcagcatgatttatagtcatttgggtatatacccagtaatgggatggctgggtcaaatggtatttctagttctacatccctgaggaatcgccacagtgacttctacaatggttgaactggattacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaatgagatcccatttgtgaattttggcttttgttgccattgcttttggtgttttggacatgaagtccttgcccatgcctatgtcctgaatggtaatgcctaggttttctcctagggtttttatggttttaggtctaacgtttaaatctttaatccatcttgaattgatttttgtataaggcataaggaagggatccagtttcagctttctacatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttgggttaggattgacttggcgatgcgggctcttttttggttccatatgaactttaaagtagttttttccaattctgtgaagaaaggcattggtagcttgatggggatggcattgaaactgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagaatttgctgaagttgcttaacagcttaaggagattttgggctgagacaatggggttttctagatatacaatcatgtcatctgcaaacagggacaatttgacttcctcttttcctaattgaataccctttatttccttctcctgcctcattgccctggccagaacttccaacactatgttgaataggagtggtgagagagggcatccctgtcttgtgccagttttccaagggaatgcttccagtttttgcccattcagtatgatattggctgtgggtttgtcatagatagctcttattattttgaaatacctcccatcaatacctaatttattgagagtttttagcatgaagggttgttgaattttgtcaaaggctttttccgcatctattgagataatcatgtggtttttgtctttggctctgtttatatgctggattacatttattgatttgcgtatattgaaccagccttgcatcccagggatgaagcctacttgatcatggtggataagctttttgatgtgctgctggattcggtttgccagtattttattgaggatttttgcctcaatgttcatcaaggatattggtctaaaattctcttttttggttgtgtctctgcccggctttggtatcagaatgatgctggcctcataaaatgagttagggaggattccctctttttctgttgattggaatagcttcagaaggaatggtaccagttcctccttgtacctctggtagaattcagctgtgaatccatctggtcctggactctttttggttggtaaactattgattattgccacaatttcagatcctgttattggtctattcagagattcaacttcttcctggtttagtcttgggagggtgtatgtgttgaggagtttatccatttcttctagattttctagtttatttgcgtagaggtgtttgtagtactctctgatagtagtttgtatttctgtgggattggtggtgatatcccctttatcattttttattgcatctatttgattcttctctctttttttctttattagtcttgatagtggtctatcaattttgttgatcctttcaaaaaaccagctcctggattcattgattttttgaagggttttttgtatctctatttccttcagttctgctctgattttagttatttcttgccttctgctagcttttgaatgtgtttgctcttgcttttcttgttcttttaattgtgatgttagggtgtcaattttggatctttcctgctttctcttgtgggcatttagtgctagaaatttccctctacacactgctttgaatgcgtcccagagattctggtatgtcgtgtctttgttctcgttggtttcaaagaacatctttatttctgccttcatttcgttatgtacccaagtagtcattcaggagcaggttgttcagtttccatgtcgttgagcggctttgagtgagattcttaatcctgagttctagtttgattgcactgtggtctgagagatagtttgttataatttctgttcttttacatttgctgaggagtgctttacttccaactatgtggtcaattttggaataggtgtgttgtggtgctgaaaaaaatgtatattctgttgatttggggtggagagttctgtagatgtctattaggtccgcttggtgcagagctgagttcaattcctgggtatccttgttgactttctgtccgttgatctgtctaatgttgacaggggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttagtatttttatatgtgaatttgatcctgtcattatgatgttagctggtgattttgctcgtaagttgatgcagtttcttcctagtctcgatggtctttacattttggcatgattttgcagcggctggtaccggttgctcctttccatgtttagcgcttccttcaggagctcttttagggcaggcctggtggtgacaaaatgtctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccctgtcactttcaggtacaccaatcagacgtagatttggtcttttcacatagtcccatatttcttggaggctttgctcatttctttttattcttttttctctaaacttcccttctcgcttcatttcattcatttcatctttcattgctgatgccctttcttccagttgatcacatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctgcatccagctttgttccgttgctggtgaggaactgcgttcctttggaggaggagaggcgctctgcgttttagaatttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccttgtgaggtgtcagtgtgcccctgctggggggtgcctcccagttaggctgctcgggggtcaggggtcagggacccacttgaggaggcagtctgcctattctgagatctccagctgcgtgctgggagaaccactgctctcttcaaagctgtcagacagggacacttaagtctgtagaggttactgctgtctttttgtttgtctgtgccctgcccccagaggtggagcctacagaggcaggcaggcctcctagagctgtggtgggctccacccagttcgagcttcctggctgctttgtttacctaagcaagcctgggcaatggcgggcgcccctcccccagcctcgttgtcgccttgcagtttgatctcagactgctgtgctagcagtcagcgagattccgtgggcgtaggaccctccgagccaggtgtgggatataatctcgtggtttgctgttttttaagccggtctgaaaagcgcaatattcgggtgggagtgacccaattttccaggtgcgtcagtcacccctttctttgacttcgaaagggaactccctgaccccttgcacttcccaagtgaggcaatgcctcgccctgcttcggcttgcgcacggtgcgcgcacccactggcctgcgcccactgtctggcactccctagtgagataaacccggtacctcagatggaaatgcagaaaacacccgtcttctgcatcgctcacgctgggagctgtagaccggaggtgttcctattcggccatcttggctcctcccccgaaactttcgtttttaaaaccatcagatctcatgagacccattcactatcaggagaacagcatgggaaagacccacccccatgattcaatcatctcccaccaggtccctccctcaacaagtgggaattatgggagctgcaagatgagatttgggtggggacaaagagccaaaccatatcacctgcctcctttctttccccctctgccctgtcctaaagcaaggtgcatccttccccctgggctctagatcgcctgccctccagctcctcgggccttgcccacaccaattaccctcttgcttctgtcttcaacctccccatctccactggctcctttccattagcatttaaacatgtccaaatcttttccctcaagaacacccatagctcttatctccaggtctctccaacaacctcctgtccccaccacatagccaaattcatcaaaagagaaaaataagttatctccacttttcttgtcctcaacccattctatcagactcttgccatcacctgtggattgtaaattctcctgccatggattcctccattgccctcttaaggggccgcttggcaagcatacaatgccattgacctcatcctcctttaaatatggaattccttggcttctgagtgatcctatagcctctcagttttccttctggatttgctgtgctggccactccctagatgttcaatggttgcatttcttggcattgttttcaagctctttcccttctctttctgatctcatctagtactatgaattaaactactacctagatcctggtgactctcaaatgtctacttccagtctacttttttctcctaaattgcagatgcccacattcctctctaatattacatctcccatgggtgacctacatccaataatagttatgaaagagaacagctaatagcagtaggctgagtgatggacttaggaagggcaaagacccctttggcagggttaagaaaagcagaggtgaaatgagagaggtcaggacagtcacctgaagtatttcatagttctctaaaaagtactctcagattcaaatttccttgacactttgctaaccgttctgcacacctacatcctaaaggacagggctctccttaacatgaattaaatttgaatatgcctctaccttagaaaatatattgttcctctaccagtgtcctggcatatggagactgcctactgaaaatcatgggtatgacattgatttgtgtaatgctagctttggagtacatgtagctttttctctatggacttaaattttttttttttttgagacggagtctcactctgctgcccaggctggagtgcagtggcgccatctcggctcactgcaagctccacctcctgggttcatgccattctcctgcctcagcctcccgagtagctgggactacaggcacccgccaacatgccggctaattttttgtatttttagtagagacggggtttcaccttgttagccaggatggtctcaatctcctgacctcctgttccacccaccttgacttcccaaagtgctggcattacaggcatgagccaccgtgcccggccagacttaaattttaagggaggcatttacattaaattatacttcccacaatccactcagcttggtctttggctccattgttgggtggaattacaattgctagtacagtagctggatgttaaatagaagtcagtgtagaacaatagatgtcgaaataaaaaacaagattagaaacagaaaagttcatggcttcaaaatgcatgttagcctggggtaaaaaaactgcatggatcttacagaacatggagtccagcactgatacggacaggagatagggaaatactggtttgaagaaggcagttcccgggcaaaggccccccaccttcaagccaagaaacccacagccctcagtgagaacaggcattcctgtttttgcatccaaaaagttgccttttggcctgctatgtccccctatcttgcatccatataaaccctgaaccccaggctccagaaagaaatgcacggacgaatggcaaaatggggcagcagagaagaagagaaaagaaggaaaatcatcttcccactccattccccctctagctccccatccatcccacggagagccacctccaccactcaaaaagacccccacattcactctttaagtccatgtgcagcctcattcttcctagactccaaacaagaacccgggtgccaagagggcactgagctggttaactttagctgtctgcagattgcaaagccaaaagagcatgctgtaacatgcccgctgggcttcaggagtcgcagacacccacccttagagacaaccagggggccagaggccaaagtccttgccctggctcctaaacctgcctgtctgtgtgctccccctcccgtaaggggtttgagcttgtggcagctgaacagagaggcatacccctgtcacatgtcatgtgggggaagcagggaactctcctgtttcagcaccttcatttttaaaacaaggatactaaggtttagagagaatagttacactttctcaaggttaaactctacggaatgggatgaaatggtgatagaattcagtgcttattccatctccatgtgagaggcctgagggacatggcatcattctgctagggccttcgagttattggaatttttgcaaagcatgtcaacatcccacccggcagaaactctggcatattcacttcatccacgtgcttcttctgggaccccttgttttagccaactccatacccatacttcaggagactcctgattttcctgaactctgagtcctggacttgtgttcccacacccagccttggctcttctctcaggctaaccttagccccatttgctctgctagaatgtccctttctgttttcttcctcctttggttctactgcaaccagcctcaccaaacagtattctgctcatctgtctaggagctctgcaatacacctgagctcataccctgccacacctgccccagccccacgaaggaaaacaaaacaatagcaacaaacaaacaaacaaacaaaaaaaaaaaaccctgctgaactcagattctgattcagctagcatgaagccatgacttgtaccaggcactgtcctaggtgctggggtgaacactgtcatatttaacttaacctaccagcctttcatagaatcctgctctgtgaaatttgcacaggggccaaagggaaacaaggcattatttataataattggcttgccattatccattctgttggcgctgcctgcaacaacatgatggacctgtatgctattcacagtctataaaaaagtagttctgttgtgattcaacatatagtaatctccattttaagaggacaatagaaacactcagctgttattcatcccagagccttaaacggcagagaattcctttatcaggaacataaggttagaacagcatgagttattaacattgaaagtagcccaatgcatttattgaggtgctcaaactattgaaaaaaattaacgatttttaaaagtaaaaggctagacctcaagtagcactttgggagaagtgtgtcaaaggcacaaactattcagaactgcttaggttgaaatgaggatggggaaagagtcttggtccccataacccaactcagttctgaatgttctgaagagagtaaaggagaaacgccaggcatgttcagaaatccagatttgaggggccaggagtggtgggaaatatgggagcagctgcaaatcatagttaattaacaatcattagggatacatgcataacacattttgtattcagttagctatttatttatttattcacagccacattccacaaagggcttgaggcagcctacaatggcaaaatgcaaacaagcgtaaaaagtcaggactagcatatacggtgaggaacaccttggccagaagggcacacatctgtcagccctaagggactccagaggtaccacagtcaagttccaaatttggcttgaggcatcctggcagccaaagtgaaaaggagacagggtcaggtccaagcattctctttaacaagacactgttaaatgtctttctttcaaagcaggtaaaaagctgaacactgacacagcggccccacaaataactgcagaatcagtggtctgcaactgcagtaaaatggatgggacaagggacaatggcaaaggagttgggttctggagctgaaagtcctcactgtgaggtccagcttaacctctactagctccagggtcctggagaagatgtttaatttctctggggcacgttcttattatgcataaaccagagatttaaaaagacttaatttgctaagtcgtgtgtcagaaagaagaaaaatgaaagagggagaacgaataaaggaatgaataggtatgtactatgaagtgaattgaaacatatagagcacctagcatatgaaacataccagaaccttttctagtttttttttttctttaattctttctgtgaaattgagtctgggtagcagactgttcctccatctgagtggctgtttgtcagtctctgtcttccctctcccatcctctgcccctaccactctcttcaacctcaactccagaggtagctggggctatgccacatctcaatctcagaacaccagggcacagagaagtaaagagacccaagtgatggatgggtgggtgagtctataattctcagaggaacattattagaaacaacaagtggtgatgggcacaggatcaaccaacacaatgagagagaaaaacagtcaactcggagatcaggtaatcagtgattgataatctgataatggttgaacactcacaaggaagggccatatactgaaatgagtccatttattttacatattcctaccttgagtgcttgttcacaaatatgctttacctaatccattctgattttgatgaaaagttccattttgtagaaatggaacttttgtagaacatttctacaaaatggaacttttcatcaaaatcagaatggatgccagcaatccatccaaaaccagaatagagccagcaatactggctgtcttgatgctaaacacttttcgatatcagctaacagcatgagactaactatcgagcttttgtgttttcagtgaccgtatttttctaagccaaacatttaaaaaattcacataaaagtcaaattacttgtatatattttgaggctcatctagtttaagaaaaaaaagctatcaaaaactgaatatctcttggaaattctgagtcatacagccactgcattaagctacttggacaggtgatcttcccatttttcagatgattctccttaccttcaagcttaggtaagaagtctctgctctctgttccctttgaacttgcacacatctccattctaacacttaccactctacagctgagtttctgattagactaagaacccactggccacaggatgtctgccctattcagttgcatgtttccaaaatttgctcaataacaaccaaagggaactgttttgcaagcgtagaaaatcagttcttcagtacactactaaatgcagcaagctaccctccttttttctacattgccctctacactttttagcttctagacttctcatcctgccttgaccagccccagctaggcctctttagttgcaagattccaagaagtcagagaggacctacattcacagggcctgagccagctcggagaaacgggccccctgggagtagccacagagggtcaggtggaatccatcatggtgcatcagggctgagagttgaatctgtacaatagcccaggccatgggaggccttcctaaggcccgacttgaccactaaggatctgttacttcttgggtccccaatctagcagtgagagtgaaggaaattctcaggttccttggccaaaacctcaactctctgccttcagaatatgagcttaatgagaattccctggatgagaaccactgtcattcatttaaatcacagctacacattaccgtgaagccttatcacactgggcctctctgatctcctgtaaagggtcatcaatttctgtatcttttacttttttttgtctgaataatgaacatactgctgaaagcaatgcccgggatgaccgggcacatctaggagattctaaaagtgtgagtttcagatttttggtacgattttattttcttcatgcttaaagtctcataaaattctggatccatttaatcatactacctaatcatatgtttatcatgaaaagtagcactaatgtggtaggcagactgtttttccatgtttctttctttctttctattttattttattttttatttttttaagagatagggtctctttcacctaggctagagcttattgcagcctcgcacacctgggatcaaacaaccctcttgcctcaacctcccatgcccatgtagctgggactacaggtatatgctaccacacccagctaatttttttaatttttttgtagagatgaggtctcactgtgttacctaggttggtcttgaactcctggcatcaagcaatctttctgccttggcctcccaaagcactggggttacaggcatgagccaccatgcctggccccatgtcctgtttctaaactaataattagcaaggtaaggcaaaaacggtccttttacctgtatttgagctcacatctacggaggcttcaacagaacaattccatgtcctatttttggaagaaagctccaatttctagccctagttttcagtgttgtggagtagttttatttcctgtctttcgtattttttttttaaaaaaagcttctccaacattttagttgcaatctgagacagtctgtttcagagacaaaattttacagccagatgctccagtgtgagccgctgcagtttgtttctaaggatgatcagtaacgaatggggaatgcttgtcatttgctcaaatattgtgaagtcttgtcttttcttgggcacatgcacacttttataggcaaggtttcatccatccgtaatgcctgctgggacaactgggagaacaggtcagtcatttgcagaaacagacctaaaaccctaaggcctaggagccatcacagcccccaccccatctggacattaacaagacacacagggtggggaaagaaggcaaatgggagtgcagtggagtcaggagataggcaactctgggcctccacttccgtgggggattttaataatctccctggagtcacagtgggttgttataaggaggcagagggaaggtaggatggttctgatacagaaaatagctcctcagtgggacaggggagatgacagcagagaagctttcaaccacctttttttttgtgatgccacaagtctctgcagctcacctgtatagcgctattgctctattccacgtgacaaaacatgagtcacctgctcaattagtttcattcagtccattatccctatagctagggagagctctctcccataaactggcaaatcattgttcaatatatttaatcttaatatggttgatccttccttttctttctttttacctctcttcctctctccatccttcttattcatccatccacctatctatccatccatttacctgaaggtatgttgaccatctactttgtgtcaggtactattccaagcacttaatatacaatatctgattaaattttaacaataccctggaagttagctcttaatattctttatgaatattatatgaggtttagagagtttatgtgtcttgtccaagattcagcaaaattcagcccatgggctaaattcaacctatttttgtaaataaagtttagttggaacatatccatgcccatttgtttacgtatgacacaatttcagcagagtggagtagttacaacagagaccatttggtccacaaatgctaacatatttactaactggcccttaactgaaaaagtttgccaacccctgttcttgcccagtaatacttagcaagaaagtagcagagtcaaagattcaaacccagatctatttaactcaaaaggccataattcttcaatgctgtgtcatgcaacagaagtatgtgagttttgtctacatgacttcttgacacctagggtgagatggccaggctagatttatggtaagaggaacagatctgacatatattacttagtaagtagccaattactgtggaagactctcttcatttgtaagaaaagccagtgaggatgctttttttttttttcctggtgaagtaattatagagacgagtgttgatgcatgttttgactttgctgcaaaagtagttctgtcttctccagtttaagtaattacattagtttctaaatagagcagatggaactatagttgtcaaagaatgcaaagatcagtcaactgcatttatggtgtgacattctaagcagagataccgcaaagtatcttgtgcaaaaccaactaggtgagtgctattgagcacctgtgagccagaagaaaacaggagaaaaatgtggctaaatggaaatggaaatttctacacaatgggatctggtggcaaacacattttcctaccataatgccccaacaattgcttgttttctaatgttgcctggttgggggaagatatattctgagtgttcctccaaacttgtagaactcaatttttctgggggagagggttgtcctaagatggtctgcttggtactcagagtgcaaagatgtctcctgcaagaagcaagcagcttatgaaggaagcaatgacttaaagcagacacgttacctctaaagaacagggagaagatcaaatccagaaccaggcagtagtaataagggaactgacctggcaataggccaaggatccaaacgacatgggaaccaggcatgattcaaaacagccactgctgaacacctacaccaatggggggaaaaatgatactcttagcgttagagtccacaactgctacagagtctcagctgtgatttctactgccgggtgtccccatagaagtctgcatcccaacccctgagacctgtgaatatgttaccttacttagcaaaagggactttgcagatataattaagctaaagatcttgagatggggagattattcttcattttttgggtgggctcagtgtaatcacaagtgtccttgtaaatgaaagtgggaggtaagagggtcagagtcagagagagatgtcaagatgctacactgctacctttgaagatagaggaaggggccatgagccaagcagtgcagacagcttctaggagctagaaaaagtcagccgacagattctgtcccagaacctctagaaccaacacatccaggcaacaccttgattttagcccagtgaaacccatttcagacatctgactcccagaaggccagaagataataaatttgtgtggtttcaagccactatgtctatggtaatttgttatagcagcaatgataaactaatacaacagccctgacttggggggagggtaaaggaaagagccacacaccaccaccctctcaccatgggaggaatagttgaaatgaacacatgacttcaggtccccaacaaagagctgaatgggtttcaggctagcttgctaattcattcaccaattctcagctctggtgttgcttgattcagaaggtaaagacaatttttaaatttccttaatttcaaaacttaattcatccaatgcatttaatttaaaatcatacattatttatccacaaatcctgatacacagggaaagaaacagaaatatttgctggacaggtggcatggaaacaaagggttattagcgattgccatgcaggcctaagtgaattcacaatgaccatcatgacatcatgtctgttgttactatcaagagcgttgctcttggataagtatcaataacctcagaactatggaaagaaccatgtgtggagtttggcaccacagatattctctgagtgattgaagtctcttctaccatggtgagtggtaccatggaagtaatcttgtccccaggcctcctaagcttacttatgatgaagtgatgagactcttacccaagaaaccattacagaaaaaaaaatcctcgcctaataaaattgtgccagtgaacaaactctcagatatatggccatattgacaagatctgcaatggtatcaaaagaggtcaagctaataacctgaggaaacaggaagaaaactccaattgtcttatacagaaggtctacaatcaataggatgaagtctaacactggcgagagtggggtgagatggatgaacttctctaccacctggtgatgaaatacattgggattctatgaaaaagcatttttttctaaactcaatttccatattaattttagagctatatgtaattagttaaaaatgttcctgaagacttaaatcaagataatcttttagaagtaacaaaatgatctacacatgaaaatactcaattcagcttcacatattgccacatgttatgttccctgagaagcagactctgagagtttagcatgtagatgttttaagtggtttccgtggggtcaacagctatgcagaataggggaagttagcaggaatggggcagaaatagaagtcaagctgtgaggtaggcccaataacatcttcagctaacctgctggggagctctaaggctggaatgtgagttgtcctgttttggggatgaaatggtaaaacatttaaactcttgattctctgagtcagtgaacattggctgccccaggaaggagcccaatcttgggcaaggcaactctctaaagctgaggggattcttgaagaagcttgtgtaaatgaatgaatgaatgaatgaatgcaagcttgtgcaaggttaacccagtggacttggggtactcaaactctgcacattttaaagagaagactggccccttgaccatcctgggagataacctataagcctttggaatacctagcctgatacaaatgtctttgtgtatctggggtcttgggatatgccagatagtttatgcaaacaatgtgatttatggtgaatgcctgtttttgttcacctggggccctggtcatgctgtattggttggacgccggagactgagcagtcatggaggtaccccaggcctatgtgactagcccccagtagaaaccctagagaccaaagctcaggtgagcttccttgttggcaatccttcctatgcattgtcacacactgttgctgagaggatgaagcattgctggcacaaccccaagatcacacatgctttctcctatgctgtttttgttgttgttgttgttttgtttttttgtttttgagacggagtctcactctgtcgcccaggctgcagtgcagtggtgcgatcttggctcactgcaatctctgcctcctgcattccagcgattctcctgcctcagcctccttaatagctgggattacaggcctggctaatttttgcatttttagtagagatgggatttcaccatattggttaggctggtctcgaactcctgactttgtgatccactcacctcgacctcccaaagtgctggggttacaggcgtgagccaccacacccggccactatcctatgcttcttttaaaaccagccgttcactgttaatctgtattcttttactatattatctatatttactatgtttactaatttttactgtattactaattttatatattatactaaatttatgtaatattactaattttactatattttactatatttattaatatttactatattaatatatatcttttactatattaaactggaacatgagtatagcagctttcctgagttctgtgagtccttttataaatcatcaagcctaaggatggtctcagggacccctgacatagggctagcacttaagagcagcctgctagctgtagtctcagcagctagggtaacaaatcctttcttgaagggatagccaggtggcacatcacagtatgtacctataaaagctagaaacaagtgaaatattcataaataggacatctatttggcaaagtagaagttaggaagtacccagccaagctctgcctcatggaataagagtgctttttgagaatgattccaatatctatcttcatttgctatacatatggagaaaacagtcctctcagtttggggagaaactctgaattattcttaaagaatctctggttatcccctctagcttacactgaacattctaggtccttgagaagatcctcatttcaaaggcaatagaaaccatctgaaattgattcattggaaaatgtatatgctattaacaccagagagcagaagtagactggctaaaatatagcaacttgaaatatattttatgtactggaatttgatcaaatagatggataacttctggaatgatgacagcaaacaatctttggaaaaacacatgactgtgcttggagaacggtatcatagtttttaagaaatgtacactgcatagctagatagcatagcagtgtccatttaaaccccaatctaacacttcgttgtaagttgacagtaggagaaaatggttattagaatatggtttgacaggccaggagctatggctcacacctgtaatcccagcactttgggaggctgaggcaggaagatcacttgaggccaggagttcgagacagtgcaaaacctcattgtctttacttaaaatacaaaaattagctgagtgtggtagcacacgcctgtaatcccagctactctggtggctgaggcacgagaattgcttgtacctgggaggtggaggtcacagtgagctgtaattacaccactgccctccagcctgggcaacacagcaagactctgaaaatatatatatatatatatatatatatatatatataataaaatattaatatattataataatataatttattatatataattatctataatatattataatataattattatatataatataatatataattatatataatatattataataatataatataatatataattatatataatatattataatatattatatattatattatatatattatatatatataatatatatataatatatatattatatatattatatatatattataaatatataatatatatataatatatatataatataataatatatatattataataatataatatattatatatataattatatataatattatatatatggtttgatgggttacttgataactgccaattcagtcttgagatgaggaacaaaactgaaatatgaaacatgactggtctggtagaccacaggactgcttctggtccaccgactgtgaacgttaatgatgtgtgttcattgctgggttgaggtaagtatgagttggtgcactaccccctatttctctctttctttgtcacagaggccttgaaagctccatgatagagatgacagagctataagatgaaagcagcccaaatccctgagtcaccaatgtttgaagaagagcttcccaggagaggtaccagacccacatgagacttcacatgattataaaatgaacttctattgtgttgaatctctgaacttcagggttgttttgcagcacagactacattatagtgacaagtagaggaaggtacaggcatgctaatttcattttaaaattaatcaaggattgtcaatggaaaataaagatttcagattccttgcaccttaaaaaagacgaaaaatatgtcttttttcttccccaacccctgcttatgtgaagcattatagtctaatagctggcattttagagagatgaaaaagatgagtttgcttcaaaatgtatatatgaccagactgtaaattcacatgcaacgcagtctgctttgggagttaaacatattatttaaacaaatcattataacttgacttattatacctcaatttgattataaaacaaacattaaagtgaaatctaaggtaagtcttttttatttccagttccaaagccatttccatttcttacttatctttgaatcctcagccccaagcacagtgcctgaaacacagcaggtatccacaatctttggatgactgaatgaaaaggaaagtttaaagtcaattacctttaatcttgcttgtggtttctcagagctaatttgaacactagatggagaaatactgaaaaaaaatatttttcagaaaggcaagcatcctcttggtctgagaggtttcataacaagttaattttattttaaatcagtatgaatggatggatgataaactttggaaagtcacacttagaactacattgaaaacaaatgaatgtgtccccagatgaaaaataataactatgtaaataaaatttgaaataaccacttgatagcaaagagaactccagtatcaagaaatattttaaattccatgcaatggttaattatattcctgaaatctatgcacaaaagggcaaaattgaagaaaaaaaagaatataggttaagatgaaattcgtgaacaagaacctgaaaaatataataggcaacaatgtgctgcatttccacatttaagaggctttaacatccatatttttctcccatgtgcaattacatgaacttataatccttgaaaaattgttattatttttgttgctaaaactgcttgtaataggagtcacagatatgtgtagtaatatgctcagatgattacatttgaacaaataccatggtaataattctcatatttggaaatgctagaatctgaattacacatacagtttgtggcatctcttttttgaagccttagattttattttattttttgttttaagaccaagtaaaaatccaactttcagctaatggaattctaggtctagttggtagaacgagatccagatggagttcaaaacacctgctgaatagtatctgtaaactgccagcttgatatcgtcaccaagaattctgcaagctgagtgtccacattggaatcttaaggacttgcatacagtgtagttatatataactcataagaactaattattaactactagactgtgaggactctttctttggcttttaaggaaagtcaccgagttaatgctgaatatatttctaaaaaattgtacttatgaaattaatagagttgaccgacaatttgaataatattaggctacagtaacctcgaacttgattactcttatacatggtaaaacaatccagaaatcctggggaagggttgtttattatggctgcatggaggttgcccaagccctggcattcttttacagtttcaagggagggcaaaagtctgaagtgggtagggactgagccatacttaataatttaaacttagtatcatggaacaattcacacccgttacatacaagttaaataaccttcatgctgtgttgcaaactgctcttcctgctatacttcaaacagatagaatcattttacaaaataaaattaccaaaatgaggatatacttcataaaactgttcaagggagaagcaaacctttggtgaagagtgtgatataatcaccaatggctttaagaatgccattgggaggatcttaaaatggagatgggccagatgcagtggctcacacctgtaatcccaacactttggaggctgaggtgggggcatcacttgagatcaggagtttgagaccagcctggccaacacggtaaaacactgtctctactaaaaatacaaaaattagctgggcatggtgacgcatgcttgtaatcttagctactcaggaggctgaggcaggagaattgcttgaattcaggaggtggaggttgcagtgagccgagatcacaccactgcactccagcctgggtgacagagtgagactccaactcaaaaataattaattaattaatcaattaattaaaataaaatggagatgaaggatggaagtgatggtgagatgtgcaagttccagcatgtgtggatctgatggcttttgaaagtatcaactgtagggattctatcatattcttacaggaacctaacagtgttgatatatatgatgaaatatagcactcaaaccttcatggaagatggtgcctctgactctggagggatacaatgaggagagagagcacacagccatagtcgaggtctccaagtctatcatgcatcagcatcaccaagagggtttcctaagatttagattgctggatgccacccccagagtttctgattccataggtttaagtgaggacctaataatttgcattttcaacaagttatcaggttattctgacactgctggtcagggaactatgctttgagaattactggtctacgtgtttcacttagaagccagaatggttcaccactgtctccttctcactgggctaaaaatccaaagtcctaaccattgccagcaaggatctatgtgatctgggccttaacaatctttctgacatcatctcctgccagtctccttgttgctagcaccactcaaggctcattgtcctccttgctgatccttacatatgccaagcttgttcccccctcacatcctttgcaattgctgcttgctccctcaacccagaatggggttcctgcagatcttcaaagggcttgctatctcacttcattcagttctttgtgcagagaagctttccataaccatcctacttaaaatcgctcttctccacagttcccctttcattactgtctgtcccttccctgaaaatttttcatatcattttcacctgaagaataatatttatttaccgattgtcagctcctctaagaacagggacttggtttgattcactgctgagttcccagtgcataagaaagtatctgacacacagtaggcattcaatacaaatttgttaaagaaaaggatgaataattgattgaataaataattttaagaaagagcaactgcaaatatattagccagcctccaaactgacaaagctaagagggtaaaggtctgagatttaaaaatcaaacttgcatctatgaaaacactctataaataagaatgtacactatatgagagaatttctgttatacataaagaagggtgaattgtatctactcacaggagccaattgtgcacatctcttcccaacccaatattcaataactttacactgatagggagaaatcagtcacagtaggaatatttacacccaggaaattggcaaacattacaattcaaggcttatttttatcagcacactactgattctatccatagataaacacattccattactcagtttgatagcctcacccatgtacctgtcacccagaccagaggtgagacaggtttgttgccaattaaaggagggaaaatgggacatctcagtataacagattgggatagactgggaagcttatctaaatcttacttcaggatgtccatttagcggggctgaacatctactttgccctgcctgagcggtcgaaacataaaacaggtggacatggggatgtgtgcttttgaagatactcacccttcgctcctgctctacatgtattatggggaaactgatcctaatcttgagtctatggatagaatatatgactcatattattcaagtctaaagttgggcccaacaatggattttcagttacacaagtccataaaatctccctctgtcttacttatgactaaatgaatcctgactatgctgtgcttttttaaaagcaggatataaaatagtacaaacccaagtttgagcacaagtaaatcaaatacatactcaagccacaagtgacagaatggaataagcaccgaaccagtaaaatttctttatttttttgttggtagttgtacaaatctattctttgtctaaacatttttgcttaaattttagtcacattgtttctgcaattaaaaaatccataatatataggttgaatttcaattttcttctctgtttataaactgttttcccacacattagaaagatgtctaagataaacccatgaattaatggagaattaaaatggcagagccaatttaaataccacatatttaaacaaacactagaaaaaaaatctcttgcaacagagattgctatagcacattaattataaggtttcagatagatttttgtaactcaaacataaattttaaagaaccttcccatttgtttctttaagttattaatgtctccaatagaaggacaagttgacctttaaatctgaaccagctcagaaaaaggcccaaatgcacacttgacctcttctacaaggagcctattttagtcacaatacaattttacccactcacaggtgctctgtagcagcctgacagtggcatttacatttttttttaaataagctaagaaataatagaacaaggaacactggtagtcacttgctttaattgtaactttgggcctctgttctgtcttatcacccattttagctgacgaatgcacttcctcattccctgttttcctcgtggtaaagtaagaaacttgaatttgaaaccagagccctgagtctcctatgccctggccatccactgcctttgcatgcagcctctgttctggccctgaatccgctctctccgcaattcccagagcattccttgggtctcaactctaaggaagcatattcctttcacgaatcattttgtaggggacacaggagggtacattcccctagcacagcctacagcatttcactaaaaagcacccagagaactttccctaaagtctcctccttagcccacagtcttctgggctttccaagctttcccactttttctcttcttgatgtccctgtctgttatattgctcctaaatttcaggacactaggagacacaaaccaatcaaaagatttcacatgctcttttaggtattataattcagtgtttacaaattatctagacattaattagatccctctcttctaccttcctggtaatcttactccattctttccaggcacctgtctttttactctggccatggtccgtcagcatttcaaattgtctacgccgcttctgctttacaaaataaccagaaaatccctctccccccaacccgaatgaagctgggaattttaacctgccatctgtcagcagctatggacctatatgatatctccttttgacagccaaacatcataaaagtgttgtctacacagatggagttcattctttacctgctacaatctggtttctgcccataccacacctctgtacctgccctcaccaagtctaacaagttcttaatcaaatgggcatgttgcaccttgtgttacttgaaccaacgtgaagtgtaaatcccacacattagaatattagagatttcataagcaccagtaaaatttatttttttattggtagttatatgaatctattctttgtctatacatttttgcttacattttagtcacattgtttggtataaagagtgtaacactagttaccattcactgggaacttcattcactgggcaccaatctttaagtatagagacttctttaaaaaaaaaaaatttttttgagacagtgtcttgctttgtcgcccaggctggatggaagtggcatgatcttggctcactgcaacctttggattcaagtgattctcgtgcctcaggttcccgagtagctgggattagaggtgtgcattaccatgcccagctaatttttttatttttagcagagataggttttcaccatgttggccaggctggtctcgaactcctgaccaccgcctcagcctcccaaagtgctaggattacctgccatgccacccagcgagaatcttctctaatcaacacaagtattgaaaataagcattgggaaaaaaatgtctagagatgtttgaaattagtggaagacttaaatctacattgaggatcaccattcagcttgcctgggctgcctctgtgtcagtcagattttgctttctagctggaaaccacccttactccatctgggaatttgaaatgtggattgttcctcgggccccaccattaatgacaacacaaacacatatttttacatgattttaatcattgtgtatgttcaatggtgtctcctggcttatttatttagcattatatcataagcatgtttaaggttgcccaatagcatctataattaccattttaattgctgcataatattccactaagtggatggtcatgatttactaagccattaccatagtgttgggaatttaggttgcttccaatttttgctaccataaattgccctgcatatagcattttcctaggtttgaattaattctttaggataatttctccagcattgattgctggtttaaagagcatgagccatttttaagacctttcatacacatttcctattccttccaaaaggactgtgctaatctgtcactagcgatgtgtgagaggccttcctaagggtaattgcatgaactgataaagtgtgcactgagaacagcctggaaccctggatgaataagcagcagtgagagctgagagtataggatatattgaagaattataggtctgcaagaattgtctttgatgggggctttatacattctctctgtctcctcgctccctcgcctgaaaatcatttacagagtcattaatgagggtctctatcataggtcaggcatcagcttttctgtaaaccaaagcctacagactttggaaaagtccctctaagtctgtgatccacacaaacactgtgagtatgctttgccatcactgggagccagattaaggctgaatgtaattctttccagtggacccagagaacttgcaaatggcttggatgagccatttatgactgatattccctggaaaagaacctaagcagttggaataagcagccacagagaccaagagtggtaaagagaggcaaggcaaaggctagagaggcatgatatgatacctccatgcccaggcaagacctggtgtcgacagagggagcaatgcttggagcctgaagtcccagtttccagtcccagctctatcttgactatgcagcctcatactgacttctaagcgtcttagagtgccctcttccaagaggacccagatacctgtctcacaggctaacatggagctgagatgggagagcatagagcttgctttgaaagatgcagggaactacaaggttattaaatccaactcagcaaccagactgtttacaccagcagtgtgcctgtccagataatattgaatatgtctgggaattcagcctggggagacaagtgagtgccaaatggtctgtttctgcaaggctgccactaagaagaggattcacacactcctggaaacccttcagagcagttcaggttattgggccaaagctagagggccttgggtgtgggctcagaattagattttctgcatattaatgatcattctttcacatcacactatatgaatgacttccaactatttccaagttattttccaactgactgagaaagctctgatccttactagttgtgggacgttgacagagttatggacctccctgagtctcagtgacttatttgttaaatggagataaaaatgcctacatttggagtaagatagggaatagtaataatcttgatggtgacaacaatgataataatgtgaataataatgtgaatctgtagagttaatacaatgtgctcactctgagctaaactaaggactgtatgtacattatcccacctaatcctcataacagcctccggaggtaggaacattaaatacctgagatcaatgaggtacccagtgagtggtaactagtattacactctttaataccaataattcccaaggaagaataacctaattagttagtgggagagcaggattgttgaaatgagtattgcctcaaggattaaccccactttgggaggttaatgtaaaaaaccaaagtgatattgattgtgttaatgaatacatttagtgctctccttggatctgtatttgacttgtaattgggtagtttcctcccactttgactctgggcttggccacatgacttgttttggccaatgggacaacagcaaactgtgggcaagtggatgcttgaaaaagtgcttgtgcatttctgcttcttctcttggatccctacttcttccacgagaagacaccccaaggccaggctagcttattgaatgtcagaccaggtggaccaaagtggagtcacccagctgaagccacctgagaccatctagttccagctgacctgctagttaatccaagatgcacattgagtattgttacgcagcattattatggcaatagctgactgatgcaaccagttccattacttcacacatactattttcttcatacatgctgataacacctggtgaataagcattttgccaaaattctacatggattgtatcatttattccttatacaaaaacccatgaggtacatgctgttattacccttactttattttatttatttattttttgagagagggtcttgttctgtcacctaggctggagtgcagtggtgcaatcacagctcactgcagcctcaacctcccaggttcaagtgattctcctgtcctcagcctcctgagtagctaggactacaggtacatgcctccacactcagctatttttttttaattgagacaaggttttgctacgttgcccatgctggtctcaagctcctgggctcaagcaatcctcccaacttggcctcctaaagcactgggatcacaggtgtgagccaccatgcccagctaccttcactttcaagatgaaaatataaggtgcaaaaatttaaataccttacccaagcttacagttagtgatgggcaagcatttcaagctgggcagctcagcttcagagcctccgccacaaccactatgcattgctttgtgcacactataagagagctcctcataccaagctgctttatacgactggttgcaaccctccccttgcctgagcataatgcctctatggacctcccttttcagccaggccaggcatcatgaatcaagagctggctgccttcctctctgagcttatggctccttctccttctttgacaaggtgctctgggaagagagaacaccatcaggaaagaaagccttctagcaaacacaagatccacagattgaaggagtgaagtgctcttcatgatgcagtgctcttaaaatccaggctgtgtgatgggcctgaagagacccgcagaaaaccaagggggccctaactgcactcttgccacttctcagtaaagtcccaagaatcccaatctgcaactgagccttcaacaggctgtgcaggtttacagccctgttctcatccaggcctcattgtctctgtcacctggacctttgtgacagcctcctcttagggcctgcagcctccagactcaccttttctaatccgccttacactccaaaccagagagacttcccaaaacacatgtcactctctgcttaaagctctgcaatgtgtccctgagatgaaatacctgaaaacatcatccaagtcccctcccaatttatcagtacagccttccaggtcttgggcactgatcttcatgtttccaaagcagagtacagggctttcctttgtctatgttcatgccccttctcttatcaatatgctcttcatcactaggttaggctcttacctgtgcatcttgtatttgggcacagatacaggggacaggggctataggatgcaatgaagaataaggtgttttgcatggagggtaatgaccctgggtcttcctcatctctggtcatgagccctcaaagtccagagactcagcaaagtggtcttcagtgtaaccccagagcctggccccaggagcactcagggactttctgggaggtaggctgtgagtaaggagctccagattcatacacattaaggtaaagacctgggataatgatcagcaattcatttacattgccttaatcacaacacttagtccttaagcaataacttatattcatatgtattgcacagattactaagtatgtgctcttccatttctcattgaaggtacagtaaaagccttgccatcactcccattatacagaggaagaaactgagacctagagaagttcagaaccttgctacatcaatcagaagtacaagccaaggctcatgaagtggtttccttattttctcaccccaagttagtaagtctgtaacttctccttcacagtgcaatttgtcacgcagtctatggcactgtagaatttggctatagatccctaagtcagaaaagtccatgtttggagaactactagtaagtcaagacagaggagtgtgacaaaggctgacaaaaccctacctgcagcctggaggtcacaggcagcctgctttttgagtctccctgaatggaggggaaggggctctccctgagggaatgtgctcaactctgggtcgtgtggaagagttaggaagttaacactccatgagcgaccctcatccaatgtcggctgggaatgggtggataaataccctaactttctaaggtatatgtgtgtccagcagggcctccagtggggatgaaccacagttggccacaatggtaacctgcccattaacacacccttcattggtctttattcccttccctgagccttcactgtgttttcagggatcacctccgaaggaaatgacttacacccaaatcaggatctgtttttgagggaacccaacataacacatggagagatgggtttcctatgaagaaggaaatatgggctgtaaaataccacggagagtcagagtaagtacaggcggctacaacaaagatagatcaggtcacggaggtctctgggaatagaggaaagccacccagaggaaaaaaggacatgactgccactagcaccatatgtatgtttcagatgggatgtgtatttatgtgtgtgtgtgtgtgtgtgtgtgtgtgtgtgtgtgtgtagggaggggtgacagagagagagaggcagaataaatatcttggtcattggttacaagccaacaaaactgaagtgatgaaactcagtgagttttatagaaatgtgctggagatgcttcaattactttctcaataggtctattttgataactgaatgaaaagaatccatgtgaagcacctaccactcttcctggcttgtagtgaacacacaaaaagaattgttgattattgtagtagacactgtagtgtacctcctagattctccttacccagccactatacccatccccattgctgtgaggtcaggtgcccaggaatcacagcatcccacccacccttcccttgctccaggcaatgccctcaactggtaggtgtcactttgcccagaaactaccattcttctccaggggacccacggccaagggcaaactggcataggctatgcaaggctggcccctggcagaatgtatgtggaaggggcaactcttcagtgtgctttatggaccatggaccaaatccagctctccatttgcttttgtaaattgttattggaacacagccaccccattcctttttgaattgtccatggctgctttcctgctacaacagaagttgagttattgcaacagaggtcgtctgggccacaagatctaaagtatttactctggcccttgatggaagaaacttgtccaccgagccctagagctgcacttccaatatggtagccattggccatatgtggatatttcaatttaaattcattaaaattaaataaaattaatatttcagttcttcaactccaaaaattacattttgagtactcagtagccatgagtcgctggtgactctcctatcagcccagatacagaacactgccatcttcacaggaagttctgttggatggtgctgcactataggcttcagcttctgggtaaaactaaggggatacttaacctgaccacattctgactcaaccccacccacatccctccctcctcaacaggttcctccctcaataaatcacatgtacctgttctcctatctcaggctctatatctagagatcccaacctaagacagcctttttttttttttttttttttttttttttttgagatggagtttgctctgtcgctcaggctgcagtgcagtggcgtgaacgtggttcactgcagccttaatctactgggctcgagcaatccttccacttcagcctcctgagtagctgggactacagggtgtgttaccatggccagctactttttaaaaattgttttgtagagatggggtctcactatgttgtcagggctggtctccaactcctgggctcaagtgacccctcccaccctggcctccaatgtgttgggattacaggtgtgaaccaccatgcccagcctccaatgactaagatagttatgatatgcttgtattgcatccccaggttcatatctttgccattcttgtgatgagagtgtgggctactaagacacaggggaggatgccaggttcacctctaaatctccagtctccactacagtgtctgtcacagagcagcattcagtaaataatacatgaataaataaagtaaataaatggtcccctcatatgctgtacccctggtgtcccgtcaacagcccagagctcctcttaatccattcccactgcacgtttcaggttcaatttctcagacattcactttacccggaagtccagctgtgacagctaatagatgaaaccatccaatttgcaagttcccctgagtctctgctgtaaaatcagcctgatcctcaggaagttccacacctaggtctccactctcagccctatgacctcacctccacagactctgcacttgagcattccaccctcagcgcttgtgaaaggagtcatgggagacacaaggctggaggatgtgtctgcatcttcagaaacccgctaacagggacagcgtctgtgataccggctgacgctcattaaaccaaggctctagtagcctgttcctctcagatttcagaactaaaagaacagtctggttatcctgacttcttcttttatcataagatgctgcaagtcgaatctacagcagtcagggttaagagaaatcattaagtaataacaaagtcaggagtttcttctctgaggtaagctttgctggaaatttctcgtccctactcaagatggcaaccaaggacactttggagatagcagcttagaaatggccctgaagtgggtctttccttagactttaggtgaaaacactttcccctgatcctctggggaaacggctcccctgaggttgtctggggtttttacagagctcttctaaagaccctgggccttggggcatgctgtttaatttactgggttattggctgtcatattgaagacaaatgcatccaaggaaaaaatggctcaagaagaacagactcctccatcacttcaatcaaggggtccttcacgaacatgcttcattaacagcaaaaagggctgttggggtgctttgtccttactctacatccccctctcagctctgcaagactactgctgtcctcccagcaaaccaagcccggcagagagagaagccatcacaggaacacagttggcctcagcagcctgatgctctcaaggaatgtgttgaatcactacacagataatcagaaggcagctgctaaggttcagaagagaaacagcaggttctatcattaagtgagaagctgcccacatgaagagttgccctaggcccccgaatgtgactaaaacacagcccaagaaggccgctacagctgcaattccatgcctgtgctgaggcccctgcgtgtctagcgccactgtactcttcgactccaaggtgtaccattcatgtggaaggctatgtaaatcatgcttcttggagggaggccaggccacagccctgcaggtgggcacatcctgtatcagtccattctcatgttactgataaagacatacctaagagtgggtaatttctaaaggaaaggggatttttttttttggtgtcgttgttttttttttttttttttgacagagtctggctctgtcgcccaggctggagtgcagtggtgtaatctcagctcactgcaagctctgcctcccgggttcatgccattctcctgcctcagcctcccgagtagctgggactacaggcacctgccaccatgcctggctaattttttctattttttagtagagatggggtttcaccgtgttagccaggatggtctcaatctcatgaccttgtgatccgcccacctcggcctcccaaagtgctaggattacaggcctgagccactgtgcccggccaaggaaagaggtttaatggactcacagttccacgtggctggggaggcctcacaattatgtcagaaggcaaggaggagcaagttacatcttacatggatggcgacaggcaaagagggagagcttgtgcaaaggaactcctttttataaaaccatcagatctcgtgaggcttattcactatcatgagaacagcaaaggaaagacctgcccccacgattcaattacctctcactggatccctcccatgacacgtgggaattgtgggagctacaattcaagatgagatttgggtggggacacagccaaaccatatcacatgccttgatggccatgcagaacactcatctctctctttgctcacctataactggggcagtctgatttcagaatcatacactccatgttctcaccacatcctataagccaagttcatggaggcacacatttatgtggtgaaagtccatctctataaacgtatccatagattcctcacagagaaaaagatatgaatgctggttaaagtaataactccctcatctctggggagtatgggaaggtcctgaaagagcccctaagttatgcttgatttactgcaaaaagtgtttgctggttgagagcagacatatccctccctcaacttctctctcatgtttggagagacaacccaggtgcagttaacaagagaacctctttgcatttgcatagcactcaagcatctgcagcacagagccaatcagagccttgccttagctcctggatgcaggcaaggcttacttgcctcaggtctatgttatccaggcaaggggaagacaaggagggcagtaagagcctgctccaactgtggtccccttataaagagctctccaaaaggccccaccctccaccactctgctttacatctcactggctaacacttggtcacatgaccacactcagctgcaagaggggcatagtcttttagcactcacatcattgccagaaaaaaataatcccatctcaggaagtaagaaggtacaaacagatattggttagcagtctcttccacttggctccttttttacaggtgatgaagcacagaatgattaagaaacttgtccaagtaaacagcagaaccaggacttgaaatccaggttttcccaaccaacctccaataccctgtccactacttccttaactgaccttctgcaccactgaggtttctgcacaaatcactgccagatgctattaacaaggcagtatcctccctccctcaagcaatctcacacacatacatatgccctcctccatctccctgggctcatcaggatcacctcattttctaaaataaatctgtcacctccatcaatcatgaaaaacaattgctcaatcagctgcagtagagggggccttttcaaatcagggattggactaaactggaattgaccagcagattcatttcaatcatcaccttgacagttacaggcagacacagtcacagaggccagggttgttgaaagactcagcatgcacaagaaaagtgcttttattctctgctgcttgcatttctgtcttggctctgcagggacaataaagcagaggtcatctcctaagctgctctgagatgcccaagaatacttatgcaaagataaagtagaagagaaaaagcaatttccttcctatatttttaagttctcaggaaaacaaccacagtggagaaaatactcatctctgccagtgtgtcaaagaatgacaacggccaggcaaatgcaattggatcttatgtgttcacagtgagaaaagaacacaattaagaaaccccagcaatacctgaattcttgaggaagtgcatagacctccatttctctggcgaagctctccagagaggcccccaaaataaactaaaggctactttattcactcacttttcaaatgggtgagtgaataaagtagcctttagtttattttacacgtgtaattaaatggctcttatatctgaatggtgtcagattataaagggttctataaacaaaaagcattttgataaaggaaagtgaatttggtatatattattgtgagagaaaaagataaatgcctttacagatggaaagtctaaaaatgatggtattgaatgtgacaacggacatatattaaactagaataaataggaattaacaaacatggccaaacccctattgcttgtcaaagtcagatataagaaaatataggcataccctattgatctcaaatgtcagaatcaatggacatttgtttaacttctacttaccaacaactgtcatggatattttctcaaatgttttccatttagtgactgtttcaaatctatgagctagtcatattttgttcccattttacagatgagaaagctgaggctcaaagagattaagcaacagtcattaagggacagaggcaggggcaggtctggaatccacttgctgtgattacaagcccagtgaggtttctgtgccttgagcagttgccttttctagaacattactaatgatattcaaggcaggttgtattgctgagcagagacactggaagcttcatctaggttcaaagtttgggtgtgccactcattagctctgtgaccatggacaagtgacttccttctccaagcttcaccctcatccttaaaaaagggataatatggccaggcacagtggctcatgcctataatcccagcactttgggaggctgaggtgggtggatcatctgaggtcaggagttcaagatcagcctggccaaaatggtaaaaccccatctttactaaaactaaaaaaaattagctgggcttggtggtgtgtgcctgcaatcccagctactcaggaggctgaggcatgagaattgcttgaacccgggaggtggaggttgcagtgagccgagatggtgccactgcactccagcctgggcaacagagcgagactccacctcaaaaaaacaaaaacaaaaacaaacaaaaaaaacaaaaaaaaaaaggaagatggatgatactatatcttcaattgctattaataagtagagaatgtaggtaaaatgcctgccacatattgtttctattctattcaaatgacaaaaaaaatggtctattaaacattcattatgaaatcaggatacttggagagattcctttaaggggaattatctgctctgaatccacattgccatttgcatgcttagaccacgtagcccttcattcatttaacagaacctccttgagtacttacttgctcaatgctggaccatgctgggcactgaggtaccagagcttagaagacactgtgatcactaccctgaggaatgtgctgagggatggtgcacgaagcagggtgttgtaactttccagcctgcatctggttatgattgctgtggctctctggattctttctgccactggttgctgatttcctgtttccctctcagagcatccccctccccttcactcatgagtcccagagctcctagaaactccaatctgtgctgtcagaaccaatcctactcatcacattcctttctttgctgctgggaggctactgaagacattgatgcctatggtgcctctgatagcaggccaaatcaagggcctgatggttgccaagggtgagtccctgcctttgtgtcacctcccccatctttgtgtcacatcacttagtgcagatttcctgaacagtgtgtccttcagttcatatgaggtgcatgtggtagaataatcagaatggatctggcaacactcagacctaaccctaaggacctcataaaaggcaaatttcccagcattctctttctccatcataactttccaggactgaccagtgctctaccagttaatagcactgacagcctacatcatgtgtgaagtcctgtgctctgtactgggaacccagcagataaataagactaacagactgatatgatttggctatgtccccaaccaaatctcatcttgaactgtagttcccatagtactcacatgtcgtgggagggacccagtgggaggttattgaaccatagaggcggttacccccatgctgctgttctcatggtagtgagttctcatgaaatctgatggttttataaggggcttttcccccacttgccctacacttctccttgctgccaccatgtgaagaaggacatgtttgcttccccttccatgcttgtaagtttcctgaggcctcctaagtcctgcaaaactgtgagtcaattcaacctcttttctttataaattacctagtcttgggtatgtctttattagcagcatgagaacagactaatacacacaccttcagtcttgtatggcttacagcctatcaaggacagcatcaagtatcacagaattgagtgataataaaaagaaaaaggtagatgatcttgcaatcatcaggtgcaaattcatggcagcaggcagctaaggagtggaaggctggaggtcaaggagaagcccacagatgtgtctgatcttcacaggccagtctagttgtggaattctccctgacagcgtattaagatacacctgcattctacctttgagagtaactggaatatttttgtcataaaattattttgaactatttaaaaaatagtttcattttcaacatcacttggtttccaagaacttaataatttatcactgtctgtggtttctctaatcactttgttcctttgggaattcttgatctgcgaggaaaactaacccacagtttatcgttaagtgtaatgaaattttttgaacagtaaatttgacaatatctataaaggcatgtagacacatatgtcatagataacgaattcttgttagcttcaattattcagtattctttttacatttttgagtcaacatattgcttttccaggccgtaaaacatttccataagtcctgaaatctcctgaccacaaagtaaaataaggaaaaagggcgcagaaagggagcaggacaggacaggggaggctggagaagctcttgcagggcttcaaatggcaggaaaggtagtgacaacactcccaggatgttagaggccatggaaactatgtaaactgagggagaaatcaggctaggtttggtgttgggatgctccccattgctgtcccatagagaatgaacagcagcaaggacatgaagttggtaattagcacccaggaggagaaggctggtagaaaggtccaagaatgatgcaagaaggctctccctagcacagtgcattcaaggatgaagaaaacaaaaaacaaaaaacaaaaaacactgtcccagacaggcaggcaggcaggcaacttagggaggacctctcaaaaagctgcagtggaacaaggaagtagcaactggccacaaatgagaacatcccacaccagacatccagggccactctacccccagaacccactcattgagggcacgaaactattcaagcggatggttactacagagaggggtagggacaagcgaaagagttatctctttgcagactgcactacgtccaacacatccagacaataccagctttgctggataactatttttcctgtgtacctatcatgttctgggcaccttgaatgactctctacatatctgttcattaaagcctcacaggagcccactgagatgggtacagttattccaaatgtatagataaggaattagcccagagaagtttagtaagttgctcaggttcacacagctggtaagtagtgagatgagagtttaaatctggaaggtcatactctccttggaatatcctgtggcttcccaaagcccactaacatcagggcaagaatatcactactacccgcattgaagagaaatttatagattatatcttattgcattaatgttatatgcatttaaattcactttcccatttagtcatcacgagaccttcttcagcaatgacaattcaatggatccaatcatatcatggtgtatttgatcctatcagcaatgagacatgtaataccccttccaccctgaaaaggtccatttcaatggaccaaaaatggaaaggtatggaagtagcaaaattaaatcacatttaaaaatacatcatcatctactggaaaagaaaaaatagtaataatctgccttagaaatttgccagatctcagctgggtgcagtggctcacgcctgtaatcccagcacattgggaggccaaggcaggtggatcacttgagttcaggagttggagaccagcctggccaaacatggtgaaaccttgtctctattaaaaatacaaaaactggccgggcatggtagtgcacccctgtaatctcagctacttgggaggctgaggcaggagaatcacttgaaactgggaggcagagattgcagtgagccgagattgcaccactgcactccagcctgggtgacagagcaagactccatctttttaagaaaaaaagaaatttaccagatctcatatttataccttggttatgggtgtaaaataaaacatgagacttcaatgaatagtggcagcaaagactcctcaggccacatctgtgaatgggagagtaaaactggagaaaaaagaaacagatctaaaggataaggagggaacatgcacagtagtatggctgattgggtgtaaaggctaaggatggtgaggggtggattccaaatgactctcaggtttctgatctgggcaaacagtatgatgtttaccaaattggagtagctatttaccaaataggagtagaccattttcagcatcaacctataatgttgaggtaggtagaaaacaggtaggaaaagtagtcaggcataaggacttgaagttcagaagtggggatatattcatgtcttgttgaagtcatggaacaggtaagacatctaggaagagtttgtgtaatgaagagagaattgggcagaggacacagccctaagaaataccatcaagtgcagaaatcagagatgagaaacagtggacatatgatccttgaagcaagttctcaatgcacatgagctggatagagcttttattttaaaaataaagctgacatgcagctcacagggaggtaaaggtggaaaatctccctattgaccctggtagatgggattgttcttaggtatggaggcatggccttttcttccttaagagggagaaaagctgaggcaagataggaaagccctaaggaaaatagagggatggatgtgggagagaaaatgtcaggtgctaaaaattcagagcctgcctaagccaagcctaaaggaaagataagagcctgcaaatatttgacatgtgttaacgccagtaagggagagaatggattccgctccaaatagggggttgagacttacaagtagtgataagaaataaaagccattgattatcagctccaaacaccaaaccacttgtttgcagagttattgtctcaggaaaacagagaagaataaaggcagaatgtcaactcataatagctatagatgggcatgtccaaataaacaaagctgctcatccactgttgaaggcagggtgaaaactgacccaatttttgaagaactgtctcaaagtcttgaaaatgctcactgacccagcaaggacggttccaggaatttattccaggaaaaaatattacatatgtgcacatatattagtatctttcaggatgctgattacagcttttaaaaattaggaaaaacttacatgtctggaaatcaaagttaggatgaaatcaattgtacatctatataacagtatattaagactgtaatcaaaacaatgcctccactctctcacccccttttcacctatcatatgacactggcttttgcctgcttatatttttaatatctgttaatgccaagtcacccatcactccaacactgacaaatccaagtgatatggtttggctgtgtccccacccaaatatcatcttgaattgtagttcccataatccccatgtgtcgagggtgggaccaggtggaggtaattgaatcatgggagtggttgcccccatcctgttcttgtgatggtgagtgatttctcatgagatctgatggttttataagggttttccccctttgctccacacttctacttcctgccaccatgtgaaaaaggatgtatttacttcctgtcccaccattattgtaggtttcctgaggcctcctaagccctgtggaacagggagtcaattaaacctctttcctttacaaattgcccactgtctggtagttctttatagtagtgtgaggacggactaatacaccaaggggaccctttggagcacctcttactcaatccttcagagttggctactttctccatcctcagttttgctgttgacctgagggcatcacaacttccttgttttcctcctgcttttagttgttcgttcatggtcttcttttcaggctctttcttcacaacccaaccttatggtggtggcattccctgggattggcctctcttgtctctccacatgctttatctaggttgatggcatttattagtatggctttgtgggggggaaaaatctgtgcttcaatgaaaaactgcattgtttatagctcatgcttccttgttatcagattctgattctatgggagctgtttcccaactctggaaattgtagataactgataataatgcagaataattcttgtccatagatatgcaaatggttccatgatcaggaagagggacaaccttgctccctcaaggaaaaaaagctagttttgcttccatttgcatattcctgaagtatacagatctcttacctttgaattttcctctgtactggctgtaacacctcaccagtttcttcattaatgaattaaatgcaatcatgttcatttttacatctctgtgaggtttacctttttttttttttttaccttttcttaagaaaagtaccttgattttaccttttcttgaaaattatcttttaacagttttaagttatatctagagccaaagaacccaaatgtatgtctctatcactgacttgtacatatatctaactgattcttcttattggaagtaatgttctctaaagttgcactgaattactgaatattgaacccatggctcctaggagaaatacaaagttcagttcctgtgagcctctgctcacaatgcttttgtcaaatgattaatatagaaccttgtttatgtacataaccttgttctgtgtgtttctgtttaaagacagcttacttaacagattttgtcaattcattaacattgaactgacagccagcagccctgtaactcaggcctgaacaaagctcatttaatatacctattttctctgcaaagcacatcacagccttcttgcgcttaggaacatcagatgacacttcagcactacacttgggggccacttaaagcagcaaaatcaccaacagcacaaaaatgtgaaaaacataacactaaataaaccatgaaaagcacactcgtttacagtaggggagctgaaacaagaaggcagagtgctacctctgaccccagctagtaatatgtgcactgggcaaccaaaagttttcactgttccgtgcaggtctgtgaatgactgggagagaaccaagagtactgatgttggtgttacaaataaattttagtgagtagataaacttgcaaatatgaaatctgcaaataatgaaaactgtatttctgtatctatattaaatgtaatgtatgtctcccccattagtattcaggatccataaaaactaagaccatatctattcaattctattatatattattcaatttaatatttgcatttattgaagtaaaaaggtacttgagtacatagaaaaatattcattatacattgttttaaagtgtgttactcaacaacatttacatattagctcagttttgtccagggagatatatctgtctgtattaagaaaagtaaaccctaatggaaagaaatgtctcaaaattttgtataatctccatgtggtggggttcatggtttctttttacatccttttttagtgtttttctgtatcttccaaaataaaataatgaaaacatatttttttcatcattgctacgaaatgccattaagacgtgaatacctgccttaacttttccactatatacagcagaagtttgaacagctccaggcaccaggaactctctaactctcaaaaaaaacatctgggtcagcacctccagcctgctcatatgacagctttaatagctcatccccatagggcctggtgctctcctaggtaatatctttcatctatctttggaatatgtggccagaattaaatgtcatggtcttgggatattttgtgtgacatattacaggcatcccactgcacactcagtctgaaccctaaactcccataatacagaataccgttaccttgatagccacacctaattaagaatgtacactcatccactcttcaaactaccagatgcgccagccagacacagaggtctgtcctcagggagttagagtctaatctattcaagacagtgggatggtctttcccagcctgtgggaggtctttagatgtctaagctgccatggctttggtcaaatgctttggggtgggtgcggggaaagtcaaatccatgtaccaactataaaaggtaattaagggttatgttattgacttcttccttctaagggatattcctctgggctcaattttattgtgtttagttcatatacagtcctatataaaatagtgtgggtcaagtttaaatggattcgctgcttaaccttcaaataaaaaaaattcaattaatcagagctcttgcctcctccatcccatcgccaccacctttcccccatgctgtctggttaatccaagattcacagcacatagaaaccttctgtagtgaacagacggcaggagtcaggtgagtctggggtcaggagatgctatttcacagctattacgagatttgagatttggggaaaattactttactcctcagagcctcagtgtccctgtgtaaaatgacagtgatcatctgaattaagtcgcagggaaactgtgaggaccaatagaaattgtgcttataaagggctctaggaagattgtactgtaaaggctatgcaagagcaggtggtgctggccacgtggaaggggctggagctttcctcccaaaataaatttccctaacagggtgtctgctccaccattatgtctacaagttcagaagatttgtaaatatggcacccactctgataggttctcttacagctgtgaagcttctttgggtcaggctctaagcttccatcccttctccctcccaagaaactcccatactctccctccccagtccatcactgtttggggtattgtaagcttattccagcaacggtgctggaataataggttaaatactgaaaaacaaagttgaaacttccctttataccaaagaccaaaacaaaccctctattagttaatgagctaaatataagacatgaaaccattaaaaaagccaacttggtaacagttgttatcactgagtgatgctttgttggattcttttcattgttgtgtgtatatttttatgattttccaacttttctccagtgcacacatttgtctccacaacattcattcatgcatgcaacacctatttattgcatccctccaggtgccatccatgattccaggcactggtgaccagaacagacaaggtaacgatccctggggagtatatagtctaatggaaagggcaagtaataaacaaatacacacacagataagtagacaactatgaattagggtaagtttggtaaacagtgttttttgtttgtttgtttgtttttattttttcttgagacagagtctcactttgtcgtccaggctggagggcagtggcatgatgtcggctcactgcaacctctgcctcctgggtttaagtgattctcctgcctcagcctcccaagtagctgggactacagacgcatgccaccacgcccgtctaatttttgcattttagtagagatcgggtttcaccatattggccagcctggtctagaactcctgaccttgtgatccacctgccccagactcccaaagtgctggtattacaggtgtgagccaccgcacccagccgtaaacagtgttttaaatggttaaaatggagagtgaggaggaggaagctagaccaacaaggtcctttgcgaagtgacttttaaagggacatgtaaagggcaatgatgagttaactagttcacacaaaacttttctgtaaaatatttattttatgctgtagagtgaccaatgagactaaagggcatatggagcatgattacatgagaatgaggtcagtgactaaaagggaatagacacaagcaaaaaatatatatttaattggaatatgaaatacatttcctattttcaaaaggttactttcaaatttcaaaaatgtgctacctctttttttcaagtataaagatgaagaagataaagaagtaaaatggcagccaccaccagagtagttatagtggctgcatccattttccgccctaagcccaggtgggaaaagggttggctggaaaagttacaagcttctaatgattaagaagccccatcaaggaaaatctacatggccgtggtggatggacaaccactctctggtggattcccattgaccttcgagaccccctaactcccactctcacctcctgctacacctcatctcaagaatctcaggatgacttgtggctcaagccaatagtgggtgggatttagaaacaactgacactctggttttcctcttttctgtcaggcagagtctttttctctgcaccaagccaggtttgggctcactgctcaggataactctcccattcttctcactgcagggagacctctgcgttccagaatggccagcaatggacagggtgcccttggcttcctctggctcaggcatcattttggctgaggctgcataccaagctcttgatagagtgagctttgtgaacacagcaaagggctagcccctcagactcatggcaatgaggatttttggggtttaatggtgaggaaggcctagggcctaggtaatgagagagaaactgaaaaaagatagcatactgtcctcttaatatgttgtaccagttaactcacctgcagaaatgcctgttaagagcctacttcgttccttgccaaaactggttactaccagtttgaaacatataagtaggtaatatattgataatgagagagaaagtgagcccctaggtgttaaagtaccaaaggctccaatttactaagcacctactaagttctaagcattgtacttagagttctatggtcagctgggtccagagcaggactctaatcggactcagtaggccccaacctcagctacttcctaaactgtgtgacttggagcaaaacactaaatctctctggccttggtagtaatggtcatgataaaacctacctcatggggttataggtttgcaggcaaagtcagtggggtaagccttgcagagcattattagccatcattaatattaatgacctgtatttctatccagtgaggtaagcagcattatactaattaacagagggggaaactgattcacagaggtcaagcaattgcccaaggctgtccagcatcctaaggagtgaatctagcattaaaactctgatgggactgaaagcaaaccccctatttaactgtcccttactctatttgaacactgagcttgaagcttggtttgcatctcagggcttagcaaatttgggactgtttctgtactgtccaaaaatgtcaatgattcactaactaataaaaataccctcatatagagtgttttacaatttataacaatcattcacattcacatttgactccaatgggtacaacaatttctaaattatataaatttttgtgacccacagtctcaatacctgaatatatgtgtgtgtgtgtgtgtgtgtatgtgtgtgtgtatttatatatatacatgaatatatatacataatatacagacatatatatggcatgtctgtctctgtacctatacccaagggcagataggttaaaatacatattttaagaagggttgtttccattcaaagaaacactttgatctcagaatgagccgccctcccccaaccccacttaatgttcagttcagtgcaaaagatgtacaaagaggggcctggaaatagagtctagagaaagttgaactgctctaggaacttgaatgagaagactttgctgcacctgtgggcaatttgggagggaggaaacagaaagaggtgaaaatttcttgcctgttgaaaggacttttaaagtctgagaaaggatgagttctatgctgggcaggacggcaatgcgaccccttgcctgagtcccaccaaacaccaagagaagtttgctgctgcaggaaacagcctttgttatgtggcttcggcagggtggtgtggaagggcccaggtccacatttggttcagttaggggagccagaagaatttgactgatgttctagaatccagggcaggcagtgaacaggggctcatgtgctctttttgaaatctccatgtgcagaatttgaaatggggagttctggtcaatacttcatagatttcactggtaaactggccccagctgatatgcggtctgtgtatttatatttcacaaaactgacacagtaattacttacactcgtggttttgtaggctcttttttttaaaacttcctacagcatgaacattaacccatgccattagatacatataccacaaaaacagtttgtaacaatactagcatagaattccactgtgtgtgtgcaccaaaatttacttaactactctccaatcgttggtgcatttaagtgatttccaagtctttgtccttataaataatgcagtgatgatctctgtctgaaactctcttttgagcagctctgattattttgctagaaaaaaaattagcaaattgtcctcttaacatgctgtaccagttaacttacctgcagaaatgcctgtaagaacctgctttgttattccttaccaatactgcttattaacaatttaaaaaatatataggtaggtaatatgatagataaaatgcatttatttgatcatctgtaacactggacatttttaatacgctttttgctattcatattttgtttagcaattacctctttatgcctttagcctttttttctatcaatgtgattacattttaaagttagagctttttatgtgtaaagatattttatctcccttttctcagttttgtcacatgttttcccacaccagtttactaacctgctttttgattttagttaacatggcatagaagatttttctttttcttgtctttctatgtagtaaaatgtgtaaaccatgacctcaatggtgtatttgcttgcttttaatgaactgagagtctctcccaataaaagaatgatattttctttatttttttctagttttgccttttaagtttttaaactacccataatttaattagcacatggtaatatatgcaataaattctattttttacaaagtatcttaccatgtacaatttattaatcatgtactatttgataagcaattttcaattcatataaattttttatttttgtaaagctggggtcctgctatgttgcccaggctggtcttgaactcctgggctcaagtgatccttctgccctggcctcccaaagtgtcatataaattttaaaagtcaccagtggaacagaacagagccctcagaaataatgccacatatctacaactatctgatctttgacaaacctgacaaaaacaagaaatggggaaatgactccctatttaataaatggttttgggaaaaccgggtagccatatgtagaaagctgaaactggatcccctccttacacgccttacacaaaaattaattcaagatggattaaagacttaaatgttagatctaaaaccacaaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaaaagtgggcaaaggatatgaacagacacttctcaaaagaagacatttatgcagccaaaagatgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctagaactggaaataccatttgacccagccatccaattactgggtatatacccaaaggattataaaacatgctgctataaagacacatgcacatgtatgtttattgcggcactaatcacaatagcacagacttggaaccaacccaaatgtccaacagtgatagactggattaagaaaatgtggcacatatacaccatggaatactatgcagccataaaaaatgatgagttcctgtcctttgtagggacatggatgaagctgaaaatcatcattctcagcaaactctcgcaaggacaaaaaaccaaacaccacatgttctcactcataggtgggaattgaacaatgagaacacatggacacaggagggggaacatcacacaccagggcctgttgtggggtggggggagggggagggatagcattaggagatatacctaatgttaaatgacgagttaatgggtgcagcacaccaacatggcacatgtatacatatgtaacaaacctgcacgttgtgcacatgtaccgtaaaacttaaagtataataaaaaaataaaaataaaaaataaaggctgaaagaaagaagaaaataaaataaaattagttatgtaacatctcatcataagttgtttataagaccaatcacacaggacctgttatgaaaattccatacttgtaaagtgctacccagagcctgacacgtggttggcactctatatgtatgagtttcttttaaatttatttgggatatttgaatgcctatttatttttgtgaaagggtttatgtttcaaaaattaaaaaaatatactttcattcatgcatcaaaaaaaaattttaaagtcagttttgctatgtactgtattcatttctgggctttaattattatagtttttacaaatgttgacatttcacagagaaaccctccaatcactttttctaagtgctcttgacttctttctcctgtattttctttcagatcaacttttaaatcactttaagtttcaaaatgaatcccattaagattttgattagaactgtattaaacccatcaattaatttgggaaggattgctatcctcacaatattaaatttgctaatccaacaacatgacatatggccatttgttcaggtcttgttttctcatcctcaataaaactttgtaggtgtttgtattttcatatacatgctgcacaattcttagcttacacttaagtgtttatactgtaattacatttaagaataggatacattttattatagttttataatggttattactggcatatggctatttatttttgtttatttgctttgtgtctgaccatagcattgaaatcttttagtagttccaatagcttgttttttcagttaagtttattctcttaggcattgaggctataagaacgttttcttctggaaataagaaggtgcctttccatttctagcttactaagaattctgatcagtaatgaaggctgaatcttttcaaattactttttagcctctcttgagaggctcagatgatttttattttttggcctactaatatgaggcattacatccatagtttttctaatattcaacatttttcatcagtgtattcctggaaaacacccaactgggccatggtgcattatgcattgataatgattctggatttcaggagctagagctttgcagctgtgcagttaagggttccattttcatccgggccatttgagcaagtgtgtggccttgggcaagtcacctacctcctagacagtgagtggaggaattatacctccctcacaagcttgctgcaagaattacaagtaaaatattcaaaacaagctcaacactataagccttgcatacagtagatacccctcaaattggcagccactgttttcatcactataatcatacactttctttacattgtcatctcaagtgtgacagagctgtaagagtgattgaactctaattttaatatatttgggatgctattttttaaaaatccagagagcttgataaacactgttagcttttactatctttaatgcttctctgtgactcactttttcttcaaatttcaaccctgaaatttagaagaagttgagggattacttgttgacttactattgtaactgaataaagatttagttgcttgctgcttgcggagttcaattaacaagagcaagatctggtagaaagaaaagtgactttattccagagctagctgaagggcagtagtgcagtctccttcctcagggtgccactttgcttccaggcagaaagcagaggcttttaaaggaaggcttggagtgaagggcacgcaggggagagggcgaggaagtgcagggtctatgtgacttttcagatttcttatctatccggaggtctcactagtgccatcatgggcagagtgaggttgtaaatggtggcaatctcctattgggatagaattctggatgtgcctggtttgcttcaagtttcagtctctggaacttctaagtaacacatagttagacagacttgctgtgttggaagtgtctggtggagagaaggtaaagattatactttcattcctaaacagctaagtaggtggtggggggaaagaaaaaaagttaaacaattgattttttcccttttaaaaacgaggtgctaagttacactattgcacttcatcttctaggaggccctggctccctaaggagcatggagtggcagaaaaatctaaaagtgcaactggatgtctaatagggcttttcctgttgctttggaattttatctaagactacaaaaccaataagcatacaaaataaacactgccaccttctacagagaagacctgagggacttccagctatttcttccagagaacactaagaggttcccaagcggactctcactcttccctcccagcactacagtcagctcatacaataatgagacttcatgggttaggggaagtgagtctctgggattatgaattataggtttaaagagagagagctttatgttttgcctctttcttaagccaagggagagggactccaatggtgccaacagtagacatcgtgcgacagtgggaggggagagagggtctgcaagaagaggagatgaacatcttatgccctcacaggtgcttgtccgtctgcggataattctttttttttttttaaggcggagtctcgctctgtcgtccaggctggagtacagtggcacaatctcggctcactgcaagctccgcctcctgggttcacgccattctcctgcctcagcctcccgagtagctgggactacaggcgcccgccaccacgcccagctaatttttttttttttttttttttttttgtatttttagtagagatggggtttcactgtgttggccaggatggtctcgatctcctgacctcatgatccgcccgcctcggcctcccaaagtgctgggattacaggcgtgagtcaccacgccgtgcccagataattcttatggcgtctcaatcagaggctccataaccgagtatgatcagagcaggttttctcccttctttagctttcatctctcttccgtggtcctacaacccagaggaagcagagagtgcagcagcagcaaaacaagttcggtaggtgatgcaagaactgccagaaccctttctccacatctttttgaggaagtgctggtcataatccatcttctgtgactgccttcaatctaggttcacctgcactgcacaagcaactatgtcccttcgagcatggtgtggcatgcatgaaagtcccctccttccctagatcctcatggtcttgaaaatttctccattggtctttagaatccattaactctatggctttgattctgggtgggatagtgagtccattttcatttctactggctactgtttccatgttccccgaagatttatggatcatctcaccagaattacagtacagcagagatggaggttagatgtctgtgttcatactaccctcctgcccagaaggatgtcccattttacttctaattcagaaccctaagagttaggccaagttatgttcctcccattttatagatggtgccgccaaggcatagagaaatgaagaagaaaaactcacgagactagttaagtgatgctgttctattttctagaccttcaattacctctttttataattctctgcctctactctgtcctagaactgcatgttgccctgaaagacccttgcctgtgggacccacaggcttttcagagaacacagagaccacctgaggctgcttattgcagagagtctggattcacttccaatccctttttgctctgggcttgaaaggcctcattcttacaagccttggcctcctcaaagagagaagcatctgcgtaacatggttctccctcttacctgagactagagacaattataaaaaggacaattcccatcccccttaccccgtgccctatatcatgaaataccctcacagctacacgtcgaggactccacaacatgcacacagccacatgtcttaccttctcagcagtgatcagagcttgttgctaaaccaccactgtctaagaaagtacacagagtagcagctagagaaatccttcttaaaacagggtccatcatgctacagtgaaggaaatcaggttctgacatcctttccccaggcctaagatttatttctaaataatgtttattaaagggcccctaagttcccggttctctgcaaggcatataacttatctcactgaagctttccaacaaaatggtgcattataatatcccttagatggaagaaaataaattgagtcacagagagatggtgtaacacatcccggtcacccagccagcaagtgcccagcttgaaataaaaaccagattatttttggctctaaagcctctatccttttcattcaattctaatgactactctcacttcattgagcccagcaatttgaatttatcttttttatccccctggagaaaagagagaggtagacacatatcactgcaagtagaaatccataaatatgtaaataaaatagaacatgcaatcaaccctcaggtggagggaataggaagagagccctccaaatcaacagcgtatgtggtgtctctggctgtacaaagccacttttcacttggagagctgggactccgcaagactacaatgaagtgggttcccaggcaaggggcctttgattgacacgcaagggggacgggctaagattacgtgacttgctggattgttgatttgtgattctgtaactataatcggagtggcctggggtctgcgtcaagcgaagtttggggggataaaagaaagcaatgtctggggattaagtgagacaactgagtggctgaagacctgtttttgagatgaggaggaaaacctgggagcaaaacttacaagtgggtgtttcaaggaggcctatttgagggtaacaatgaggaagagcttcttctatctaatgctagatgatagtcttaagacaccaacaagctggtacccaagccattgaaagtggtacctgcaggagaggtacagggccaagttggacccatgtggtgtccctatctcttgtcacctcacctgctttctccagttactgacctcggcatccactgcccttggttctcactgtggactcccaatagttaatgctagcagcctgcctactgcccccactcttttaaacctaatggacactctgtgtataatccatccagagctgtacgataaccaagctaacactggatagaggataatagtcaccacccgagatctccagcagtgaaatggtctgccatggaagagtgtaaacttcccatcagaggcagcattcaaggtgaggctgggtgggcaacacacagcaattctaagacccaactcctatcacagaaagtctgctgttggggatgtgctggaggaaaccacacaatgctctagacaagagagtctctgagatcccagaccacagcatgaactctgaaatgggattttccaggagatgatgaacaacaaaagaatatgggtccaccttcaagatgccaattagttctgagaagtggacaaggaagacttcctgttttgatataattattcataatcatagcatccataacaatagcagcaaccaataacactttggttcactataggcagctaaagaacattttgagtttgatatacatgatcgcatttgctctcatacctatatctcatgaaagatggtgaatgattaaactaaggaaaagaaacaaaatgataaataaaaatataagaaatggattatctcaacagaacagcatgaagacacagacttaaattgctttcatcagtactaagaagtccctttgatcctaaagtccaagtgaaatcaggtagtccgcatggaagaggcagttatctgctgatctctcctgagctccagatttatatattcccatcacctgctatacatcttcacctccaacacaacatattcagacctgagctcatttccttttgtgtttttcggctcagaaaattgtttcaccactgtgatggttaataatgagtgtcaacttgattggattgaaggatgcaaagcattgttcctgggtatgtctgtgagggtgttgccaaagaagattaacatttgagtcagtggactgggaaaggcagacccaccctcaatctgggtgaacacaatctaatcagctgccagcatggccagaataaaagcaggcagaacatgtaaagactagactggcttagtctactggcctacatctttctcccatattggatgcttcctgtccttgtacatcagactccaagttcttcagctttgggactcggactggcttcctttctccacagtttgtagacagcctagacctcaccttgtgatcgtgtgagtcaatactccttaataaactttcctttatagatacatctgtcctattagttctgtccctataaagaaccctgactaatacaaccactcatctctcagccatctaaactgaagcatgggagtatcacctttgactccctactcccaaccccacatccctcgattcctatctgatcatctgtacagtttctggtttaactggctgggagtcttgctctgaactccagcctactgggctgggatgctgcgctacaggcaaacacttgacaatctcccccttaagggttaaggaggaggtatcctttgggttaagggaaggatagccttcccttagtaccccagaattttcttaatcagtgacctctcaaaactggcagagccagaatgcatccccacctgccttagctgaattgcctctctagcatcttcttgtgctacgcccaagcttgtagcctactgctgccaagtctctgcctgctactagcatgtccttactaagccaacctctgccaccagtgcctagcacagaatttggcacaaagaaaagactaagtaaatgtttgatagaaaggagtgaaacttttgtgtagtagttattcattctcagctgatctccatagtcaccaacctccttactacccaatgccactctcaagaggacacttgtgggcagaggaggtccccagggctgaagactccatcaagtcctgtggtgaagagtttctctggccaagagacctagcatttaaccgattggtgaccttcatccaactattctgagtctcagttttcctcccatctacatctcagagctgctgcaaagaccaagctatggaatgaacatccttccaaagagccatgttggcttgtcactatacataagttagtgtaaaacttgggtatgaaatgacatcactcagtggaatccttacagcaaatttctaggctcaaccccagaatttctgatttattacgtcgggggacaggtctgagaatgtgcatttctaacaagttcccaggggaatatttgtcttaatccatctaggttgcagtaacagaataccatagactgggtaacttataaacaacagaaatttactttttatagttctgagggctggaaagtccaatatcaaggtgccagcagattaagtgtctagtgagggcccatttcctgggtcctcacatggcagaagacatgaaggagcattttggggcctcttttgtaagggcattgatctcattcatcagtattctgccctgatgacataattagtacccaaatgccccacctcctaatatcatcatttcgagggttagaatttcaacatatgaattttaaaggaacacaagtattcagtctatagcaatactgatgctgctggtcgagggaccacactttgagaaccaccgcccaagatgattctaagaccatttctctttccatgctgacgctgtttttcctccatgaagcatgctatttcaatgcttgcctttatgttttacctttttttgctgttttgttggaatcctaacccagcctgtaaattcctctgggcagaaattataccttccactctacatactctctcactttctgttttgtaaaataatgagtacatttccagcgtgattaataatagaataggaaaaggaggaaaatctcagactaccaacaccaataaacaccacctacaaatagataccagccctggaattctcttaaaaattaattacgaggcaaaaaacattccaccatcagtggcgatgcaggaaggaagattatcttcttgatgacacattttgtaaaatgtgaattattcaagattttagctgtaacttaaacaccaacgttttttaaaaataaaataccacaattgcattccaactcataatttttatattgatagccagattattgtgttttcaacatgtaaaatccattacacagtcatggcaacagtttgcaatagactgtaaatctttattgagatgatcatcttgcgattgaatttcaaaatgtattatatgatcatcagcaaataagtccacgggggctgctaaagtactttgaatatcatttataaagatcaaaaaccctggaaactcttacatttaccctgtggaaagagagaagtctcatcagcaggatcaaatcaattatttttatggatgaatattgcattgcaaagctgagataaggtattacccagtttagtaacatatcattatgtccttttaaagtagtaagtttcataatcaggtttcaatgaggaattttaccaaaggcctgttttgaaaataat

SEQ ID NO: 29 - DNA, 63940 bp, Homo sapiens
aaaagtgcttagacaaagaccagactgtttgtttcaaattgaaaatgggcatgaactgtgaatggctcgagattttgtaatttttaggaagactgtgggctaatttgcaattgaaaaatcacgagagccatttatagaatgaccactctgtattgaatagctatcgctttgtcttctgtacgccccttgcttttgtgaattgtcactctcctccatgttatcctgataggttgccaatcacctccccaactttcttgccataggggtacgtatgtgactttaggaaggacagtgagagcctgccattaaagactagaagtatctccagaccaccgttccaatttcttgaagggactcactagcaaatgaaaataacaaagagaaaagcagtgatgtgagtgggaagggaaaggggagagagggagagagggaggaaatgaagataggcataaggcaaatgccacccctgagcttttaaattatatgaaccatgaaattattctttggattagggtttttttttagttgagtttctatcagttgaatccaatagaatagatatcccacctcaaaacacacaaccagtgaatagcagacctagttgcattcttgatccaaagccaagttaccccctattaacccatggtatctcttgcctagacacaaattccgactggtacaaaggaaccactttggctcctggcacagacatttattgcattgcggggctaagctgcatcctttataggtagatctaagttttagaaattgctcaagattacacctgtggaaaaaaagagaaaacccagattacatctgtggaataaaactgaaagcccttccagaaaacactgaaaggaaataagcatgatgcactatgtatctatcatacacttggttttgaaagcatttctcagtgtgtctaagtctgatttgagccatggcctcctcattaccacaagtaaattgccaccaaaggaggcttctttgaaaagatacagggcacagaatgtggtcatcggaattggactcgattctccccttactgtgtgtataactgggtaatgtacttaacctctctatgcttcaggggcctggtgtataaattggggtaatgatagcttcttcatgcattgtttttcatagatgaaaggtaatcaaacacataaaacatctggaagaattcttgcacattgttgaccctcaacaaattatatatctctttatataaggggtatgttttatggatttatgcatattagacgttttaaggcattaatcctggtgtattgattaaaacatctgccttgttactctatcatcataccctgcaaagagctgggccactcccatttcatacacttccccgtgggctcattcttttagaaatagtcatcaggcacacacaaaaagcaatttaaatggttcatctttcctcttttcatccatagacaaatttcaataattatcttagtcaacccattaattagtctaaatttgcccaagcataattgatgctgcctacactattttctataaaaatttgaaatggatggctaaacagagattttttttgtttgtttgactaagtgcattttccctctatgcaaaatgtgttagtcaatgcttatctggtgtaataagcttagcttttagtgttcgtgtctacatctgtgatagaaagaagtttgaatctctaagttcaaattatgcattggcaatttctagcttgttgacttacggtctgccccttgaactctctgagaaaacctgtggccttacttgttgaatgggggtctggctgactagccctgccttctggaacccttcacctacctaggttttcccagataaacattggtatgactactatacccacatccttgagtactttgttttcctggaccttccccattccttgcttgtttgttttccctagggttccagtcattcttaatccctttctactatttagcaattcctggataatctgactgatctcaaactttcattaccacctatacatgaaggggatgcttctcttatgttaccatcagtctataacaccaactttgctgtgcatcattcttttctaacctctagagaattcttttcaacaggtgctgtgttcctcacagaaactattaagggaataaatatagggaaacctacaacagcataaaagcctcaaggtttgttgctggactcatgatgaagatgagaccagatgaaggaatacatgaaaggaataactttcaaaccagcttcctgagcaatttcagataccctgggaatcagatataggcaaacaatacctccttaacctgaattgggaagagagatggcagatgccactgaagacacatatgaagcacagagcaaaacatccagaagcaaacacaaacataaataaaaattcagaatctaaagatcgatcaatgcagcagaacaatgttacattattcaatagtcttgccataatgggttaagtgtgtgaaaaatatccaatcttatcccaaaataaatgctagatgaaataaagctctcagtgtagcacaaaagcaaacaaaaatgacaccacaatttagatgaatataaaattttttgcacgaaaatgtttttacaatacatcgaaaccaaaaccattaaaaataaatacatttaatcacataaaggatcatattttctcatgatcctaggccatcaacacattcaaaggcacatgtctaaattggaaaatatttgccatgcatagaaccaaccaagattaatgctgttaatacataaactgttcttacaaatcaatgagaaaactaatgagtatccccaaagaaaaatgtacaagggaagtaaattcgtagtttagaaaagaagaaatacaagtagccaggaagcatgaacaacagttccactttgggtatcaaagaaatgaaaattaaaacaataagatttttgatatatgatgtttttattcattaaaatgaaaaatagtctcaggtactggcaggcaagggcaataagaaccgccttgagtagcggtacagtcaattttagaggtcagcctggccctttttagtctatatctctattctacatctaaaatttcaaaatgtgaataagttttcacttggcaactctacttctaggaatttacctgaaagaatcatgtgaacttgcaatgacgcatgtacaacaatgctctctgaaatggtataataatggaaaattggaagtagcataaaattcaatgataggctagctcaaacaaaatctcttcccaaaagagttctttaaatttatttcttcttcctcactatgtgccattctgtgccaaacacacaccagtctttcttctccacacatttttcctttctttctcccacatatgcatttactttctctcagcccattttcactctctctcatttttaccttctatctcccccttccactcacatttactttccttcttactgaccatttttcttttctctaagccatttttgcttttcctctcatgcatgctgtcttcctttctcctttcccccaacactttttctttttctctgtcactgacttttaccttctctcttatatccatgtttacttcattctcacagttaatagttttacattctctctcttgcactttcattttctttcttacacatacttttacttgacctctctcccccacactttcactttctctcccacaccgtgacttttacacacacctttttatttttgttctcactcagttttcctctgtaacccagagaagagggtgaaatgtccagattagagtttatccagtcacggggcagccaggactgggttgagacctgaagcaggaggctgttgcagtattccaggatggagcttagttttttctaccaagcagcagtagcaggatggaggggaaaactgtggatgcagaagacatttctaaggtggagctgatgggtctgagcaaccgtttggtgaatgaatggtagcatctaagatgatgtcaaagtttctggcagggacagcagagtagaaaatgtcaccaaggccgcagaaagtggtaaaaggaaaaggcctgggtgttccttgatcctagagcacctatatctaaggcaatataatctttgcaggattttcagaccaaaaaaaacgttcttgggagaagagaaaagagtccgtaattgcctacagagagtccttgaattttgtttcttcaactgagcaattctccctcttgtatgccattcaggggcatccttaaaatatttttactccaatgtctataatactaatctgtatgtctttgtgtatccaaaaagcacttgtacccccaaacctactgaaattcttaaaaaaaaattctgtaaaacttaagcttcgtgcattaatggattttttaaaatagagctatcacaggataacaaattttgcccaccactagctaaatgctggctgcatcatctctttgcacaatgtcattgacacaattatatccccaaagggcttgcagactctgtgagggcagggaggctgtcctcactgctcagcacaggtcccaattgcctacaagagtaacagcctcttagtgggtactcaggaaatatgctgggatgaataaatatttaaaatctttctcatgttgtcagtcattattgttctgtaaaaactgaaaactgaagtgaaattatggaaccactcgcatttttgatgataagtgcaggcccataaacccgaggcaatgatggaaatcattaagcatcattggaagtggtacatttttagtttcaattggatgcttattggacttaagctggtcaaatttgtgctcaagtgtcaatgaaaagaacaaaattaaagatatattgaatgttggaaacagagctttgaagattttatgtaaaaggtgaggcaagttggggagttattattttttagatttcttgaagcaaacctcctcactccctaccacaaaaagaaaagctaagtcaaccgttccaacacagacatttgacttttatgcaatttttcaggaaagtattgtgttatggagtaggagctgcctgtcccaattgcttatcctagtatttcatctacagagacaggtgaattcttgtcagcagatcagattgtgggaggtgacagacagtccagctctccaatgtgaccttcagaataattcagagcattgctgctacactcctggggacagatggaaatctaatgggtacagaatgctctgggcctggaaggaaggatttaatgctcagagaggcacttggtacatcatccattgtttatcttcatgtaaaagattgtttaattaatcaactcaaagtattcatgctactttcccagggtctgaggatacagtcatagaaatactgataaaaatccctgccctcatggagctgacagtctagggcggccaggtgcagatagaaaatttaaaaactaaataagtaaaccatacagaacgataatagaacatgatgagtacgagagaaaaataaagcagcaatcacggcaggcagtttaggtgttgctagcaagcaactgcaactcccaatagggaagtcagggaagttgtgctaggatgtgttattgttcaatatccattatttcttccactccaagatgactatgcatcccggcatcccggacaccgccacgtaacttatagtccttccccgctggctgaggagacctccttgccccagagacaggaggtttgccatatgacttgttttgacaaatggaatatgagcaggtattgctgtacagaacatctaaaggaatgtacctgtgtcacttagctcaatctcttatgtctatcgtctaccatgaaaatgaaatgtcctagacaagggctggtcctcccacctgcttgtggaatgagaaaacatgtggcgagagccatgcctccagcaagcccacacctaggagggacgtgagcaaggaaaaaacaagtttgtcatgtaagccaatgataggatttttctgttaccaccataaagccgattaatataaaaaagcctttctaagaggtgacatttatgccaagactggaaagagataagatgataaaactgaggcccagagaagtgatgtaactctctcaaggcacacatctattaagcgacaaagactctattgaaaatctttctctctgcgtttgttcacactatctcctcaggcagggacttgcctagctcagatcacaaaacccacagggtcagcaatattttcccatcctggccaattgtatgtacagcctccatccttaagttacttgaggcacatggccctctcctgcaactgaagagaagtgtgactgagtctgcagctgaattcttccatctccttctcatcttttacatctcactagaaccctgcaattagcttgtgagacagggcaggatggtgaatatcaacatctcatatttacaaatgagaacacttaggctgggagctaagcgacttccttaaaatcatgaagtaagtggatattggcggtggaaaccccaccttcctgaaaccaagaatatcactgcatcacttgaatttttatatacttgagtatttgagcatcaattcgctatccctatatatatatatatcccctatctataatagatagatgaagaaattaaagctcagagacatgaagtaactctcagaagttctcacaacttagaagagcagattagaatcaaagatttttctcactccagaacctgtgcatggtatgagccctgtcctctttgtgactttctatgaggatgcagaatgatggctgttggccacgaaacacattgcacaatgttgttagtttaaagaagttcaatgaacattattgcttagtcaattcatcctcaactgagtgacattgctggtgcccagggagagccagattcaatgttcatgaggaagctgcatatcatgatgtgccttcaatcagaaagagctactccgcaccagggtctgagaccaccaccagccaaatgtctaagggaataacagtgagagggatgcgtgtctctctcccctgcacttttgctttgccagacacttttcgctactgggaaagactaacatcctatacatacagaaggcaacccagtgtggcagaggcaggatggttagggttggaagttcagctcttccatggaaaggctgtattgccttaagcaatgacctcaaaggcttgttttgcgggctcaccccacaactcattcattgattccttcattcacttatttaaatgtatattaagtactcattatatatcagttattattctagaccctaggaatacagcaatagcaaccagacagtctgctccgtgaatacctccaaacccttaccactgtttcactctaaatgtacagaatggctactctgctcctaccccttgctctgcaaaaagggcctctgcaactaacacagtagtcccccagatcacaggaggtctcagagccagagacaggtcatgggcaggtagaattcccctagaatctccatccctctgctaatacaagtaaaactgactcataaccccacctttcatgacacccttgggcagcccagcccagacaactctgctaccagaggtcaaactattagcccttctcaccatttttttaatgtttccaggtgagtagaagagcaaatggatccagacaatcaatagcaaggggacagaaagtcattgtggagtagcaacttttgcttgtataaaattgtaaaaacaaaaacaaactatcaagcaaaaatagacatacgaagaaaatggttgagtttcctatgtagagaaaaactggaaatgtgtacctcacctttgcttcctttacctggataagcccaatagcccagctccaatgttgaaattctcaggaaggctggaacagccattcccctgacccaggagacctttcccatggccaacccattgggcaattacaaatagaaatattctttcagttaaatgaatgaattacttgtttaactgaaaggtagttagtattgtcactgttggtgtttgttttaaacttttacattcaggggtataagtacaggtttgttatatagataaacttgtgtcatgggggtttgttgtagagacccctggtgttcatcactcaggtattaaacctagtaccctttagatatttttcctgatcatctcccttctcccaccttccaccctctgaaaggccccagtgtgtgttgttcccctctatgtgtccatgtgttctcatcatttacctcccacttataagtgacaacacacagtatttggttttgtcttccagcgttagttttctaagtttaatggccttcagctccatccacgtccctgaaaaagacatgatctcattcttttgtatggtacatgtaccatgttttctttatccagtctaccattgttgggcatttaggttgattccatgtttttgctatcgtgaatagtgctgcaatgaacatacacatgtatgtgtgtttataatacaatgatttatattcctttgagtataatcgtaatggggctgctgggtctaatggtatttctgtttttaggtctttgaggaattgccacaaaaagtaatctcatatactgttggtgggagtgtgtattattagcccagtcactgctgatcttgacaaacccataaagaagaaaatggactcacacggcacagaggggtatctcaaacccaactctactaatctcaaacccaactcaccctcatggattttccgattcccatcagtaccggcttagagttactcttctgacgaatattgcactgatgtaaccaccgacaatacagccacgtgcatttaccttaaagtgttgctccatgccagcttgtggctgatgcaaagctagctggccagaaataggatccttgggattcacgccagcttggggatcaacatccctaagactctgaacagaattctccatgtgaaggagttggacacactgtgaccaagatggaagctttcatgtgtcgactggatggtccccatcaaggctgtgtgagttttctgggtgaactccatgaggacaaacaccccaaaatgaggccaaaggccagatgttcctgcacggtctttccacagtcctaataatatccttagtgcttattatgaactatgggtgattatgctgatggaatagaacattgtagaggcttaaatctatataaatttctgcaaaattctgccctttgagcaggatttaatgtttaattccatgctgcctgatctgtgatgtatacaaggattccaagttataccattcacctgaaaatctgcaaaccaccctggaatttgtcttcatcgtctttctttttgtggccccagagaccatagttacagggaagcaaggctagatgggggaagcttctcgtcttagcaacatatgtaacttatgcaaagcagctagtagagtcctggcacccactaggtgagcagcaaacctgttttcttgtctctatgccatacttttgttttccaagaagttcatttgatagatttctaatacattccaagtttctgcctcacgatgtctaaaggcatgccattactattaaaggagggacagtaagtgaccagcaagagaatggaatgattaatctagagtctacagggcacggcatgacattatagtctcttccattgatgctctttgacccctgacttgaagaagctgggctctgagaagggagaacaacttggtctccaaacatctctgctgatgctattctaaatgcaaagaaatgtcaaagctgaaataaccataatgcaattgtacttagcctgtttgctgaaatatcagtcattgctttgcacagcaattccatttttaaagttcattgtgctagaaaaatgttgcagctccttaattcttacgttctcatccaagccgggtgggaggtgagaagtttttgaactgtatgaaaatccatatttcagcagcattaccgagctctctttcagcatcctgcacattttctcttccctgaacccagagaaatctcccacttccatggcctgccctcattttgacagcaaacattaaaagagcatcggcagaagcacagatgaaaaaagaacaacacagggttgctgagcacccatcctgttgtctgaggaggaccaggctcactgggaactctgggttgagtctggttcgctcaacctctaagggtatcaatgactgatgttctggaagccgacttctacaggttgcctcaatgggctcttggtttcgaacttctggttatattcagccaataggaggtacaggcatgggattggagaataggaggatggcgaggttgggcagtgattctctccctgcttttccatggtttgtacagtggctacattctcctacagcagcatttctcaacctcagttctattggtatttgaggccaaacaactgtttgtgatggagggtcatcttgtcttgtgtgttgttggatatttcaaagcattcctggcatctactcactgtgtgccagtagcacactcgccaggttgtgaccaaaatgtgaccaaaaatgtcctctgggggaatattgccaatttctcatagggagcaaaattgcctcagggtacatctctatagacggccctttcatttaattcccactgctaacccattcacaatgctctctgcaagtagctgggaccccaaggtaagtgaatactagtatatgtggtcctcaatatggattctctttgtatgtaattggaggtgctgtgtcctttagcagactgcaagccttctgagggcagtgactagggctcccgcataaagcacaccccacccaggaggcttcaagcacaatgtggccactggaaggaaacacttctaggtgctgctagaatcccaggggctttagtgaaactctctctttcctggattcctcctcagtggaagcagaatacacagggacactgctccctccactctccacccccagcctctttttataatgactcttcctgtctgtgggctacttcctcctggggaacagaaggtctaggaggcctctgaattggcaccagcgccctgtggttaacttgtgtctggcagcaaaagctgctggtccctaggatgcagcaatcacctctaaatgaggtctgcctttgctacatttaaggactgtaacaattgctttttctcccttggaaatataaccttagagatgaactgctcttgattcagtaaacgtctgtgccagtttccttagaggctaccatgagaaggtactagcctccttccacaaactcaagaggaaagcacaaacctgcaatcattgcccattttcctaagtccctgcatagggctgaggccaagggcagaggctgggccgggactctagaaggcagcagggaggtgtgttgggtctgagttgtttctggattgcaagtgtcattgatgcatatttaataccaatgacactgctctgctgtcactatcagtgccccatgcaagccttggggacatcttaaggaaaaaactggcataaatgatcccataggtgtgtccctgtgaagctgtgtttaaagttctcctagattatatttagatcctggcatggcttctccagttatggaactgtgtgtactgctgtttggttcttgccaggtctggtttttcatggagtcagggtgtgggcttagaatgctgatctccacacttggtcatgctgcttgcctttgccaagctagatgtgctaaaggagtgagggatcaggagaactctgttcctggcccccagtaagcaggtgctgccagttcacactgacacgcaccgctgaagagcataaaactataaaatggagtttctgcctcagtttccacatttgtgctagatttctgttgggactgctgcctcattgactgtaaccctcatactggctgttgttccccccaaaaccctctcagggatggaacctagagctagctgtacctccatccgattggtgatggaggaaatcacagttttattctcccctggctccagcgttgaaatcaggcagccttggtctaaaacattaactcagagccagtcacctcaccttctgggtttcagttgcttcgtctgtaaactaatgttgaatattttaatcctttcccactattttcttctgagctgtaatttgcattcagtaaaataaacaaatcttaagtgtacagcctaatgaatttctatacattcacatacctgtcatccaacccaatatagagaatacatttccagccctccagaattatcttgttccctaacctaggtaatgccacacccccatagggaaccactgttttggagttcatcaacatgagtagttttgcctgtttgtgaatgtcatatatatggaatcctacagtatatactgtttgcgtccagctttgtttgttcaacatataagttttgaggttaattcacattatggagtgtacagatagccagtccctttctgttgataaatagtattccactgtagcagtacaatacaacaatgtatccattctactttggatgtcatttgggttgttttcatttggagactattacaaataaagctattaccaacattcttatgtgggaatgtttatagaaatatgcattcatttctcctgcgtttattccatggtccagtaccagggatttaagcaccaaaattcattccacacttaagttcctcatcagcacattttgatgcccagaggcacctgaggctcagcaggttctacatggagtccatcaccctcatcactcagccctgacaatccctccaggctcagggctaaacatctcctccagggctacaggccagccatcctcagcttctagtgctttgaatatgccttattctccttctatcttcctggccttcagaataaattaaagtcagatgattacatcccctttatacagaaatatattctagaaagattaaaaactcgaaggcaaaacaaaacaaaacaataaaagtgctagaagaaaatctgaagtatcttttcatattcttgctttggttgcctaaaagtgtaataaggttaaaagcaaggaagaaagactgaaataaaaattaaaaacatctctatataaaaagagtataaagaagacaaatctgttaaaaactaaataaatttatttagtttattctttactactaatgtgtcgaaaaacacatattatccttaatacgcaaagggctcttgcaaaataataagagatgtgtaaagctccccaaagaaaaaaatgcataaagaagtagcaactggtaatataaaggtccaataagcaagaaaaagttgctcaacataatcaatcaacaaagaataacacattaaaacaagctattattttttactaatcagattagttttcagacaattgatggttttgggaaattagacctctcatatgctcttggtagaattataaatcaatacctcttttccaagaagatattcctatgatgatcaaacaccatataaatgtggccaagtaattcaatttctaggaagatgtcccaaggaaatggttgtatatatacacaaagatatgtaccagcctgttcataacagaagtgcataaaaatttaaaacctgaaacaacccaaatgcccagaaataggaaaatcatgaagtaaagtagggtacatacatataatggaattatatgcagccattaaggtgattggataaatatgtctttatcatggagagctgttcatatcctttttgagagactgaagtaggttgcaaaaaataagtcaagatatgattccattattgtgcatgtgcgtgtgtgcacacacatgcccacggcaagtgtttggaaggtgttctattcagggtaagtgaacctcagtaacctcaaagatttaacacaagaaagatttctttttcgctcgtgtcacagtcaaaaatgaatctgcagggtggctctgcttcactttgtcattgaaaagcccaggctccttctatcggtggctccactgtcccaaagagtcttgaagtccccctctggaccctctgtatctcaccatcagaagagggaagaaacagtgggggtggggtgtttacagggccagggctggaggtgactcatttcttcccaaataccactaaaacataaccacagggtaacccctaactgcaaaggggctgagaggtgtagccttgctgtatacccagcaaccgcctagtctccttcacagaaagaaacagcaaaattctaacatgattaggtctggctagaaatatttgggatcaactttgctttctcctttcactcttccacattgcccagacttttcccaaaagatgtgggctacttttagaataagagcagaaaagcccaatacagctattgccagccttccatatttgcaggttctgcatctgcagattcaaccaatcatggactgaaaatatttgaagaaaaaacaattagaaataacaatacaacagtaaaataccagcaaactaacacaggaacagaaaaccaaacaccgcatgttttcactcataagtgggggttgaacaatgagaacacatggacacagggagggtaacatcacacactggggcctgtcaggaggttgttggggggacaagggaagggagagcattaaggcattaagacaaatacctaatgcatgaagggctcaaaacctagatgacgggttgatgggtgcaggaaaccaccatggcacatgtatatctatgtaacaaacctgcacgttctgcacatgtatctcagaacttaaagcaaaataaaaataataataatacaaataaagaaatacagtaaaacaactatttacatagcatttgtattgcactgggtgttgtaagtaacctagagatgatttaaagtatacaggaggatgtgtataaattacatgcaaatacgacctcattttatatgaagaacttgagcatccaagaattttagtatccaaggagggtgccggaaccaatctcctgaggatactgagggtcaaccgtatttccattctgatggctttgcagaggaatcagacagtcctccactgtaaatcaagctgcaattagtgccctggtgttctggcgccccgggtccttcgtgttagagctgggacatgaagacagcacccgagaagaagggggcctgaaatatccctggctgcccttcacatctcaaaagacacagacactagtccccaaggcagctcacagcccacccacctggaactttctccatgcctgggaggcctcaaactgagaagcaaaccccacgttgctgtgtgacagggcctgcttctgtccgcctaggtgcacaagtgcatcccaccactcagaggaatactccccacaccaccatttgtcactgtcagcccagggagcaattatattccatccggccagaaataaacagacaccagcatcacacaggagatgacaggcagacacactgcctctgatgcacacacgtttttctcatgcccagctgtgactgagcctctgggcacagatgcagcccagagcctggtgggaaaagcaaatcaatgagggcccttagaggatctcgtaagctctctcaccacttgctcttttcaggtagaatgaacgaatttggggaaaagcctaacttttaaattaaacagttgtaaaacttctgataaaaatgccattaaagaaatttatgagattaaacacatctctatggcttctcctgcagatcagcctgtgggtctgaaggcctttggatcaaggggatgagcgcattggtgtgggagccggggcagggagtggggtttgagctcctgcagcactgcttaacagctgtgcagtcccagctgggtcctgtaaccttcctgccttccaaagggcaatattaccacttgcccttcctccctgcttttattaatgcaattttctctgcttcatatacactcctacatcctccttatggcagagacgacttgctctctcccaaattcactctcaccttccatcacacagggctgtagctaggaagcagctactcagctagagagtatatttcctaccctatgttggctatgtgtggcttcaagacaaggcttttttacattgtgcacatgtaccctaaaacttaaagtataattaaaaaaaaatagattcaattttatttatttattttctcttttgagacagagtctcactctgtcacccaggctggaggtctgtggtacaatcatggctcactgcaacctcaacctctcgggctgaagtgatcctaccacctcagcctcccaagtagctgggattacgtgtgtgcagcaccatgcccagctaatttttgtatttttcatagacacgggttctccctttgttgctcaggctggtcctgaactcctgggctcaagtgatcctcttgccttggccacccaaagttctgggattacaggcaccgcagccagctgactttaacgtttttaagaggagctttaggttcacagcaaaactgagcagaagattcagaacctcaagactagttttcaccaatgaaatgggaacagaagtgatggctgtgactcccaggccctgccctaaagtgccttgcaggtgttcctccaggcacattctctctttcagcttgctggggtggaaatgagcaggacaaacttggaagccatgcactgaggatgtaagtcagggctgctgtccacctaggtgaccgagtgaccaagtaaaggactattgctcctgttgccaatccaacataccacactgaatgcaatgaggtatctttgattgcatcctggaacagaaaaagcatgtaagtaggaaaaaaacacaactgattaaacctcaacaaaatctggtgttaacagtaacccacaaatgtgccatggcaatgtaagttgttactatttggtaaaactgaataaagagtagatggggactctctatattatcttcgtaacttttccatgaatctaaatttattccaaaagtaaatgtttattaagaataatttttaggcagggtgtggtggctcacacctgtaaccccagcactttgggaggccgaggcaggtggatcacctgatgtcaggagttcgagaccagcctggccaatatggtgaaaccccatctccactaaaaatacaaaaaattagccgggcatggtggcaggtgcctgtaatcccagctactcaagaggctgaggcaggagaatcacttgaacccaggaggtggaggctgcagtgaaccaagatggtgccaatgtacttccagcctgggcaacaagagtgaaactccatctcaaacaaaaaaaaataaaagagagagagagagagagaaaaaaaacgatttttaaaatagctgtattgagccattgtgcctttgggtctatttattactgcagccacgcctaccctaacaaatgcacttctcttcacctgtaaagctcctagtcacattttaagacttggctttgacattatctccattaagaagcttcctgtgattaccagggggtgaggtactgtacactttcttcctcgatcacacccaagagaagtaactcatagaactgcctatttcccaagccacattgaagtcttccttgagtcagaagccttgtctgcttcacagctacaacattcctcatggtgttcagaaatatttgtccaatgagttaatgccagcctcacctatttgttgtgaacattcactataccaaccagaataaaactgcttcattaactctgaagcactgcacagatgtaggggatgattaatcagttgcaaagtatttattgaacaacagacctgttttataattgtgatatattttcctggtggcctggagtgtatgcattgatacatggcacttggtctcatgattctgactgtcttaattagtattgatgaggcaaaatggcttaaatagtcaattcaatgccatctgttgaacacccaaagaccaaagacattataggtgtgggtttgcttttttttgctttttttttttttggagacggagtcttgctctgtcacccaggctggagtgcagtgacacgatcttggctcactgcaaccgccgcctcctgggttcaagcaattccctgcctcaggctcccgagtagctgggattacatgcacccaccaccatgcccggctaatttttgtatttttagtaaagacagtgtttcaccatcttgggcaagctggttttgaactcctgaccttgtgatctacctgcctctgcctcccaaagtgctgggattacaggcgtgagccaccgcgcccggctgagtttgcgtttcttgaatgcctactggctgccaggcaaacatgtgttgggggctttcactcctattatttcactgaatcccagtagtgaaatactccaacgttggtattattatcctccactttacaggtgagaaaattgaggagcagagagaacaagtgatgtgtttaccactgctcacttcgtaagtggagctaggtctccgaagtccacctataacctgcttcttttcaaaacagcatcttgacatatgattgatcgccaggctgtgctaagaactgtcataaaaataaattcaatttcttccatgcccctctgggttggctctcaaataaaagctgaatgccagaactcaaacaaacttccataaactgaagtccagttgttgaagctgggacttggggtcagaggtgaccctcctggcctacagagagctgtctgagctgctaaacccaggatgcttcaactgtcctggattcatctgggaataagaattatttcggctaggcacggtggctcatgcctgtaatcccagaactttgagaggctgaggtgggtggatcacgaggtcaggagttcaagaccagcctggccaatatggcaaaaccctgtctctattaaaaaatacaaaaactccccaggagtgatagcagatgtctgtagtcccagctacttgggaagctgagcagaagaatcgcttgaacccgggaggtggaggttgcagtgagccgagatcgtgccactgcactccagcctgggcgacagagcaagactccatctcaaaaaaaaaaaaaaaaaaaaaaaaaaaaaaaaaaatatatatatatatatatatatatatatataatttcaactttcatgccatgccagtactgctctaagtattttacacagcatagctcacccaacccttacaaccctaggaggagactactatgattccaatttcaaagatgataaaataggctcagaaatgttagtcaaaagttactgtgagtaaatacttcactatgaaattagatgctcaatgtctcctttcccaatagactgcaagccatttgagggcagggacagtcctgccttattcttcttcgtatctaaagtgtacatcacagagtcctgcacgcagtagctgcataataaataattgttgaataaaggcatgaaatgataaaagtcatacaaaatttggggagccacagaatctctggaaggcctgtaatgaatcaactaatgattgttgctatcacgtgaatatcagccaaatgcctgagtctgcaccctgtctataaactcactcctgcctgctcctctccaccagcctcaccctcaccagtccatgcactttctgagagcacccagggaggcagaactcctagatgccaaatgagaatgggttccattcagagctctctgcaccagagccatgctatgctccaggcagaaagaggcagagggctcttagcctgattctttcacacaagatcacttggccctcagttagcatgacttgtgttcaaggtctcaaaagttcccccaagaagacgtttatcatcatttagccacatttatgagctaaataaatgttcatttatttatttgtgtattcatgttgtatgtcactgatattttgtgctcggttccttacatagcaatagctgactattgcaaactactaagtctatgttacagaagaagacactgaagaccagaaggtttaagtaacttgcccaacattttatagaaagaatgaagctagtatataaatttaggtctgtctctaaagcagacaggcttctgctaccccacatggctccctctgtcctttggaaggacatccagtccttatacctggcaggacagccagtgtgtgtcgccagtgtgtgtcgtcagtgtctggggcatctctcccatctgtacctccttgacagtagcacaaaggtgacccttggacagatgctgtactgagtcaggatgtcacacctggaaacccgccgtgtccctgctgagtaactacccttcactccagagctctcctcggcacataaggatattcctcactttaatgtgtaaatgccattccaaatcagcaaccaaatccaccagccaggggagctccaggtgattaatgcatctctcaggtagtgaaaaccacttaatcttcagctgcaagtttctgactccaccaaacacagatctaatcgcccacaaatgcactgcctgatgggtctttattgcttaattaccaaggtgagaggctcataattaataagccatttactcctacatttagatgtctccagaaaatgtagccaaagattttccaaggaaattcacattatttgtcatctttatatctcttggtacctgaattggtcacctatctcattggtttctaaacttttctgcctacaactaaatatgagagggagagggaaaaaaagagacaggaagaggagagagaagatttcccctcttcctcctgactctatttttcatttataaagacccttgtgatacattgggcccacctgaataatccaagctaatcttcccatcacaagatctttaacttaattgctttaattaacttaattaacttaatctataaagtccttttttgcagtgtaaggcaacatattcacagattctggggattagaacacggacatagacattttttatcgggggtgggggtgggttattctgcccaccctaatgttcagcactgcaacaacctaagccccccacagaagaaaatggttaaataatctctccccacacattgcatgtgctgccattaaaatgcttataaagaactcttagaacatggcccatgctgatgctgtaatatttggtagaaagctgggcaaatttcaaaagtattacgctttgcataacaagtgtaaaaagcatgaacaatgatgaacaaataagatgacagggaaataataattcctatttattgtacttggtagttgaatcatgtacacttatttgtttctgtctgcatttttctaaataggaaagaaggatagagaagaggaagagagttgaagatgctgcattgctcgaggaagaggccatgagccaaggaatgcgtacagcttccagaagctggaaaaggcaaggaaatggattcgcctctagatactacagaatgcatcctgccaacacatcaattttagcccagtaggatgcatttcagacttctgatctccagaattgtaagataataaatttgtatgatttcaaaccactacgtttgtggtaatttgctacagcagcaagagaaaactaatccaagtgcccttgtgaatgaaactgttcacgtagttcagatttctattacaacagatctctagaagtggaattactggatcagaggatgtgactgttttgagagctcttgactagatgttgccaaactgctatccaagaaggctgaggggcaactttggtagatgatccaggaagaggaccccaacccccactgccccggggcagtcattcacttctttccatcttagtttcccacacccttgtccaagccatgccctcacctcccctggaaagaatgccccagccccttcactggtcttcccacttcgcctcttggcagccacagcttgtgtcccacatatcagccaggagaatctcattaacacctgagttagagcctggtgctctcctgtattcgtttgagctgttataaccacataccatagacagggtaatttattagcaacagaaattcattgctcacagttctggggactgggaagtccaagactgagactccagaatatatgatgtctggcgagggtctgttcctcatagatggtgactttatgcatgctcacagggcagaagaggccgggggctccctcaaacctcttttacatgggcactaatcccgttcatgggggtgggatcctcctgacataattgcttcctaaaggtcccacctcttaataccatcaccatggggtttaagtttcaagatatgaactttggggtggacacaaacgttcagaccatagcacatccttcattgttttcccattactctttgcataaagaaaactatccctgccctggcctctgctggccaccctctggcctcaccacccaccaagaaccctcaccccttaccttctctgctgtggccacatgggtcttcccccagcttccacccacaggccatgctctcatttactccagggccctggcacatgcctggaatgctctcctcacattcttgttggccccaacatctctcccttgtcctttcgagcccatataaaatgcacctttctcaggaaagcccccttcacctctcaggcaaggtccacttctcatgcattcccatactgtattcttctccttcatagcactcatcatgattacaattaattaactttttaattagttgtttagcttttaatcaaagtttggtatctatccaggaacttgcacatagcacaatctctatgaactttcacaaactgaacacacctgtgtaaacaccacctggagcaataaaacattctctgccttctcgggcatcccagaagctcacccatacctcttccagttactaagtcccctaaggcaatgcctaccttgacctctaacactagagataagtttttgtttttttttttttttaacatctaaacacaattgatagccttttttttttttggcatatatgtctccattaaaatataagctccataagagcaggacccatgtctgttttgtttgccatcctattcccaatgtccagcaccttagctcaacaaatatttgtcaaattacagaatgaattaattaacaactaattaatgttgtaggaattgggcaacaaggtgtaggaggtacagtgagcagggtgcccacaggaagatggaagtaagagaaacaaggtgcatctagccaaggaggggccagcaggaaggtcaaaggaatgcccctggctgcacaagcccagcctgcactgggcaaggcaagcaccctggccactaggggccttccacagtggcatgagtccaccccccacccacccaacctccaactccctgcccatgatggtctggataagatacccttcctccatagataggagcttttctggaaggacacaagctgttgagctccagagagggattgtccttggcaataaagagggggcattagacagtgttgtggtgagaataagctggcatctgttggtctcagactgggagaaattgtagcctgtagcccaagtttgaattgaaggacactgactgggtgactaccccatgatctaagttctgatttcaccagatcctgcttgcctccctactttccctccttccttccattcaaacttctgtccacacttatcagagcaggttctcctatgtgggggatgatacaaccccgttatcagcacagtggtctcaaaatggcaagacggaccctttctttctttctttttttttttttttttgagatggagtctcactctgtcacccaggctggagtgcagtggcgcaatctcagctcactgcatgctccgcccctccaggtttaagcacttctctgcctcagcctctggagtagctgggattacaggcccgtgccaccacgcccggttaattttttgtatttttagtagagacggggtttcaccatcttggccaggctggtcttgaactactgacctcgtgatccaccacctcggcctcccaaagtgctgggattacaggcgtgagccaccgcacccagcaagatagactctttctatgcttctgactgagggcagtttgggctcccaagttggagaagcattgagcctgcctatgtgggttgcagagccaggcagagcatttgacatttccggttggagggccatggcagccagtattttatttaaaacactcagagtttacagtcaaaaacccgtgagtctgaacaaattctttaactggcaattccctgcaaagggctctgcagtttgcactatttcaatcatgtgttcaatcaaaagggtattggagacgtaactgtacattatcactattgacatttcccagcctactccactttggttaaaaagaaagtgtccaaagatgccacttaataactttgggtatcatgaaaatgtcactttggcaagcagaaaagtggatttacacacccaccaaaggtgacctgcttagaaagagacagcagggattgtttcctggcctccaaaagagacagtgcacccaatgtccctgcaagttaccattgctccaggggatggagggagggagaggaagaacaaagggcagtggcagcccaggtgctactcagcccactggagcaggctcgggtggacagaaaggcttctagggcttcagcaacaaagctggggtgggggtaggggttgggcgaagaaaggtgatatggtttggctctgtgtccccactcaaatctcatctcgaatggtaatccccacatgtcgagggagggacctgttggaaggtgattgcataatgggggcagtttcccccttgctgttctcatgatagtgagttctcaagagatctgatgggtttataagtgtttggcagctcctcgtttgttctctctctctcctgccatcctgccatcatgccatcatgtaagacgtgccttgattccccttcatcttctgccatgattgtaagtttcctgaggcctccccagccatgcagaactgtgagtcaattaaacctcttttctttataaattaccctgtctctggtagtatgtttatagtagcgtgagaatggtctaatacacagggaaaaaggaccgactggtgcaaagctgataaaatgactgcatccggttctggagtcccagatgggggtaacacacacatagaaagacgcaggaaggtgggtcccagccaagagacccgtcccttggtcaaggtgatggggggcagcaagtgatcctgtggcccggtgaaagcaaggtcaaggttttggaaggaccgtcaagtgttagcagagctacagctggacagagaaggaagaagaggggccattttcccagaggagaaggctgtgaagagccagccaggcaaagtggcagggctcagttaaaaaccggtagaatggcaggctgaggcatggctgcaaagactgggttatccccttctccacttcctgggtttccatctcagcaacacgcaccaacctccacaatctaggtggcaacctcaaatctttctgtaacctcacttcccacagtgctttgcacctaacccaggggcagacaaatattttctgtaaaggaccagacagtaaacattttaggctttgcaggctctgtttattggaacattcaccctactcaactctaccgttgtagcgtgaatgttccgagaaaacttacaacactaggcagtgggccacatttgatgcatagaaaactgcttgccaacccctgatgtaacagattgccaaggcctgtcgatgttaccttctaaagatctcctgaacctgcccacttttctccagcgcccacaccctcgccacactagtccagccacaatcttctgttgcctagatgaccccagcagctccctccccgcctgcctcctccattctgctttcacttttgtctcctctacccagcagccagagtgagcatataaaatgcagttctgatcctgtcacctctctgcttaaaactcttcagaggttcaccatcgcttccagaaaaagatcaatactcctgacgtggcaacctgtcgagactcaggaccgctaggaaatcagctcttgtttacccctctatccattacactacgatccagctggggtaagtgcctgttggagcatctgcatgagttctccctcctgggcctttgtccctagataatctggcaggggcgcactttctctccattaacaattccacccttccctctcctcattttgactcatctcagtttaggcatcacttcctctgagcaatcctccctgatgtcatgaggcagtgctgagtgccttctctggaccctctgtttacttgcctgttaaatcctgaacatctggaagggagtcgtgttcagcaacatatctacgccttgcagcacggtgcctggcctgcagctggtgttccgtaaacagctgctgactgacgggatgcatcggtgagtcaatcaattaactctctctcacaataggaggatgaagctcagagaatatccaattggccatccttccccagaggccagaaaatgctgtggcttgagttccctggggctttgcctgccctggttgggatggctttctgccccagagttctctggaacttgcaagtctggagttttctgacccaggagttatctgtgtcagaaaaagaacctggctttcagaatcttctgtgtattataaggtggactaaggtttagaaagacacaaaggaactaatacgtttacacattttcctgggtaaaagcataagtaaattctcaatcatcttttctttagtatgattattcatttattaatttcttcacttatttattcattctacaagtgtcccctgagctcccaaggggtttctgcccctcaactagctgcttcatccacagagatggctggtacccaattcttgccttaccgtcagatgaggaagacagtccattttgatacagtgtggcaaatgctatcataaatgaatggtcagggacaatgtcagggagtaaaatgagggagagtaaaaatgacaataaagtacacaagaaagttcaggtcaagcagtattttagaaacaagtagacttaacaagctgaaaagaaaacaggccattaccaaggaagagtatatagaggcagttaaaaataaaagtagataggtcaggttaatgtcaacaatcgctataacagaacagtaaagaaacatcaggctctttacaaaattggatcacagaagcataatatggtttgcaaggaaatcaactagcattaaaaagattcactcccccaaaatggccatgcaggtgccagttttggccacacctctgcacaaggcggatgagcaaacctggtgggagggatacatcgcagaagccagcatgaaaggaccaccaggctgtgctgcaggctcttccaagggaggggctaaggggacacagacggagacccaggcatgcaggtttgagaacactggaaggagtgaaacctgttgtttctctcctgacctggatgcaacagagtaaataagatgatactgcagactggggatgtttagctcctctcttaatgaaactgcttcaaagaggtcgggggagtattcccttggcagtgattgtggttaaactgggctaacggtgactgcctagactgctttctccatctagttcggccaccacagagggtcagggctacccagactaccggccagggaggaaggagatcaacagcacggagatgtgtgtgtctcaaattaaaaatggtctggccagatgcaggcactggcatgctcagggagaagcagtctaaccaaacaagagaaaaaccttcagacctgagcaaggctgtgtgtgtgtgtgtgtgtgtgtgtgtgtgtacaggcatacccagtctaaccaaacaagagaaaaaccttcagacctgagcgaggctgtgtgtgtgtgtgtgtgtgtgtgtgtgtgtgtgtgtgtgtgtgtgtaggcatacccacatgtgtgtgaattcccattaggaggtgggacgctagcaaactggaaggcagagcccatctgaccctgagatcctcacactcatgcaaccttaatgccaagacaaactgaatggttgattgtgtcaactctcttgttttagggatgggaaaacaggcccagagtgggaaaaggagttacctcgagtcaaccaggagagtctacgagttgagattaggattgatccctggcctttctggaagcacactaaccagggattcactccttttgcttccaggacacactctattatttaatcctcatctcaatctcccagtgcagggtaaatggagaaaattatctccatgttaagagtataaaagctgaggctcagagacagtaagtatttttctgagggtcacagaactaatcatggtgcagatgtgattgcaatgaaggcctgtttaactccaaagcctttccactgtctcatgttgtctaatagatagccagcaaatgtttcaaacttaacatgtttgaaactgaactgctgatcttccccaataaacctgctccatcgacattcttccccatctcacttggcagcaatctcatccttccagttgcccaggcctagactcctctctttttctcacttccactaccaatccaccagcaaatctgttggctggatcttaaaatatatccagaatcaaaccatttcaaccagctctccctttgcagatgtcaccatctgccctatctcggatctgcaatcgcctcctacagtctattctcagctctgtagctggagtgatcttcttcttatgcaagcaactcatcttactctctgttcagaaccctgcaacagcttcccatttcatgcagagccaaagcctaagcccttacaatggcctttgagtcttgcaagttttttttttttgggggggggtcggtttttattatactttaagttttagggtacatgtgcacaatgtgcacgtttgttacatatgtatacatgtgccatgttggtgtgctgcacccattaactcgtcatttaacattaggtatatcttttaatgctatccctcccccctccccccaccccacaacaggccctggtgtgtgatgttccccttcctgtgtccatgtgttctcattgatcaattcccacctatgagtgagaatatgcggtgtttggttttttgtccttgtgagagtttgctgagaatgatggtttccagcttcatccatgtccctacaaaggacatgaactcatcattttttatgactgcatagtattccatggtgtatatgggccacattttcttaatccagtctatcattgttggacatttgggttggttccaagtctttgctattgtgaatagtgctgcaataaacatgcgtgtgcatgtgtctttatagcagcatgatttataatcctttgggtaaatacccagtaatggcatggctgggtcaaatggtatttccagttctagatccctgaggaatcaccacactgtcttccacaatggttgaactagtttacagtcccaccaacagtgaaaaagtgttcctatttctccacatcctctccagcacctgttgtttcctgactttttaatgatggccattctaactggtgtgagatggtatctcattgaggttttgatttgcatttctctgatggccagtgatgatgagcatttttttcatgtcttttggctgcaaaaatgtcttcttttaagaagtgtctgttcatatcgtttgcccacttgttgatggggttgtttgttttttcttgtaaatttgagttcattgtaaattctcgatattagccttttgtcagatgagtagattacaaaaattttctcccattctgtaggttgcctgttcactctgatggtagtttcttttgctatgcagaagctctttagtttaattagatcccatttctcaattttggcttttgttgccgttgcttttggtgttttagtcatgaagtccttgcccatgcctatgtcctgaatggtaatgcctaggttttctcctagggtttttatggctttaggtctaacatgtaagtctttaatccatcttgaattaatttttctattaggtgtaaggaagggatccagtttcagctttctacatatggctagccagttttcccagcaccatctattaaatagggaatcctttccccattgcttgtttttctcaggtttgtcaaagatcagatagttgtagatatatggcattattgctgaggtctctgttctgttccattggtctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaggaaagtcattggtagcttgatggggatggcattgaatctgtaaattaccttgggcagtatggccattttcacgatattgattcttcctatccatgagcatggaatgttcttccatttgtttgtatcctcttttatttcattgagcagtggtttgtagttctccttgaagaggtccttcacatcctttgtaagttggattcctaggtattttattctctttgaagcaattgtgaatgggaattcactcatgatttggctctctgtttgtctgttattgatgtataagaatgcttgggatttttgcccattgattttgtatcctgagactttgctgaagttgcttatcaactaaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccgagtcttgcaagttcttgtctccaggtacattcctgacttactctcctcccattttctccttcacacactcagctctaggccccctagcttccttgctgttctttgaacattacaagcatgctcctgcctcagggcctttgcaatggctggccgtatactagaaagtcttccctcctcccttcttcctccacccttcatgatccacgcgactaaatctctctcatctctttcaagtctttgtcaatatatcacttcctcaatgaggcctactctttaaaattattaaccacttctactgcaagaatttccaatctgcattctctctgctgcgttttctcttactaccttttagcataccatgaactctactcatttattatgctaattggttattttctgtctcccacatgaaaatgtaagcaccatgacggaaacgatttgtttcttttgtttattggtgcatccaaacctagtaagcagctgacacatggcaggtgctcaatgaatatctattgaattgcactatctctctaattggtggctgcataaaaaaaaaaaaaaaaggcttaaactcacaggagaggaaatttttctaagtcacaaagtcatttttttaaacattactccatccctaagtcttccacagaaggagctgaatgtgtaattttgacaaatgagtttgcatagagaaggaaataaaacatggaatgagactatgaaaggagttcttgggaagagaaaattgcattgcctttaagtaggaaaaggaaagtaatatttaaaagcaaagatgtttaaaacatcgcaattgtaggtagaaataactcagaggttgaagggggagggtgctgcaagatgcagtggaattctttcttatctgggctcctgcctaaagcattactgggcaattgacaggccaaatcaataagcaacttaaattctggtctaaaggaataactgaaatgaatgcacaacagcacagggaaacaaatcggcacttggaacaaaaaaggggctggaatgctggctttgactggcttgttcaccccagtgaaaccagcactccaggttacttgctaagtgctgtgatgattataataatggtggctttgtggggagagtgtcagcgcagccctctttccctcctgggtcccagtagatggatctgaatctggtctgttctgtggagagaagagaggagggaagcacctgtcttggtcttgtctgcaggctccctttcctggggtgtgaaggagctcctgcaggcttggtgtggagggctggtcccaaaggcaaggcctggggtggaggcccctggggagaagagaatgaacctcaaactcagggttggccagacgaagctctgaggctagaggtggaatcacaggctggaacacactgtccagaattcagatggacagagacaggatcacagcaggtcaccaacgaactggaaaaatccaagccacctgggctgccacctatagttgtgcacaaaaccacaggtcaagggggtgagtccgcctgaaattaaattagcctaggggccactatccctcacgtgggttgagccagttcagagggagggacatctttttgcaatctgttcacaaaaagaggttaccttttcaaaatttgcacagagactccccaaactctggcaactgtggttatctgtgatcaccctttagtggtttgttttgtagagtcaggcatgctctggtcaagagaagctgcaggaactggaagaaattaactctgatcttctcagagctcgcccaaaaaactggacctatagagaaacctatggaacatttcaggcttccttttcccaatccaaatttgagctacagatttgagccccaaattaatccccaaatggttctcctactgattcgttcatttcgttcatccaggtattcacagggttactaagaagtgcttgtcctcggtcaggccaggaaagagagatgacagacttggtcccatcggcaaactctttacagacaaaaaatccacctcactcatctctacagctccagggctcagcacaggggctggcacatgaaggctccctttccttaccttttcctggcacatgcaaatatatgttttttgagtatataaatcaatgaatgatgagaatatcttgcaactccttcaaaccgacaggtccacagagatgatcttgctcctgaccttgacaacagaaatacattcttagagactctgtagtcctaaatagaactttggggaatccttttaaaaatcaaacgcatacttggtaggagaactgacaatggcaaccagttgctcagagttatttgctcaaaggcctacctgcctcctaagcctcactgttcttcattaactgtcaggggttaaactttcaagagctactcccaaaagagctgcaggaaaattctgtctaaacagccatgcaaaagtgtctggggatcactacggacagaggatgatgacagagggcccatgacattgggccttgtcatggctgaacactgaccttccactgtcatggctgaacactgaccttccagtgcctacagcttttaaaaagagtaaaaactatgttcatgggtacacaaatacaaacatgcactcccccacacacacacatacatggacacacacagaggcatatcatgcattatcttctctcattcatcgatattctcaaatggcttattacacagatttacattcacaaatattctattatgtaaatgtaaatctattctattatgtgaatgtaaacctatataatatatttagccattttctcagttggatattttggttatttctatgttgtcacaattttaaatcacattgaaataaactaggcccctttgactcctttctttctctcttactccatgtggtagactaaatgtggctgctaagtttatttctcccactatgtcttccagccaattctagatttgagtcaattctagagaccaccatggtggagagtgcatatgcaggcacgccagttaactgatctggctgagcccagccctccagccatccctgccaaggtgtcaatgtgagtgaaaccatcttgaactctgcatattaacttattctccagctgaatatcaccaagagacctgtcttctgatgctacatggagtggaacaatctcccagctgagctctgtccacattcctgaccacaaaatcatgagatattaaataaaatggctgttgttttaagcatcaaccagtcttctcaatgctgccacaatcctcacaatggcccataaatctctacgtgatctcccactattctctttgatctcatctttggccttcccatggctgaacctgctccagccccactggcctccctgttcctccctgaacataccaaacatggtcctcccacctcacggcatttgcacttcctttcccctctgtgaggataatcctcccccagatgtcagcacggcatggtccctggcttcatgcaggcctttgcatacatttcagtcaatcagagaggtcttctctgatatcttacctaaaacaggagtccttttcttccacctcagccctctggagagccagggaacacctctctctccttatcatgctttatttttcttcataccactttcacaatattaatatttatatgtttattgtctatttagacctcctctcctccccacaaataaatgcacattctttagtacgaattctccgcaaacagaaacgttgtctgcttttatcattgctgtattcccaggacctaaaacagtgtcctgggtgtaggactgatcaataaatatttgtaaatgaatgaatgaattaattagcacacgttcttggatagaaatctctctattcatttctaattattcctcaaaataagttcctatgagttaagttgtggaggtgtaggaataacacatttcaaaatcttttagcacatattggctaaaattccctacagacaggctgcactggtgcttacccatcctgctagggatgtgtaagagtgctaatttccttgcatcatcaccaatataggataaagtcactcaaaaatatttgctacgtggatacatggaaaaaaatggttaccctttattttaacttaactttcttgatcctgtgtgaactgaactccttgttccacgtgcttattggccactacaaagtaagttccttgacagcaggggtttagatttgctcactgctatcccagcatcccagatagagtctaggatataagagatacatgataaatatttgtagaaagaatgaattaatatagatgttttcttttgttattgaaaggctattgactcatgtgtcctctgagaagtctgtctcttttttcttactgacttgaaataactccatgcatatagaatattttactgtcatctaggttgaatttttaatgtgtcatttgcactctattttgtatatgctattttttgacattcagaaattctagcattttatgtagttacatctatcattttattttagttcctctatttggtaccatgtttagctacagtcataatagttaacactgtatagcacttcccacatgccaggcacttttctgaggattttacatacattgtttattaaattcctacagcaatcctataaggtagacactatcattatctaatcatataaagaaactgaggcaatgagctatgaaatcaatcatctcctgtacaagattttatataaatttacctgtagattgctttatgatttcagtttttatatttgtgattattatgtaataatagaaatctattgggttactccatggagaagtgagggtctaattattttttcccaattaattgtcaagtgctccaacacagtttattgtaacaatatgtaacatgtctgtaacatattgacatatatatatgtatgaatagacatatgtatacatacatacaaacatatgtacatgaacacaatcacacactatatagcatttgctggtattcttactcagctcacttgtactgtcggtcctttttagttgtttagtaatttttgtggtgtgttcagtgaatcaaatttataaaatagaaatataaagaagaaacataaaaggattaccagcgattccctacaaatcctgattaaaggcacgttcaatgttgttctcatgaaatatgcacctgtcaaataaaaacataagcgcctccaaattgcattataaatgcacaatactttttggaaacagtttgcttcagaactttggcagccacaataataacacacacaagcctgtttcaccccaaaggaaatatctacaatacaaggatgtttagctccatcatttttcactgctttgggtttcttgcaaaaccattttgatttcagttgaaactaatgacagcaagcagtttatggtcaggttcacaaagtacatttctacccctgctgtggggaagggatcacaagaaaatagcttccagtaggttacgactcatctagctcccaaagtggggactcctccaccagagcctgcattttccactttttgccacactcagagaaggacttcgacctcaacatgtgatccagataaagagcatcctcctacacaacctcaaggtaataataacattttattggtatcttgtacatccgttggcattggcatttatatttttattcctatatcttcttatgtcaaagagagcatgctatacatcctgttcccaccttgcttttctcttaatgatttatttgaaaatggtttgtcattcatttctacagctgaataatagtttgctggatggctataccccatgtatataacccgagacagggtgaccttttgtggcccactgcctggcacttggcttggtctaacaaacagaaccttcatgcaccaagctggtcatgccaccaagtcagcgcagtcattgggagtgagtggtatgtgagtcctggctccctgaatgccctgatggaccccatggtccagccacactggctgggtccctgtaagcttagcctaccttgcctgagagccaaggaaatcccatcttctgcctcaccatcctcaaccacatttcagcaccaatgcaagatccagtacagctgctggaatccttgtttcatccagggtggacatggcagaggagtcagcaaccattttgtgccccagtgttcttcagataagttcccactcatgacaaactctagcccatactgcaactgaggtcccaaacatgcaattgcattgtttcccacggtgggctgggtcacttgctactgcaacaaggcagaggaaggacagcatcccagcatttacagacacattgcccagcatggggtctggctctgccagaatccaccgaaaggtatgagccctttatgaactagctgcactctgccctttggtcataagataaactcatatcttgacccaaggcagagccctgacatcagcatcagatcaaacttttgtctcaccacagagcaagccctgaccctggtcagactcaactctgacccttgcacggcctgagccctgacttgggccacggactgcaacccgaccctcagactcacgctgagtcatgacccagatcacagacacagctccaagccccagacttatcctgagccctaaccctgggcccagactcagccctcaccttggctgtgactgagcccagctggctatcttcaaatgcggtcacacaggaggtacttggcacagtaggcagatggctctgtgtgagccctgcctcggctctggatggtgcttatgatctactgcctatcacgagcatctagtatcttgccatggggaagaaatctcagtcccacagacctgagttcaaattctgccactgtttagctgggtgactttgggcaaattacttctagtccatcaaattagatgccttctgaagaaaccatttataaaatgggcacaaaatacctgctgtcatgatggtcatgattaaattatatgattgtaaagtacccagctcacagtagatagagttcatccctttccccagtaggcatcttgtcagctgcagctgaattattggtataggaacaagccctccagagctgtgctgtcctatactgtggccaccaaccatatggggctattttaaacaattgaaatgtggctggtacagccgggcacagtggctcatgcctgtaatcccagcactgtgggaggctaaggtgggtggatcacttgaggttaggagcttaagaccagtctggtcaacacggtgaaatgccgtctctactaaaaatacaaaaattagccaggcgtggtggtgcacgccagtaatcccagctactcaggaggctgaggcaggagaatcacctgaacctgggaggtgaaggttgcagtcagctgagactgttttgtgccactatacccagcctgggcaacagagccaaactgtccccaaaaaaaaagcaaataaatcaaccaaccagaaaaatgaaatgtggctggtgcaaactgagctctgctataaggaacacaccatatttcaaagacaaaaaaattcagaataagaaaaagaatgtaaaatgtatcattaataagtttttaatgattatgcatttaaataatatttgaaatatattagatcaaataaaatatactactagaattaattgcacctggttcctatttttaaaaatatagctactagaaaattttaaattacatatatggtttgcaggtccagaggtctgggaagagcagttcatgggtaataaagacagttaaaacagaaacaagagcaacagtaaaattaatacctaactaagtgtttattgtgtgctgggcacggcactaaacacttaagtcctcacagcaacctctgaaggtaggccctactactgtccccattattgagatggcacaactgaggcaccaagacgtaaagttatatggtccaaggtaaagagccagtaaaaggcagaaataggatttgagtccacaacacctggatccagaacctatgtcctagaggaaatgacacattcattaaaggctgcctcagtaaagtgcttcctacaaatgagtcacccacagggaagaaacatgccctggatcaattaaatgctgtcattgagacatgggcagcagcgaaccccactctccaagctcttacctacccacattgctaggcacttcactgcccatcagactggttggcactcaacagggtctttatggaggtgggggagttctctcatttaatcttgtgcatttctcagacatatgccaagttatctttatctggagaatcaaagaggacagctccttcaaacctttttagctttctccattagcaagaggtacctctgagagcaaaaatgataaactcaattgttcaaaaagcaagttccgttcttcaatttgtgtgccagtcataaacacagcaacttccatttgagcagaaatcccacatttcagcagaaatacttaatgtgtcatttctcctgcatccatcttcttcaaagcacttactttagaaagtagagaaggaaaaacaaactctaataacctgtactttgaatgggagatgggaactttatgataaagaactcaaaatgctttattgacatggctgcacacatcccccttcagctcctgaaactgctcctgagatgagaaaactttcctaggagccttgcaactcgacttcacacccagctaggctctgggggtaggatgcacactcactccagctcctgatctgttttgatcagccagaagtcctagttcaagtctaaacccagaatataaccatcttttttatcttaaatcatgcatttacaaatatctggcaaatacatattgagcactgtggcagattatattttccaaagatggtcatgaccacgccacttatcccacaagttcttacaatgtgatcttgtcactccccaccaggaggtggagtttatgtcccctcctctgggacctgcgtggacctttgtgatgggctggaccaatggagtatggagaacaggcttctatgtgacttctgaagctaaacataaaagttacaacaagtcatgaaagagaaaagcttttgctcttggagcccagccactatgctgggaggaagcccaagccacatgaagaggtcagagataggtgttccagctaacagccccagttgaggcccccaggtggcagccagcattaacctccagacttgtgagtgaggagtctggcttatatataactccagctctagccactgtcttatgcaaccacaggaaggagcccccaaatgaagccacctacctgagctagttatggttcatcaaaaaaataagacataatgaaaaatacattactgtcttatgccactaaggttctggtgacttagcatgcagcaatagataactggagcaagcacctactatgtgccaggcattgtgcaatctgctttaacaacagttgaagcagactttgtccctgaccttaaggagaccatagcttagtggggacataaaaaagtaaccaatcacaagcctgcactgtatgaacaggtgacagaggggcatgcaagatactttgggaacaaaccaggcttcgggaatgtaacaaggcctgaggacatcagggaagcatcctcagaggagaagattgtttaattgagtcttcagaaggagtcagtgtcaattagatgaaggaaaacagagcttttcattcattctaaggaattttgggaaaataatgtagcaaaaatagatagaaaaaactatgagaaagcctgctcacttaaaaacatattataaaacctcaataatcaatacattaataattaaaacctcgataattgattggcttattgacagaccatttgactaatgaaacatcaaaaagtgcagaaatagatctaaatgttacagagatttagcgtgtgtgtgtgtgtgtgtgtgtgtgtgtgtgtgtgtgtgtgtgtgtgtaatggggcattccaaagagggacttttccagaaatgcattgtactgcatgctatatacaccaagataatatccaaatgggtcaagattttaaatgcaaaaagaaatcccaatccactgaaattttagaagaaaatacagaaaaatagaattttagaaagaaaataattttgtataactttggaagtatctaaagtcttttttaaatcaaaatccagaaatattaagggaaagattgataaatttgactacatgataaaaaaaaattgtgtaatgccaaaagaaaaagagagggaaagagaagccttaagctaagtctaaaaacaaagacttctatgaaggttgaagataggtacaatgtcaacctgaaaaactgcagcttctccttagcaatcctaagatatctatagcttcttgaacctcttacagagggcctgaaacagagtagatgtttaataagatatattgcatgatcctgttacagaaactctcactaagatggaagttctggtttaatcttgactcagttatgtgacctggaacataaatgggtatgtgcacacacatgtgttccatgcactggggggaagtagagcaggtgattgcttccctactgccctaccacctcattcctggaaaaaacacatcaccactttcaaggtaatacattgacgcagtgatcaagactgccaggcaaggccacagaggcagcattaaagcaagcccaagaatcaggcattgttctatggatctcactgttcccctaacctgaggctcacttcttcaaaagtcaggatctggctgcatcttgctgaacctcaattttcccatcagtacagtaaaatgggcacaatgaccatggcttcagaaaccagttgagcatttaaatgagaataatgtatataagagaccgagcactggtggaggatatagcacaaacttcgttcttagtctctgtggccaccagagtcattatggtcatggtcagtttgctggagattcttttttttttttttttttttttgacatggagtctcactctgttgcccaggctggagtgcagtggcacgatctcagctcactgcaagctctgcctcctgggttcacgccattctcctgcctcagcctcccgagtagctgggactacaggcacccacaaccacacccagctaatttttttttttttttgagacgggtttcaccgtgttagccaggatgttctcgatctcctgacctcgtgatcctcccgcctcagcctcccaaagtgctgggattacaggcatgagccaccgcacccagctttgctggagattctattacgataaatatgtaggccaggcgccgactggataaataggcaacctccacttgtgcttctctgtctggaggagtttcttgcctttaaggtacattgcatagatgaacagaacacattaccaaagatgcacaggaacaaaatgaaagcatcaagaacaccctgacctgctactcaggatactgggccataggccccactctcatgatttcaggctgagagataaggagctgttaaagctggggttttgtttctcattcctccctaaacacagtgaagcttgggaggcattaaatggatcaagcatttttcagaacaaggtagagaaaaaaagacgtggaggtatgtcatgcttagaaaacacaaggctagcccctctgaaggtgctgaccgactccctggagtttactatttgtgtagaccttacaaagctcaagtttggggtgtctgcctgtcagtttctgcttcctggtttccatcatgaggcctctgaggactccacctaaccatgttatccagtccctgccactttaaatcaaggatctgaaaggcagcctctccatttagctgacaggagaggcagctttcaagagtcttctgtatcctttgtcagtgaaagtcacatgggggaataacccaaacttttcttccctttccagtgtagtgaaatggtaagtttcaagcatatgaaaaactcagccattggaacatcatggggtcgattaagccagtaatgactcaaaccaaagagctggggaatcttccgactaagtaatagggtagtgaatgcacagaaaggcagaggcaaaaaccgaattgtagcatctagttcatgagcctttgcatgactttggtctcaacaccggcacagtaatcatcatggaatctcagaatcactggaggagcaggatcccccaaaacccatctctgtgatcgctattggatgccaaaatcctccgcacatcttcatctagtggtcacccagcctctgatagcctccaggcttgaaactctactctgaaatattaagaagggaagctgtgttcaccactcagacacccactcctatttcacctccctgaagaaaccttccctgtctgccctctcagtcactctctaataccttgtctgactttgccttcttaatagatgtgttaggtgctgacccaggcatggaggttctgactgtgatgtcatgtagcttacttattgccatttagactgagctggcgagctcatttatctaatctgttaaaaccagatttggtggaaagtgaggacctcaatatttccacatttgctgacaaccttaaactctcatcgaagagtgggaagttgttgcttggaatcacattaagattaataatgacaatagagataatgacaactgcaaatatagcaactctcccactcacaatggcagtcccgattgcacaaagaatccagtaccaggaagggacacattttaagctatcttggaactgtttcctaatctgtgggataaagatagatcaaacaccactttgcattttttaaaccttgaataaataggtaaatagcccctttgttaagtaggagaaaatattgggaggagacgagtttaggcttctcaatatgtttccatctcattggccagcaggtctatggttcagagagaggttgaagctggagacagggatttcagaattatctgtagagtctcttggttgaggccttgggaattaatgaaattgcagtaccagagagtaccggaggagaagggaagtggggagctgtcctagagaacaagctagaatagaaacagtcaagacagccaaagcaggagtatccggagaccaacgtgaagggaaagaagtgagagacatgtggaagaggtggcaactcctgccaaaggggattaagaacaaggagttctaagaactttctgcagggctgttggttggagacgctgcctccatgcaaatctcatttgccgctgtcaatccagatcctgtcccaccacgaccatttctgagaaacagactcaagacatgaaaaaaaaccctctttctgtaaaattggttcgtgaaacagactacaggcattaatatcctttatgagtgacaatttagggccaatatttacactttgtaatgttcgttctctttctctcgggacagaaaagaatgttgccaatatcaatgaataaacattaataaaatcaaatataatcttgttccatctggaatcaacctttaaaaaaattcttaacatctgtatataatatacatacacctctatgtacaatagggaaatcagattttgcctgagagatgtgcacagtatttaatgccaatttatttggttccaccttttctccagactgctttagaagggtagcgtccctagaattgagattctgaattagtttcctctgactctcaggtacagaatgtccagctcaagccaagacatatcaaatatttatccactcccagattttcaaaaatccagctttctgtctcctcctgcagctgacctcctctggcagaaattcagcctcaaactgggagaaatgagtggatcaccagaatcaaagctgacgtcagtggtactgtgggttggtgtatgacgtgggaaccctgacaaacagaaatgaatgtttataaatgttagatctcaggtctgcaaggaaagatcttgctgtacttcacaaatggacttgctttttaatatgtctcctgtttcaggacaagtaatgttggtcagaactctgggggtgaacctaggggctcgtaccacttggggctgcgttgtcactcctgtcctcagcatcgcagaggccaaactgtacccagatgagaccccagggaaagagaaaagaatcttgggcacgggggtcattattcaaagaacctggtgtagtgcgtgggagatactgcatgcacctctaactcagacatatcattaattcacaccatccctcttgtgcctactaaaccaggatttctcagcctcaccaccattgacattttgggccagaaaattcttttcttgtggaactgctcagtgcactgtaggatgtttagaagcatccctggcctctacccagaagatgccagtagtactgtcccggttgtgacaagcagaaatgggtccagatacggtcaaatgtcctctggtgagagggtagcaaaatggcccctggttaagaactactgcagtgaattattcaagggaccatgagtgaagttttgaataatccacacctgagctaagtggtgccagagagatacttgcaggacctcagctttgttagtctgacatctctcctataagcccaccgactggagaccccaagcatgctgcagcccctacctaacagatcttcatttattccattacaggctgtgggcagcatttcttcatttcagatagaatcttccagagtttaggaacagagcaggctgccttctctcctcttgccaggaatttcagtgcgacattgaacatgtcactggagtttgcttgttgcaaggacaaacacttctcctggcacctcacccccacacctgcctagagacaaggctgcccaggctgtttaaagggaaatcagtactgtgccaggcctgtccaagtgaattttttctttgagcaaatacccctgcctacttgttcatttttaaaaccataggtcttcctggtgagggggcttcaaataaactacaacaaagagtaaagtctttatcccttagtaggaagagaagaagagcctccaacaataatttattcattcatccactggtaataaaggcagggctgtgatcacaagagaggagatacagacttcttggtctcaggggatttgcaaggcccagagtgtccagtggtatagatctatcaaggagaagcttccttggtaaacttagtgcctactgatccaggaaggaatatgtgctgctcacttcatccctctgtctccatgtcccacctggtaaaaatcagtcctgacaataccaaaactttgccaattctacttctgaaatatctcctggctcagatccctccatctttgcagttcctaacgtattaatagttcaggtatcatcttcgtttgttcctctgaactaatgtaattgctttctcatgcctttccttcccacttccatacggaataccacggcggtctttgtaaaacccaacagaatgagaaaacgctcatatccctcctcaccaaataccataaacaatgtttgaaaataaaaacaaaattgtcacgtggaagaaacaaaaacacttgcaatgtttgtaacagaaaacctaatatctatatttctgactctctcctggcttccacatatgtgaagaactctcacaaatcagtaagaaaatgccaaaaataggcaaaggccatgattaagcaaataccaaaaatgaatttttaaaacgaaaaatacaaatatgagaaatgtgcaaccttacttctaattgagggccacaaattaaacaagtatattttaacctcttagattagcaaaaatgtaagaggttggcaacagcaggtgttgacaaaaattcacaaaaatgggagctctcataatggttggaagtgtaaattggtgtataatttatcaaaggcaattttcctacattgtgtttgttttctactgctacataacaaataactataaatttagtggcttaaaacaacacacattcattttctcacagttttagtgggtcaggagtccaggcagaacttaactgggttctccgctcaaggtcccacaaagctgcaatggaggtgtcagccagggcttagatctcatcttaggctgagtcttcttccaagcgcacataattattggcaaaattcatttccttgcagctgcagactttttgaggcttgcttcttccaggctagcaggaaagagggtctctgacttccagactcttttaaaatgtctcagttgattaggtcaggaccactcaaaattaactctgttgattaaagtcatctgattagaaaccttagttttatcccaaaatcccctcacttttaccatatattgaaacatattcacaggattgacacccattgcctttgccatattctatggcgatatggtttggatctgtgtccccgcccaaatctcatgtttacttgtaatcccaatgttggaagcagacccagtgggaggtgactggatcatggaggcagagttctcatgaatggtttaacatcatcttcccttggtactgcatagtgagtgagttctcacaagacctgattgtttagaagtgtctagcacctcctccaacctctctttctcctgctctggccatgtaagatttgcatgcttccccttaattccgccataattttaagtttcctgagatctcctcagaagccagactgatgctgccatgcttcctgtacagcctgtggaacagtgaggcaatcgaacctcttttctttataaattacccagtctcaggtatttctttatagcagggtgagaacagagtaatgcatatgggttagaagcaagtcacaagttccacccatgcccaaagggaggggattaaagaaagacacagatcatcagagatcatcttataattctgccaacagcatatatagaccaaaacttaaaatgtttacaatctttgccatagtaatctcacttgtaggactatatcccaaagaattaagtggactagaacatatatatgcccacagaagccttttcatcattctgctatttgaaatcatgaatatatatactatagtagcaaccccaatatccataaaaatgagttcaaataatttatgatatatgcacatggcctatcgtatagctgttaaaaaaaaacacaagtgatcaaaaggtatttaagtaaaaagagtgctatgatgtattaagaggaaatagcaagtttaagtccatctacacttatatttatatataactgtgaaaatgaacctaaaattgtaaaataacatacagctattagcagacagtatcttcaggtatgggaatagatggcaatctttattttctgtgtagtttttatggtgtgaaactttttgaaatagctgtgtattccttttataacaagacacaacaaaagagctgttttttaaatgcgagagtattggtttgtaaaatgagtagtgtacaaaatagtatactcaagggcatcttatgttttgtaaaatatagatgagaagaagaaaacttgttagggaagacacaaaattttaatagaggctagatagacgttggtattatgggatgtcttgaggttctattttagctgttttctgcatttttccaatacaacatgtacattattttcatagtttttcaaaccaattcctgctatcttttttttaagtgtagaaaaggaaccatacatagggaaaaaaaaaatagccaaatgcagtctcacttccctggtctccaggcagagatggcctccaacatctgagcactcactgaccacagcttcctcccatggcttaacagtgccttctattgtggctgcctcgcccatcaggctgtaagggtactgatggcagcacccctcgttcacctctgcacctccagtgcctgtcacagggcctgccacagagtacttcacggcggctaaataaacgaatgaagaagatactggcaggctagaaccttgtaagcaaatcaaagtgttccaacaatcatcttatttgcaatggtgaaggatggagttgagggagcaaactggaggcagggagacaagatgccctggtttattaggagtaagatattgaggacctggtggcaagggagcagcagtgcagatgcaccggaagtggaaaggacagaattcagggaataatgggagtaagtgtccacagcagccaagcattgagggtaatgcccatactctggcttggacaactgggtggtgacatttgcctgaatatggagcaaaagcttttgagagagaaaacatgacaacttcaggtttgaacacacagggtttgatgagcagagacatctgggaggtgccacaaggagctccttatgtcatcctcccagctgtcaccacacacagggttgattctgcaaaccaccggagcttaattgatgcatgtcttctgagtaaaattcatctatccctcctcagggatgaaatgccccctgccttaggattctgtgacttcctcaagcccagagagatggggtgcaatgggagggttgagttacagtgtcaggcactgcataggctaaggagctccagggtctgctactctgctatctgggaagatgctcatttgcattggttccctctgcagtgggatgattttgtccttcatttgccttccctggatgatgcaggctgcctgcatccccactctgaaaactctttacacagaactggccgcacatttcataaagccatgagtgatgtcaaagagcatgtacaatggggagaagactgactctgggcattaattttacatttgtaatcaggggatcttaatcaaatgccaccaagctaccattgcaagacagccttccacaaacaccaccccttgcacagctcaggttctgcctggcactcaaattatctgcaaaatggtccctaccaccgtgcccacttatgccccaggcctctccatggagccacatccagtttcctaagcttactacatcactctttgtgttgtcctctcagccttgattgcccttccagatgtaacctaactagttcagccctctgcagccttcaaaacctagctcagtcatcatctgtcctgggggatctttcatttttattttttaaaattttacttattttggtttttgttgttgttgttatttttttgttttgttttgttttgagatggagtctcactctgtcacccccactggagttcagtggcactatctcaactcactgtaacctctgcctctcaggttcatgcaattccctttcctcagcctcctgaatagctgggactacaggtgtgcgccataaagtctggctaatttttgtatttttagtagagacggggtttcaccgcgttggcgaagctggtcttgaactcctgacttcaagtgatctgcctgcattggcctcccaaagtgctgggattacaggtgtgagctaccacacctggctgggattttttattattattattttttacatttttaattttatagatttaaaggtacaattgtagttgtgttaaatggatatattgtacagtagtgaagttggcttttagcgtccatatcaccggatagtgtacattgcgccgataggtagtatttcatctctgaccctgctcccaccctcctaccttttagggtttccaatgtctcttattccactctgtacgcctgtgtgaacccgttatttagctaccagttataagtgagagcatttttgactttatgtgcctgagtcatttcatttaaaacaattgcctccagttccaaccatgttgttgcaaaatacatacttttattcttttatggccgaatagagttccatggtatatatgcaacacattttctttatccagtcctctgttaacggacactaaggttggtttcatgattttgctattgtgaataataccacaaggaatatgtgagtacacctcctggcaatcttcaacccctttctaacagggtgggtttggatccctctgtcctgagtcaatgtcaaggcactgcattgaacctttctgtttatgattctgcatctctcacactactctgagttcgtaggttgctgtgccttgtctcagtaccatgctcagctccatccccacatctaccatgttatgtactagtgagtggtagctcccgcctgatagaatgagctactctccatagtggaaaattctttcccattgattccaaacagtgcaaaagaccccctttcagaatgaaatttgagggtcacctttggctcttctctgctgcatctccaacatacaatctgccttctacctgcaccatcacccctttcattttcccattatattattccagtggatgcaagtgattgcaaattaccatctcacccgtcacaaaagcattatctacaaatcgctttgtaggccatcaagcatcagcacatgtcacgattatctgggtgctcataaaatccttgtgagatttgaaggccagaaaccatcttccacattttacacacaagaaacatgaggctcagtaaattaatctagtcagatacaaagtttagactgcaaatcaagacttgtaattctcagacttggtctttttacatgttacctccattaaatagtctactataagagttcgttagggatggtttactctacaagaaaaggatccttttgtttttctccagtgcctagtttgggacgcagcacaacaaatcaataaatcaataaatcattactaaattaatgaatacatctcaataaatcattactaaattaatgaataaataaatgtccctttgcatcatgaccttagttttctcatctgtaaacgagcatgtttaggtgtgctggttcccaagaacatctctggcactcttttgtctctagctatcaatttctggctagcagactgactgtcaggcggaggtctgtgccgggcaggatgcaggcatggtgaacaccaggtgccctgggtgtgaataacaagcaacaaaaactgaactgagaccatttatgaaaataataatgaaaccacacattccttgataccagaaataatacagggctccatgccttgttaccggctctgcttctcaatgtctttgccatcccaatgtcgttcattcccactttgcctgaagtccatttttggtacagaaatgtaatttagtgggtggcttttcccacaactctgggccactaacacattcattttcttctctgcttttaaagtttatgttcctttgtgcacaacaggcagcacatcaccactttcctgcaaagtcacaggcaacagagaaactcctaaaagctcctgcaagtcttgggagagactggagcatttccattaagaccctcatgctactagattgttcttaggaacccctcagaagattcagcaacatgcaaagtgacttgtagaatgggataataatcataagggtaataaacgcctatttgatagtgcttactttctgccggacactggtcaaacggctttctatatatcctttcatttaactctcctgacaactctgtgagggaaatgctgtcaatatctctatgtttcagaggggagatctgaggcatagtgacattaggacactctacaggtcacattattaggaatgggcaaagccaagcttggaacccaggcagcatgattccagagcaaatactcttaccactatgttctttttttctcctatagctacatatgctcctctttcatgaagccttcctggccaccccacaaacaatgctaaatactagatggtgacagaacaaggagcaggggcttcacagtcagttagaactgatttccacccctggctgtgccaaattacttatatgattgtgggcaaattgaataacctctttaaatcttaacttcctcatttgtaaaatggaaatgataaacatttcacagtaccttggcaaacacttaagacttaagagtcagtaaatgtcctgcatgctctgaaatgggaagtcccaaggcagaacagaggggtgctctgttcccttcactcctcattcatttattcatttattcacttacccaacaattctttaatgagcaccaaccacataccgtgcattgcctggggtcctgggaaggttcctgttctcacggagcttacagtctagtgatgagtgacagaagttaaaaggcaaatacaccaatggcacacacaatttcagagacaatcagcgcaagaagacaataaacaggagatacgagtgatgtagtaatggtatgctggggaggagggtgtgagggagagaactgctttagactggcctgggagatatttgagccgagactaaaatgagcaaatgagcagcatcagccagccaagtgaagatccagggggctaggggtggggtggagaggggacaaacgatttagacaaaggaaatgacaagtgcaaaacgcaaacaggcaaaaaacttagagggttctaggaaaccaaataaggccagtacggctggagcatagtgcatggccaggagaatagaaggagatgagctttgagaggctggtgcgactagatcttgctgggccttgtgggccatataaacaaggagttcggatttcattgtaagtgcaataggaagctcttagggcattttaagtagggaactggcatgatgtgatttatgttttcagaagctcaatctcgataagaagtgaagaatggataaaaggagtggaatacatttagaagtggaacctggagattgtgataaatgttagacctcaaagcttcactccatagacggacaagaatgacatttcttctttatccccgtagatgtgtttcccaagacatccaggagaggatattggcgcaaacagtgagtcatcactctccacccaccttccagactccctcctccatgcatatccagctcttctcaacctggggctcccttagaaaatccagacaaaacaattgccacagagccaacatcttccttttccctttgtcttatggtaaaaacatatttgtagaagcaaatccaataataaaagattagcacataaatacactgaaaagtaagatcactgacaaatacaccaagtgtcggcaaacagttctcagtgtcttggcacatgcggagcccatgttgcaggtggcatcaggcagacatggggcctaatcagaactcccactgaagctggacggccttgagtcagcaatgttctagttaatatctctcctccatttgtccccccgctctgcatttcctggttttttcaacagagtcatctggggaaaacccacacattttatgatattttgtcttccccttcctctctgttaaaataaatgcctgtcacatttgatactcatctgaattactgatgttgggcatgagatggtggggccatgcgatccctctggagacaggaatctggtttatttggatccccaggagctcatgaatactgtgagttaggcttttggctcttaaagaagagagtccataatatcccagaacaatgcctcagtagcagatttagttctcttttttttttctcctgattgtgttcctttttacctagcactaatgtgggtggctatggtgagagaagaacatgctaggaagaggttctctcattttcatattcttctcatgcacacatccactagggagctaggtggagatgcttgcaccccaagagctctgggcccagccactcattggaatcaataagccttcctaagggtttagagttgggggaactgaggcccagtgatgttctatatctctcttctataccccgaagacattgagttccataattgtaccatactttgcctggcatggcctgcactggcatggctcatgaaacatgataggggcctgcccagttgacccaggccccccttgaggcttggtgtgtgctgagagggtgactcctgtttcaggcattgacaagaaacccagtccaggggtttgtgttgctgacagcaggcaagctatcagcaggggtgtctgatataggctgtgagactccaaggtcaaaggaggaaaagcatctcagagtctctgtcggttggagagggcagagatgaaagtagaactcatggagtgaggcgtgacccaagcactacagggagaggcacatgcaaggcacaggcctctatgaatgcctgaggagtccattcagaatccagttagacctgccccggagcaggtgaaggtgggtcacgtggtcagagctggacccatggctgaatccattcagccactttctgctcaggccaggactgaccccaggacacagcctgcagtaggggagctcactgcccttgcttaggggcaggcaaagagattcaaaagccaaggggggcctggtaacactgacatcccaggctcagttctgctcatcagtccctgagtgagaaaagctgcaggtcttcaggcccttgtcactccctgctggtgttaatttactcacttcttagacgtctccgcagaaaggtcaagggctagatgagtaatcatggctgagctaatgcctcagcctcagccatcgattctcgacctcaattttcacaaatgtctcactatcttatccaaatatgcttcataccttggaggaaagggtgttcctggtgaagtttgcaaatgattgatttaagtggttgtggctttcagaaactggcataaaaaagaatgtgagcaaagaccgatctgcacaggaaccaaccattggatgctgctgtggggaggaatgtggataccaggaaacgggctctctccccctcctacaggagcccagagcctcctacctcagtccaccgattagagggtcacaggtttcaggatgcatcagaattacctggagaatgtgtcaacatgcaggttccagggccctggccctagagtcagattctatagatgtggcgcaagacccagaaatgtcatgtggccacgatccttcatgagcctgatggaggcatggtctcagagccttgctgctcaaagtgtggttggtggactgcaggcagtagaacagaaatgaagaatttcaggctacaggatcagaatctgcctttaacagaatcgccagtgattcttgtgcacgatgttgagaaatgctggcttagaccacattgtgagccccgttggctcttctctgggcccagatttttctctggctgtgttttgtgactccacttcactcacctctaattccctgagggaccccttccaccccaagataaatagaactgaccttctgggccacacactcttgcagggagacatgtacacacacacaggcacctaccaaggctgatgtggtagggccagcccagcagatctgggacctcagcaaagccaatctgagggcaagagaatgagaacagaaaaagtatgggggctacagccttgccaactgctcacagatttcagcaaagaaaacagcaataattaattctgccaatactttttgagcacctgctatgtgccaggccctgggggaatgacagccgccattcatataataccttttggttgataaaacatgttcactccattctgtcagtgaactgcacatacgacagagaaatgagcctgtgatatagaaagcatgatccccattttacagatgatgaaactgaggctccaagaaactgagttacttgtccaagatttaaaaatagcttttgagctgggatccccacttttttggctttcttccctcacactcaatgtgattaatttatttgctctacatggtcatttgagcattacccccgacatttttttctgccttttctgccatgatgactgtccagcatggagaagcattgtgtccagttgccactgaatttccattagatggggccactcatcctgaactacaagtggcactgagtatgcccatgctcacagcagctattcatcatagctaaattttcatcacagctaaaatgtggaagcaacccaagtgctcatggatgaatgaatgaataattaaaatgtggcacatacatagaataaaatattatttagccttaaaaaggaaggaaattcttacacatgctactacatagattagccttaagctaattgaaataagtcaatcgcaaaaagagaaatattatataattctacttacatgagacacttaagagtagtcaaaatcatagagacaggaagtagaatggtggctaccagggggtgggagaagagggaaatgaagagttcgtatttaatggacacagagtctccattttgcaagaaaaagagttttggagatggatggtgtgaaggttgcacattatcaatgtatttaacgctactcaactctacatttaaaaatgattaagatggtatattttatgttacctgtattttaccacaatttaaaaaaatgggaggtggaggaagagattctaagcagcttcctgtgtaaaggccagatcttggaactggaagttaggactgagccaccaatcatgaacggaatgaccactgggactgcacagaaatatattaatatgtcagccaaacccaagattcagaggctgagcagggatacgcaagacattgctttgaagtgttgattccttatcactcatcagtgaaaattcttaaacttggagcaacaatgaaatgcttcctgaacacaagaaaataaaacaacaaaataaagaacaaaacaagccctgaacatgcctgaaccaagaaagccaggatgtgagggtgatgagcatgagggtgtgggcatgggcggattgcatggggctgggagtgcacagcgggggagcctgaatgagcaggcagagggacctgtgggcgcttgcttttgcttccgggtcttcttcattatcatgggcccggggaatctgagagggtctcacagtgcccacagccttacccttatcccaggtgcaactgctgatcctccctgaaacaccagctcataagggcatcctcatgtggaccagaagcaatgacactggccgtgtgtcacagcttacagagcatcttcatgtgccacccaatcatctatgccctggtgggagtactatctccactcattttacagatgatgaaactgagactcagaccagtaaagctgtctgtccaaggaataaccagagggtagacttgcatccagactccaggctccaaggcccaaactctgcatctggcacctcatggtctcatgtctccggaataagtactcaatagccacagctgaggtgcctcatgcatcatgggcagccacagcccctgccccagtccccttgtctgatgaacacacatcatgatgccactctataaagaggaccgttgccagaaaggattaattcattaatgaatatgaggtctctggaaacccagaacgtgatgtaaatacccgtgctgtcaaagctgcctctctgttgcagaatgaaaagcaccaaaatccctccattgtccttggataatagctttgatttggggcagggcaggaggaaggagactctgtctgggggataaacaatgctgggatgttccaacatagcaggatttgcacacaggatccagcagagatggcgtgcttttctcaatattgtctgggatatcaaatgggaagactggaacagccaggggagatttggatgcctgagatctggagctgctggagctgaaggaattgatttccaactagatttctcacacgcctcgtgcttgggctggatggctgaaggtcagcccagctggcactgtcacctggagcacggacttagggtcttgccatggggtccaggcttctcaccgcatacagagtgagttctgaaggagaagatcttcaagggaacaagtgtcctaagagaccaccctcaaatgccatgtggttccaacttttctcaaggggaaggtacagttttagccagcccagacccaagggaagggatcagagacattcttgatgggaagagtgtcaaagatttgggggccatgttttaaagccatcacagggaaggacgtcagggtttggtataggattgagtttgaataccctagtcccagacacccaccccgtctctatgaggaagataatacagaacactccaacacttttttttcttttcatttttgagacagagtctccttctgtcacccaggttggagtgaagtggcgtgatcttggctcactgcaacctccacctcctgggttcaagtgattctcctgcctcagcctcctaagtagctggtactacagacacacatgaccatgccgggctaatttttgtatttttagaggagacaggatttcactatgtgggccaggctggtctcgaactcctgaccgcaaacgatccgcccgcctcagcctcccaaagtgctgggattgcagacttgagccaccgcacccagcccccaacactttgaattaaaccattttcatccttgaggcataagttttagggtccttaaggaacctaggtccttgcctttatttattgatgacaaaactgaagccacgagaggacacttgttatggccaatgtcacatgtctgctaagtgtcacagccagtgttcaaaaggaggctgctgactccaaatccaacactgactctttgctcccaggtctggctgctatagcagctgggctgcctcgttctttctaccaagatatggaatccatctttagagctgagtaaccagctgcaaaccagagccttccagcttctcttcctctaggagaagggcaaggaacagggcggcccagggatgtgtgctgtctagggaggctgtaggctggcagacaaataagagcagatcagctgacccccactccccccagggcgggtctatgatgggcaattggataaacacattcagaacaggatgaatgtgcagccgagcgtgagcacattttaaaatatacatttcacctccatatgcagatcccagtgacatgtgacaaatgtgctgtggcctccaggagctgttctccaaggaggcacttatttcatttgactccaagcatccaacctcaacagatggcagaattcagatgggtggcgggaagcaggcttcaattactgcaggaagactcaagttagacaatgggaagaactttccttctctggaacaccagcttttttcagcgactattttgcaatgtgatacacagactcaacatagacactttcacgtgaataaaagtgctctctgtagaaatggggggaaaaaaacctggttgatagaaacttagacttttagctcagactcccagattttctgcaatacactcattccacaaagggtgtcacccttgtgagcacttttggcttaaatgaaggctcagtgtctctttttggagagcagacaacatgttaaggacataaatatgtagatctgcgggtttacttgttttgttttttttttttgtttttttttttgagatggggtctcactatgttgaccagtctggtctcgaacttctggcctcaagcaatcctcccatcttggcctcccaaagggctgggattacaggcgtgagccaccatgcctgacctgaaatatgtagatttgaacttgaaaacctgagaactgaagccctgtaaccttttccaaactaatctgtgagacaggaaggggtttagaattatataaataagtcacctgcttgtgtgtcaggcacattttttctttttctgttgttgttgtgggggataacaccctttgtgagataaaactcacaaccatacaattatacaattcatccatttaaagtgtataatgcagtgaattatcgtatattcacatagttatgcagccatcattgtaagtcaattttagaaaatgttcattaccccaaaaagaaattccatacccttcacttccacacaaactctttgcctaggcaaccactaatcttctttccgtgtctatagacttacctattctgaacattgcaatacactagtctttcgtgtctgacttctttcccttatcatgttatttcaaggtttgtctatgttgcagcatgtatgccttcattcctttttattgtggaaaaagtgttcactgtatggatatgctatatttaatttatccgatcatcagctgatgggcatgtgggcggtttctattttggggtgatcatgaatactactgctatgagcattcatgtacaaggtttcctgtggatgtatgtcttcatttatcttggatatggacttagcagtggaattgctgagcatggaactgtacatttaacttcttgaggaactcccaaactgcttttcaaagaggctgaccatgttacactcacaacaacagtgtatgaggatccaattttttcacattctctccaacacttgttattatctgtctttttcatggtggccatcctactgggtggggaggtgcttcttttatgttatctcatttcatcttcagaacgctgccataagggcaggcactaccatcccaatgtacagatcacaatagtgaggctccaagaggttgagcctgtcaaggttgcaaagctggtaaagaggcataaagatgtgttgtcaggtttgcctgacacctctcccacttccctgtatcccagtccactctcaggcccgtcacgccacctgcatagccctctccatgtgtttatctttgtgttccacgtgtgactcattgctgagatggtcaggaatgacagcgactgaactttctatccaaactcaccttccttccctgagccttgagatggaaccatcccctcctggctgtgggcattccttctgtcaagggtgagagccagcccagactgccatgaaataaaccaacatgcttctcttccccaacccctccatcagtgcccagatccagccccactaggctccacctggctccatagctatttcacccacctcttggagcacatgaggctcttgcctggtccatcaatggcttcagggatctcccacatcagacttccaggaaatctccctttggttcaaaaaatcgtaatgaacaggaccctaaacaacctagcacctcctaagacccatgctgacatgggcccttggtcgtgagttgcatcattcagcctcctgctgaatgaggtcagcacctgctggacccacccatctcctgactcttccccttccccaccacacaggaagacaactgatgcagggagcatcagtgtcaggtgtgttgtatttatgtgacgcacacagttccctactctcccaccattgttcttcgatatatgacaaaactcccaatttgtcaaatgcttaacagcagtcaggaaaatgtattctccacacatccaccgagcttttcattttgcacaactgtcagcaagaacagtttacaaattttctgtcatggagattctgaaagaatggggaagaggggagaaacaccccccaccccaaccccttctgtgagtcacagcctcaacttgacagaagcccaggcagcagctgagactcccctgttacattacacgtcatcactctttgcatttaagcccattttccatgcagccatttctgaatgcatttctgtttccatcaaatccctccccatggtgtaaaagtaaatattagacagtgccctcctcctaaaagaccttgtatttcaagctcaaaaaagtctcctagagggactcagtagtagacagctgtctgctccacagatgccagccagcttccctggctgacatgcaacagattatcatgcaaacccagaagcctcaagcttttaagacattatatattgaaaatatacactgaatcatctttaacagaaaaaaaaaaactaaaaccaaccaaaatttccaaagagagacaatcgattaaataaattatgataacccccaaaatggaccatggtccaccatggaaagagtgtttctgtggtgtgggaatgtggttaggatatgttaactaaagcaagtttcaaaactgtatttacagtatgattcccatttagtaaatgtatgtatgtatatttatgcatagggggaaaaaagaccagatggatagacaccctaaatgttaacactcaagagattatctgctttttaaaaagatttttattttcatgtattttccacattttcttccatgaagcaaaaactttttttgaaaaagttgtttctgctcaacagtctattcatggaccattccaaaaactttaaacttggcagactgcggccagttgtacagtaaacataatttacagcccaatggctttctggcagtgagcactttttcattcacaccaggtgatgccatactgaacagcagctgtccatatgattttaatcacagtaacttttgaaaccacaacttgcagtgccccttattttgttccattaaaaagctgtcttttgaagctaatgagcaaattctctgagaactggaacctagcaaatgctgaatcactgggcgaatagcccgttaaatccatactagttatgcagctctttgaagacacacacagcttaggtaacttgaaacttccctctgagaatatataagatctctggttatcatatgtaaatgtaagtcaatgcctaacaagaaatgattatttgcaaataccttggctatgatctaagttgcagatctaatttgaggagtagcagagtgatcactttagcacagacctggaggctaagattaccctttacagggaaatcctgaatagggttgagacttcccaagagacagattctatgagctactcacaattacaactgtctaagctgaaagaaaatttcaacactaaatcccttagtctttccttttcctttctattcagtctcttctgttttatctcctttcctacccaccttgaatatttcttgagctatctctttaataatacttttagaatgtgctttcaaaacgtttgct

SEQ ID NO: 30 - DNA, 18295 bp, Homo sapiens
taatagcagtaggctgagtgatggacttaggaagggcaaagacccctttggcagggttaagaaaagcagaggtgaaatgagagaggtcaggacagtcacctgaagtatttcatagttctctaaaaagtactctcagattcaaatttccttgacactttgctaaccgttctgcacacctacatcctaaaggacagggctctccttaacatgaattaaatttgaatatgcctctaccttagaaaatatattgttcctctaccagtgtcctggcatatggagactgcctactgaaaatcatgggtatgacattgatttgtgtaatgctagctttggagtacatgtagctttttctctatggacttaaattttttttttttttgagacggagtctcactctgctgcccaggctggagtgcagtggcgccatctcggctcactgcaagctccacctcctgggttcatgccattctcctgcctcagcctcccgagtagctgggactacaggcacccgccaacatgccggctaattttttgtatttttagtagagacggggtttcaccttgttagccaggatggtctcaatctcctgacctcctgttccacccaccttgacttcccaaagtgctggcattacaggcatgagccaccgtgcccggccagacttaaattttaagggaggcatttacattaaattatacttcccacaatccactcagcttggtctttggctccattgttgggtggaattacaattgctagtacagtagctggatgttaaatagaagtcagtgtagaacaatagatgtcgaaataaaaaacaagattagaaacagaaaagttcatggcttcaaaatgcatgttagcctggggtaaaaaaactgcatggatcttacagaacatggagtccagcactgatacggacaggagatagggaaatactggtttgaagaaggcagttcccgggcaaaggccccccaccttcaagccaagaaacccacagccctcagtgagaacaggcattcctgtttttgcatccaaaaagttgccttttggcctgctatgtccccctatcttgcatccatataaaccctgaaccccaggctccagaaagaaatgcacggacgaatggcaaaatggggcagcagagaagaagagaaaagaaggaaaatcatcttcccactccattccccctctagctccccatccatcccacggagagccacctccaccactcaaaaagacccccacattcactctttaagtccatgtgcagcctcattcttcctagactccaaacaagaacccgggtgccaagagggcactgagctggttaactttagctgtctgcagattgcaaagccaaaagagcatgctgtaacatgcccgctgggcttcaggagtcgcagacacccacccttagagacaaccagggggccagaggccaaagtccttgccctggctcctaaacctgcctgtctgtgtgctccccctcccgtaaggggtttgagcttgtggcagctgaacagagaggcatacccctgtcacatgtcatgtgggggaagcagggaactctcctgtttcagcaccttcatttttaaaacaaggatactaaggtttagagagaatagttacactttctcaaggttaaactctacggaatgggatgaaatggtgatagaattcagtgcttattccatctccatgtgagaggcctgagggacatggcatcattctgctagggccttcgagttattggaatttttgcaaagcatgtcaacatcccacccggcagaaactctggcatattcacttcatccacgtgcttcttctgggaccccttgttttagccaactccatacccatacttcaggagactcctgattttcctgaactctgagtcctggacttgtgttcccacacccagccttggctcttctctcaggctaaccttagccccatttgctctgctagaatgtccctttctgttttcttcctcctttggttctactgcaaccagcctcaccaaacagtattctgctcatctgtctaggagctctgcaatacacctgagctcataccctgccacacctgccccagccccacgaaggaaaacaaaacaatagcaacaaacaaacaaacaaacaaaaaaaaaaaaccctgctgaactcagattctgattcagctagcatgaagccatgacttgtaccaggcactgtcctaggtgctggggtgaacactgtcatatttaacttaacctaccagcctttcatagaatcctgctctgtgaaatttgcacaggggccaaagggaaacaaggcattatttataataattggcttgccattatccattctgttggcgctgcctgcaacaacatgatggacctgtatgctattcacagtctataaaaaagtagttctgttgtgattcaacatatagtaatctccattttaagaggacaatagaaacactcagctgttattcatcccagagccttaaacggcagagaattcctttatcaggaacataaggttagaacagcatgagttattaacattgaaagtagcccaatgcatttattgaggtgctcaaactattgaaaaaaattaacgatttttaaaagtaaaaggctagacctcaagtagcactttgggagaagtgtgtcaaaggcacaaactattcagaactgcttaggttgaaatgaggatggggaaagagtcttggtccccataacccaactcagttctgaatgttctgaagagagtaaaggagaaacgccaggcatgttcagaaatccagatttgaggggccaggagtggtgggaaatatgggagcagctgcaaatcatagttaattaacaatcattagggatacatgcataacacattttgtattcagttagctatttatttatttattcacagccacattccacaaagggcttgaggcagcctacaatggcaaaatgcaaacaagcgtaaaaagtcaggactagcatatacggtgaggaacaccttggccagaagggcacacatctgtcagccctaagggactccagaggtaccacagtcaagttccaaatttggcttgaggcatcctggcagccaaagtgaaaaggagacagggtcaggtccaagcattctctttaacaagacactgttaaatgtctttctttcaaagcaggtaaaaagctgaacactgacacagcggccccacaaataactgcagaatcagtggtctgcaactgcagtaaaatggatgggacaagggacaatggcaaaggagttgggttctggagctgaaagtcctcactgtgaggtccagcttaacctctactagctccagggtcctggagaagatgtttaatttctctggggcacgttcttattatgcataaaccagagatttaaaaagacttaatttgctaagtcgtgtgtcagaaagaagaaaaatgaaagagggagaacgaataaaggaatgaataggtatgtactatgaagtgaattgaaacatatagagcacctagcatatgaaacataccagaaccttttctagtttttttttttctttaattctttctgtgaaattgagtctgggtagcagactgttcctccatctgagtggctgtttgtcagtctctgtcttccctctcccatcctctgcccctaccactctcttcaacctcaactccagaggtagctggggctatgccacatctcaatctcagaacaccagggcacagagaagtaaagagacccaagtgatggatgggtgggtgagtctataattctcagaggaacattattagaaacaacaagtggtgatgggcacaggatcaaccaacacaatgagagagaaaaacagtcaactcggagatcaggtaatcagtgattgataatctgataatggttgaacactcacaaggaagggccatatactgaaatgagtccatttattttacatattcctaccttgagtgcttgttcacaaatatgctttacctaatccattctgattttgatgaaaagttccattttgtagaaatggaacttttgtagaacatttctacaaaatggaacttttcatcaaaatcagaatggatgccagcaatccatccaaaaccagaatagagccagcaatactggctgtcttgatgctaaacacttttcgatatcagctaacagcatgagactaactatcgagcttttgtgttttcagtgaccgtatttttctaagccaaacatttaaaaaattcacataaaagtcaaattacttgtatatattttgaggctcatctagtttaagaaaaaaaagctatcaaaaactgaatatctcttggaaattctgagtcatacagccactgcattaagctacttggacaggtgatcttcccatttttcagatgattctccttaccttcaagcttaggtaagaagtctctgctctctgttccctttgaacttgcacacatctccattctaacacttaccactctacagctgagtttctgattagactaagaacccactggccacaggatgtctgccctattcagttgcatgtttccaaaatttgctcaataacaaccaaagggaactgttttgcaagcgtagaaaatcagttcttcagtacactactaaatgcagcaagctaccctccttttttctacattgccctctacactttttagcttctagacttctcatcctgccttgaccagccccagctaggcctctttagttgcaagattccaagaagtcagagaggacctacattcacagggcctgagccagctcggagaaacgggccccctgggagtagccacagagggtcaggtggaatccatcatggtgcatcagggctgagagttgaatctgtacaatagcccaggccatgggaggccttcctaaggcccgacttgaccactaaggatctgttacttcttgggtccccaatctagcagtgagagtgaaggaaattctcaggttccttggccaaaacctcaactctctgccttcagaatatgagcttaatgagaattccctggatgagaaccactgtcattcatttaaatcacagctacacattaccgtgaagccttatcacactgggcctctctgatctcctgtaaagggtcatcaatttctgtatcttttacttttttttgtctgaataatgaacatactgctgaaagcaatgcccgggatgaccgggcacatctaggagattctaaaagtgtgagtttcagatttttggtacgattttattttcttcatgcttaaagtctcataaaattctggatccatttaatcatactacctaatcatatgtttatcatgaaaagtagcactaatgtggtaggcagactgtttttccatgtttctttctttctttctattttattttattttttatttttttaagagatagggtctctttcacctaggctagagcttattgcagcctcgcacacctgggatcaaacaaccctcttgcctcaacctcccatgcccatgtagctgggactacaggtatatgctaccacacccagctaatttttttaatttttttgtagagatgaggtctcactgtgttacctaggttggtcttgaactcctggcatcaagcaatctttctgccttggcctcccaaagcactggggttacaggcatgagccaccatgcctggccccatgtcctgtttctaaactaataattagcaaggtaaggcaaaaacggtccttttacctgtatttgagctcacatctacggaggcttcaacagaacaattccatgtcctatttttggaagaaagctccaatttctagccctagttttcagtgttgtggagtagttttatttcctgtctttcgtattttttttttaaaaaaagcttctccaacattttagttgcaatctgagacagtctgtttcagagacaaaattttacagccagatgctccagtgtgagccgctgcagtttgtttctaaggatgatcagtaacgaatggggaatgcttgtcatttgctcaaatattgtgaagtcttgtcttttcttgggcacatgcacacttttataggcaaggtttcatccatccgtaatgcctgctgggacaactgggagaacaggtcagtcatttgcagaaacagacctaaaaccctaaggcctaggagccatcacagcccccaccccatctggacattaacaagacacacagggtggggaaagaaggcaaatgggagtgcagtggagtcaggagataggcaactctgggcctccacttccgtgggggattttaataatctccctggagtcacagtgggttgttataaggaggcagagggaaggtaggatggttctgatacagaaaatagctcctcagtgggacaggggagatgacagcagagaagctttcaaccacctttttttttgtgatgccacaagtctctgcagctcacctgtatagcgctattgctctattccacgtgacaaaacatgagtcacctgctcaattagtttcattcagtccattatccctatagctagggagagctctctcccataaactggcaaatcattgttcaatatatttaatcttaatatggttgatccttccttttctttctttttacctctcttcctctctccatccttcttattcatccatccacctatctatccatccatttacctgaaggtatgttgaccatctactttgtgtcaggtactattccaagcacttaatatacaatatctgattaaattttaacaataccctggaagttagctcttaatattctttatgaatattatatgaggtttagagagtttatgtgtcttgtccaagattcagcaaaattcagcccatgggctaaattcaacctatttttgtaaataaagtttagttggaacatatccatgcccatttgtttacgtatgacacaatttcagcagagtggagtagttacaacagagaccatttggtccacaaatgctaacatatttactaactggcccttaactgaaaaagtttgccaacccctgttcttgcccagtaatacttagcaagaaagtagcagagtcaaagattcaaacccagatctatttaactcaaaaggccataattcttcaatgctgtgtcatgcaacagaagtatgtgagttttgtctacatgacttcttgacacctagggtgagatggccaggctagatttatggtaagaggaacagatctgacatatattacttagtaagtagccaattactgtggaagactctcttcatttgtaagaaaagccagtgaggatgctttttttttttttcctggtgaagtaattatagagacgagtgttgatgcatgttttgactttgctgcaaaagtagttctgtcttctccagtttaagtaattacattagtttctaaatagagcagatggaactatagttgtcaaagaatgcaaagatcagtcaactgcatttatggtgtgacattctaagcagagataccgcaaagtatcttgtgcaaaaccaactaggtgagtgctattgagcacctgtgagccagaagaaaacaggagaaaaatgtggctaaatggaaatggaaatttctacacaatgggatctggtggcaaacacattttcctaccataatgccccaacaattgcttgttttctaatgttgcctggttgggggaagatatattctgagtgttcctccaaacttgtagaactcaatttttctgggggagagggttgtcctaagatggtctgcttggtactcagagtgcaaagatgtctcctgcaagaagcaagcagcttatgaaggaagcaatgacttaaagcagacacgttacctctaaagaacagggagaagatcaaatccagaaccaggcagtagtaataagggaactgacctggcaataggccaaggatccaaacgacatgggaaccaggcatgattcaaaacagccactgctgaacacctacaccaatggggggaaaaatgatactcttagcgttagagtccacaactgctacagagtctcagctgtgatttctactgccgggtgtccccatagaagtctgcatcccaacccctgagacctgtgaatatgttaccttacttagcaaaagggactttgcagatataattaagctaaagatcttgagatggggagattattcttcattttttgggtgggctcagtgtaatcacaagtgtccttgtaaatgaaagtgggaggtaagagggtcagagtcagagagagatgtcaagatgctacactgctacctttgaagatagaggaaggggccatgagccaagcagtgcagacagcttctaggagctagaaaaagtcagccgacagattctgtcccagaacctctagaaccaacacatccaggcaacaccttgattttagcccagtgaaacccatttcagacatctgactcccagaaggccagaagataataaatttgtgtggtttcaagccactatgtctatggtaatttgttatagcagcaatgataaactaatacaacagccctgacttggggggagggtaaaggaaagagccacacaccaccaccctctcaccatgggaggaatagttgaaatgaacacatgacttcaggtccccaacaaagagctgaatgggtttcaggctagcttgctaattcattcaccaattctcagctctggtgttgcttgattcagaaggtaaagacaatttttaaatttccttaatttcaaaacttaattcatccaatgcatttaatttaaaatcatacattatttatccacaaatcctgatacacagggaaagaaacagaaatatttgctggacaggtggcatggaaacaaagggttattagcgattgccatgcaggcctaagtgaattcacaatgaccatcatgacatcatgtctgttgttactatcaagagcgttgctcttggataagtatcaataacctcagaactatggaaagaaccatgtgtggagtttggcaccacagatattctctgagtgattgaagtctcttctaccatggtgagtggtaccatggaagtaatcttgtccccaggcctcctaagcttacttatgatgaagtgatgagactcttacccaagaaaccattacagaaaaaaaaatcctcgcctaataaaattgtgccagtgaacaaactctcagatatatggccatattgacaagatctgcaatggtatcaaaagaggtcaagctaataacctgaggaaacaggaagaaaactccaattgtcttatacagaaggtctacaatcaataggatgaagtctaacactggcgagagtggggtgagatggatgaacttctctaccacctggtgatgaaatacattgggattctatgaaaaagcatttttttctaaactcaatttccatattaattttagagctatatgtaattagttaaaaatgttcctgaagacttaaatcaagataatcttttagaagtaacaaaatgatctacacatgaaaatactcaattcagcttcacatattgccacatgttatgttccctgagaagcagactctgagagtttagcatgtagatgttttaagtggtttccgtggggtcaacagctatgcagaataggggaagttagcaggaatggggcagaaatagaagtcaagctgtgaggtaggcccaataacatcttcagctaacctgctggggagctctaaggctggaatgtgagttgtcctgttttggggatgaaatggtaaaacatttaaactcttgattctctgagtcagtgaacattggctgccccaggaaggagcccaatcttgggcaaggcaactctctaaagctgaggggattcttgaagaagcttgtgtaaatgaatgaatgaatgaatgaatgcaagcttgtgcaaggttaacccagtggacttggggtactcaaactctgcacattttaaagagaagactggccccttgaccatcctgggagataacctataagcctttggaatacctagcctgatacaaatgtctttgtgtatctggggtcttgggatatgccagatagtttatgcaaacaatgtgatttatggtgaatgcctgtttttgttcacctggggccctggtcatgctgtattggttggacgccggagactgagcagtcatggaggtaccccaggcctatgtgactagcccccagtagaaaccctagagaccaaagctcaggtgagcttccttgttggcaatccttcctatgcattgtcacacactgttgctgagaggatgaagcattgctggcacaaccccaagatcacacatgctttctcctatgctgtttttgttgttgttgttgttttgtttttttgtttttgagacggagtctcactctgtcgcccaggctgcagtgcagtggtgcgatcttggctcactgcaatctctgcctcctgcattccagcgattctcctgcctcagcctccttaatagctgggattacaggcctggctaatttttgcatttttagtagagatgggatttcaccatattggttaggctggtctcgaactcctgactttgtgatccactcacctcgacctcccaaagtgctggggttacaggcgtgagccaccacacccggccactatcctatgcttcttttaaaaccagccgttcactgttaatctgtattcttttactatattatctatatttactatgtttactaatttttactgtattactaattttatatattatactaaatttatgtaatattactaattttactatattttactatatttattaatatttactatattaatatatatcttttactatattaaactggaacatgagtatagcagctttcctgagttctgtgagtccttttataaatcatcaagcctaaggatggtctcagggacccctgacatagggctagcacttaagagcagcctgctagctgtagtctcagcagctagggtaacaaatcctttcttgaagggatagccaggtggcacatcacagtatgtacctataaaagctagaaacaagtgaaatattcataaataggacatctatttggcaaagtagaagttaggaagtacccagccaagctctgcctcatggaataagagtgctttttgagaatgattccaatatctatcttcatttgctatacatatggagaaaacagtcctctcagtttggggagaaactctgaattattcttaaagaatctctggttatcccctctagcttacactgaacattctaggtccttgagaagatcctcatttcaaaggcaatagaaaccatctgaaattgattcattggaaaatgtatatgctattaacaccagagagcagaagtagactggctaaaatatagcaacttgaaatatattttatgtactggaatttgatcaaatagatggataacttctggaatgatgacagcaaacaatctttggaaaaacacatgactgtgcttggagaacggtatcatagtttttaagaaatgtacactgcatagctagatagcatagcagtgtccatttaaaccccaatctaacacttcgttgtaagttgacagtaggagaaaatggttattagaatatggtttgacaggccaggagctatggctcacacctgtaatcccagcactttgggaggctgaggcaggaagatcacttgaggccaggagttcgagacagtgcaaaacctcattgtctttacttaaaatacaaaaattagctgagtgtggtagcacacgcctgtaatcccagctactctggtggctgaggcacgagaattgcttgtacctgggaggtggaggtcacagtgagctgtaattacaccactgccctccagcctgggcaacacagcaagactctgaaaatatatatatatatatatatatatatatatatataataaaatattaatatattataataatataatttattatatataattatctataatatattataatataattattatatataatataatatataattatatataatatattataataatataatataatatataattatatataatatattataatatattatatattatattatatatattatatatatataatatatatataatatatatattatatatattatatatatattataaatatataatatatatataatatatatataatataataatatatatattataataatataatatattatatatataattatatataatattatatatatggtttgatgggttacttgataactgccaattcagtcttgagatgaggaacaaaactgaaatatgaaacatgactggtctggtagaccacaggactgcttctggtccaccgactgtgaacgttaatgatgtgtgttcattgctgggttgaggtaagtatgagttggtgcactaccccctatttctctctttctttgtcacagaggccttgaaagctccatgatagagatgacagagctataagatgaaagcagcccaaatccctgagtcaccaatgtttgaagaagagcttcccaggagaggtaccagacccacatgagacttcacatgattataaaatgaacttctattgtgttgaatctctgaacttcagggttgttttgcagcacagactacattatagtgacaagtagaggaaggtacaggcatgctaatttcattttaaaattaatcaaggattgtcaatggaaaataaagatttcagattccttgcaccttaaaaaagacgaaaaatatgtcttttttcttccccaacccctgcttatgtgaagcattatagtctaatagctggcattttagagagatgaaaaagatgagtttgcttcaaaatgtatatatgaccagactgtaaattcacatgcaacgcagtctgctttgggagttaaacatattatttaaacaaatcattataacttgacttattatacctcaatttgattataaaacaaacattaaagtgaaatctaaggtaagtcttttttatttccagttccaaagccatttccatttcttacttatctttgaatcctcagccccaagcacagtgcctgaaacacagcaggtatccacaatctttggatgactgaatgaaaaggaaagtttaaagtcaattacctttaatcttgcttgtggtttctcagagctaatttgaacactagatggagaaatactgaaaaaaaatatttttcagaaaggcaagcatcctcttggtctgagaggtttcataacaagttaattttattttaaatcagtatgaatggatggatgataaactttggaaagtcacacttagaactacattgaaaacaaatgaatgtgtccccagatgaaaaataataactatgtaaataaaatttgaaataaccacttgatagcaaagagaactccagtatcaagaaatattttaaattccatgcaatggttaattatattcctgaaatctatgcacaaaagggcaaaattgaagaaaaaaaagaatataggttaagatgaaattcgtgaacaagaacctgaaaaatataataggcaacaatgtgctgcatttccacatttaagaggctttaacatccatatttttctcccatgtgcaattacatgaacttataatccttgaaaaattgttattatttttgttgctaaaactgcttgtaataggagtcacagatatgtgtagtaatatgctcagatgattacatttgaacaaataccatggtaataattctcatatttggaaatgctagaatctgaattacacatacagtttgtggcatctcttttttgaagccttagattttattttattttttgttttaagaccaagtaaaaatccaactttcagctaatggaattctaggtctagttggtagaacgagatccagatggagttcaaaacacctgctgaatagtatctgtaaactgccagcttgatatcgtcaccaagaattctgcaagctgagtgtccacattggaatcttaaggacttgcatacagtgtagttatatataactcataagaactaattattaactactagactgtgaggactctttctttggcttttaaggaaagtcaccgagttaatgctgaatatatttctaaaaaattgtacttatgaaattaatagagttgaccgacaatttgaataatattaggctacagtaacctcgaacttgattactcttatacatggtaaaacaatccagaaatcctggggaagggttgtttattatggctgcatggaggttgcccaagccctggcattcttttacagtttcaagggagggcaaaagtctgaagtgggtagggactgagccatacttaataatttaaacttagtatcatggaacaattcacacccgttacatacaagttaaataaccttcatgctgtgttgcaaactgctcttcctgctatacttcaaacagatagaatcattttacaaaataaaattaccaaaatgaggatatacttcataaaactgttcaagggagaagcaaacctttggtgaagagtgtgatataatcaccaatggctttaagaatgccattgggaggatcttaaaatggagatgggccagatgcagtggctcacacctgtaatcccaacactttggaggctgaggtgggggcatcacttgagatcaggagtttgagaccagcctggccaacacggtaaaacactgtctctactaaaaatacaaaaattagctgggcatggtgacgcatgcttgtaatcttagctactcaggaggctgaggcaggagaattgcttgaattcaggaggtggaggttgcagtgagccgagatcacaccactgcactccagcctgggtgacagagtgagactccaactcaaaaataattaattaattaatcaattaattaaaataaaatggagatgaaggatggaagtgatggtgagatgtgcaagttccagcatgtgtggatctgatggcttttgaaagtatcaactgtagggattctatcatattcttacaggaacctaacagtgttgatatatatgatgaaatatagcactcaaaccttcatggaagatggtgcctctgactctggagggatacaatgaggagagagagcacacagccatagtcgaggtctccaagtctatcatgcatcagcatcaccaagagggtttcctaagatttagattgctggatgccacccccagagtttctgattccataggtttaagtgaggacctaataatttgcattttcaacaagttatcaggttattctgacactgctggtcagggaactatgctttgagaattactggtctacgtgtttcacttagaagccagaatggttcaccactgtctccttctcactgggctaaaaatccaaagtcctaaccattgccagcaaggatctatgtgatctgggccttaacaatctttctgacatcatctcctgccagtctccttgttgctagcaccactcaaggctcattgtcctccttgctgatccttacatatgccaagcttgttcccccctcacatcctttgcaattgctgcttgctccctcaacccagaatggggttcctgcagatcttcaaagggcttgctatctcacttcattcagttctttgtgcagagaagctttccataaccatcctacttaaaatcgctcttctccacagttcccctttcattactgtctgtcccttccctgaaaatttttcatatcattttcacctgaagaataatatttatttaccgattgtcagctcctctaagaacagggacttggtttgattcactgctgagttcccagtgcataagaaagtatctgacacacagtaggcattcaatacaaatttgttaaagaaaaggatgaataattgattgaataaataattttaagaaagagcaactgcaaatatattagccagcctccaaactgacaaagctaagagggtaaaggtctgagatttaaaaatcaaacttgcatctatgaaaacactctataaataagaatgtacactatatgagagaatttctgttatacataaagaagggtgaattgtatctactcacaggagccaattgtgcacatctcttcccaacccaatattcaataactttacactgatagggagaaatcagtcacagtaggaatatttacacccaggaaattggcaaacattacaattcaaggcttatttttatcagcacactactgattctatccatagataaacacattccattactcagtttgatagcctcacccatgtacctgtcacccagaccagaggtgagacaggtttgttgccaattaaaggagggaaaatgggacatctcagtataacagattgggatagactgggaagcttatctaaatcttacttcaggatgtccatttagcggggctgaacatctactttgccctgcctgagcggtcgaaacataaaacaggtggacatggggatgtgtgcttttgaagatactcacccttcgctcctgctctacatgtattatggggaaactgatcctaatcttgagtctatggatagaatatatgactcatattattcaagtctaaagttgggcccaacaatggattttcagttacacaagtccataaaatctccctctgtcttacttatgactaaatgaatcctgactatgctgtgcttttttaaaagcaggatataaaatagtacaaacccaagtttgagcacaagtaaatcaaatacatactcaagccacaagtgacagaatggaataagcaccgaaccagtaaaatttctttatttttttgttggtagttgtacaaatctattctttgtctaaacatttttgcttaaattttagtcacattgtttctgcaattaaaaaatccataatatataggttgaatttcaattttcttctctgtttataaactgttttcccacacattagaaagatgtctaagataaacccatgaattaatggagaattaaaatggcagagccaatttaaataccacatatttaaacaaacactagaaaaaaaatctcttgcaacagagattgctatagcacattaattataaggtttcagatagatttttgtaactcaaacataaattttaaagaaccttcccatttgtttctttaagttattaatgtctccaatagaaggacaagttgacctttaaatctgaaccagctcagaaaaaggcccaaatgcacacttgacctcttctacaaggagcctattttagtcacaatacaattttacccactcacaggtgctctgtagcagcctgacagtggcatttacatttttttttaaataagctaagaaataatagaacaaggaacactggtagtcacttgctttaattgtaactttgggcctctgttctgtcttatcacccattttagctgacgaatgcacttcctcattccctgttttcctcgtggtaaagtaagaaacttgaatttgaaaccagagccctgagtctcctatgccctggccatccactgcctttgcatgcagcctctgttctggccctgaatccgctctctccgcaattcccagagcattccttgggtctcaactctaaggaagcatattcctttcacgaatcattttgtaggggacacaggagggtacattcccctagcacagcctacagcatttcactaaaaagcacccagagaactttccctaaagtctcctccttagcccacagtcttctgggctttccaagctttcccactttttctcttcttgatgtccctgtctgttatattgctcctaaatttcaggacactaggagacacaaaccaatcaaaagatttcacatgctcttttaggtattataattcagtgtttacaaattatctagacattaattagatccctctcttctaccttcctggtaatcttactccattctttccaggcacctgtctttttactctggccatggtccgtcagcatttcaaattgtctacgccgcttctgctttacaaaataaccagaaaatccctctccccccaacccgaatgaagctgggaattttaacctgccatctgtcagcagctatggacctatatgatatctccttttgacagccaaacatcataaaagtgttgtctacacagatggagttcattctttacctgctacaatctggtttctgcccataccacacctctgtacctgccctcaccaagtctaacaagttcttaatcaaatgggcatgttgcaccttgtgttacttgaa

SEQ ID NO: 31 - DNA, 345778 bp, Homo sapiens
aaaaatgccacaattttcaagtgcataggcttatactgaacagtgccaatagtcaacatgacagaggtcaaatttggttgcaatttcaactaatgcctttggaaacatttaagcacacattgacgaaatttggttaaagggtccgagagcaagtatttgaggtttattgaacagtactagatgaaaaagtatgtgtatgtctgaaacatcgagatgaatgtagcatttgtcttacttgggtgttcgagctaacatgttttgcttacctggcaacttcagtaaggaagctaagcgtagggctatgcggagcccaaaatttggaaccacttcattcccgtagatgtaaattgattagtaggagcaagagaggatcaatgatactaaataaactaaaccctaggggggactagttcagaagtatgatgatttgagtaccgaggaataaaatgaaatacaactaacatatcacgctgaaatctcaggttatgtttgcttttcttatgtaataaaatagagtctcttaataataattagctttcaaatagcattcatgcactgataagactaataaataaaactagaaaaatatctcctctagactttcaccaggagcactgataaattgttacatcgtttatcagacaatcatgtgtctcatttgtagatatcttatttctctgagactgcctgaaatgggcagagtaaagcagtttgttgataattatcaaatagtatctttctctctagaaagttgaaataattgaaagagaattaatatcagcatattatctttacccttaatatttcttcttcaggggatgaggtattcttaatgtttattaaaatctcccaatgcttttctttcaggaggacttcatttcattgaaagaaccaggcaggtaggtcagtgttccgactgacgtttacaaatgatagttttcatttataagataaacatccccatcaattttgaggtctcgatctaattatttcatcatagtttttgaaatatggaacttatttacatttaaacttctcctcctctgatcatggttgactgcagcctcaacctccctgggctcaagtgatcctcccacctcagcctcccaagtagctgggaccacaggcaggtgccaccacactcgactaatttttgtagtttttgtagagatggggtttcaccacattgccaggctggtcttcaactcctgggctcaagggatcatcctacctcggcctcccaaagttctgggattacaggtatgagccgctgtgcccggactgaagatatttaacaatgttatgttgactcagaattgtttaaagtcagagttaatgagataatttacatatataagtataaagtatattgtataacatacataacatagattataacatgtaacatacattcatacaataaccctttttaatgtacagtgctgtgagttatagcaaatacacagtcatgtagccacgaaaacagtgaagatacaggatgttcccatcatcacaaaatgtgccccagggacactttgtagtaaaccaatcccttgatctgaagcccctggctaatgctgatttattttctctaactatggttttgcctttccccaaatatcacataaatggaatcagaattttccttcactacccttagttttggcttttctgtgtatgtacatgtcagactggctctccctctatgtctttcttgccccttctcatgggtaccctatcttgctgcttacttgatgcttgctggcctgttagaaagcaaggagttttctactgtcctgtcttaggaagacccccaatccttggcatctcattatcagggttttcttagttaatctgccctcaatgaatctcaggaaatctgttctcaatggtagctacaatatgccttgcttatttgttggactttgtatgggacagaaattcctggcccatctacagtgattggagaccacaacacagttttctgttttgtgtccaggagtaactattttgtttcttttttacttcccccagctgcaatgggccttcatctgtgcaacagggcttatggtccctctagtcgttagagaagaatcacaggtcacctttcccacaggagtccctgctgtcctcctccaggcttacaccatgagagggtgactctgatctcacaggctgtcctaaatttgagacggagtctcggtctgttgcccaggctggagtgcagaggcgcgatctcagctcactgcaagctccgcctcccgggttcacgccattctcctgcctcagcctcctgagtagctgggactagaggtgcccgtcaccacgcccggctaattttcatatatttagtagagacgtggtttcaccacgttggccggatggtcgcgatctcctgacctcgtgatccgcccgcgtcagcctcccaaaatgctgggattgcaggcgtgagccaccgcgcccggcctacactttcttacacccactcggagttcgtctgtggagagcagcccctgagtgagtgaacgtcgttttgtgtgtatctctcaagaggttctaacttctcatgccattcctctaaacactgcttctttagcaacccatcgaacattgttaacgaattcttcttatgtggttacagtacctggcttcccttccttctgtgttcttctcaggtgaaccaatgcgcatgcgtcatccccttagtgggtcctgcttttccatagagtttacactactcgtttgccttgaaactgtagccctctgaggggctccagaaaagttaaaatatttttagttcttcagctgtcttgtgttattggagtaggaaatatttatttccagctttctgccttctgaagaagaattctgccctgcaaccctgcaatatttcaaccctacaatatttattagtatctacattacaactctagaaatagtaatcattccttccatctacctaaaataattagttctaatattaaaagattctaccaatggatatagtgctggattcaataactttttatcttttttttcctactaagagattgtataatttgactttgattcttgttgacatttttgttaataatatgtaatctacatttttcattcagaaatttgtttcttgcatgaaaaagtaaagtgattccatcatcgcttttctctgtgaattaaaaaaacactacattttaagtgatcttccatagtcagtggctatttaaaataatgacttcatttgcctctaggagatttgtgattagcatttttactttgaaatcttagactcagtagaaatgttagtaataagttcagtcgttggttctattttatttttttttataggtaccatttttgaaacttgcactaatacaacagccggttgccacatgtagcgcttaactctagtttatgttgattaaaattaagaaaaagtaaacatttaattcttcagttgcagtaaccatatttcaaattgctggacagatgaatgtggcaagtagccactgtactggtcaacatagatttagaatatttccaacattccagaattttttattagtgctgctctaaactatgtaatgcatattctagtttgttctcctggtttccattttcagctttgacaagtactaaattttgatgtatatatttcagccaggtattatgataaatatctaaataaaaaataaatgtttaaaaattataataaaacaaatggtggcctggtgcggtggctcacacttgtaatcccaagactctgggaggccgaggtatggggatcacctgaggtcaggagttcaagaccagtctggccaacatgacgaaactccatctctgctaaaaatgcaaaaattagcctggcatggtggcgcatgtctgtagttgcagctatcgggaggctgaggcaggaggatcacttgaatccaagaagtgaaggttgtagtgagctgagatcacaccactgcactccagcttgggcgagagagcaagactccgtcttaaaaaaaaaaataaaaaaaatttaaaacccaagaaatatattatttcgtagttcttatgcatttgtgaatgtattatttgattctagcagtgtaggaaaggcagggctcataatactaattctacagacgaagaagtgagacataaaaagataaagtgatgtgtccaattcacataaccacaagtggtataacctaaattgaggcacagctctctgatgttaattcagtttctttctattctattaagtcctggtaagttggatccaattaactgagttcattgccaactgtcaagcacactttgactattacatattatttttcttttgtgtcttttatacctcgtatttcatttatacctggagtgcgtttgtaattttcacaacctgttaaaatcttttcctctttgagagtccagttaaaaatgtcaccttcactcattttatattcgtttttagctctatctctaacctttagggaatgtatcatgagttgctttttagtaacttagcaacatgtgaatatatcgtattttttccactaatttataaatctattacagagaggggcaaagttatattcagttttatatccctagagtatctctgatagtgtttggtactgaatctacattagttgcagcaaataaatggatacaaaaggacattttaaagcagcccaggaaactctcagtaaatttgcagagactgctttagtttgaacagaacattttaaatgaagacacggatctccttatttgattactttagttgtaatgcaggcaagtttatgtccatttccagtacttactgggaggaaaatgacagatgtgagttgtaagcagaagaggagatggagccactgctcattctagatttcctaagaatcatatccttattcatttaatctttggaaaaaaagctattctctccccctatagacagcaactaggatctctgtttctccagtacaagagtagtagttttctattttaaactttgctcttggaaagtgtctcaccatgaaatggccttcattttcatctcatacattttatttcttataatttgccagaatgaatgacacatattttctcttctgatttttttaaatgttgagtcatcaaagacaattgagctctcatagagataaatggaaatgaactgtctatatgaaaagaagcaagttgacagaaaggaattaaatgaagtaaatatttcttacgtaagtggtacctattcagcacatagggctttgaataatttgcagagtcatgcagactcactttggaatgcagaaagtttctaaaataatttaaatatgtccagttgacagtttcttgaacactttgagtaaaagcatgtcacaactaagaaaagtaatagaaagaactcaagtattttaaaagaaacaggctagtcttatgaaacaacacaaattcatattaaaaagatcaatttaatttaaaaagtgtggaggatagtggttaaaaagcatttgaaagattttgaaagcatccaggttcaattgcagaatgaatggtgtataccagcattgtactctgggattcatgaatccctaggattctgggatgttttcaggaggaattgagaggtctcaactattttcttcataaaacaggatgctgttttcctttttcactatgctgatacttgtgccagtgaaacaaagtgatgatgggtgaaagtgctggtgccttggcagaaatcaaggcaatgacagcaaagggtcctagtaatagtcagtatattctttacttccagttcagctattttgttgttgttgtcatttttgttgtttgttttgtttggtcttttggtgtgagccaccacacctagcaaggtctattcttgcagggaaaaaaaaaaaaaaaaaaaaaaaaaaaaaaggccaggagcggtggctcatgcctgtaatcccagcactttggaaggctgaggcaggtggatcacctgaggtcaggagttcaagaccagcctggccaacatggtgaaaccctgtctctactaaagatacaaaaattagccaggtgtggtggcaggcgcctataatcccagctactcgggaggctgaggcaggagaatcccttgaacccaggaggcggagtttgcagtgagccgaggtcaggccatcgcaccccagcctgggggacaagagtaaaactccgtctccaaaaacaaacaaacaaaaaaacacaaaaaacagttgttacttaagaatgtccctataaagaagtacaagttttaaatttcattaaatctggattcttttaagtattctgtgtaacaaaatgtatatataaagcaggactttgattccttaccacataaagtagtggtctccaaggacagcacttgtgcaattctttgagaactaaagtagccattttgttttaatggaacatcatttaactttaaagaatgtctgacagagtttaattcagatttgagtatttagggggtgttttctcaaaatgaacaaattggatctatcacttaaaggaataaaaccgacagtatttattgccagtgataaaatgtaagctttcaggtaaaaaagagaacttataaaaacttatatatagcaccataagcctggtaggttcccagtacttaaagatttttctgataagatcagtggcattgttaacacatgagaatttttagatattttatagctcagtgactcaataagtctcaaatgaccaatgcatgatgttacaaaatcatgaatcagttaaaaagtcccaaattgcagatagacaaatagtatttaagacatcacagaataaaagttcattgacagtgctttcatattccacactgaaattcaccttgatttgtaagatttggtgtagtatcaaagaaaaatattaataatgatctgaaaaggtctatctttgtgaggccagtttctttatacactttcacctaaaccatttattaatatcatgaatgcaggagcagataagagcaaacagctgtgttatgttaatccagacagagttttgcaaaaagatataattcttctcactaaatgattgtttggaaatatattggctcttcataaaaatatggtatttatgttaacatatgatacatttatttaaatataaaagtataaattatattttaacatttcttagtcttagttactaatatggcaaatactgatagctataatccctaaaagcaaaagcttgttgggtactcaataattttttactttagaggcatcctgaaacaaaaatgtttgataactgctaacgtagataataagtcatataaataaattctaagacaaatatgttattttgagatgagatgagatgagaagaaagaatatgtagaaaaggaataattagaactctatcttgaggaatgtttgatatcacttttacctgtcagggacctgatactattaactgttactttattctttgtctttttttttttaaacatttacttggttatttgaagtggcacttatgcattctgaatccttgtacaggttaaaaattaagaacaaaacagatatttattcagtcaacttgtttatccacttaccgctctatctctaaaaaagaaaaggtattgattaactaccctacttgtccatttcttcatatctatttctgtactagatggctctaattacaatgatttggcttattgtttaacaaattctgttctattttgttaaagaaaaactgtaagaaaactctcactacatttttcttgacttccatgtcttaattcgatgagtagttttcaaactaaattactttatctctaaggaaaatatgacaaaaattatttttcttttttgaaataacgagttccacttacatttcaccatatacttctgctttcttcctgtttgtctggctactctaatgaatctctgcttattcttgcttatttccctaactgttcagcatggaaatttccattctcctcttactcaatatttcccccataagtgatctcatttattaccatgtttcgaatttctctgtaccaattattcccagatttttatttgccatgtagatttcttctttgatatgtggacatgtatcttaaactacattttttaatatttcttctgggctgtcacaagtgcacctcaaatttaacttttaaaaatatcattttataatttatctgtagtaagcatattcttccaggttctgatgagtggaaccacgatccattttatggcattgttagggatcataggatccttcttttgatatttctccacagctcattcataatcatcaatcactaagacatgaagatttctcttccaaatattaaaagatttttcatttctatttcttctatccctcttagtaggtctgcagactactaacatcttttacccagaactttgaaaagtcccgtaactcgtctcctctacaactgctgctccctatctgaagtctgtttgctatacttaataaaatgcaaatctgatttcacagtttcactgtgttaaattccttcttgccttaattctcattgcttttaggaaaagaccaaggctacgcataatctgacacaactcttcccattcgtctatgattttcagccattacaattttttttagtttcttcttcttcttcttcatcatgcgtattcctactataggattttcctagagctttctttctgcctttctccctctctttttctatttgacttcgattcgctcagacttcaaatctcaatgagatctcatggtactttctattcgtgtataacacttaacagagttcataaatacaaatacagtcaggccttcacatctgtagtttctgcattggcaattaaaccatccgtgaattaaaaatattcagaaaacaacaacaacaaaaaatacagcaataaaaataattcagataaagtggtattgtgtaacacttaattacacagtatttaaattgtattaggcattttaagtcatctagagatggcttcaactacatgggaagaatatgcgtaggttatatgcaaatgctatatatgccgtttatgtaaggaatttgaacatctgaagattttgatatccactgtcaggaattctagaactaatccccagtgataccaaagaataccaaagaatgactgtacttataattatgttctttttttgctaggaaactctacagggcaactattctgtttattttattttcgtctggtttttttttttttttttttttttttagcatcttggactagacctagataattttcaataaatatttatctgtatatatgaaaaaatatgtgttatatggaaagagattaaaatgaaatacatgtcaaaagagaatgatatggaggtgggaaatcagaaattccctccatgggttctgatttctcagcttttaaatgcgaggattcttcctgctataatattatgtgctttctgatcaaccatatttgctgaatcttgaaagcatatattatttaggggggtataatttacctcaaaaaatgctcatatataaatggactgaatgtgctatattgcaatagcaaaactcagaataatataggattcttaacctaagtagatatgtcttccgatttaaaaaatgtataaaaataaatatttagggtactgaattttattttttaacttgaataaacatatttttaatattaaagctcttaaagcatatatcacctttaaaacaaaattatcttaaaaaaatgaatccatgtatatgaatttgtcatttatttacatttgatatgcagccctggttactgcttattatctttccatttttttaagtgaatatgaatatgcatattaacatataattacaattgtactaacaatactttatataatataaaacaaatatattaagctgtccgcctcctaaaactacttttgaaatacagacaaaaatacggctttaattcttggttaacaaaataattgccttttcacctgccaaaataccttgtggcaccaacaacacagcacagactatccggacaggtagtatctgttaaatccaggttagttttcaacaactacttagtggaggtttatgtggtctagctgaacctattatgcctggcaggttctaatatcaagaacctgaaagtagaaaataacagcaacacagaacaatttgttctggccataaattgtttcttatctcttgtgttagtccattttgctgttgctgtaacagaatacctaagattgtgtaatatatacagaaaagaatttatttggctgatgattctggagtctgggatgaccaacgtcatggtgatggtgtctggcaaggaccttgtgttgcttcacagcatcacagaaaagtggaaggggaagcaagcacatgtgaaaaggaagggaaggggccgggcgcggtggttcacgcctgtaatcccagcaatttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaagaaaaggaagggaagggagaagggaggctgacctactttaaacaacccactcttgtgaaagcaaatccattttcacaacaatgagcccagtctcacaagaaataaattaatccatcttcctgacctagttacttcttaaaggcctcaccctacaacacctttacagtggcaattaaatttcaacaagagttgtggtggggacaaaccctagtattttacccctggtcacctaaaactcatgtccttctcacatgcaaaatacaatcactctatcccattagttccaaagggcttaacgcattctagcaccaactcagaagtgcaaagtccacagtttcatccgcgaaataaggcaaactccttccggctgtgagcctgtaaaattaaaaacaagttatctacttccaaaacacaatgacagaacaggcataggatgaatactctcattccaaaacagagagataggcagaaagaaaggagtaactggctcaaagcaaatttaaaagtcagcagtgcaaacatttaatcttaaaatctcagagtaatctttcattctgtgtaccacctcatggacacactggggtgaaggttgggcccccaaggccttgggaagccctgctcccatggctttgctgggctcagtctaaatggctgttctcagaggttgcagttgcaccctggtgcctccagtttttccaggcttgtgttgcacactgccaatgactgtacagttctgaatcctgagggtggcagcctcgcccccataactccactgggcattctagtggagactctctttggaggccccatgcctgcagtgtgtttctgcctgggcccacaggccttctgcaacatcctttgaaatctacgtgtaggaaaccatgtctgcatagctcttgcaatctgtgtgtctgcaccctgtgaacaccaacaaagcttgctgcttgcaccttccagagatgcagcacaagctctatctgggcctattaaaagccatgatgtgggtggtgctgccgaggtttacagcttgtaagctttggaaaggcacctagaagaacttgacccaaagttgtaacagttgaagagtgttgtgctggaatgcatggagctgagtattgaggaagccctggtcagtgaggctgtggagggcaccctgggcctgtcacacaaaattatttttttttctccttggtctctaggcctgtgatgggagcagcaacttagaagatgtctgaaatacatttggggtctttttcccactgtcttgatcaattgcctctggttcccttatatcagtatgattctctttagtaactggtgtcttggatacacccttgttttattcttctcaacatgcttttttgttcttaacatggacaggctgcaaatttttcacatctttattctttgcttctcttttctgtcacatttcactgtacacagttgaaagtaaccatgcagctcctcctatattttgcttagaagtttcttccacaaaaatagcctagttcatcactctgaagttccaccttccacaaagccctggggcgtggacccaatggaaccaagttccttgcaactgtgtaacaaggatggcctttactctagttctcattaagacgtttctcatttccctctgagacctcattagaatgtcctttactgtccacaatactgtcagcattctggtcatgaccacttaagcagtctctgagaatagtcactttccctaatcttcttgtcttctaagccctcacaagaatgacccctaccattccatttatggcattctaggctttttctagcctttatctccaagctcttgtaacctctacccattacctagttccgaagccactttcacattttaaggtattactagagaggcaaccacacttctaggtacaaattttctctcttagtttattttctgttgctactctaaaccaaaaagtggctgaggcagatctcaatcaatgtggaggtttattttgccaaggttgaggacatgcctggggaaaaaaactacacaagttgcagtaagatctgtgtcttgtgctattattccaaagagagaacttatttaaaaggggcagagcaagtgagagggtaagaaaaaaggaaaaaacaaaaaggagggagagtaagcaatggggcaagtggttacattcttgtgaggctctgatgagtactcagtaaatctacagtttacatctaaaaaggtgtgtggaagtactgaattatgcattggattggagctcagtaaatctacatttttacatacaataaagtaagcatatgaaattacagctatctgggaacaaaaggaaggcagtttttgcttgactcgtttccaagtttaacttttcccttgggcacagtgagtttgtggtcccaagattgtattttgcttttatactataatgaaatacctgtgactggaaaagttgtaaagaaaaaaaggtttatttagcttatggtactggaggctgggatgttcaaggtcaggtagctgcctctggttggcttctggtgaagttctcatgctgtgtcataaatggcatacatatggaaagagaaatgggtgtgtgcagagaaagaaaggaaggagacataggaggctgacctgttttacaacaactcactttctgaagataaatctgttcctgtgagaactaaaccagtattgtgagacctcatccagtctcctgagaaaggcattcattcatttttaaggaacccaaatcacctattataggccctacctcccaacactgttacactggccattaagttttaacatgagttttggttggcacaaaccatttctaaaccatagcacctatagcctgttacgcatgaaacatttcttaaaatgactttatggtgtgtttctataaactaggacagatgaaattgctatacacaattttggtttagagacagcaagataatgtgtaaaacttctttcactcatgtccgtgtgaagagatcaccaaacaggctttgggtgacaataaagctttttaatcacctgggtacaggtgggctgagtcagaaaagagagtcagcaaagggagataggggtggagccgtttaataggatttgggtaggtagtagaaaattacagtcaatgggggttgttctctggccggcaggggtgggggacacaagatgctcagttggggaggttttgagccaggatgagccagaaggaatttcacaaggaaatgtcatcagttaaggcaggaacaggccattttcacctcttctgtgatccttcagttaggccatctggatgtatacatgtgggtcacagggaatatgatggcttgggctcagaggcctgacaacttcaagtcaaggattctcgaactagaagtagactaccaccacaacagcctccccaaacaaataaaacttccttgacaagagcctgatgttaaaagtcatagactaaggcacatgttttagcttccttgcagacttgctgtttcaccacagccacctttctattgtacttaaaatcatcttctattgaagttgagaattaataccatttctctctttgtaaaaagataaatgaaataaatgtgctgcaatgttttttctaagaaggtggttttggaatgcataatacaaatatctattgtgctagagaaaagctttttgtgatttgtttttttaggaattaagaagttactgaagtttcttaagccttgtagtggtatttctttcatttggaattaatgaatctcggtgtaagactttggctgagctagaaaggtataatctctggaagatgagcaagtgtattattaactcaaggtagttattagctatcaaaggaaggctaagatacgaaatgcttcataatacaatgaaagatgaaaatatacttctaaagatactataacaggatgaagggctgttaacatttgtaagaaaaaagattctgacaactcaatactctatttaacttacgactatggcaacatatgtttctatcactcagtttataagtaccattttctcttatatcagaatatgtattacatttgggagatttcttttttttttacttagaactggccatgttgttcaacaatttgaaaatgtctctattaaaagcttcaggacacatttttattttaaaaataagaatttttcccactatataatttctataaagcaagtctacgtagtggaacctcatttacttctgaagttttcagcaaaaagcaaagaaagcaagtgatttaaaccattacagcagtagatttaaaacactgcatgtatactgtgaggccacaagatttggattaggagtattttttattggtgcttgccactcaagtttccaaaataatagtttttttttgcccatttttcctttggatttttttctactttcttgttgagtcactggaattattaatgtgttctggctattgatcctgtgttgtaaatgtcttctcccactgtgagtcttttccttttgattttcaaaatttgggacatgtctatgaaatatattccccctactttccttgaaaatgcaataaaggtattgtcctatattctctctttaaaatgtttaaggttttctactcagttaaattcttggtccatttggaattgaattattcagaaacaggtatctttctttttggtttttcagatgatgctcaattgtcctagcatagatactgaaaattctatgcttgctttacttttctgcaatgccaattgcaccatatattgggatcaattaataaatagtataatggattgtattccctaagaacgattttggcctgaggatttgggtgcaagtagctcatttggaaagtgattcttaggggtcagggaggaggtgaggaaacaaggatgtaaaccaaggaagggaagtaagcaactaaaagatacataatctagccaatcatgactgagtaattgggaccagtttcactaagaactcagggagacaataaagaactggcctcagaggcatcccagactaggtgggagaaagctggcacatttaactgctcactcctctaacattgactgaggtctgttttcaggcaaactgactccctgcccttttaacttgtcctgaacatggtcaaggcatattttaatagccaaggaaaaattttctaggcagagagtcacaggagttcacagtaattgccttcagcgtgtagaggtgaatgggatcacactgagagtgtctttcagggtattccttgctcttctcagagccacctatggcccataattattccactatttcctaacactcattcttcaaggttatgaccagtcacaatttctaaaaatgatttacaacaggaagactactaggataagatatagtcccactgctggagttgttctcacagccataattgatattatttctatattttcatacatatcctagattctcttccccataaaagagcacaacttctcatggtagttgctcacccagtggagaaagaatgcctttttctctgagggatctgagaccttgaatatagtgttttgcccttgctaaggagtttcttcagttgcacattcctggttatcaccaagcatggaggcaagtatacacacccctggggcttctccttggtttcagatagttgacgttgtacccgttgtggagtaagaagccttgtgatactcatgttgatggtagaatagaagtccttgttaggtctgtttattggaataaagtcttccagatgaccatgaagcagccatggttttaggtttagtgtaactcttactgtgttgtcttaataagagcacagtacacccctggaaatcagacatcggttcctgcagaatattatacttcagggagagttatctacagaaggataactagtagagaaattggagtgctctttttttttcctactttttatttccaacacacatgcattgtacctatttaagaatgcaggaccatttaatagctttttgtggtatataaggcatcttgaaggacagttactctaacctcagaatgtctcatacccatgatgcaacttaaaaactttattctagaaattttattttagacatagagtaaatgggaccagacataccacccccctgggcttaaatagaaaaatggggaaaaattttagaaagcgaacaataggcaatatggaactgtgatccttgaagcaagggaaataagatgagttttgtgttcactccagatttctgcctggaagaatttctgtaatttagtgcaggaagagtaaacctatgcaaagcacgacagtcttaccaagttggagagtcagaaatcagagaacctgggggctatactggagtagaggctgctagatagataaaggggttcatagatatgattggggcatttgagtctcttgctgaatatgaagctgtgcatatattagggtaaaatttcacaagacatggaaaagtatgttatgaggctgtaggctgaccaatttccagagctcacatagggctgagaggtatttgagtttcaacccccaggggggagagtcctcactgaattcacaaggcatggggtatagactacagaaatgtcacaccttactagtagaactaaactagtcctaaagtaaaactactgtagatataatctaaacagagctgtttttttaaaaaaatcacttgacataaaatgcatctgtaaataatttagctgctttctggaatgaagttcaatgattactaaagcaagacaatatttagaactcaacaatgcagaattcagattccaccatccaatcaaaatgtattagacaccagaagactcaggaagatgtaaaccataagtaaaagaaaaaaaaaatcagtagaaatttacctggaaatgacaaagatgatataattagaacagacaaggaattaaaaagttaattatgagtattttcaggaatttaaagaaaagcatgaacatgaagaagggagaaaagaaacgtataaactggaaacaaaactttcagagcttaaaaaatacaggtgttaaaaaatttcctagacgggattaaaaaacagattgagccctgcagaagcaatcagtgaactcaaacacatagcaataaagacgatccaaactggattacaaaatgaaaaatactttaaaaagtaaaatctaaggcaatagtggaagtttaagagtgttcataactgaaacagaaaatttttgagaaaagtaggtatcttttccaaatttagaaaaaatataaaagattcaagagtatcttacacaagataactgtaaagtcacacaatacgcactgtaactaagttactgaatactagcaacaagaaaaaacatttataagcagccaaagaaaaaatagtatgcatctcatggcaacaaaggtaagaaattttttttctcagacttctcaacacaaaggatgcaagccacaaaaaaaaaaaaaaaaaaaaaaaaaaaaaaataggattacatctttaaagtgtgaaaagaaaaaaaaacctatatccaatgggagaagtactcaaaaataaaggtggaaaaaaattcttcagaataattaatactgagagatttgtagttctttagaaagaaggaaaattaaatcaaataaaaaagtgtatttacacgaaggactggagagtgccaggaatagtaagtatgtgagtaaacatgaaagatttttcctattttttgtttctgtaatttaatatatatttttgaagacaaaaatacagtaagttgtattttataatatatgtgcaagtaaagtgaataatagcagcacaatggaggaaagggcagaaaatggatgtgtactattatacatatactattatgcatagatttttcatgatgtataatattggttaaagttagattgtggtaagttaaggatgcatatggtaaactttatagcaaacaataagaatacgtgtttttcagaaggaagtatagttaatgagtggaaatgaatttaatagtaaaaataccatgttaatccaaaagaaaggaaaatttataaaagaatcacaaagaagaaggaataaatagcaaggtggtgtatttaaccccaaccacatcaataatttcattaaatgtaaaaggccatatatgcaaataaatgggggacctttcagactaaataaaaagcaacattctactttatggtaattacaagaaatagacttcagttaaagacatggactggttagaagcaaagggatgaaaaaatacaccccatttgacaagttttcttatgattaatgtttgcatggtatacatacttttctctcctgtctgtctcatttctccataattatttgagtagacccgaaaaaaattggtaagactatagaagtcttgaacaaatctaaaaatccaattgctttaatcaagaattgtagcacaagctacagaataaaaacgatataatactattgaagtgtccaaggaacattaacaaacagaaccaatttctgggccataaaccaagcctcagaaattttaaacaaaagagataatacaggatatagtttctgattaaatcagaattaagttagaaattaatgcagaaagatgtctttgataatactaaatatctggcaattaacaacacttttctaaataacctgagaatcaaagaaaaaattaacaagaacaattagaaaatattttaaactaaatgaaaatataaaacaaaattctgtggcatctagtttttacttttacatttaggaccatgattcattttttaaatgcttgcctattctgtaaagtaagtaccctctgccccctacccccaacattgatattcatttgttgcagcagcttttgctaaaagaatactattacccgtgaatcactttggtatctctgttaaaaaccaatttatggtatattttttggtctacttcttaactttttcagtctgcttcattaacctatatgtctatcctctgtgaataccacactattttgattatttctgtagctttatagtggaactttaagtcatgagaatgttcttgggtcctctacttaaaatttgttttgactattttatgtctcttttgcttccatgtaactttgggaataagcatggtacttcctacaaaaattgaattgggattttgagagggataaaataccctgtttgtctctagtaatatatcttatcctaaagtttattatgtctgacatttatatagtcactccaggtttcttatgagtactctttcattataaatctttttctatccttttaacatccatcttatctgtatctctatatttaaattgctaaaagtctttttgaaagtttattttaagcaacatatagatgggacttgattcttaatccagtgggagaactgggtcactgaacccaatactcagtcaacataaatatcttaaaccatgccttccatcttattttgttttctgtttattttatagtgtgttttcattttctcttttttacttttgatgttttatctgttgctattaatttatggtttctactttgtgtgaagacttctaaaaaattaagtaaaatgaagatatcagcgttgcccctttaccaatgggtattggtccccagttgtttattgtgatacaaagtgagatctttagaatgcattaaactccccttctcccaactaactctaagaattgcgatgatataaacattttaatccatctgtaatgcattttatttcagaatctttatttagcccttacactaaaagtttcagccacaccatcattgtcaatttagatttatctactataaggtttattgcttaaaaacattttgtgtcttctttctgttttaatttagaatgtatattcttgtccatttgagctattattttctcttgatttgcagccttctgattcaggtcatagtggtaattatcaattcattttctatatttaaaaaaaaaaaaagtagctgggcattgtggtgtatacctgtagtcccagctacttgagagcctgaggagggagaatcccttgagcccaggaggtcaaggctgcagtgagccatgataacgccgctgcactccagtctggacaatacattgagacgtcgtcttgaaaaaaaaagaaaaattacaccctcacattttacctttaaaaagtgtgtatgaatgtgcatttgatgtaagtgaaagctctgttgtccagtaactggttttctaggaacacttcttctgaatgttttgtttcttttccttatttgatagcttagttatcttaggtgcttgctttctcttttgcctactatgttaatcagagtatagcctaggctgcattagcaaagagacctaacccaagtggctcaaacgaggtagaaagtattttttttttctgtcatctagaacagttttgggattccaaaggctatctttgcattttccgtaacaattttctcaattagtatgtttttatgacagtccaggggaagaacctgtgttttaaggaagttacctgaaagctgcacatcacttctgctcacattccattatattattagtcacgtggctacactaatctcaaaagaggtcaggaaatacaagtgatagccattacacagatgaattttgggaaatctttcattaaaataagctgagaaatggacattgagagacaattagaagttgtgtttcttagggcttttttgttgttcttgtccatcatggttctagttcattttctgagaatgtcggggctatgttcagcaaattcataagtagcaggtgagcggactctgttcctgttggctgttaatgtgtcattaacaaattgtcagttcatagttggggtgccaagaaagagattctttgttttcttgtctcataagttttgaagtatagccctttcttaacaaccgtgttggaaagtcatcccatctctgtaactcgcttgaaattcacctagaggcaaggaaaccagcaggtttcccaggactactcataaaggcaggcataggagttctgtaagcaaagttctatttcctggtctactcatgcctttgttctttctgtaactcatcctgaggcctcttaccatccttcttgctctgcacaacacctatgcttagtcacagctcatcactaaagtagcaaatgacaaaaagaatggacttgaatggcaggtttgcccatgcaggtgactgtcctaacagccactaaaacaagcaagcaagcaaaaaaggctttcagatcttaatagtaatgtgggaaaagctgtggcaactagaagcttggcatgtctaaagtcatcaagtgaaggatggtgattagcagggtaatcctactacctggtaggctcaggtctctgataagagcatttttaaagtcctgattgaagagctagatgaacgaaaaagttttcagtttagacccattatactctgaaatgtaaattaaataaagttattttaattccctccctccctccctccctgccttccttcctgccttccttcctgccttccttcctttctgcctgccttcctgccttccttcctgccttcctgcctgcctttcttctttccttccttccttccttccattttcttcttcatttttttttaatagaccatttctcactctgttacccaggctggagtgcagtggtgagatcatagctcactgcagcctctaacttcagggctcacatggtcctcccacttcagccttctgagtggctgggacaataggtgtgagccactgcacctggcacgtattttaatttcagtaagagttaaaggaaagtgccaacttctcttatttatttgcctccaaatctttttagattatttataattatttttataacatattctaccaatctatggtgttctttttgataaattgctatatttctatagaactgaaaacaaatatatttactatggtgttaatattggcagtctagacccttaagaatacattacgtatattttagtcaaggcccctaatcttaacaatgaaaaagtaaattttacaatatttaaatgattttgatgagttcaaatgttagttagaaagctgggattggttttcaggtttactggatcccacttctccaccttacgtataacaaatcgttattaattaattccttaatggaatgattataattgtatagtctacaaaacagaaccccaaactgtgattttaaatgtgttgatagctgtcataggtcacgtaaatctcagagaaaattgccagtttctaatttattttattttaatactcaaagttattaaacacataaagttaagtgccacagtataatagtagaatatacagtacaaattaatgacaaagataaaaatctgtcatacaattatttgtcaagtaaactaataacctctaggctcattcatataattcagttgtcgccttaaaatagcctaaagtaagaaacaaactatgtggcagtataattgaaatacttacaacatcagagttgaagctgatgtggtaccaataaaataattttttttttttttttttttttttttttgagatggagtcttgctctgtcgcccaggctggagtgcagtagcgtgatctcggctcatcgcaagctctgcctcccgggtttacaccattctcctgtctcagcctcctgagtagctgggactacaggcacccgccaccaagccaggctaattttgtttttttttttttgttttttcagtagagacagggtttcactgtgttagccaggatggtcttgatctcctgacctcgtgatccacctgccttggcctcccaaagtgctgggattacaggcatgagccatggcgcctggaccaataaaataatttttaaaattcagttatgaataattttcttaaattgtttccctaatagcagatttttggcataaaatttataaactatataatttaccatttaagcaaataagtcaatggtttttagcatattcagtgtttttcaatcattaccatctattttagaacatttcaacattcccagaagaaatgctgtatccataatgagtcataccttattgttccccaacccctcatccagccctaagcaatccttcatctacaggctatctgcatagattctcatgctttagacattttacatagatgatatcatacaataagtgatcttttgtgtctggcttctttcacttagtataatgttttcaaggttcagacacattgtagcatgaattactttttgaatgagtgatatttcattatgtgtatatgctgtattttattttgtacacttgccagttgatagatacttgtctcatttccactttttggcaattatgaataataccggtataaacatttatgtattaagtttttgttcagacatacattttcagttatcttgggtatattactaggaatggaattgctgagtcatgaaaacttcatgtttaacactcttttaggaattgccagactattttctataggagctgagccattttacactctcctttatatgtgagggttccaatatttttacattttccccaacacttgttattatgtgtctttttgacaacagctatccttgtgggtatgaagttgtatctcattctagttggtcttgatttgtatttctctgatgacaactaatgttgattatttgttcatttgtttattggctagttttagatcatctttgcggaaatgttgattgagagattttgttcattttcaaactgacttatttgtctttttactgttcagttgtaatggttctttatacagttattatgcaagtcccttaacagttacatggtttgtaaatattttgttcaattctgtcacttgtcttgtgaatttctcagtgatatcctttgaaacacattttttctttccttttgatgcagtcaaatttatttattttttctcttgttacttgtccttttggtgtcatacgtaaaaaggctttgcccagttaagggtcacaaatatttattcttaagtttacttttaagatagtttatggcttcacctcttaaatgttgagttaatttttctgtgtatggtgtaagaaaggagccaaataaaacttcattcttgagtgtgtggatatctaatttttccagaaccatttgctcaattattatttgcccatttaattgtcttggcatccttgtcaaaacaaaattcctcataaacataacgacaaatttctagactttgttttatactcttgatggacatgtctaaactatgtcaataccgtatacttacactaactttgtagtatattttgaaattaagaagtgcgagtgttccaactttgtccttcttttcataatgttttggctatttttgttcccttgtcagtttctataagaagccagctgggattctgagggattttattgaaactgtagatcagtttgaggaatattgccacctttacaatcttaagtattttgatctttaaacacgagatacctctccatttatgtagctcttctttaatttgtttaacaatgttttgtgttttgagagcataaattttatactcttttggttacatttattcccaagtgtttttattttgtttgatgctattttaaacgaaattgttttcttcatttaatttttggtttattgctaatacatagaaatacagttgactgttgtacgttgatttttcatgctgcaacattgctggactcagttatcagttcttataatatgtgcgtgtacaagctgttcttgctcattcttgggcagaggatgagatacctatggcaggaatttagtttaactttaaaacaaaggtgataacaacacttacacaaaactaattgccttcttatttagggactaaaaccacctttgtaaaactaacacattgtccacaaggttaaaattatgtctcaggagtcatgtagccagaggccacagatttgtaaccttcctgattgctcctatagatgatatgatggtaataaaacctagggttagtatttgagatatttttcagacactgcattatgatgtaccagctggtaacacctggattggcaactcatactaagaaactgataacatgtcttgtaacccctaccgaggaactgactcagtgcaagaagactgcttttaccacctgtgttttcatgcctgacccaaacaggtagcattctccattctctaacccactgacagccaaactgtcattgaaaattcctagtctctgaattcttggggaggtgaacttgagaattatcttctgtccttttacttggttggccctgtcattactaaactcttccttggctgcaaaactggttgctctcagtgcattggttttgctatgcagtaagcaggaagaacccattggcctgtaatgtaaatagactttcaaaatagcttctatttttttctatttacaaggaaaccttccttttgacatttaagctttatatgctttcaaactgacagacttattcataggttatatcagctgttatttgccaaactttttatccggggactttaaagataattctctgcagattttttacactcttaatgaatcaacagtaggctctgtaaaaggaaatgaaaatgtgcacactatatttgttgtatcagtgaaactcaatatcacaggattaggaactcagagattcaaattttgaataactggaggtagttgtacatgaaatcattaacagcaaaaagttttgcctttcgaagagcctatttataaaaacaatttcattttttattacaataaactgtcaattgattctttctcaaacaccatatgtaaattaatcattgtaaatattgtgaaaatgatatagtttgagtaatcttaaaaatcagatataccgtaaaactgtttcttgtgttggcaaaggaaatgtgaaaacagctcctgatgtcgggtgtttaacaagagttttgttttccacggatgaaggaacttctcctccctttcttgaagattttttaattttagtctataaaacaaactgacaacagacagattagtaggagaaaaggcatacgagtcaatttgtatgcaaatacacagcagccacacaaaatgtgagactccaggatgagccagatgactgaagattttatactgtacagaaatgagtaggggtttttagctcttggagtgaagtggtaacaggttattggaggccgaggaaaagaactaaataatgagcaaaagcggtctggttacgcagatgaagtctcccgagcagcagtcctcagagagatggtgtagcctttagtaagtttgtctgtcaaaccttgataagtgtcagacctttagtctctttttcctgtgagttaatctttcctagaacccaagaaggcaacctcagaaaaagcctctgcctgcatcccctgtttgttttattaaagcagataggtgtatatttcttttacaaaaggatagcttctcagagctcattttgtctgccctttctcatcacaactaacccaaaatataccaaagaagcatattctgggttagttgtgccaaagaagcatattttggggtggcatattttggtttcccagtttcaaaaaatataaattaaaatgtttatttctatggcagtttatggaaaacacacatagtgctcttccaggaaaagtatggttatggtatatttcttatgatagtaatttggtttagtagtgctacatattttcatactctctttgtgaggttagaagcaagatggagtcaactatgccagatttatctcactgtcataatttttgcaaaggcactttcatttgtcacttgaaatctttgttttaataattttagaggacaaagaaaaagttatttgatttagtggcattattatgcattggtagtatcagtggttattcaaaacttttagccttttctagttaataatatttaaaataagcctagttattaaattctacccagtgtttgcttctatttctccctgcttctgacattcattggtcattgaaattatcacattaaaatgtacctagaactgattatattttcaaatccaaatagttgaagtgagaaaatagggttttcattctctagattcacaacagaactttcacacaagtattctacgtcgtatcaaaacttccactcctttgagaatcatattatcctatcctttctgcattttctacagcttcctttgtaggttctacatctgtttcagactttggtacctggatcatagttgccagatttacacatctttggattatttgaatggtctttaaccatcacctataaaattccaaacaatagctttgtgtctaattccccgggcttttgcagcttcaatggccatttacatttacagcaaacatcctccctgcagggtcaaattctccaagttttcctaatctggtctggtcaagctcagaaccttataatataacttgcctgttctctgaccatgatttcctgtttttctaactcttttacttccttatttccttcattttattttaccaaagattccaagaccttattatcttacttctgttttagaatgtatcagatacttcctgatctcccttccttcactggctttcgtgaatttcatgtcaaaagtctgaacaactttttcagtagcctagatttctcagcacctgccattttgtcatatttatcctttcaaagtgaacccagaatcactgctatgatctgcgttatcttttcatttacttcattgaataagtgctgtggagacaaaaaatacacaggtgaaaatatcctcataagtaactttgattgtgacttcgaaacatttcattaatacctttactgatcttgggtagctctacctttgattcctcacaatgattattctaaacttttatgactttcctatgtctccttcctcggtttctattaacctcattctcactggacaaccttattcttattgagaagaaacaaagcaaacaaaacaagaaatagatcctgtgaccattagttggaatctcacttctatactcacctacaaacatatctattccatattccctattcttttctctataagatgtaaatatgagtttttatgttccttttgagtaaatatttccatatgtttcttttttttgctcccttgagagaacttggtgagcgaataagctctttttttcccccattttacctttaatctcttttatcttcctgggaaacattccctcaatgcctagataggcttaaatagccttttgctaaacaaacaatatcaacaaacccctttctttcttatctttttttaaaaattgtttttataccctactttcaataatgaataaccttcctgtttcttatactaatatctcttaatattttttatcttcttcctatggagattaatcagtaacagtcctcatcattctttggtttctaatcagtaacagtcctcatcattctttgtgtttcatatacttcctaaatccctctaatatggtttttcactttccccatgacaccaaagcaatttttgttatggtctccagtaacttgtaattcatacattcaattggcacattcaattgatattttacaatatttgttttgctgaaaggttatattacattcgatgactgtggaagaatttttcaaattgtctttcttaaatcccacttcacattattatttggaaagacaggaatgctaaaatcacttcaccagctgtcttgcagctataatctttgaagtcaaatgtgtttctcctttagaggcactctagagagatcaggaaaaagtggagtccagatctgtggcttgaagctagtgcttccagtaaacaagatttggaaatgagtgggttactttcacttgtgttccattgccgggtgttcaatgtcctgctgccaataaatgacattggccacagagtcctcatctgattttctaattcctggcatgactttagctttgtgtgctcattctccagcattccatttgtgagagttccttgggaaagcagcagaatcttctggttttccttatagctatagtgatggctttgcagtattaactctttttgaactgagtgtcattccagaagatctaaattggaaacggtaccttcaagatgcctaacaattatagaaagctccacagaaatccgctttgcaactattgtaacagtgggaggaatctagcataaacaaactctatcttgcttctaacctcacaagcttactgcccttgctcattgctgaatgttggcaaagctaaatatgggagaaatctggcttacaatttgatgtttaatcaaggagaataataattccttcccaatactgaccctctccttgttcagggacccagaccatctttgtaaggctaataaaaggccacagcattaaaattatgggaggggccttaattctgccaagatgtaggcatggttaaatgataactagccagagtcctgtagccagaggtcacaagatttgaaacaccacccctaccttgctcctgtagataacatcactattataaaacctaagattgatctttgagctatttttcagacttttgcattctcctcacctactgactctacctggactcatgccacataccaagcaactgactcaaccaatcatgtgatccccacctggaaactgacccaagtacacgaagacagttagacactcttaatgtttcatccctaacccaaccaatcagtagcacacattccctagcctcatgcctgccaaattatccttaaaaatcctagcctctgagctttcagagaagcagatttgagaaatatttccagtcttcccacttggctgctttgtgataattaaactcttgactgcaacatccctgccattctcagtgtattggcttttccaggtagtcagcaaaaaggagccattaagctgtgacacaattattaatttaaatatcttcatacttcaaaatcctatgttgtattctgctcctctgctgaatgaattctgaatgctagaacacttattctccctctcttaattcctttcattgccatgacacagcgctcctccggtcattgtcatacctctggtttttgccttcttcttaaacagcttctctttctcctttctgtttctatatgtttgtatttaggaacaactcttagagtctacacactgtccttggtgatcttacacattctccttttttttttttcttaggcaggtatgttgcccatgctggaatgcagtggcacaaacttgggtcactgtagcctcaacctcctaggctcaagtggtcctactacttcagcctcctgagtcgctgagactactagcacatgccaccatgcctggctaattttgtttattttttgtagagaggggatctcactgtgttgtgcggctggcctcaaactccttgactcaagcaatcctcccatcttggccttacaaagtgctgggatggtagacatgagccaccacatccagcctgatgatcttaataacaaatatatgccaactcttaaatttgtatgaataagtcagacttcttttttttttttattttatttttttactgtagacatagactaaggtactgtgtatctccatatggttattctacttgttccacaaaaattaacatggggaaagtgagctcactttatttctctatccccaaatatggttcgtttctgtacattttcatttgattttttactaatcatgcatccttatttgtcatttttattctcatcttcttgtatcacatttcatattcagtcaaaaaatccctttctacaaaggaagctatagaaaatacagttaggggccaggcacagtggctcacgcctgtaatcccagcattttgggaggccgaggagggcagatcacgaggtcaggagatcgagaccatcctggctaacgcgttgaaatcctgtctctactaaaaatacaaaaaattagccgggcgtggtggcaggtgcctgtagtcctgactactcgggaggctgagttaggagaatggcgtgaacctgggaggtggagcttgcagtgagccatgatcgcaccactgcactccagcctgggcgacagagtgagactctgtctcacaaaaaaagaaaatacagaaaggatagggtagaatgattctcaaaggagtagaagttttgatgtgaagtattgatctcatcccccttctttatccaactaccatttttaaaaatttgagtctttgaaggccaggtgtggtgtctcatgccaataatctcagcactttgggaggcctaggtgggcagatcacttgaggccaggagttcgagaccagcctgaccaacacagtagtgaaaacttttctctactaaaaatagaaaaaatagccaagtatggtggtgcatgcctgtaatcccagctacttgggaggctgaggcatgagaattgcttgaaccttggaggcagaggttgtagtgagacgagacagtgcagctgcactctagcctgggtgatagagtgagattctgtttcaaaataaataaaataattaaaatttaaataaaataaaattgagtctttgtcatctcccacgtagagcacagcaaaagtttcttcactgggctgtcttccttaaatttattctcatacactgcagtcagaatactttacataaaacacagaatacttgatataaaccacaaccaaggcatgttatttctcagcttggttcccgttagtggcacttcatcgtgtaagacaatgcctaaattccttcatggtatttaactccttcatcaacctggcttctctctatcttccttgtctcttttctcctcttctgtggttggtcctggtataccttctctctgtaccttctctctgttccatggctgacacacttacacatatgcaaaaagataaactttcaaatgaatgaaaaaagccacattttactaaagtttacattacagcaaatagtaaattttaatttgaaacctaagctattgcatctctcttcacctcagttacagagatatgaccaacagcatcctatagagaacaatttttgttagtatttatggggtattttctgcatagctggcaaaactgtgagcaatatctttagaacattttgtatgtaattctgatacaggtccaataaaatttgtatagttttttgcaatatttaataattttttaagttggtaagtggttaactcaggattgaacctagatagcccatctccaaagctgtttcctttaccataccctatattgcttctggtagattaaaaaacatcataagttatggtagtgatggcaatagattagtttcctagggatgtcataacaaattaccacaaacttggtagctttgaggcgacagtaattattctctcatagttctagagaccagaagtccaaaatcaacttggtaaggctgctttctcttggagtctctgaggtcaaatctgctccatgcctctttcccagcttccagagaaagctggcaattcttagcatagctgtctgccctctgtatctctgtaacttcctcttttcttatcgggacacttgtccttataagaaatttagagtccatcctaaattcaggttatttttattttgagattgttaattacatcttcaaagacccttttctccaaataatgtcacattctcagatactgggtgttaagtcttggaaatacctttattgatggatacagttcaatcaattaaaaggatcgtcaaggtatcatggaaatgctattgactatgtaatctgtgtagagttataatatgataagtgtgccaagcaaaaggcctcatttgccactgcttttaatcccatggctcaattataaccagaaatattttagaaaggtattgtaagaattccatgtctgccaaactagtggaaaaaatttcaaatttcaggttgaagggaaaagagaaagatttaatagaatgcatgtgcatcatttatcacaattgctaacaatgtttttatagaatgaaaaggaattttttgtccataaaactgatggaggagatagacattatttaggtagataatgagagcaagagtcctttggcagaacttcccttctaacaaaaatcagcccaagaaatcatttattttctaacaaagagcagcctaaaagatcgagctgcaaacataaataaggaagctggaagtgtgcatggggggatgctggcagctacaccaatagaacagggctccctgggagccacgcatgtccaccatggggctcgaccttccctttgttgttagcatgtgtaccgtaacaaatggacaacatggagaagctcagacagggaacccacatgcataataaaagactggggtgggggctggcagagagtcacaccctatccagatggcacaacaggtcctaacaagtttttcgtgtcctatgtaaatcagacacggccttcccactacgtcatctataaaaacccctgcatttcaccacagattggtaactcatttttctgggacccctctctgtagcatagagctgttctctttgtttcgcctgttaaatttctgctctgtacctcaccctttgtgtgtgtccatgttcttgatctctgtgcctgtgagaccaagaacctcgagtgtcaccccagacaacaaggctgcctcaacacgattttactgatgaggagacaaatgatgagatgtgtaggtttccatttatttgagttctgttgtagtttttcctacagtaaccatgctagcatgatatataatattttttattttccggtgtgtgtatgttcataggctgccactcactgtcatttttactttgggtttactttgggtaagcatttctctgacttaccgaatactcttgaagaaatacgtatgttttaatgatttgcaactcataaagcagttttttatatcccaagtgaggctgaatgagtgataactttaggcctggccacattttgagaaaatataacacatgagtgtttggaacatgaatgaaaagaaatcaagtcagtttttatttttcactccactgacaacatatcacaagtcaaaaatgattcctcctgaacttaaatatacaaaacgtctcactttgaaagctggaattaaatttttggttcagtaaaaaaaacaaaacaaaacattttcttgaaattttattcctttgtgttatataaaatcttttaagttgatatacttgctgtagaaaaattttaaaagaaaaatggacaaaacctgcacagtggtgaattgtcataaattacataatcaaacataatttttcatcaaaatgctaaatttgtagtagacagtaaattgttaatacttagatgcttataatttttgaggaaatatcatgttatagacactgtaaaactaggatgacaaactgtattatataccctaggagactgtttataagttcatgaacaaccccaagtaggaaagaagaacaaacctggagataccacactatctgatttcaaaataccttgccaaaccatagtagtcaaaaaagcatggaagtagcataaaaacagacacattgatcaatagaataacatagaaagccaaaacataaacccacaaaatttgtcaattaattttcaacaaagcttccaagaagacacaatggggttagggcagtcttttcaataaatggtgttgggagaactggatactgacatgcaaaataatggaattgaacccttaccacatgtcatgtactaaatcaactcaaaagggagtaaagatttaaaatctggagctgaaaactcttggcagaaaacataggagaaaagctctattacattggtgtgggcaatgatttcttaggtatcatcaaaagtacagggaacaaaagcagaaatagagaaatgggatggcatcaaataaaaaagcttctgtgtagcaaaggaaacaacagagtaaagagacaatccactgattgggagaaaatatttacaaaccatatatgggataagagattaatatataaaacatggaaggaatttagcaacatagtaacaataaaacaaccgttagaaaatgggcaaaagatctgaacagacatttctcaatagaagacatacaaatggccaacacatatatgaaaaaaaaaatgctcagcatcactattcatcagggaaatgcaaattaaaaccacaatgggatgtcacctcacaactgttacattggctgttatcaaaaaagataacacatattggtgaggttatggagaaaagagatcctttgtaaactattggtgggaatgtaaattagcaaagttcctattatttttaggcagcatatttgcaattttggtaatctaagatatatgtgaatatatactattttacttcttcctgcagactaaaatgtttatgtcccagcaaaattgatatgtttgtatcagaacccccaatatgaaccagggagtgggcccttatcagattcagatgctgaatttgttggtattttgatctagtacttctcagcttcataaataaaattcatgtatacatttgtgttgtttataaggcacccaggggatggtagtttgttatagcagcctgaaaagactaaggtactcttccttccttattgtatttcattccaccaatcatttgaaaatcatttattgaacatctgttttctgggttttgggaatataacaacaatgcagataatatagctgctctcctaggattacaattaaacagaaaagtacatatatagtttgaaaaaataaattaatcctgaatgaaaactgcattttggtgctgtacagaacaaaagcacagtactctaatggtattaagctgacgatcctctttttcaatacagtgtatagtctcagaatatttgctgatttgcacacttgtgaggcattggcagatctctggattgttccttccttactcaagacgcaggcagcctgcaggccctcggttttcctgaggaattccttttattgttgaattaatagcattgagtctagtagatgcagagtgacatatgttaacatattcaaatagacaggtccttaacatacctaacttcccatatattaataaagaattattagtgtgataagttacagtaattagaaataaatgtttcttggaattatgctgctgtaaaattggggaaaaaaaaacatctagccaccagcagaacagacttcctttctcgtcatttaatatagacatctgatagccatagaaagggacaatctagacacaattttgcaatgcagtttgccttgaaaagagtcgggttgcacacaggtgagaagcagaagttctagtttatacagcttgggtatggctatgtctgggatactatgtaaaattcctggaagtcacttggccctaaaacataagggcaaagataaacaaaaagaaatttagagaagatagagaagtagattaaaatattaaatatgtataagttggcaaaggaaagaaagagaggtcacgttactggtcctcagttgttttcagtgtataaatcaacagagaggcgaacagaagaatggttcagagacctctgaattgaagaaaaaggttttgttttccttcactcaaaatggctaaagatcaaaaattcttcctaacatataagaagtcattaagtgttccatgatggtttttttttctctgctgaaagtttttcatatcattaaataaaagttttcaaattactaatgagaaagttgaattctagatggattaagtgtcttactataatagtaaaaaacaaaagtggctagaaccgaaatcccatctactggttggctgatctgttttgtacctgcataactgggtatcccttaactacttacaacagggtcaaactctctgaagtcaatgtggtttcaaatatatactctaattgtatttaataatattattttatctttaatatttttattgtttttcacaatgcagaatacagaaaacccagattaatatttttgtggttttaagataacacagatagtagtgattcttaatgaggtatatggtgtctgctcttgagcttattagatacaatattcagaaggcttttatattcatcaggaatgtcagtgggtttaaaaagtttgggaattcactactctaaataatgcaactgaaggataaagccagaattttgctcagaaatgatcaaagtgaggttggaatcttcataaagtcatggaatgagaaaccagaaaagtgcttagtcccagtgttgggaggttcagctagaaagatcggggaaaggagcatggttcataaaatacattactatacctactttcctttctacagctgaactaatgcggcagaaatgaagactcaatttatatcagcctacattgctgaggagtgtgggagagaatatgacagccacacacttcaaaggtggaaaatagagggacaagtgttagtttacttgccaggagaggtctgaagcctactttggaatgcagggtaagttgtgaagcaagcatattaatcatcaatccccacccagaggacttgggaagtagaaggaggtggaattcctaaaattggggttgtagcttaggccatccgcaaataagagggaaggctgaaagtctgtttttacaaatcagaatcccaatttctttctccgtcctgtgcatataagtaagtgcccatcctgcaacccagaataattgggagatttgctctctaaagtaaccagaaagattctgtactcaacacatgatatggtttggctgtgtccccacccaaatctcatcttgagttgtagctcctacaattcccatgtgttgtaggaggaacctggtgagaggtaattgaatcatggggttgggtctttcccatgctgttctcctgagagtgaataagtctcatgagatctgatggttttataagggggagtttccctgcacaaggtctcttctctcatctgctgccatgtggttcgtgcctttcaccttccaccatgattgtgaggcctccccagtcacatggaactgtgagtccattaaacctctttggtaaatttcccaatctcaaatatctctttactaacagtgtgaaacctgaccaatacaccacattagacacagctgagaaaaaaatattatgcagctaaaacaagggaactaagtgaacatacaaccccaggttcatcttagtctacttgtcccacagaatgctggcatctgggtttatagttcccaggtgagagaataaaggatatgattcttctctataaaccaatgactgataaaatgcctacagaaaattacagttgattgttcctggtctgcatctatctcaatctcccaactctaaaacctactttgtaaaaagtttttgcccattcaaagcaatcacaacaaaacaaaaataaaaacaaagcaaaatgtatcagagaaacataaataataaaaacagattatttaaaaaatactttccttaggtaaaataacatattttacttattaaatgaagggaaatttgtagaaaaatatttatagaataaagggaactcttgtatattaaaataattaatgatgaaaacatcagctcaagtagccactttgcaaaagagtttggtgatatctgttaaatatgcaactacagcaaatccaccctttgatgcatacttagaagaaatgtgggaaaatatatatttggcaataccaggcattggtatgggtgtgaacagtgggagcatttttatactgctgattcatgtgtaaacttgtacaaccattttggaaaaataatttggcaatatctcttaaatttgggcactgacataccctgcaaatcagcagttatttcattctcagccaaatactgtatataaattcttacattttcttaggagacacgtagaagaattctcatagcagcttcgtgcatagtaaaaaaaacaaaactccaggcccatcaacagaagcatttgtaaatattagattggtgcaaaagtaattgtgctttttgccattggtttcaatatattgtggtgtgtatttacatgatggaatttcatacctcaatgaatgtgaaagtatcacaactatcaagtatcaatgtgatattgagataaaaagcaaatgtcaaagactgctatataataaaattccattttatgaagcttagaggaaaattgaaaaaaatattgttcctgagttaaaatgtatgatataaaaatttttaaaaccaagacgattataacacaaatgtcaaaagaataattctcttctctgggcagaattggaaaaggacaggaatgaacccattcgaatgatatatgtaagattgtattattatgtaaaacagagagttcatgggaatttaattattttagccataaaaatatatttatatattttattaaaaataagtagaatatcacataacttaaaataatttaaattattatactacatgtggaaaagaaaaagattaaaggtcgaaaatatgtcatgtaaactgacatagacacatctccaagtagaatgaatgaaaagagaaaggtatcaaatattatggcatatttgtaatttgagaaaaatatgggaatataaaacattagagatacggacgccctttggaaaggtacacaaagaacgagtataagtggatggctgctttctgaaaactgattatttgggaaagagtatgttggtgggaagatcattttttaattctattacctactaaaataagaaaaatcagagaagaataaccaagagatagtcatctgcagagatccagtgtcaagagaggaagaaggagaaggagagagattaagtactataacgtccaaggaaggacgaaattaaatgtagaaagacattatactccaagaaaaaaaagggaaagatgggctaattttttctctcgtattagtggctaaaacaacaataacaataaaacactgagaaaaaaaaagagaaaaactgagtcttctgttatctgaagcaaaacggtatcatttttctgttgatttgtggatctaataacattcttccactgcttgtaataatgaactctgtgttatattgaaaactttagttttatcttcaataatcaaatgcttagcaatggccattttcatttcaagaaagcaatagccagaattcaattatatttagctccttcgaaaccctcatttccataaacatgctttttgtcttcacttttattgatttaagtacacatttatttatctttttctagaataccttgtaagcatattgagagcttttcctgccaagtgtaatttgtctatattactgaaaagtgttaaactctagctaatgttcagtaagcaataatggttattttgtatttactcattatgttatatgaaaatacattcaggcaagatgaattttatttggtggcataatacttactcttcctcatttctgtggatgcttacatttacttgggtgtctgtgtgaatttatcacaatcttcattaagtctttgttgtcaaaccctcagcaagtatgttactaactgaaaagacttgttagtcacattgaggggggcaggtgtaagcttcaaggaatagcccttacaaacttctgaaatgacattgaccatggcagatacacattctataattgggacgctttcggtacaaggagaggcagtgtgatgtagcagaatggggcgtggattctagaacctgtgtatcttggttcacattccatccttacgtttggctatgttgccttgggtgacttgttcaacctcgttatgcctcattttcctcatctgtacaatgatcataataagattgttgaaaagatggtgtcattttatatataaagcacttagaacaggaactgtaatacagcaagaaaccatacatcatgatcatgatcatgatcatcatcatcatcatcatcagttgcagaacttaaaatttaccattatcatcattcctaagcaactataagtaaagcagcagaagtcctcagtctgaagtttaaacaaatagtttgtcttggtcatcttggttatgacactataagaaaaaattagactgagaattgtttaaaaacaatttccattttactgtgcttatgttataagaaagtattgctcatcaattaatatgctttcactttattgatttttttttttttttttttttttttactatccacatgttctagtcatgcagtcacaagtcagaccacctcacacagtggttggcaggtgctgtacccaattgaatgccataacgcctcaaggtttcagggagacattctgttggtgactttgctcaggatgcatttttcactatgtagagttaacctgcacagtgatatttacctattcactgagttgttatttgatctctagaggcattacgatacggaaatgctacaagatatgatgtgaaccattcttgtatgccagaatgaagagagatggaaaacatgttggtaaataagacacctctggtagttatattaaaaaataggaggtggtatatgattacattgtaatgattggaaagtgacaaacatgagtaaaagtgctttgggaaggtttatgagggaattggggatatggactgatttctggagaaagaagaaactgtggagacgagctgtagggtggacagtgggtttgagggaatgaggcaaggcattttatgtgactaatgagtaaattagccttggtaggatttgcagtgagaatcctagaagaatgttatcagactcaaaataataggagggattaaaatggttctgtgatagaagtaaatctgccaaaattcctccagtcttggtctcttcagtaaaatatccctgcatgctcttcccccttctctcctgaaccagaatgaattttctgaaatgtgaatggaattatagttgaactacacttctcaccattctggaccctattcccacacttcaccgctaatcctagaggatgaagatcagggacgttattgactttgttgattttgtatcctctgggcacataagtgtgcctggtgcatagcagatccctgaagatattcttaatgaagttgatgagtagagaccaaagtttaagagaaagaattggacatggatgtagcatgcagctaatgggagatatttcatactataatcaggattgtgatgaggtcagatgttcttttaacctaataagtttatggttatacaaacaaaaaataaaaataaactacacccacataacagtatgtcattgacttgaaggggccatcaatttatttccctactgggaaggatgcctaatgtttgtagagaaggttgagaaaaattgtactgacacccaactgacacccataacagtggaatcttcagagttttacatcccatcccagtttcctcatttgagatacaaaatgcactcctcccctctaaactgctacaaatgattctgacagataatagttgcttgagtttgagatcaggatgtcaaaagacaggataaaatagagctttctgatttctgaggttaagatggctagagaggagtaatggtgattcccgcttgcagagctatttccgctcatcaggggttattagagatacgttctcttggactgatgaaaaggcagacgatgtatttaatggacaaagtccattttcttaaacttatatattctcttttaaaaaatcgggcctgaacacaacaattaaattacatacaacaacagcaacaacataaaaacacttagtcttattccgttttagctttttatacttccagtttctcctgttgtaaaatatctgccagtactgtttatctgacaatttttttccccagatatattaatcattgctcactttttcttaaaagaatgcttccaaataattaggtatacagcttttgcttgggcacatatctattgagattaacaattcagattcagagcttgtctataaaattgtgatcagaaaacattagagagatattcagagctctgcttcttagtagtgaactattgaaatgtgtttcagaaaactgttcggaggctggccactgtggctcacgcctgtaatcctagcactttgggaggccgaggcgggcagatcacgaggccaggagatcgagaccatcctggctaacacggtgaaaccccatctctactaaaaatacaaaaatttagccgggtatggtggcaggcaccagtagtccccgctactggggaggctgaggcaggagaatggcctgaacccaggaggcagagcttgcagtgagctgagatcgtactactgcacttcagcctgggtgacagagcaagactccgtctgaaaaaaaaaaaaaaaaagaaaaaagaaaagaaaaggaaactgttcctgaaatagattgtgaagaaaaatgtcatatgtgtggtatataaacacatcctgtattgcagagagtctctagccttcctgagaagttctgaccaggtttagcaaggttagagtagggaagttaaaccactaccttgaagacataaggagaaaacagagctgggttatcaggaatgggcataaacacaagagatgaagggtttaattgaaaacagagcagtaaatagtaagacaacttaaaattctgggagatttgccaaagtaggttaagaaaaaagaataggttaacctttgtccattttaatgtctctgtccaaattccctgcctcttccaacagattagagtgccaagtaaaaattaatgtattggggtagcttgatttacagctcatatattaatttcctttcctatggtatcctttcccctgagggaattttactttaccaccacaatgatgctttgtttttgctagcagtttcttactgactctcttttgtttttttaatgagctctacattgtcccagatgggggctgctccttcagcctgcaccccagaatgacagtgacagtggctccaacacaactagcagcaagcaggtagcatatgtagcaatcacatgtatattattgtaagtcgctgaaatattggtgaccattatttctacttcatcattaatggctgaactaattgtttatgagtaataatgatgataaagaagacataaaattgtactcagttaaatatgggaatagacctttaatctaaaatacaattcaggaacctcataattatcttttttaaaattacttgatgcttatctttagctacatagctaagaaatggaatatatacatttgcatatgaacaagaagatattacacacttcagactgagttctctgagtagatccacaattcttacctaatttttgatttctaaccaaatcataatacatgtaatttgagattttaatgttttatgctaaagtgtttactttttttgcttgacctggtggttcatgcctatcatcccagcatttggggaggtcgaggtggaaggattgcttgaattcaggaattccagaacaacctgggcaacaaaactaggcccctctgccatatgtatatataatatatatataaaaaatatatacatatatattataaaatatatattatatattatataatgtatattatatatataatttatataatgtgtataatatatatctatatataaagatatatatctttatgtatttttaagctgaggaaaaaataaagtttttacatatttgatttttatgaaatcttataaaatttcagataaacctttaatattataagaggcattttattatatgtgctttaaatctaatatactttgaattttaaaaattgccttcttcagattattttatgtataaattcccagagaaagtgtgtgtgtgtgaataatactttgttgacatacatagctcttagcatactatccatcccgaataaacagtaaagaatgattagcaatgccatgcaaaattgattaacgtaaatcgtgcttcattccatcctatgatagtgttgtttcgaagggtattttatgtttacatgttactttaacgcttatttattagaaaattagtactatgtatcttaataatgctatgtacttgggtagtatgcagaggagagaacaggctgctaataatgatagacctgcctttcttaccttttgggaatctaaaatataacttatattatggccaaatatacttcttccatggttgtataagcatggatttttcttaagaatccacaaaatatggagatggagaaagtggttactgacagggctccaaaggactcagaagccatcatctgtatgatagaaacatatgtgaatctgatccagctttagaaaaagctttgcaaaaaactgttattaccaaaggaaggcctgtactatcactagtgacttcattatatgagatctttctgtctagaaagatagtgctatacatatcacaagtaaatttcaccagagatgttggtattattgttctctaggtagtaatagaatatttatctctcatttaatatgaaactagccacatatctgtgaataaaaatgcagaagtctttttacgaccttttttttttaactgacatactataagtgcatccattccagattcactttaaagtgtgttatgtgttttaggaagacatctcatattaacaactgtaatctcaatattggaaggaccatccatagtatcatttcccttgtcctagatagcgaaattaatgcaatatttaaaagcaacatttatttactcaactggccttgtctgctcagttttaaaatcataagtggctcttgagcttttctacccactgattttcagttcacctgtcattttaactgataatcaaatcctacatctttcctttgatggtatttatgtaatggaaatcaacataaaataagttaaaaacagcttaggaaaagtaatggggctcagtgataacttatgaggcaaatccaaccctcacttagagggtaaggatatctggaggagatgttttcttgcaattaaaacactatcctctattttcaactttgaggagaaagtggaggaaaataatcttaagcgggctctccatcatgcagccactgaggcagggaagtgccctcattcttcacactaagatgcactctcatgaaaggctctgagttataagtttcctgaagtgtctgtcttatatacaccaaaccatttccttgaaaacctttacctctgctacttaactgaacccaagtctgtctctcaggactcatccccaatttggtcagttccccatcagttctatcatatagggtcctcttcttttatcaccaccattgcacaggtgtttgaaaagacagccagtattcttcttgctcccactacacttccttttacacaacattacctgatcatcaactctaccctacttgtagcctggaatttcacacccttttattatcctttttgctatctttcaatcgctaagatactccttttcacaacaatgacaaatgcccagaataggtgccactactttctcttccctttagtctcaccgatcactttcttgttgagcctggccccagccttaacatcattcaccatactgtgagcgttcccagcaaccactattaatttttatgagttcactcctaaaaatttttggacctgcttaataccgtcgtgattaatgtcagcacaaaatccacagtcttctcaccctcatctcttgtcatcatctttgggaaattaaatatttatgtgatgaccttctgtcattcctgcatacaatcttttgagttttaaaaaatctacttagcttcatggattttcatttaattctattttttttgtcatcactgaaataactatggtttgtatctgattatcaataggaattgctgtctttaagaaccaaatctctgaaatatctctctgcctatggcttctatccttttgcttttctaaattgttttcccatggaaattgcgccctttgttttcaatatgccttcccatgcctgcctttccacatttctcacaatctgtaagtgtcagaggtgtttgaaccagagcaactccatcttgaataggggctgggtaaaataaggatgagacctactgggctgcattcccaggaggttaaggcattcttagttactgaatgagataggaggtcattacaagatacaggtcccaaagaccttgctgataaaacagttggctgtaaagaagccagccaaatcccaccgaaaccaagataatgatgaaagtgaccgctggttatcctcactgatccttagtgctaattataatgcgttagcatgctaaaagacactcccaccagcaccatgacagtttatagatgccacgggcaatgtcaggaagttaccagatatgttgtaaagagaggaggagccttcagttctgggaattgcctacccctttcccagaaaagtcatgagtaatccatcccttgtttagcatttaatcaagaaatagctctattcttagttgagctgttgctctgcctatggagtagctattctttattcctttactttcttaataaacttgctttcactttactctatggattctcctagaattttttcttgcttgagatccaagaaccttctcttggggtctgtatcgggacccctttctggaagttaacataagcgtctcctttacctcccttgcaattcttctgattctgtttgaatcctcatggaaagctcaatcccctcttactgacatttgggcatgttcacccatcccttcccaatcatgagttaacatttatgtatagcacttcgaatcccaggctgctcaaccttcaaagagaatatcatacaacctcagtaattgcatatcatacaacctcagtacaaatttcagctattcagcatctgctatttataaaagtagtctataattctttcatatcttttataggcagtttttcatcctatgtttccctcataatcaccttttctaaaatgctgtctttccatataccagtatctttcttgaccagtatcttgtcagggcttcaatcactgagcaggtaatgtttcagagtggcctgagcattgggaagcagccaagcaggcaaacattggggggaagagcattccaggcaaagataaaagcaagattcatttatttatttatgtattgagacaaagtcttgctctgtcacccagggtgaagtgcagtggcgtgatcttggctcactgcaacctctgcctccagggttcaagcaattcttgcacttcagcctctcaagaagctgggattacaggcctacaccaccacacccagctaatgttcctgtttttagtagaggcagggttttgccatgttgcccaggctggtctcaaactcctggcctcaagcaatctgcccacctcggcctcctgaagtgctgagactacaggcatgagccaccgtgcctgagctggaaagagtagggtttaaaggctgagattcgaaaaatcattttgtatattaaacaaacaaacagatatatggctggagtatagcaagagggtttatacatgggaggtgagatctgagaggcagacaagggtcttgtagagccctctggtccatggtaaggagtttgcattttattttagtgaaattcagtgtttctcaaatttggcattattgaaatttagggccagataattgttgtggggctgtcctgtgtgttgtgggatgttcagcagcctacttagtctcttccctctagatgtcaatagcaactgtcccttaccccattgtgaccaaaaaaaaaaaaaaaaaatcttcaaacattgccaggtttcccctcagaggcaaaatcactccacagggaagtcatcggagtgtttcaagcaggggagagacttgatctgttgtgttgtttacaaattgtcagtctggcttctttctggagaatgaagtattagaaggtaaaattagaagaggagatggttcagaggctatatattttctttagtggtgagaagatagtgggttggacttcagggcttgtttaacttacatgatgtttgaaagtattatagagtttggtcatacaatttatgaaagcgtatataaggcatctaattattaatcatggatgtcagtaagaagttgcatagaaacaactggagctccaagttcaagattaaatttattaagacaaaaaagttggtgtcatcagcatttgtaatgtaattgttgaatttgcagagtaccagtgaaaaacaaccacttctttctctctcaggttgcaaatgagtaaaatacaaacagaggacctcttctgcacacatagacaaaacttaactcacaatggatgaaaaacctaaatgtaacagattaaactgtaaaactcagttaaaatatgtgtatgtccttataaccatggattaagcaatggtttctgagatacgacgttacaagtacaagcaatcaaaagcaacaaaaaatagataaattactctttataaaaatacatacttttgtgcttcaaatgacactattaaaaaagtgaaaatacaacatagagaatgggagaaaataacggcaagctgtgtatctgataaatgtgcagtatccaaaatatataaaattattacagttcaacaataaaaagacaaataacccaattaagaaaatagaaaaaggattttaatagatatgtttctgaaaaagacatacaaatggccaaaaagcacatgaaaaaaaagttcagcatcattactcattggagaaatcctactccaaatcaagataaagatactatttcatatctactaggttggctaagataaaaaagggaataacaaatattgatgaggatgtggaaaaattagaacctttaagcatttcctcaaaaatatataatggcacacggtcaatataaagaatagttttgtggtttctgaaaatgttgaatatagagttttagtgacttaccaattttactcctagatatagacagaccccagatgattaaaaatacatttctgtgcaaaaagttatgcacaaatatagcagcattatttgtaatagaaaaacgtggaaacaaactaaatatccatcaacttttgaatggaaaacaaaatgagtataaacatgcaatgaaatattattcagccataaaaagtactgattcaagatatactgattcatgctatgatatggatgaaccttgaaaacattatgctgggtgaaagaagccagatccaaatggctgcatattattccatttatgtaaaatatccaaaatgagcaagtttatagccagacagtagattagtagttgccaaggggaagggaagaaagcagaatgggaataacttctaatgactacgcatatgcatcttgaggggaggggggtagtaaaaatgttctggaatttgataatggtaatacacaataattttgtgaatataccagttgtacactttaaagtgataaatacaatactatatgaattattaataaaagtatgtgtatgtgtaaaacactcgggtttggtgagactctgtttgcctaatcctcctttcctctctccaaacaagaaaaatagaggagtgagtggagtttaagatactggttatagataaggctgaattgaagtgtgatgattacacaacatggatacaatgaagttgtgatctaacccctaaaagaaacaggtatacccgtccagtcagacacagttttactgaaacatcacctctctcagtggtgtgtgtaggaaaacaggttggagggcatgcactctgcaggtaggcagggctagaagagaagccccagagaggctgagccaaggatgctagatttctgctctgcaggcagagttgttaccctccctcagtcctctcacatgaaaacatgagcccacggaaattgaatctcttgtgaacagatttgggagggtgataagttcaattttgtgcacattgggttttgtgagcctgaaactttttaagtggaggtgttgatagaaagacgagtctatggttgtgaagtttattaccccaagcagctctggaatcttttaaaatctgccttaaaaatgacagggaagggtcagaatgagtatcacagagttgccttttctagcccaacaagcagtcataaaagtggtttaatggtgtgaaaggaaaataaatcttgggaccccaaaactactgagccaaaaggaaaagtcaagctgggaactgcttagggcaaacctgcctcccatcctattccttaaaaaaatagctactaagattaataataataataatagtaaaattttgaaaagctacatacctcactcacaggaatttcctatggacaaagtacagacagaactcaaagtcatcccactgttcactaatataaaggcatagctgcttgcctcctctggaaaggctaatcagaaactcaaaagaatgccgctgtttgtctcttacctacctaggaggtggaaacccttttccctcttttgagttgtcctgcctttctggactgaaccaatgcacatcttacatatatttgttaatgtctcatgtctccctaaaatgtttaagagcaagctgtgccctgaccactctgggcacatgtcatcagggctttctgagattgtctcatgggcgtgcatctttaccttgggcaacataaacttcctaaactgatggaggcttgtctcagacatttggggttcgcaatagaaacttcaaccctctgctttaaagagatgggtaagttgtgttcaaaagtgaaaattcatataaatggatagttgctataaattttaagttcttattccatgaagtttattgccttcttagcatttacagttttcaccatggagaactttatttttttcttttgttttcttgttgttttttggcaatgagaagaatcatactctataaacctattgtttggggaatgggaacaaaaaacaaaattaattatgcctgagaattttttggctgaaaatgtctattcctatatttgtagatcctatagacggcattttattactctaaaaaggagaaatacatacaaattgtttctgccttttctactgtttatactgcatagactgtttttattatgataagctaaataatccaaaagcttccatacactgggaaacttaatggtttgtgaaagaaaggtatcctgggagctgaagtaaaaacatggatataaaagcagatagacactaggctctcacgtttgtaagagaattatccaattcattgaatactgattgccattttattatctgaatcaataccagtgcagttaatgtggcatttagaaatcataaagatgaagataggataattgttcccctaaacagaagccttacataaatattttaaacctcatataatgaaatcacattggaatatagaggaacatgggcccacataaacactaccagcgttaagcaactcttgaggtttccttcgctcttcgatagacttcatttacaatttaatcaaaatgctagctactgccaagactaaagggatgaagagttaacaaactatttttccttctggaaaatattatttataattaaataaaaacattaaacatatattaccgttttatatttttattaggaaatcaagaattttaaaactattagtttcacacaacagattgaaagaattttagaggtgaacataactaaatagatgttctgtgtatttatctcattttatgggtgaaaagtgctaatgcctataaatgttgaataattagatgaaagttatagttcaattagagttggagccaggacagtgatctagatctcctaatcctaatttcagaatgtcttttctataaccatgttgcttacaacattttctggcggatgtttgaaccagtcaacaagttaaagtcatcaatgagctgtttgcctcttttaggtgaggatggtgaatatctgtttacatcattcgttattgaacttcctaaatgcttctttttaacattggagtttaagtacatattttgtatgatacatttccatatactgactacacttgagtgagtgatctataacttgctcgagtttttccgtttcagaacttcagaatctctcttaaactacctctaccacaggtcaacacttgcctctttagagtgtagattggcccgacttatgtttgggaaatttaccctttagttgtatgtagttgtaaaacacttactctttttgttctataaagttttattgtgtcattatatcatagttatctttgctgctgatggaggcatttggttgttttctagtttttgtttgtttgttttttatccaaggtggtgttataaaccttctagtaaagtaaatgagtgttggtgaacacaatatacattttttttgttgagaatatcctctggatatacagttgattggttgtaggagatgcatatgttcaacttctggttgggttttcaaagtggttgtatcaattgacattaccaccagtagtgtatgagaaatctggttgttctacctccttatcaaaaatggatatcgtgttctttttcagtttaactattttcttgggaacagtgttatcgcatgctgcatacaaccccatatgtgagtgtttgtattctcttttctccattgcatccttttttaaaaattaattgataacatatgtaataaaatgcatgtgtttttaagtatgcagtttagagtttcaacaaatataatcacacatgaaactgttatctcaataacatatggaagatttccatcattcaagacagtttctgtgttatcttttccaatgcaatcttctctaccacagaaggaacctctgttctcatgtctattcccacaagttcattttgtttgtttttcaaccacgaatgaaaagaatctcttttgaatttggcttcttttgacaggccttgtcaatttatgcatgttgtttaatatgtcagtaatttctttttattgttgagtagtgtcccattgtgtaactactgcacaatttgtgtttatacacctattcagcatttcagggacactggagtaagatactctgtttattttactatactctcacaacactcagtatagaatatttctgtgacccaagatgcgtgtgtgtgggagtggttccttatacaccaagcaaacaatttttttcatggtcaccagctgggtgtcctctaatttaatataatttcagtactatctacctggaaatagcatcagatgccacaggttgaggattcaatttcacaagactgtcccacagtttccataccagacacaagtctgggtctccagagctgatcatctggctataaattgggattcccatgaccactttctgggttcaattgatttgttaaagcagctcacagaactcagaaaaaaaacactttatttgcatttacccaattaaaggatattttaaaggacacgaataaacggccagataaagggatgcacagggcaaggtttcaaagagtctcaagtgcaggggcttctgtcccctgagatttggagtctatcaccctctaaccacatggatatattcttattcaccaacctggaagctccctcacctcattccttttgggcttttacggagctctcatcatttaggtatggttgattaaatcataggccattggcgttcaactcgatctacagctcctctcccctctctgtaggtgggggtagggctgtgagtcccaatcctctaatcacagggttgtatcccctggcaaccagcatcctagtcttgtagttatttagagattttctaaaaatcacctcattaatactctggcttctctctagattgtataaatattttgctttttacagaaatcacctcatgaacataaacactggtatgattgaaaggggtttgttataaataacaaaaatgtcgtttttcacctttatggatctgaagctgttctgcagctctttcagaaatacaaagccaaatattttcaaaaagttgcttttattattcgagtcacttaggaaattacaagggttattggggctgtgagtcaggaaccctgaacaaaaaccaaaatatatatttcatcacaattgagtttttttctagtctggggttatgacaaatagagctataatgaacattgtaggcaagaacattaaatatatataatatgtgtatatatgtaatttataatctctaatattctttactctgtggcttaccttttcatttccgtgttttgcctttttatttatttcaggtgcaattagatgagcagataatttaaattttgatgaaatctaatttgccaacttttctttatggctagtgccttttgtgttttgtctaaaagatatttgcctatcactaaaatgacaaagattttcttttatgttccctttaaagtttagcctttatgttattaatatgtcatctaccttgaattaatttgtgtatatggcatgaagaaggggtcatggttcatttcttttttacatgaatatacgttttttctgtaggtttgttttttgtacacagtaagcttttttcattgaatttacatggcacctttgacaaaaatatgttcagcattatgtgtatgtttgttttgacaaccttgggagggtaatagtcatcttccaaatttatcctttttcaagattgttttgtcactgaatctgaatcttttgatttacatatatagtttagaataagcttgtaaatttctatttatgaaaaatcctggtgaacttttgattggaattgcaatacattgtagatcaatttggcaataattgagatcttaagaatattttatcttctggtaaaggaacgtggcattgatctccatttattagatcttttcttaatttcattcttggaagtgttcgtagttttaaattttttaatataaagacttgtataattcctattaacttttttcctatgtactttatgaatttaaaaaaaaaaaactattgcaaatgtaatttaaaaattttattttccagttgtttactggcaatatttaggcatacaattagtttttctacacttattttgcatcctacaaccttgtaaaattttcttgtttcttctggatgttttctgatgatttcatagaattttcaaagtacataacagtgtcatctggacataaagacagttttactacttttccatctcgttggcttttacctattcctcttacctgattttactggctaggacttccagaaaaacgttgactagaagtgatgaaaccagatgtccttgatattttttgatttagcatgaagacaatgttccatcattaaaaattatattagctgtagatttcaggtaaagactttttatcaggttgagattttcctttctattactaatttgctgagagggtttttttttttttttttttttttttttgcacagatgagtttggatttttatgaagtgtttctttcagtgtcaactgggttgattttgtaattttcccctttattattttaatatagtgaataacatttattttttggaatgttgaattaaccttaccttcctaagaaaaacttcacttggccataataatacatgatttcatttatataattcctggatttaatttgctaatattttgttagaatttttgcatctatgtttctcagtttcattaaattggcattttcctgataactaacgtagttgagcatgttttactatcttcctgtggacatttggatattttctgttgacaagtgtttacattttttattaatcattttaaattgttttattattttttaattctttaggtatttggtaatgaagtcatgtgttaggtgtgattaccccattttgaggttgccttttctgattcctgatagcattttttaaaaaaaataaaagttgttggttttagtatagtccactttattatttctttccttcatcagtagtagttttgtcttatgtaagaaagccttgcttacattatttttataaagatattttcctatgattcccactaaaagttatattaactttttatgtggaaaattccattacttctgaaaagtgttttgctttcccagtggacgatactgtctcctttatcgtaaaatcatgaaacaaatgtccatagacgttccatagcgcttgttgtcttcccatttataacacttaatttacttatttgtaatcgtatagtattttcatttccctttagacaccaagatgtttcttgcacaacttaaatctctttagttcactcttggattataaacacatagactctgcatatagtatacactaaataaatgtctgttaaaagaatatgttgacttatgtatggatatatatttatactcaactaatagttttatataatctgtatattttactttatactataatttatttttctagtaaactaaatattgattttatgatttctaagcaaatataatttcattaggaattttttaggaaatgttactaattttgcacatagaaaaattgatatcaactagctgggctattttgagaaaatatattttatttgatcctgaaaataacctacaaccagtttcatacattattattattattattttgagacatagttttgccgttgtcacacaggctggagggcagtggagttttgctcttgttgcccaggctggagggcagtgacgcgatcttggctcaccgcaacctcagcctccagggttcaagcgattttcctatctcagcctcctgaatagctgggattacaggcacctgccaccacgcccggctaatttctttgtatttttagtagagaaggggtttcgacatgtgggcaggctgatcttgaactcctgacttcaggtgatcctcccaccccagcctcccaaagtactgggattacaggcatgtgccaatgtgcccagcccagtttcatacgttattgtaaaagacaattaacagagattttttttttgtctcaggttgttaaactttcatattttttctattttaaaattttaaaaacattttccaccacatattaactattatattttggatgaaaaacagaaacatttaatatgataaaataatatttacaacaaaatatatcagacgctaaagcctctgcccttccttttcttaaagatctacaaataataaaggcagaaaagaagagagggtaagaaaagaaggaaggtatgggaactagggtaaaaagatcgtgactagggaaatttatattgagcagtttttcatatttaaatttctgtatttaaatatctatttttatatttaagtttcatttaaatatttaattttttatatttatatttatatttaaatatttaattttatatttaaattttacatttaaaaatattaaatactgtttatatttaaatatttacatttatgttgggctgagattactacattaaatttttgcagtgtactgatttaatttttcttctccttttgtaattctagtttaggaaataacagatgtgtttaaaatatatctcagcaaaaggaaaaatatattttataataatttttagtcacttgattatatcttctatttgcattttcaccattaaaaaatttaaatgcttaacatcactcatagttcttttatttctattataataatttcttgatgacaaagactgtagattttaggccccatcatgatttacttagattttagtagccaattctttagatatatacaactatagtttttcaaatatttaaaatttagtattcaatgccaaaatattttctcaatcatataatttttattttattttattttattatttttattttttttttatttttttttgagacggagtctcgctctgtctcccaggctggagtgcagtggcgtgatctcggctcactgcaagctccgcctcccgggttcacgccattctcctgcctcagcctcccgagtagctgggactacaggcgcctcccaccgcgccccgctaattttttgtatttttagtagagatggggtttcactgtgttaggcaagatggtctcaatctcctgacctcgtgatccgcccgccttggcctcccaaagtgctgggattacaggcgtgagccacagcgcccggccatcattttattttaagatagttatttgttttgtcatttcttctagctaaaatgtgtgataaattatgtgtttttttatgcgtgtgtatgtgaacaaaactataagaaagtgataggttgagaaaatgagtttacatttaggcaagtaaataattaataaatagggccgagcgacatgtctcatgcctgtaatcccagcactttgggagatcgaggtgggtggtcacgaggtcagaagattgagaccatcttggccaaaatggtgaaaccccgtctctactaaaaatacaaaaattagccgggtgtggtggtgtgcacctgtagtccaagctactcaggaggctgaggcaggagaattgcttgaactcaggaggcagaggttgcagtgagccgagattgagccactgcactccaacctgggcaacagagcaagactccatctcaaaaaggataagaaaataataaattagtgtactctaaatttaactaatggtttttgttagaatctataaacacattaaaaatcctagtacagtgaaatagaataagcaggtggtcattgtcattaggtaactgattatgtcaggaaataagattgtggttactttagaaaagaaaattacaattcaatccacaaaaacaataagaatagggtaagtgaatgtacatatatgtcaggtaaaataatgaccgtaattcaaagaggactaattagtaacatgtttaaaaggcagaataataaaataagtggtgaattaaataactttcatagaataagtaggaatccttatcaaaaaatgaatgcaacttggttacgagcgctgactagtaatgcaggatgcacttgtaagtcaatatataatataatatcattacaaatttaaaatgatctgtctgctagaaaataaacttccttaaagcgtcccaaagaaatgtcataataccaataagataccaataagataaaagcatgaggaagaatataatacaaatgagttttttaaacacccaaacaaattagttagaaagatgtcagagtaatttgatttttgttgctaagtttgattcagcttaactgaggtctaaacctgtgagtcattaatttctgaggatgattcgtttcatatgagtgcctaggaggggaccttattcctcgacattgagtcatgtgcattgctactaaatttaattggaagaaatcaacattctgacaagaaaattttctttgaccatgagggtgcgcatttctctattccccaggctaccagtattgtcctgatagcgttttaaaacactctttgcaattctaactgatgcacaggaaaaagaaaacaaggttgttcaaaggagaacaaatacctaaaataagaaaacagagaactttatgtgaggaaaatcagaaaagataaaccattcactcagaattcatgaagaatcatccatattatccaggcacctcctacccaggggatacattttgagacgataacactaagaaccagaataaaatacctcattaactatatttttgcctcatctgtagaaacttcagcctacttcacaatgaacccaagttgtactgcgagtccccagggagtttcttatttgtactctggacctagtcccatttgctattatttattagacatcatttacttttcttattgatctccttagtgctttcagggtagatgataaccatatttacagaagaagataattttatcttctgcttcatagaagtgcctatttatttatctagtggcatttgctacaagttccataaatgatagtgaacatcaatgataatgagatcactaatctggactgtaatgtatccagcttgaggtatgcagtctccaattatttttggaatctaaccaccactttttccaccaaatgtgatgatttttattttttttgagatagaaaatctttatcacattaggcatataaccttggtttattaatgtatgagaattggatatcgatttttaaacatttatttgtatttatttatttttatttttttttgagatggagttccactcttgttgctgaggctggagcgcaatggcaccatctccactcactgcaacctccaccccaccaggttcaagtgattgtcttgcctcaccctcctgagtaggtgggattgcaggtgcccaccaccatacctgcctaatttttttgtacttttagtagagatggggtttcaccatgttggccaggctggtttcgaactccagaccttaggtgataacacctgcctcggcctcccaaagtgctgggattacaggcatgagtcactgcacctggccaaaaatttattctttcaatgaatgtttaacaagcttatgtgtatatcaaatcaaattcaaggcatttgtatgcagcagtaaacaaaagacacaaaagtcacagttcctatgttactaacgttctagccaaggcaacagacctaaaataaataaataacacaagtcctatgttaaaaaaaaaaagcgcatggtgaaaactaaaggaggaaaggagataaggaatgtttcaaaaagcggattaaaggtttgaaaccacggaagtcaccagttaatatcatggttataatacagtaaaaatctgagatattaaaggactgagccgtttggaaatttggggaaagaatatttcaaacagagggaacaggaaagggaatggcttggaggcagtcttaaatgtggcatgctccagaaggtcacggtacttagagcatgctatgggagagaagatggattgtagatgagacaagagaacaaatgtagatcagatcctttaggatcttgtagttcagcctgagaaacttggattttacaatgagtgagatatattactactgaagtacttgaaagagaggagtaaaactttattttttagctgaaattttagcaagaccactctgaacactttatgagaatagatcataggaattttaggatgtaagcagagagaccagttaaaaagctattacaataatccagataatgctaatgagaatttggtatatgaatgtagcagtgaagttgctaagaaatgattggacccacgttgggtaatgaattttatcagagtgtaagttttacatgaacttcttcaggatgcttatattattaactattatgtgtactccttttgagtagtaatatttttcctctcaacacttggtatataatctttcagtttccacatagtataagagaagaagaatgccaccctgggtgattattttctatctagatataatgactttttttttaatttccctgaaagtaatcttgtagaattaccttcttttcaatcaagttgaactttgggggataaaactagagcaataatttgcccagtaaattgagtaatttgggctcaaaactccagtcttttctcaactcaaaccatattttattttcctgcatctgttgtcctttgatgtatttttggattcttatatctatcctctttaaacatgttttccaccatctattggacgttctgcctcttttaattaatcctgtgggtttttttttcatgtttctcttttaatttgcctcttcggttttctgttgttaccattatattgttttctgcttccactgtgtgtttttctctcactttataatgcaatatagctgatgtgcataaaacaatgaaacataactgtccagtataatgggtaactagaagtgcaaatcttctgatcacataatagatatttcttgaatgaatgaatgaatgagtaaaatatgcaagtctccctgctttactctccatttttctaggtgttagttggggtagaaacacattaaagtagcagtctgcccaaaatgattgactctgagcaccttatatgggtcacccggagagggagtgtttgcagttactctatccttggtttttctgtggctttttgctgtggagaacttatcaggtaaaacaacacagatatgtgcctccctgagccttattctatgatgacattaaccaagtaagtaggagaatgaccaggtctggagaatccctagactctctcaagcacacaggcttaggttaaccattttacaggtcgcttggggggattatcctttttctgcagtgtagagcttcttggattgtgtctgtgtctgcctcaatctgagtactatttaattcatttgtatgtattagtgcagactttgggacatctaattctatttggctaacgttttagtgttcttatttctcttatttttgaggttttgaaaaagaaatccaccgatgattctgcttgttttccccttcctgagttacttctttctctccgtaagcttctgggagaactgtatggattctcttgaaataattaacatatctacttgtacttctactcattgagtttgatatataggttattccagtgaatttcccccatttcccaaggtcgaaatttctcatacaacagaataaatgcatgaagaatagcagagttgtcctagtcagtctgattaaactcttgtttgaacacagcacactgtgtttatgacaacttatactaattcactttcagtgctgttgaagaatgtaaatgtagtgaaaatggcatttaaacagccaacattgttagaatacatgaccattctatttgttgatgctgaagacctctacagattgcataaaatggaaaataaccataagaatcctaatgtgactgatgtaaaataacatttagttcccacagagaagcctttcttcaaaacctctgctaaggttaaatatcttttaaaaattcaacaaagagcatagcatggaaactgactcttagtaacacctgttaaaggaaaaaaaggaaagaatattttacaccagggcagtgaaaggaaaaactgagagtgtgactaagaagcaatatgaaaaaccctctgttgatgccaacatggatttcacactcctgtgttagctgccaattctattttaaattaccgggcctctgctgttaaagaaatatatgaaatgtattatgaatactgtagtcctacatgtcgctgggtattgacatatccataatatattctaccactgggtgatactagaaccactgtccttgaggtaaataaacaggtaaggtgttggaaaaattgggctaaaatctgattgtaacaaaaagaagattgagctagagctagggataccttgagctattttaaaacgttttataactatgtacaaaaatatctttaccttttctttggaacagtactagaaaaacaactcttgtctcatcttcttggcacattctatggaaatttatattgatatagattatagagaaaagtgttagcaaataaactgatgaaatactatttttctacaatattttacatattgggacctattttctctctctctcttccactctctgtttttctctttctgtatatattttatatacacagttaactcttaaacagtggggaggttagaaaaaccagtcccaagcacagttgaaaatctgtttataacttttaattccccaaaatttaactactatagcctactgttgattgacaccctcagtgaaaacacggttaactaacacatattgttatatatatatatatatatatatatatatatatatatatatatatattataaactgcattattttaataaagttagataaagaaaatattaagaaaattataagaaagagaaaatatatgtattcattaaggaaggtggattatcacaaaggcctttattctcatcatcttcatgttgagtaggctgaggaggaggaggggttggtcttgctgactcaggggtggcagaggtggaagaggtggaggaggggctaggggagacgagagaggcaggcacatgcagtgtcacattagagaaatagtttgtaatttctgactttttatttctataaagatgtttctataaggtagcagttcttctactatttgctttagtttcagggggatcgtatcgtaaagataatgacatgattatttaaatcatcttgaataatccgaacccatctgctagattgtctaatgtcagtttcttttctgacactgcttctacatcttctcccttattgtctggccctggttcagaagcactcatctccatcaatttgtcttccattaactcttcttgtgtgtggtctattagctcttgaatctctccaagatccatatcttgaaagacttcactcgctacctattttgcgatagccacaatcttgtttcatggttttcttgactggatctgtcataaatccaataaagtatgtacaacatttggatataattttctgcaggaggaatttattgtttcaaccttgaggacttgcgggtcactttttgtaacaacaatggaatcttcaatagtgtaatccttccggagtttcatgatgttccctctatcatggttctcttccacttcattgacaatcttatccatagggtactgtgtgtaatgagacagaggtgcttacgacatgctgacctacaggctgaaatagacatgttgtatttggggaaaatagactactttgccgcctttgctgttgaactcatgaggttctaggtggccaggggcactggtcaacatcgaaataacttaaaaaggcagtcccttactggcaagatacttcctaacttgaggggcaaaaaaaaaaaaaaaaaaaaaaaatcattgaaaccaatccagaaaaagtgttcttattgcccaggtcttgtacaaccaaaagactggcagctggtgtttagtttttcttttcaaggctcagggttgagcagctttatagataagggcagtcctgatcataaacctgattgcatttgcaaaaaaaaaaaaaaaattgtatagtaagcctatcacttcctgcctttaatcctggtgcttgcttcttttcctcattaataaatgtcctttgtgactttttttttcaaaatatggcactttgttctgcattacaaatttgttcaggtagacatgccttctcctcaatgattttattaatggcatctgagaactctgttgcttcttggtcagcagatatggcttctcctattatcttaacattttttaagccaaactgttttcttaaattattaaaccatcctttgctggcattaacttattcagctttagatacttcaccttcctttagctctgagttgttgcaaaatgactttattttttttgagctatattagattctataggtatgcttatagcaatcttgcagactccattgccactcgcgtgggcagatctggaagtgggatggtccttctaaattgagacaaaggattcagcctttgtcacctcatatccaccagtcataaataatgagttagctctttttgggtgaacccatttctgaagaggaaattcgctcattatccatcagcaggtaatactctcaacagctgaggaaatgattagttcactcctaagcatgacatctggataatgtaccatggtttccactgcttttcaaacccttgggccattcatatagtaagtttgcctcctctgagaacagttcttctgggatctgcttggtctctttttctggggaagctaacaagaagaaggcaagtaagacaaactacaatacccactactccaactggtttccaggcatggtgtcttattgaggtcccagcattggttccagttgctagaaatttggatatttgcagttgcagtagctggaccttagtgattgagtctatattttggggtccatgcctagtttacacccatatttatcaagcccatgcctggcttatactacaccgtggccacttcaatgaacagcaatcagccaacattgaccatgactgatgacagaggctatctgacatcagtaggccaagtcattttgcctactgaattacctaatacctcttttgtggtagctgctcactggtgagtgttcccatgtgataaaaatatcttcacaagttgtgcttgctcttatgactctatttacatgtcaattggtgcaactcatacaattccatcttgccacagagtagagttgaaaggaatagagggtatattggaaggggcatatgaaaaatatacagcacaatttatctttttttttcttggcatctactatttttttgttgttgttctttttcttttctttttttttttttttttgagatggagtctcgctctgtcacccaggctggagtgcagtagcgtgacctcggctcactgcaagctccacatccctcattcacgccattctactgcctcagcctcctgagtagctgggaacacaggtgcccgccaccactcctggctaatttttttttattattatttttagtagagacggggttttactgtgttagccaggatgatcttgatctcctgacctcgtgatctgcctgcctcagcctcttattagttcttcaggtgaaaaaggtgtgtccctaatacaaaagacacacaaagttctggaagcgacatggaatgtgaaatactagttattatgagaagctaaaattctagctttctctttatgtaatctggcaggcattaaaatgaagtaaaataaacaacataaacataggggctttaattttcacttcattagttagctgtgaggcctatgttggtaatcacaggtgccttctttgactgcaacttgtgctctcaagtcttagctgcaccccatttgaatggcattatttatctggtagaataactcaaatttttatttgagtctgtggttaccctgttgcgtttcctcacagacctgaattatgcatctgggcagtactaaggggagctgctgtgagtcatgaatcacctgggctcctaacattgttcttttccccattgttttgcaggaggatgttttttctcttagaaaccagaatttcaggaaattcaatgacccattttctgcctatgggacaagaaatttttctcttagaaatcagaattagtcatttcaggaaattcaatgaccccttttctgcctatgggaccaaaagaaaaaaaaaaagggagtgagtacaagcctgtcagaatgcagtctcagctttcaatttaatagaatcacgatggtgttctctcatggaagtattcctctttttgagcaccaaaatctaaacacccggaaagcccatgctaatggagatggagagaaaaaatccttccaacacattatgtacgttaccactcctaattctactctttggctcttaaagacatacatcccatctctggaagagattgcaccatacacccagtactaagttaaagcatataatacattttttgattgacactaatcctatagactattagctattctttgaaaaatactgtggtaatggaagacgtggttaagactataaattttctgtgctagaacccattgctatccttgtattgctatagcatatgtctcttgatcaaggaatacttgtatggagtaatatggcaatgaatgaggcattctttaatttcatatgcttagtcctagcagaagaactgtagatagagatggtaaatatgtatccggaatatatgtctattctcatgtggatgtggagaaggggatttcttctcattttgtgaaagattgcattatttttatcaatgttagttcctttccctataagaggattttacctcagtgccctttgttgatataatttcctcagccttctgataaatggtatttagaggatacttggccacccttacttctgagtttagattcgtgtgaatcgttttggttgaaaaaaatcagtggttgtgtttgagatcatttgtatgcacaatggagacttttaatgctttaatgtcacaacagcaggatgtctcaaattagaggttctctttcaccttgggtcccagattagaataacaatggaagccaaatggaacagacccagagtcaatccatgtaatgtgaacaagaaatggttctcgatacagttgtcattgttttaagccactggtattttggtatcaatttttactgtaacaaaatctatctaataaacatctccaagatataaagtacccaaactagtcaacctattgttagatggccagttagtaccttccagggaataaaaccaaattgggaggtatctacttttgtctggttgagaataatagcagtaaccaaatcagcctggatgcgaaagtacctcttgtacaattcatacgtagccctcatacctcctgtcatggtcactgtataaataggctcattgagaaagcacctggatggctgccaccttcagcgtaattcatatgctctatctcatttgggagagctttatccatagtggcagcttgctagtcagcatttataggggtcaaaatagttttaaatatttaagctgtttgagaagcccatatttccgaattccctgtcaccaatcttcctattttgttctttccatttcccttataagtcagtcaacccaatagccactgcccgtgaatcaacatagatctatatttcaggccacctcttcttttatatgaagtgatgtactctaatttctcaaaagtctgttaattaaagagatgtctctatgtgactatttttgaagatcgttcctgaatggggctttaatgtaacaactaatcagacagttgattgcatatggtacacattgtttcataaaccaaactgctacatttttttctttcatttctttctttgtcaaatggtcataaatagggtgatgatagatcctggttttcccagaatgcttccaatttacacccactgttccctcttaataatagtgttgctttgcatttttttccaggggttttgttttattttttgtttttgcttgtttgtttgtttgtttgttttgagatgcagtatcgctctgtcaccaaggctggagtgcagtggtgcagtcttggctcactgaagcctctgactcccaggttcaagcaattctcctgcctcagcctccctagtagctggggctacaggtgtgtgccatcacaactggctaattttttttttttccatttttagtagacactgggtttcactatgttagccaggatactctcgatcctctgacctcctgatctgcccaccttggattcccaaagtgctgagattacaggcatgtgacattgtgcccggcctcctttgcacttttaaaattgtcttgatttgaatgttaaccatattatactaatcatagatataggttgagagagatgtcacacaacagtgaaaatgtgcgcaactgagtgtttatctttcttcttcagtttatctttgcattcaagttatgcttaaattcagtttcataaattccttttccattacactggagcatactactggatccattcaattttatgattcagtagatcagctaacaacctcctgttgagtatgtacaggtggggatatatgattatttgttatcttgtgatcaaatattcagtttctactggggaccaataccaggtcacaggggattttcaaatagagaagaatttgtgacagggccaggccttattatcaaaccttaagggtctgcgctgtttctcctattgagacttgcaaagagttccataaaacctctgtctgtcataaacactgccaatgctcttgagtttgctgaatgactccaaatttcagaacatattttcccttctttgggctattttctttttctggtaccattcaaaaatgtcatatttatgagttatccagtaagaggttagaagagcctacataaatatgatgcatgttgtctcaaaatccaaagagctacccaaagcattgagtgtctttacagtgggcattgcaagggatagcaacttgctttcactttagagtatattctgagatactctctccactattggattcatagaaacttccatgatatgacgagcccctgaacttttgcagagcttctaacccattgtcttatatccacatatcttattatagtactttgaaggcttattaatttctcataatgacattcgattagaatcatgtcatccacacaaaatatcagcaataagaaatcagtctgatcaagagacctttggacattataacattggtctaagtcaggacagtaagggtacactgttattactactgattaaggcaaaaatgtttcaggttaattttactaatagaaatggaaaaaagaaaccttcggcatgcaagagaccatctgcattgattagtaaagatatcatctctggcaactcaactgtgattatcatcatcatcatcatattaattttgtgataatctgtggtcattgtccatgacctagttctggctttggcactggctaacagataattaaatgagaatgtgataggaatcaccatctccacattttaaaaatatatgtagttggtactaatctctgcaaatctgttgtagattggtttggctttttttttttagttgtgttttttttttttttttttttttctcttgagacagagtctcgctgtgttgcccaggctggagtgcaatggcacgatcttggctcactgcaacctctgcctcctgggttcgagtgattcacctgcctcagcctcccgagtagctgggattacaggaacgtctcatcatccccagctaatttttgtatttttagtagagacagggtttcgctatgttggcgaggctggtcttgaactcctgatctcaggtgatccgcccacctcagcctcccaaagtggtgggattacaggcatgagccaccatgcccagcctggcttggctttttcttcactcttgacaggagtgggaagatccaagggtttccaactggccttttctactgtaactgccttcactatacagattatagaaactatataggaattctgccagtgagtaaatatatctattcactgtatgctcagacaatgggaaaagaacaatatgtgtctgtcataaatcccctactgcaacttgagataggtttctgtccattagccgcagaattttccaatagaatacattatacatgcctaggctgtcaatctattttattctttgtagcttcgtgaccagttaatcattgccatagatctgtttctctcaaaacatgattatcactcatctcagttgtttattatgtttaatccactcaaatgacctttgacagatcaacattgccatctgatctgggctctaagtttctgttgaaatgatggagcctgatattattgcagtatccctcactgttagctctggctacagagggcagccactgcagaagtgtacatgccagtgcctttcttaccaataattttcttaacagtttagtgaatagagtcccctttgggtcattgcagccaaggaggttttttttttttttttttttttaaataggtgaataaacattttatacataacaaaactggtctaacattcatgacaacctaagcttttgcaccctaagccactaaactttggtatttgatcatcaatggctataggctgctgttcacctttaaattagctaagatgataaaggagattagcaaggtaggttcagggaatttgggagtttaaagctcttttaatattaccatttccagacactcaatagaataaattctaaatcccagattatacatagccattaatacattcatcccaaactatacttatgttttattctttctggtttaatgtctttagatcctctcataaaatgtctctcagatcactgctgatagaaattggtgatatgcagcaacacatttggggtactgagtgtctcctcttgagtcgatccatgaaatttccagtgtaatctatgaatatctaactttttatggactacaaggaaaaatgctgaggtggaggtatgccgtgaggtgaggaaacagcttgtagacgattttgaaatatagcatattgattgaaagtttgaagtataaaaaggccaacagatccgaagatgtttgccattgaagggacgctttataactcacagttttcaagagaaggagcactccattctggagggccacaggtggaggcgctggggttaatcgggaggcagagagaggtggggcctatgggttagagcctttattgtggttttcacaggaagaaacaggcatgggacagtaagcagctttagggatggctagtttgaataatttcagtgggctttgggaactagggtttgtctctagttgtctggtacctagccctgaggtgattagggcagatggatgttagtcctcaagtatgtgagtccaataaatgagatagttgggtgtggaccttggattagttggtttgcatttgaaaagcatgctagtagttgtgctatttactatccctgaaaactgggtcactgtggtagaaacaggtccctctagggtgagcaaagccccagatgtcaaagcattgagtgcagagaataaaatacataattaatacaagagccaaacatccaagtatttgatgggaatggctggttccttcagtgtgtgtgtgtgtgtgtgtgtgtgtgtgtgtgtgtgtgttggatgatgttggcatgcagtggggatatctctgctggcacagtgagttcaggggaattttgctgttaaaatattttaacattgactatctctgctcaagtgtctccactacagatctcagggtagatcttctttctcattaatgactttgatgtagcataatattttttcatgtttttatatttaattggtgctttagcagctcttagcatctatttgctgcaactagaggagaggagaacctcttcaaaatgtccctaaagactttttgattttttctgtttgttcgtcattgggcattccaggacttgagtttgtcctttttactgtttatgctttctaggctagtcagaaaaagccaactgactccacaatctttgtaataatcttggttaccatagttaccaagtgctttagccacttgaccttcctctgcacaacattcttcatcacatgctgccaggagagataatgtgggttatcaggataccactacaagccatggaattactagtggtctattacccctagcaaagaggttatttcttcttaaatacataagcagctcaattatgcaatcttattgtgacacaattctaaaatgttgaaaggtgaaaaacccttgtttcctaaagctacttcaaaagtcaattactcttagtcagtgtgccccctggaaaaagatggaacagccacagtgaggaactaagcaaagtttcataaatgaatattttagaaactgtgggcagaatataaagaaaccatcgagagatattttagctagcaagagtgttagatggatatacctagaatatgtataccaactaccttgtgttggagagatttctaagtaatgaattttacagttcagtatatctttttcctctattcagtcaacattttcacccagccatgagaagtgataggcttcccatacctcattctgaaatggtcagcatggggagcagttatctaattccgtgatgagtagatgtattgagaggaccttctgacaagaactgctgtctctaccagagcgatgccatctgacagtgaccttgcaagaagggagtctgtaaaggaaaaacgtaacctccttttcctcctaccctctcatctgccagaactttccattgactgaacccaaactgaagatgatgctgacagcagggagatccagtctccacaggtcagcttccaatgaccccagaggaaaagtctagaagggagatttggtgcaacaaacccaaaagacccagcacagataccagttaaagaggagaaaaattaaagctaattctaacatattgatcattttcttccaaattcatactggatttcttaatctttctatggatccaatcgtgttgaacattaggaggtgacttcatacttctgtgtctaagaaagtcaattcttcttctacctccaaatattttagacatccaaatcaggggactgatgttttttaaaatttagaagtaaacatttttgactctctctaaatcttttctgatatcatatttagtgacctacatttctaaaataatgctaatatgtaaagcacatcctcgcttaacatactttttttttacctaaatatatgaggaagaaaaagaaagggtataatttgataggaacactaggtgacattttctgcctagaaaataatttcatacacctgagatcaattttagacttcaccctttcttagctttattgattttggataacttgtttttttcaagatggagtctcactctctcactgacgctggagtgcagtgtgatctcggctcgcttgcaacctccgcctcccaggttcaagtgattctcctgcctcagcctcccaagtagctgggactaccggcacatgccaccacgcctggttaattttttgtatttttagtagagatgaggtttcaccctgttagccaggatggtctcaatctcctgaccttatgatccacctgcctgggcctcccaaagtgctgggattacaggcgtgagccaccgtgcctggcgattttgggtaacttttcagaaacctctctgactctcagttttcctatcattaaaagggggtctataataactaacatgaatttcaaaaaagttatttcatgtaatgtagacaatgctcttggcacagtttctgttattagtcactaagtaattggaaaggatttttaatagaacaaagaaagtaataagagaaaacattgatttagatgtctaaaagatgagtgaagatccatgaagaaatttagaaattctctaaatatttttaataattttttgaattctaaaaatatacagatatttacttatatacctgatatctgaatagaaatgggtaactaccagcagtgtgaatacactgatggttctttttcttctttttttaggtttagagttatcaccacatgcacactcatttccttgccataaggaatttaaactcctgggagccaaacagttgagaaatgtgtgtggtccaatgtattggctgctctggagcttaacatagtgaattgaaaacatcaataattaatgggatacaaagatagcagcctggactgcctgtattacaaagcagggatactactaaagccatttacattttgaatttcagcagctcctaaaatcagcttatatgcaaagctccttacactaaaatgagcttaatttctgattgtaaacagttctgctgaacaccataaatttcaggcttcatgagaatccattgtttaattcagattggtttaagaaaagctatagtcacattaaaatcttacatggtagatttactacttttaacttacaccaacaattttctagcgcaatttttttagatattttttttttcaccagtgtgtagaatgttaaggtgaaggactagttatttcatgcataaaaccaattccttctgcttttcatatacatttttcctatttgaaagcaatacatatgtaatatttctctatttcgtatttgaaagcaatacatgtgtaatatttctctactacttttaaagaacgtaagttttagaattccaactctcttaatactatccaaacctttcccttctaaaatgattggatatgccaatattttgaaaatatatgtaagacaaataattggccggtttgggcaatcatcattcatttttctttttcttttgggtaacagctctcagatttctttttgggtattcacgtctttgtcatgcggtccatgtaactctgtggaagctggagctatctacacttctatcctccaaagtagtcaccatatcccttcaagctattcatgttttttttttgttgtgttttgtttttgtttttgttcaaggatgggcatatggtgtcattaaagtcaatgagatatgagtaaaaatatatcatttctgtgagggcttttcgggatcaagcatttcttattttcaataagatttcgttggagagaatcatttcatttactggaattgaatgggaaaggctattgttgtggaagctggctggcagccattctgtgaccatgaaggtttccagcattaaaatgatgcagacaggatggaatatagagaagggagatgggtcaaattgcagtgtttgaaggcacgcatgcatgtctgactaaagcacccccatccccaacttcaaggcatgttccagctttgagtatatgtaccacaaattaccattattttaaagctagaatatatatgccagtttattatttaggtctatagcttgcaatggagagatttctaaacaatgaaagcattttcacattacaaaatacctctttcctctatttaatcagtatttccacccagctacagtgtgacattacaaacgctcagagcatgttgtaaacagttctgctgaacacatctgctgaacactatgtgcacatacagttcaagcagaactttttccactttggaagtttttatagaaattgtcttcctttggctgggtgtggtggctcacgcctgaaatcccagcactttgggaggccgaggcgggcggatcacaaggtcaggagatctagaccatcctggctaacacggtgaaaccccatctctactaaaaatagaaaaattaggcgggcgtggtggcgggcgcctgtagtcccacctactcgggaggctgagacaggagaatggcgtgaacccgggaggtggagtttgcagtgagccgagatcgcgccactgcactccagcctgggtgacagagctagactctgtctcaaaaaaaaaaaaaaaaaattgtcttcctttaatgtaggtatgcaaaagcattttaattacaatttcaaaatggattttatgtttttttctaacctatggcttcatcccaaggaacccatagctgcccttcccccaaaagcagtggcagagggattcctacaaggaatgccccaaatcggtggacgatggagctggttgggatttccaagaaagagggaagaaacacctgggtgttcaggccaaaggattcattgaggggaaatttgttaccgaatgatgcagcacagccttaggacggatagcaagagaaagaaatgttctacctaggtatgtccccagccaggtggtcagaggatgaaatttatatgagggtttatgaaaatttggctcagggctgaagccagtatcagtgttttgagctacaacctagacagatttaccagtgcctggaaatgttcaggtccctggtttgggttcaagttcgctgggaaaaacttgtagctgtctgggtcacacagtgttttaggcatttcttgatttttcattcaggatccagaaaaagcagggaacctgggagaccctaccctgtttactcagaattgccaaatggtatgaacagaaatatgaagcatatttaatacatgtggataaagaaataacatctaaataatatatataattattataaaagaattatatatacacatttggaaagttatttaaatttatatttcttttgatttgggtaagataaaaaagattataccattttttgatatttaatttttttttttttttttgagttggaggcttgccccgtcgcccaggctagagtgcagtggcacgatgtcggctcaccgcaacctctgccttcaaggttcaagcaattctcctgcctctgcctcccaagtagctggaaattacaggcgccaggcaccatgcctggctaaattttttatatttttggtagagacgggatttcaccatgttggccaggctggttttgaactcctgacctgaagtgatcctcccacctcgaccttccaaagtgctaggattacgggtgtgagccacagcgcctgggctgatatttaaatttttgacaataccatttgtcatgaaataattaagatacattaaataattaaaacacacccataatccaaaatttatttcttatgcatgcaacaatcatttgttttgtattcattcatttataacctggacataaaaattatttttatagcagcatttgtcatcataattaaatggatctttaatacttattagaaattctatgttccatttcatttgtttaaaaaatctacttatttctgcttaaaaagaagaagtaatttgcaagttttgtttatcctcaatgatgacaacatctagatttgagtaatctaatcaaaagaaaatttatcattttattcaatctgaaaatattcagaagaaaatatgattcattcaaaatgccaagtattcaataggaagaattcacctagatatttgattcaaagttgaatctatttattatatgaatttgtaagacgtctcttttacttaaatactactttcataactgaaatgtgccatttattttttctcagtaaattttataatagaataaaataaatgagagaaaaatcgaggtttttatggagctgtgtaatacttgtatctaaaagccaaagaaggctgcttgatgtgaagaaaatgacagaaatagagcagtaatttcaagaattatgtttataaaatatattaaacaacagttgctatgtcctgatataaatgaagagccacgtaatttttatccatgcaatgcctgtaaaatatgtttacagtcatggaaacaataatggaaatcatagaaacaaacgtaagaaagcaagggatacttttctcattgataacacactacaaggtaggtacaacttgctagatgaataaatgaagaacagagatcttaatgaatttgactgaggttacaacatttaaagttgaaatttaaaaagtgggtattcaaactgaaattcagtattcttcataactagatttcatttactaatcatcagcaaaataataattcaactatgtactaatcgctagacttttatttaaaaactgtattttctaaagagatgaatggccttcatttactggcagtcattcgtttgacaagaaaagataattcaatgacaaatacaaagctcttcaatttgtatattttaatctgtttccataaatttcaaggtttaagtttcagactattatacaaacattccgtttgcctataaaatatacctaaaaagctggaactttttgaaatatagcaactactgatgtttgagaaaatggcacttttaaaaaagttaacatgcaaatcaggctgcagaacagttttccctcttgcaagtaagtgttttcacttaaagagtctttaaaaacaacctgtcagaaagctggaagtgtttttctcattactttttgaatagacaatttctatccagccacaagtgtttgaaaattcattaatgagcaaattgtctgttaaacattaaaatagggatacatagagtttgttatgaaagatttttgtaattaattaggtccaaaggacagagataagattgtcgcttcctacaactttactcttagtgagtacatagttgaaaatatcataaataaaaaatgcatttaatgcgcctaagctaccgaacatcgtagtttagcttagcccaacttaaatgtgctcagaatagttacgtgaacctatggctgggcaaaatcatctaacacaaaggctattttataaaaagtgttgagtatctcatataatttattgagttctgaaagtaaaatggttgtatgggtactcaaaatctcatttctactgaatatgtattgctttcgtaccattgcgaagtcagaagatcataagtcaaatcttcataattcagagatcatgtgtacattctactgtgtttagaaaacatattttataatatttctatctgttttatgacccagcatgcagtcctctgaaaaaggcttctggtatagtgaagaggaatgcacactttgctgttgtttggtggagtgtgctatacacgtgttttagatgtcgttggtttatagtgttgtccaaggctgctttttccttgttgatttctatttccattcatttttgaaagtgggatatttaattttgtgttattctttttcatgttgaagattcatttagtcaaacttactcatttttttcagctttcggagtttgtcttttttttcacattcaaaaggaatagtgttgatttatcaaatgtatttgattgaaaggagtgtgatttggcaccaagctttttagtgggtctcagaattgcgtaaacatgatttcttgaagagtccattatctccctatagttatgaaatgcttttattatataatgaatattccggtgtattcgaataaactttttgacttcattctgtaaagctatttattgtctatgtattcatgtggcaatccactctctttatcactgagagtggataaataataagaaaaataagtaaaagagcctattttaatatctagaaagcttagaaatgcttcattactattttgtgtaatctaacagaaattccttaaattttttccccagaattttaatgtattttttttgtgggaatataaaacatctagcccttataaactatcattgtaggctagataattttcagtggtcaagaatctcattagtcttccatagagttacttatacttggttttggttttgaatgtctctgaaactattttaattattttaaaaatatttcattaccatcttctaaaattgtatgtgagtggatttttttttctacaaaccctaagaattgatgagatttttatctggatttatatatattaaaataagaaatatgattaaaatgaatgaaggtgctgggagctgttaggacattaatggtttaatatcctggaattagcaaaaattggaaaaatagctacagaatttccaaagctgtaaaattggcagatgtttaaacaagttatagctagattaagaactgaaaaggatttcagcaaatatttgaaggaaaatgacaatgagaagacatatattccttgaaagtacacattttacaatattttacataagaagctactgatatattctgaatctcttagttaagtatattaatctctaaagtatgtgtttaagtacaccattttgtataatcattagattctttttctgttttgagaaataattatttaataaaagtaattcaaaataaatgacaaaattctcacaactactcaaaaaatatttgtcatggtaaatgtttatattttgcattatatttaacttcagaccaccacatatccctaaaaatatggttagaaataaaggttaaacaaaagataatgttttgtcccacagtttccttggtacaccattggtagcagaatctaatatgagaaattaggagcagtaaagctcttcatgtgattttagaatgtgtgcactgtaatgccaaataatggcatatttcacttttgaaatttatacactttcatgagcagctatcatgggtatattcttacaatatgttgtgtaggtcaagagtaagatatgttgagttttccttcactctttaaagatatttttgctaaagattctgcattgacagtgtttttgttgtttgcttggttgttttgttttgttttccgtcagtaggtgaaagcattctgccacttacttctggccttcatgttttctgattatatagttagtggtatttgaattatttcatgtaagtaaaatgtcatttcttctatgctacatgaaatattttttcttagttttttttttttcagaagtttgactgtcgtgaatcttgccatagatttctttggcttcatcttgtttgggtttgtcctggctttttgaatgtataagttaatgtctcttgtaaaatttgtgaagttttcatatttcatctctgagtactttttgagccgtgccttttctctcctctcctctccgtattttaattacacagatgttaggtctttctaatactcttacatctctctaaggttttttttttttttttcctattttctctctgtttctcagcttgagtaacttctatcattttatcttcaagatcatggattattctctttccttcattttgttattaagcccattcagtgagtattttatttttgatattacattatttatgctcacgtttttatttcattctttatatcttttatttatgtactaaaacaaatttccctggatccaagtatattcataatcatgcactgaagcactgttatgacacctgctttaaaagcctattagaaaatagtatccttgtaattttggtgtcagagtatgttgagtgtctgttctcattcagctagagcttttattcattctatgtatgatgaatgattttccaactgaacctggacatttgaggtattataagactctggctatttaaatcttgtgtttagcagcccttgtctgatgacactgtagtagatagtgggtacgcatgtgtaccctattattactgtcaggtgagcatacaagtacaagtttttcacagcctccactcacatctgaaatgaagagaagatccttgttaccacaggttgggtgtagcctgactaaattttgaagtcaggctttttagacctctgctttttactgaatattttcacacttaagcgatctggtccactcttatagttcaagctccctattaaacttcaggtgataccatcctgcctgggagcaagggtagctcttcgttattattccgcatgtggggcctccaccaacaccacagggaaggatatggtctcattattactgagtagtggcaaaagtcttgactctggacgagtccttacctgataaaacattacagagaaagtggaggaatagcttgttactgatggttggggtaaatgtacagacatacctcctgatatccactgacaccatggagtgaggagaggtgttaccatttggcagggataaaatctctggttccctacttacacatttctaatgctaccctgtcagagggaagacttgagtgtgtctcagtgctacctggaaaagatggaaatgtattcttttcattcaaactttccttatcaggatgaggatggttttttctgcagtggtatgctgggatagagtgattattgtctaaaagttttctgtgttttttagtctttctaggttgccctaatcctagtcctttggctaaataaagaaaggaggctttcttagcattcttttttctgctctcatgggaacttaaggattgccatcttctccagtatcctttctggatagaagaggcagaaagaaaatccagagaactcaccaacttgttcttcaagtctggagtttactggcacatgtgttttctctccaactttctgagtcttcttatgcttgtttgatgtataatacccaggttacctaatggttggaataaggaaaaatatctctgctccatcgtcccagaagcagaaattctcccactcgttatctttcaaagtttgattgaaattcatatggttgttgttagaagattaaaataaaccgaattaaatatttattatattgactccttgccaatgatatttattgtgataaatatctctatatcatttccttcagtgtttgacactaaaggatggcaaaatttcacagacctatctattattatttccagcaaaaactattcatatccctttggtcaaaggcaacagtactcaccgtgaggaacagttggtaaatctaagggaggctctgcgttgactcacagaccctgtgccatcttgaacttagaagtagaggtaattgtggctattttactaaaaagccacaattctcaattctcttcttgacatattagcagcatttgacacagttattttctcttttttattggttctgtctcatcttccccatgactaaattttgaagtcaggtttataaacctctacacttgaccaaacatgttcatacttaagtgatctggttcaccctcatagttttaaatacaatctatatgcttatggatttttatttccattcaagacctcttttttaaaaaatgcagacttttatactcttgtgcctattcataatcttaggtcacatgtatcatagccaccccaaagttattatgacctaatctaaaatcttggttccatctctcctcaatctgaatagctggtagtcttccccatctcactaaatgaaattctaagaattgctttggaaaaaaaatcatggactaaagcttgatcctttcctttctcttatattctaatgttatccatcagtaaattctgttggctatatagatgattatagtctgatccatggttagaatagtaaacatatccacatatctacgtatgtttactactacatatctacatatgtttactactctaaccatggatcaaactattctcatcgttcacattaattattacaattgtcatttaattgagcttcctgcttttgttatttacctcttagaggtctctgtttccaaacagcagacatcttaaaaatgaatgcattacaatcacagaattgaaaaatgtatttaagattagataattttcactattggttggaactaaatctatctctttgttttagtgtgtgtagtcgctgagtgtcattttaaaataaataatgtaggttactataattgctaaaattaccctgagaaaattatgtattggattttttcattaacatgaagtgatagtaaaatagaattactctgattttaaaaaaaggaggagacaaaggaaaattttgttttgattttaaaacaggaggagatgaagcaaaacatttttcaataattgttattttttatgtatgccctctttaaataatcagtttaattttgggaagttatgttgcataaattgatacatattaggaatgtgatacatagaatttaagccccttaagaggattaattttaaaaatgagtcaaaagtaatttttctttagagtaataaacatttcagttacgtctacaactcttcttcaaaatgtttatgttaaatttgtcatatattatagacacttttcctaaggtttcacatatttttactactcagataaatcaggacacatataagtttactttgtccttttaacaaagccacaaagtataatgagtgttatgaatatatttatttaaaaatttctgtctgcatgttaaagtcttaagcaaattttgagttaacaaatatcttccaaatcactcagactcctgctaaggaaggatgtgtacagtagcaattaggacagttaatcagttggatttgtcatctaaaggggaaaaatcattaacaagacactgggtggccagtgacagatgaaatacttaagactcgcaaaattgtcagctctctcatttaaaaggaaaaggttgagtctttctcaatttaaattttgatgtatgtcactttgccaaaaagctatacactgaacccctgtcacgcagaaagcttgaaaatttgggtaaaagttaagcaagcgagttgtcctagttaagtcaccaatctcttctgcttactgtcttatcagggcctcattagacttcagcaagcattacaggttcccacacactagaggcaagccattaaatacttgctgttcatttacaattatctgggcacagtgtcacggagtggaaggagggatcctctcctcaaggactctagtgtctaaaagtgtcattggaaactaacaaccacatgttgaaaatgccacaaagttaatagttcaattctactaaattccttaccttcacaaagtcaagcatttgcttaaaaatagcagctaattatacttataatttgagtatcaacactaatctcacataaaaagttaccaaaaatcacagttcaattgacttcaactagacaagtgtctggaagatttttagtaaaagtgttatgtgtattatctattaatgttaacttcgttatctatcaagatgctaggctcatcaacaccaagtcattgaatcaaatcctcttgtaaaaatcagttttattgaggtataattgatatgcaataaactcaacacattaaatttatgattattttttgaatttggacacatatatacactcataaaaccatgagtacaatatccaggtaataaacatatccattacttctagaagattactgtgatcctttggtttttggtattcagtaaaatatttaacatgaaatctactctcctaacaaatttttaagaacatagttcagtattgctaactatgctatataggcactatgctatacagcaaatacccagagctaatgtatcttgcataactgaaattttatactaattgaacaactctccatttcctccttcccctggtccctggtaaccaccattgtagtctatgctttgagtttgagtttttcaggtcctcgtacaagtgaaatatgctgtattttcctttttgtgactggcttatttcacttagcacaacatcttctgagctcatccatgttgttaaaaatggaaggattgacttccttttaaggctcagtagtatttcattgtaaatatataccaccttttctttatttattaatctgtcaatggacatttgtgttgtatgcataattctgctactgtgaaaagtaatggcagggcacataccttttcatgatcctggtttcaattattttgggcatataccccgaagtaggattgttggatcatatggaagttctaagtttaaatttttgaggaaattctgtgttgttcttcctaatgactacaccattttatacccctcccaccaacattgttaatatttctacacaccctccccaacatttataatcttttgtgtttttggtaatagccatcctaattagtatgaggtgatatatcactgtgactttgatttgcatttccctggtgattagtgacacggagtaccttttcatatacatcttgaccatttgtgtatcttctttggagaaatgtctttttaagtgttttgctaatttttaatcgtttaatttgtttgtttcactattgagttttaagagttttttaatgtattttcagtgttaacctcttatcagatacgtggtttgcaaatatattgtcccattgtgtatgttgcttttttattcagtggattttttcatttgctgagcggaagactttttcagtttgatatcatcccacttggctattctgcttttgttgcttgtacttttggagtcatacccaagaaatcatgactaagagcagtgtcatcaaggttttcttctatattttcctttcggagtcttagagtttgaggttatacatttaactctttaatccacttttacttagttttttgtgtataaaactctaatgtaagtcacgtgcacatgaatatatagttttctaacaccatttgttgaagagagtgtctttcctccattttgaattcttggcacccccgttgaagaccagctgactatgtgggtttatttctgggctttttatttggctccattcatctatatgtctgtctttatgccagcaccatactgtttttattagtttatatttataatatacttgaaatcaggaagtatgttattttcagctttgttctttctcaaggtagctttggctgttcagagtcttttgtggttccacattcatattatttttttttttctatttcccgaaaaagaatgtaattggaatttttgtgggtataacattaaatttgtagatcactttgggtagcatagatattttattaataagtcttcaatcaatgaacatagaatgtcttctcattattaatatagtctcagttacggctttacttcatattttatgattttcaatgtactttactattttttaattcaatttttaatgttttctattgcataaacaggtgaatcatgtagttgattgagtttagtttggatactctgaggcatactaagattttccaagctttctaaagtagttgtggactctattttcaaaacatactcttttctttatagttttattcataataaaataatttaaacaccactaagatccataggatacaaattagcatcaagattcaattcaagtaatcattgtggtcctctcatcatgattaaattaattactattataaatacctgagctgtgttaatacatgtaaacacaaacacacacacacattaacatgactaatctgatttgcacaatttacttaaatggtatgtaaaaataaacagcaatgcgtaaaaaattgccaccattgcagctttttgaagaatactttaaaattaattactcaagtgacaacacttgaatcattatgtaccaaatacttgcagagagcttacttggcttgacaaaagatctaaagggtcagcaaaattttagtcaagtaagtcatatttgttacgtaatctattaactatattaatggtagttcacagacttgtagacctggggtataggtaatatattcatcaaactcacccagaattcaagtgtagtggaagtagtggaagcactcactttggaatgtaattcttttttgtatttgtgtttagataggcatggaagtcagtgaggtaagggaatgatagttctaaggaaaagttcagagagaaagtgcacaaagtgtcaagataacacctatatggtcccagtaacctagactaagagcaaaaagaaagaggaattgagttcagtgttatgttttagctaagatcttaagtgttatgtttttaagaatcttagaaagagatgaaagttaaaatgtccaaataaaagaaatttcaaaactcctttctctaaactctttgtaaaacattaaaagccctatattgaaagcacaaggcactcttgctttgtggcctgtaacatgctatgaaacttggggtgatagatatttgacataatattggataatctaaagagacaatgccttgggcaacaaggtagaacactctacatttttattctatatatgtgtatatatatatatatgtatatatgtatgtttgtatatgtatatatgtatatatatgtatgtacgtatatatatatgtatttttattctatatatgatttcttataatgaagatgaaatcttttactacatgctcttttttgggtgactttttttgcttctttagtatttgtccagtttttctatatgaggtatgtaaaagtagatagtttattctcacttatgtatgaataatagaattttaagtgaaaatggattattttaaaaatagttatgtgtatatttgtgtttttatttattagaaaaaacacagctaacaaacaatgatgattcagagaattgaatggttaggataaggtcagagcatgtgtatctgtaaaaagtaaggtaaatttaaagaaaaacagtaagtatcagaacagttgtacaaagcaattaaattatgagttatgctcaactagaaacataatgttaagctgtgattaaggtatgagtttatagcagaaggattggagtgttaagtgaaatgaatcagtgaaagatatcctctcagaataagataagaggtgagcagttaaagtcatcggcaagattaacttgttgttaattttgctgctgaacctcctcgtgtcacttaaatcaatgtgattatcacaacaaatctaatggttctaccagttattgttttattcagtttttctagttattgtccatggatcagagaaagaattgcaatacctcattttagaaaagaaaggacacaaggcaatgaaaatgaaaaatcttgccaaaattgatcaccaagcggctgaaaggcatgcattaaaatgtattctgatgattttatatcaaagagagctaaatataaaacttggtctcgaagaattgatcagtttagatgcacttaatcagaatttattgtgagtatattggttcgagtacctagagtaatattaacactctgaaagttaatattgcctgaagcaatattagcactctgaaaattaactttgtctcaggtacttgaaccaatatgtttgactgtgtatttggcaatatatttaaggctgattaatagaagcctggacttaccacttgttctcaaaatcagtaagtttgatatgttggaacttccatgccatactgtagaagaagagtttctaaagtcttgaaatacagaaatatttcaagaaatacagaattcatttactgtgcacaacctatttgtggttatatagtaattgtagcattcaagagaaccctttttgagaagattcctttttcccaagaaaaaggaattgttgttgttaaaaatacattgttgaagggagtactagcatctcagaaaggccctgggagatgttaccaggaaattaggcttctgatttcaatggaaatattggatcctgtaatagtaatgtttaaccttccaagatagaagggttgtaattatcataataagcatgggagcaatttgaaatgatgtttttgacccacagggatctgttgtccaagccagttgatcacagggttctatccataacaaataggtgtcctacagaacaattgcttgaactataagattaaaacaattctttgtccagaggtcagaaacctgaatattgtcaatatcataggtattcatggatatttacctggttcatagacttaggtccctttacagagctgttgtccctttactgagtgaggatttaggttcttatgaagaagaaacttctacttataattagaagaaacttctcatattgcaatgtattttatacattttcttctaaatctttcccaagaaacttaccgtcatatactgggataaacgtgttctgaatcagggagaatacctcaatattccagatgttattagatactggttctaaattgacactaaatcacagagacccacagttctaccattgtccttgggtcagatttagagggagtgaggctatgtaggtctagtgaaatgaagttatggcctagtctcttccatagtttgaattaaaaattattattgttccccagttcctaaatgtatagtttaaataaaaatacttggttatattgtttaaatccacagagtggttttctgagccatagaatgaagactattttgacaggaagggccaagtgggtgtgtatggacatgtcattcccagccaaaaaggaattcaagagcagagattaattctacatagaaattatacttcccaccagagactacagtgatgcagagaaaatggttcatatcatatccctgtttaactcatctacttgactggtacaaaaatcaaataggtcttagaggttactgtgggttattgtaaaatttaactggcttttatgcctatgtggtctctttactaaagaaaataagccacatcccctggtactacctaggacacagaagttgactctctctctctctgtctctgtctctgtctctctctctctctctctctgtgtatatatatatttttttctgagaagataggaaagagtgtatatctctcttccacatgaagatgtacactttgatgagtatttcaagagtacatcttcaatgtcttgttttatggctataaattgctctctgacatataatcatcttgagtgtccttagaaattgtaagtcccacagaacattacagcagatctattacattaatggtacatttgctcattggatctgaagaccaagaaggaacaagtaccctggatgtttcaagaagacatagctgtgccagagcgtaggagattaaaccctaggaaatggaaagctgtcccattctgaagtttccaatagtccagttatctaagatacacgggatacaccctccaatgtcagaaacattagctgtcccttccatggcctgccatgaagaaagaggcaatatgtttggtgtaactatttggatattgaagacaatatataacagattgagtgagctgtttttacacatttattggatcacttatgaggctacaagtttggcacgaaatccagatcaagagacgacttaacaaaaagtccatgctctactgcaagctgccttgacatctggacctattgttgagcatccagcagtatttgaagtgtctatggcagatagtgcaggcatgtgtagcccctgggtagaatcacagtggagatccctaagatactgatgcaaaactgatgatctctctggcctgtcactattatctattggaaaaaatgctcctagaccactactgcactcctaatcacaagacatcaagtcacctggcaacctcagctgctcatgtaatattttttgatccataaaataataaggttatttgcatgcagcagtatgtcattattaatggaaatcatatgtgcaagaccaggcctcagtaggtttggaagacacaagtaaattgcataacacatggagctcacccactgcaccccttcgagtgcttcactgtcacttccaaccctcagttatggaaacttaataaggtttctaataatagaagaggatccaattaaccagtttggacaagaagaatacagagaggcctgatttaataatgggtcagcattttgtgtggctgtcaacaactataagtagtcagctgctgcattatagatctacacagggatagtcctgatggatggaaagaaaatcttcctatttgacagaaatctgagcagtacattttacagtttctctatttggaaaggtctaattctaccctaacttctgagcaatgcctgatgggtcaactagcaagtcaaggacttagaaaggacaagattggaatattgctgctaggaaagtctgggatgtggggttggtagtggtgatgtgttatgtgaattggcctatttaaaaaagcacaaagtgcaaagatgcttgtgtcctaaagaccatccactacagaggaggatctcagtaatgaactagacatgaagacctgttctgtggctttctctacagttgttttcagattcctggctcttgctgaatgggcctatgtaccaagtggctacgtaggcaagaataaaaactatgcatgagctcaacaacatggactttgcctcaccaaagctgagctgctttgtgcccaaatgctgaaaggaaaggtgaatgctgagtcaatatgataccatattttccagtggactaaccagcaatgcaatttcagattgattacactgaaagtcttcctttatgaagcgagcagaggtttgtttccacagaaatagaaagtttttctggatacagtctaaccattccttcctatgacacttctgccagtgccactattgatacacataaggaataccttattcctttgtacttagccaatacaacactgcctcttatcaaggaattcattttaacactaacaaagggtgctaagaatcatgccacagaatttgctgattttatgtgtgctcatcccttaaaatcagctggtctgatagaatgttggaaatggccaactgatgcctcaattgcagtgccatctgagagagggagaaaaaaaaaacccagaaaagttaatgtccttttgtatacactgtgggcatatattgtgctgttccccatggttgttatatcagtgggtggaatgaggagtgccctttcactctaatacctaacagttccttcagatggtttttcttcctatctacacaaacttgaggtcagttggattggcagacacccaagacagacacatctgtgtcaaggtcattccattaaactggaagataaggctaccaacttgtcattttggacttccctttcactgaactcacaagcaaatgaaaggatcaacttgtaaactgtggtgttttatcaaaattaccaagagaaaattgggttactcctaggcaaagtagtgagggactaggcttagacctggatgcttcctaaggaatttcctggtaattctatattgtattaggttggtgcaaaactaattgtagtttttgacattaaaagtagtagtaaaaaccacagttaccttttgcactgacctaatataatcatgtcagtgagaaactagaacaataaggtcagaatcaacatgagcatggattctataagaatacaattttggtttgccccaaaaagtataaaatatctcaacatactaaggggctaggtaaggtaaagagaatgtggaattagataaaggaagaagagatctatgatcattgattttgattaatattactaatgatattactcagaatattggtaacttataatcaatactaattataatattaataacttataattaacattatttatcatttgatataagacaaaactactatagtccctatctcttgtgattagccagagagttaggaactactgcagttatgtcttatatcaaatgattcatttttttttttcattttaaaaccttatatagccaatgttgttattttggacctatggagagtatgattgagtttacaccattctgtgatgacttggtgagaggtgggctttgcgctttcctttctgttggtcaagaatggacgctgagttgaaaatgtgtggagaatattatttaatctccatttataacttctcccttccccacagaacaatttccttttattctctggcttttgttctgtgttctaaggagtaggctgtggacagctttgcctggaggttcttacctttcagctttagattgaatttgtgatagtcaatagagaaaagtaccagtaggttgatgggtgagtgaacagagtggtcaggatatttcttcaccaaactcctccccacttctggcagtgagtggccacggaagccacagttctggcagtggttgcctcctctctcacctgtaagttctgttgaacatctctgccattgcacatctctccccttgatgctcttccctttgccatagaggcttggtggtagtggcttcctgccatttagagtccctgggttctgcaacatctttgattggttactttaaactctcacactctccattaaattatcttaattgcaattgagtgtatcttctatttcctgctgaaatccaatctgatattctaatctataacaggagaatccttatcaatagcataaattagatcagcattctttaaacattttttttccttggaaatatttattctatttatttctagagacttgtttataaaaaggctccagaatcaatggatggaggtgtagggatgatgtcccgatgtgtgcttctggaaaaacacacatttacctacccttccccaatctcctgggaaaactcttggagcctacacaaagaaaaatgctaaatgttctgatttgtatgctgtttttaggttatgtaaaaatggttttcatagtaatactgtaaatatggtaatatagtaatattgactattctaataattattgtttcagactacatgagaatatttaatttagctgctattctaataaggaggttgcctcggttatcgttcccagttcccctgtgcctcgatgcccttaccattcatggggaaattagtagatcctaatgcataaacttattgtgaggattacatgctatgatgcatgcaaaacattcaggacactgtttggctcccagtcagtgatcattccacaggagctattgttattctacacattcacctcccctatatagtcatagatacagatctttttactttattcatcatccaggccaatccttaaacaccaaggaaactccttggcatgaacttagagggcaataacagcgacgagttccctaaccgacttttcagctaatctctcatgtagtgctctcctattttttccagtaaaagtacctaattatgaatcttaaatcactggagagtttctgttgaaacataacaagtgtattgtcacaaagtctagtttatgattttaccatctttttctttaacttccttcaattctttctcattaggccccctcatatgattaagtttaattttcttccccatttacctcatgagatacatcatcctgaggcacatcatcattgaagttaaaccttgcagcaacacacttaattaaaattttagtaacgaatggtactatattactataaaagagaaactatttcaaacattgcattttaccgacattcataatatgtgttcattttatatttcttctttttttttttttcctttgagacggagtctcgctctgttgcccaggctggagccaggctggagtgcggtggcgcgatctcagctcactacaagcttcgcctcccgggttcacgccattctcctgcctcagcatcccaagtatctgggactacaggagcctgccaccatgcccggctaattttttgtattttttttttttttttttttttttttttttagtaaagacggggtttcaccgtgttagccaggatggtctcgacctccttacctcgtgatccgcccgcctcgacctcccaaagtgccgggattacaggcgtgagccaccgtgcccggcctatatttcttctttaaaagcaacattttaaccatttgacccaacattcttattactggatatatagctagaggaatatgaatcattctagcataaagacatatgcacgtgaatgttcattgcagcactgttcacaataccaaagacatgaaatcaacctagatgcctatgaatgatagatgggataaagaaagtgtggtatataaacaccatggaatattctgcagtcatgaaaaagaacgagatcatgtcttttgtgggaacatggttggagatggaggctattatccttagtaaactaacgcaggaacagaaaactagatactacgtgttcttactgataagtgagagctaaatgatgagaactcatgaatatgaatgaaacaacagacactgggttctactggagggtggagattgggaagagaaggatcaggaaaaataactcttgtgttctaggcttaatacgtaggtgatgaaataatctgtacaaccacgaatttacatatataaaaaccttcatatgtaccccccaaacctaaaataaaagttaaaaaagcagaagtttagcagagaagtccattactgcaaaggacaaatgaattatagtttggtattatgtatcactgaatttgaattttaggacctattcacaaactgaagagttctgagatgagaaatttatttgaaacaacaaggaatctatgccaaataaccacaggaaagttgaatgctttgaaagactttgataaagtatgttaattaaaaccagcacttgagcctcctcggcagtttggcggttgacaaaagcacttcagaacagtttgaagaaattgtatgtttcatgttagggagcgattgaaaagtcagcaatacctcaatcatttgagatagaaatggtacattctaaattggcctctagaagagaagataaaataatctaaagtataggcattataatgccctattttcaggcagcctgacaaagtctagcttatactgatatagttataaagcaggcaaaaatcaaaggtagatttttttctagattttctttcccttacttggcttaggatagaaggatagaaaaatgacttccaaaccgtaataaaattaaacagaaattattactaagttacagcaaagaaaaaaaataacgccgacgttacccagcattgttggaaattaccattaaggagattgcttaactgaagtttaactcaatggtggaataaactgtcaaatatatagtgggtttcttttcatattttacatatcctgcatatcattgctaatatgaagttaatttgaagtaacttcactttgcaagtaaagctatagatgtcatattctcacctttcgggatgtcacaatagaccaaggtattccagcactagttggttgtattttatgataacattggatcacctaagcctggaatactcaataaccttcagtttccttaatttttaattggtaatgctgaggaaaagtattggaccaggaagttgaaactcgatagagaaaattggttgaacttgaatcctctataagaaacagatttaataggtgggagttcgatgcatcaaatgagctgtttgtattttggtctcattcactaaaaatatagtaggatggtaagggattttttttttcctgtcttcttggagttaatttcatttttgaaagattttcactggatatagaaatactgtatagaaacacactctaaaggtattattcatttatcttctggcttccattaatttttttacagcactaagctatttgttgtattgttatactctgaaggtaatctgaaagttgctttgacttttgaatatgtgtttctttgtctttggtatttggcagtttttgtatgatgcgtggttttctttgattacattacttgggtttcttgaatattccaagtggtgctttaaatcagctttgaaaaactcttggcctttatcattttatgaattgtcgtgcccctttaagtctcttctctacttctatgattgttcttgcacataagtaggattttctaccactttttattcttggtattcttcagtacttacattttattgtgacttaaacattgaaattcttttcagcaaagtctaacctgtgaaactattgatatatttatttctcttactgtattttatgtgtagatttttctttttaattaatatatgtataaatatgggtatagatatataaactatatattccagttgtctgctgaaatatgtagcttgtcttccaatatgtcaaacatattggtcaaagctagattgaaaattaaagtttatatcatataacttcaatgcatttgtttctaattttgatatttattgttttaatctgctcaaatctcttgctatgcttatgttctgttgaatataggtatgaaatattctatatataatttgaggctgtgaatattgttgtgctccagagagggtttacttttgcttctactagtattttgcatatacgcaaataatcttaatcagctctggggttgaattaattcatagctatttccggtcttcatgaagattggtttatttttagttaccctttattcctacgatatagtccactacttcactggtacttaatgatatcccagagtttttactgaagtcctttctctttggaacgctttgaagtacaagttttgtccctccagcctcatgacatagttgaaatttctcatcagcttctcaacttttcaatcaactgttgagtttaccactctggaatttcttgtcccggactgtctttgcccttcaccaaatcctcattgctatagaagttctttcttgtcttcaaaaacatgcttcatatgttatccagttgtacacttttaataagtgtgttgttaattgcagtttggttgttgtaagcagaagtccattaaatatcttggatttttttcttatagaaaatgagtaaaaacctctgttgtataaaagtaaggcttttgtttccagaacccagtatatttaaaggaagactagaggatctgatttaagtccttcaaaactatttattttcacattgctctgaaaatattgaccaaatattgacaaaaaattgacaaaatttgactagatcttaccaaaaccccaagtctgtatataagactattccaaagtgttatttcttggcatcagtgatcttccaagggtgaaatgggttgatttaaaatcactcccaatcttcttggggagctcctgactacccatcattttcaaattcaacaaaatagatcttatttctccaccatcacaaatatatgcatttgtttcaatccagaaacactgattaagcagtatagataacatcatctcatgactctttgcttataagttattagtgaataaaatatagtttggagggtaatcagacagcaagaggttttatgttaaattttgttaggtgagagctaaatttggtgttgactgagcagaccttttttttttgcagtaataataggctattcacttttttctttttcctgtatcataaaaagcgccacacattttagttatttcatgagtgtttttttttttttttttttttgcatattggactggcatttggtgtaccgtaaaatataaaccattttaaccatctcatggcatttctggataagcctttttaacaaagggctgcctccaatcttcagagtgttgaaagctacaatctctagtgttcttgtttctgaattttgtcatctttgtcctgtgccttgagattttacagcgcctcccatgaaagcaggtagaatattcatccctttcctccactgattgcaggctgcatggtcagagatgaccttttgacagctctgagccaagactacaagaggtatgggaagattttgtcattttctttttgtttctgcattctgctgtgagaggttagtctttatgttggttattaccttattttggaataatattttgaaataatatttcctaatcatcttgattaagtaacatcatctaattaagtaacatctaaaactggaaacaaaaatagcaggataaggatgttagttgtatttgtggacctaaatgtgtaagaagcagaggaatcagaattgaaaagagtgggataggggagatcagaatatgccatctctaactattcaggattgttgagctgaaggtaatttagaagaagcaaattcagaaaagctccctgactgtcctctatttgcctaaaagcaagacatagatttataaacacaaaaggtatcctgcctacccttctaccaagaagaacagcaattaaccactgaatacagcattggaactttactggcctagagatggtaccagagaatctacattaacaaagttactaactagcctttatctgtcatttgtttgcctttccaaaatttgtcaccccgtacatccctaaaaatgttctgttccctgttgacattaagctaaaattcaaagccgctttatttgaaaactactcaatccctgggtatttcccatgtatgttatgtatataatatatatgttaataaacttctccttgtttttcctttgttaacctgtcttttgtcataaggatctattccaactaagaacctatgaggattgaagaaaaataattttttttcctgctggtgcttggggctactcttttccatattcctcacagagctatttgacctttcataccacgcaaacctattattttgattaagataataatttaaaaaggaataacaaagtgtgtttttatttttattatactttaagttctgggaaacgtgtgcagaaagtgcaggtttattacatagatatacacgtgccatggtggtttgctgcacccatcaactcgtcatctacattaggtatttctcataatgctatccctcccctagtcccccaactgctgacagggcccagtatgtgatgttcccctccccgtgtccacgtgctcccattgttcaactcctacttatgagtgagaacatacagtgtttggttttctgttcttgggttacaaagtgtatttttttttggagagaaatgtatgagggcactaaatatataaaatggttacagtgtatgccccttcctcataaaacattcatcttcttttctcctctgagaaagctccagaagttacagtagtctgtataaatcataggataaaatacaaccaatatgcctgtgtatattgagttttacttgatgtttgaatcatagagtttgaaggagaaaaaataaattcttccacagaaaaattacttcctacaaaaataatacagagatccctcatagactgattgcattttcagtttttttcagtgaaaaaatttgagcaataaaagaatttcataagaacagcagttgataatctatcacaaaactgataactcagttattctaaaaatttctcaaatttgacaacattaatcttccagaaagtgtatgtatatgtgtgtgtatatatatatgtgtatatatatatatgtattttttattctttagaagcttatgttaaataaaaatgtaatttaaacttttgtttgctttttatctcttcgagtttaaagagttaagttttggtacaaaagtatccttctcctaaaagtgtcaagccttcattcagaaacatgggaaaatcactctctcaggcaatccaatggataatcagctcaatgcttcttacgcgttctataggaaatacaccaataggtttatctttatcaccaaaataaaacttgaagtagaatgttatcaaagagaatgacaattccagtcgcccagtgtatcaataagaatcctcttataatttataacctttagtaaataatttagccacacaccttagggattctacatacgtgtagtgcaaattctaaaatattcaaaatatttttaactttgtcaaagatgaaaacaacaaacatgtttaaatgtattacatgtaatatttaaatagcatggcgattactagtacattgcattgggttgataaatcaactacttttttatagaactcagaataaaggattgagatttgaaggcaatcgtttaagactgttgtcattttcaacagcttatccatgaatccaaactttttctgcactttgaaacaacaaaagtaatttctaaatacatgaaaacgttatttgactacaaatgtaattctttacaaaatattcaaatactgtatgtgttaaatttataaaaacaatactcgttgtttatttaatttacagagaatctgtgtatttgtctatagaatttgccttcatctgaagagttctgttaccttgccagtacttctttccctgggaacatcactaataaataaagcagccttgtgttactgacttcatttagagatgtcaaagggagatttcaagaggtgtttttttttttttttttttttttttagttttgaaagtgaatgcctatgaaatggacatagattttgtaattcaagtcattaactttctagtaaactattataattaaagataatacatgtaattttagaagtaatgtaaactgtccatctcatcccaagcctcattaaacaagatgacaagcaagatagtgggtcacgttctaactacatattcattagttatgataagaaatacactatgactatctgggagtaatcataaatttgtaatttctaggaagaaagtactaagtatttgaaataagatcaagagctgtttaatttttgttaaagggaaataaaaagggaaaaaaataaagtcaataattttgatatatttactaataaaaatatatttgaaccctacacagtaaaattacaactaacacattgcactgtaacatctattaaaatggccagaacctataatatttgcaatcagatgctgatgacgatgtgaaacaacaggaattctcattcattgctggtgggaatgcaaaatggtacagccactttggatgtcaatttgatacttttttttttctttggggacggagtctcggtctgtcgcccaggctggagtgtagtggtgtgatctcggctcactgcaagctccacctcctgggttcacgccattctcctgcctcagtccccctagtagctgggactacaggcgcccgccaccatgcctgggtaattttttgtattttcagtagagacggggtttcaccgtattagccaggatggtctcaatctcctgaccttgtgatctgcacgcctccgcctcccaaagtgctgggattacgggcatgagccaccgtgcccggtggatacttattttttttttaaaaaaaaaaacaaaggtaaacatgcttttaccatgcagtcctgcaattgtatcccttggcatttaccgaaagaagttgaaataaatccaaacaaacacctgcacacaaatgcttgtagtagtagctttattcataattgccaaaactgggaagcaaccaggttgtccatcattagatgaatggttgaataaatgagagttagtatattcagacaacagaatatttttcagagctaaaaagaaatgcatttatcaagtgatgaaaagacactaaggaaatttaaatgcatattactaagtagaagaagccagtctgaaacggctacacactatgtaattccaacaataggacatttggtcttaaagtctctgaatactcttaaatcatgccaaataataactttatcattctctgcagagttaatactatgccgtacatttactacacttcagattcatagagttgaaaaagctttataaatgtaaatactaaggcaggagttaggcacaagtgtatacaaatgtaacctatttttttctgagagaccctggttgatactgggtctgatgaacactcacattagagagaaatatagtttattatatagtatgaagctaagagacaagctgataaagtgatttaaagttagagtagataagacttgagtataaaaaaagatactcaagaatctgtggctgaatatttaaagccagagagtttactatcatgggaggtcttagaggttatccaagtcaccacctgtgttttaagggtgacgaagaagcatgcctggaaaaattaaatgacccacacatcagataaaagaatataagtagaagatttttaacatcatgttcagtatacttctcaaacatctgaggtatgaaagaaccctgacctatgaaagtatacaatcttgacttttaacaccctgatttatatacctaccagaaatatgagcttcagaggaaagtatctaacaggagagcctaattggaagaatcagtcttgactgtatttccaaagtgcatatgacatttttcaatggagacaaagctatttccagtttggagtctcatgtttcaactaccaacatttcttccataatcaggagggagccgggcgtggtgggcctccctcccagcaacttgggaggctgaggcaggtacatcacctgaggtcaggagttcgagaccagcctggccaacatggtgaaaccctatctctactaaaaatacaaaaattagccatgtgtggtggcgtgttcctgtagccctagctactcgggagactgaggcaggaaaatcacttgaatctgggaggcggaggttgctgtgagctgagattaggccactgcactgcagcctgggcgacagagtgagactctgcctcaaaataacaacaacaacaacaacaacaacaaaataataataataatcaggagggagtgaaaccacagaatttacaaaagtggttttcataacttatacctaaaatctccactttacacaaaacagtgaagctacttgaagacaagatagatgcccgccttccgcctcagcctccactgagagcattctgtgctagagctacagtgtctctttcatctcaagcttataaatgtctttctatacaagattttttagagagatggagggaaaatgttgcaaatgaccactcattttaactacctttgttactgtggctattcttggaaaatgaaaattaccaattgcttctttggtgaggaatcgttcagcctataattagttgagatacagaaaacttatgaatggcagagtctttagtgatagttgtaagaatgctttaaaaaaaagtatgtgcttgataatttctccactttttttaacttttaatatatgaattagctttcagactaaagtttgtggctttgaaacttgatgaccttaggcaaataacaagtatgtacatttgtttcccagtcttaaaatcagctatcaatctgaccttaaactttaatcattcagtcttaaaaacattttcatcagcattgaaggccttgattatattgggaggcaatttgatgtggtaggtaccagccagcctctggaatcagaatgtctgatttcaaagccttgcgtattggttaattgggggcaattactcagtagttttattaacaacttgtaaatattcttttgattcttggaaacacctttatatgggagacaaaataaatatattgcttccagtaacaaaagtacatccccatggaatgacatattttacagagttcatcctatacctttttgttggtttgttttttgttaacagttgtttaatacatttagtgagccaggtattgtgtgagtcactgagaaacacaaaaagaaatgagaatggatggcaagcctcagagctcagtgaagtggttttaaaattctatgaaaataactctgtgaggccaggtgtggtgacccatgcctgtaatcccagcatttttgggaggctgaggtgggtggatcacctgaggtcaggaattcgagaccagtcccaccaacatggtgaaaccctgtctctactaaaaataaaaaattagccgggtgtgatggtggacacctgtaatcccagctactcaggaggctgaggcaggagaatcacttgaaaatgggaggcggaggttgcagtgagctgagatcacaccattatactccagcctgggcaatggagcaagactgcatctcaaaaaaaaaaaagaaaaaaaaaagagtaactctatgatagagaagtattggtatctaggtgatctaatgactcatttccagagtgatatagtttggatctatgttcccacccaaatctcatgtcaaattgtaatccccaatgttagaggtgagacagggtaggagatgattggatcatgggggcagatttccccctcggtgctaccgttgtgatagtgagtgaatgttcacaaaatatgattgtttaaaagtgtgtagcacctacgcccctctctcttcctcctgctcctgccatgtgtggtgtgcctgcttcccattccccttccgttatgattgtaagtttcctgaggtctccccagaagttgtagccaccatgctttccgtacagcttgcagaaccgtgaggcaattaaacttcttttctttataaattacccagcttcaggtatttctttatagcggtgcgagaatggactaatacacagtgtacaacatcaaactttcctagggttatatgaaaatgcttttatcttactttctgtacttaaagctgatttcacttcagttgtcaatcataatattaaagagggcactttgcttatcaagactgaaaatcatattacgcttcaataaataactgtccatcacagctatcttgcttctatctgattaaattctattatctgaggatcagataattctaatattctgttctaagagtcggatattttattttgcagcatgactgaaaataaaatcctttaagcaacatttcaaaaagcacatacttgtgcagagtaatttctgactatggacaatagatttagaaagttaaaattttaatgacgtgaatgaaaatcataagctcacaattttgaattttattttctctaaaacaaaataatagcttgtaagacaaaacattttgcagttacttatgtttaatttactatttgtaaacacaatcttggtgatcttaatgtgtttaatatgggaatatatattccttaggtaaatttttttttctgctttactctggagaacactagaattttttaaaagcatatatatccaaatatatttttaagtagaaattttttagagaagttttagattcagaagaaaattgaaaagaaagtacaaagatttctcataaatcccttcctcccaccccaccattaacatcctgaatcagagtgatgcatttgttgtcattgatgaacatgcgttgacatttcatcaccacccaaagtcaacagttcatactatggttttcactccctggtgctgtgcattctacaggtctcaacatatgatggcacatgtgcaccagtgtagcattatatagaatgaattcatttcctgcaaacttctttgtgttcagcctttttgtttctccctctatcctgctgccttaatctgccaacaaccatgtgttattcattgtctccatcattctgcattttccagaatgtcacatagttggaatcacacaatatacagccctctttgactggcctcttccacgcagcaatacgaacccaagtttcctccatgtattttcctggcttgatagaccatctctctgcctccaagtcctgtcaatcatgaacaaagctgctacaaaatcttgtgtgcacgttttgtgtggacacaagtcttcgacacattcaggtaaacactaagcagcgccaccattagatcacttaattaacacatgcttagttttatgaaaagctgccaaactgtcctccaaagtgtctgcaccaccctgtactcttacatgtaatgagtgagagttcttgcccatcacattctccccagcagctaatgccttctgtgttttggactgtggccattcgaataggtgtgcagtagcattttaccattatcttaacttgcagtttcccaatgacatatgaggaacatgttttcttattacaatcaggctacacatctcctcattgttgagtttcaagagatgtggagaaataggaacacttttacactgttggtgggactgtaaactagttcaaccattgtggaagtcagtgtggcaattcctcagggatctagaactagaaataccatttgacgcagccatcccattactgggtatatacccaaaggactataaatcatgctgctataaagacacatgcacacgtatgtttattgcggcactattcacaatagcaaagacctggaaccaacccaaatgtccaacaatgatagactggattaagaaaatgtggcacatatacaccatggaatactatgcagccataaaaaatgatgagttcatgtaattggaaatcatcattctcagtaaactatcgcaagaacaaaaaaccaaacaccgcatattctcactcataagtgggaattgaacaattagaacacatggacacaggaaggggaacatcacactctggggactgttgtgggctggggggaggggggagggaaaacattaggagatatatctaatgctaaatggtgagttaatgggtgcagcacaccagcatggcacatgtatacatatgtaactaacctgtacattgtgcacatgcaccctaaaacttaaagtataataaaaataaaataaaagagttccttacatattctggacaagaatcttttgcaaagatatgtctgttgcaatattttcctcagtttttggcccatcttattctcttgacagtgtcgttcacagagcagaagttttaaattttaataaagactggcttaccatttttttctttcatgaatcatgcatggtgttggatctaaaaattcatcaccatacccaaggtcatgtaagtattctcccacattatcttctaggagtctcacagttttgtatctcacatttagttctatgactgattttgagataattgggtggaagaatataaggtctgtgtctcaattcttttttctttttttttcttttgcatgtaggcgtacaattgtttcagaaaggtttgtagaaaagactgtctttgtgccattatttttcctttgctccttcatcaaagttcagttgaataaatttctgtgcctctatattttgggtctttattctgctccattgatctgtttgtctattctttcaccaataccacactatcttcattaccatagctttataataaatctagaattcgagtagtgtcagttcgctgactttgatatttttcaatattgtattagaaaatctgggtgttttgcatctctatataaagtttagaatctgcgtgtcagtatccagtaaaaaactttctgatattttgattgaaattgtgttgaaactgtaagttggagagacctgatgtcttgacgatattgagtcttagccacaaatatggaatatctctcagtttatttagttctttggtttcatcagttgtgtgctttttattaaaagcatataacttgggaatattttgtaaaatttatgcctaagcatttcattttcttagttttgctaatgtaaatggtattgtgttttgaatttcactttccacttgctcattgctggtattgattgataggaaagcattttatttttgtacattaatcttgcatactgaagcctttctataattgcttattagttccaggatgttctttgtttgtttgtttccatttcaattttctacatagacgatcagtcatcagcagttttattttttcttaccaaatcactatacctttctttttttttttttttttttttttttttttttttttttttttgccttaataaggacttccagtacaatactgaaaaggagtagtgagaggacacttacttgccttgggaaagcttcaagtttctcatcattaagtataatgctagctgtaatttaaaaaaaaaaagctctttatcaagttgaggaatctcttctctattccttctttactgagaagttttaacatgaatgggtgttgaattttgtcagatgcctttcttcatattttgatataatcatgtgatttgtcgtttttacccagttgatttgatggattacattaattgattttcaaatactgaatcagtcttacattcccaggataaatctcacttggtcacatatttcttttattcatcattattttattgctaacattttattgcaggtttttacatctatggttatgagagataatggcctatagttttcttttcttctaatgccttggtctgattttgtattagggtaatgttggcctcatggaatgagttaagaagtattccctctgcttttgtgttctgaaagagattgtggagaagtggtatcatttctaccacaagtatttggtagtaaacccatctaggcttttctagatgctttctgttttggaaagttatcgatcattagttcagtttcttttgtagatataggcctattcaaattgtgcatttcttagagtgtggtagattgtacctttaaagaaattggaccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaagaaattggaccattccatctagattatcaaatgtatgagcctagagttgtttatagtatttctttattatcttttaaatatctgtgggatctgtactgatatcccactttcattttttatattagtaatttgtatcttatttttttcttagcttggtttcaggcttgtcagttttactgaccttttcatagtgtcatctttgatggtgttaagttttcttttctttgcattttcattgatttatgctctaatttttaatatttctttgctgctgcttcctttggatttaatttgctcttctttttctagattcttgaggtagaattttgttaggaattttatattttcttcttttggaaaacgtgtattaaatcctataaatttacctataaatgtataaatttaaatcctataaatttttttttgctgcatcccacaaattgtatgctgtattttcgttttcacttagttccaaatgttttcagattttcttgacatttcttttttggcccctgttttaattggaaatgtattgtttaatctccagatagtttggaatattacagctgactttctctgttgtctgagagcagacattgtatgatttctaatcttctaatttattaagatgtgtttcatggcccagaatgtggtctatcttggcgaatgttccctgtgagtttaaaaaagatgagtattttgctgttgcgggctgaagtagtcaatagatgtcaggtgtatccagctgattgatgttgctgctgctgttgagttcagctacgtctttactgattttcttcctgttggatctgtgtacttctgatagagtggtgttgaagactacaactgtaatagtatgttcatgtatttctctttgcagttctatcagtttttgcctcatgtattttgatgctctcttgttaactgcatgcactataaaaatgtttgtgtcttcttaaggacctgatctttttatcattatgtaatgccattctttattcctgagaattttctttgctctgaagtatgttttgcctgaaatcagtacagctactcaagcttacgtttgtttgattagcgttagcatggtacatctttatctccttactttttaatctgtatgcatttttatatttaaaataagttcttttttctttttttgcagatagcatatagttgggtgattttctaatccactctgacaatctctggtttttcattggtgcatttaagctattgctatttatgatgatgatggattaatgatgacaattggattaatatcgaccacatttgttgctgtctattcattactcttgttctttcttcccatttttgtctactacaatttttctgccttagtgattttaattgagcattttatattattcattttttctctctttttttctctttccctagcatataaattataccatttttttctctttttttagtttttagtgtttctgtagagttggtatatgcatttataactagcccaggtccacttttaaataattctataccactttatgagtagtgcaagttgcttataagaacaaaatattcctaattcctcgcattcatctcttacatcattgctattcattttacatatagtaaactgtagtcatcaaatacattgttgctattattttgaacaaatgattattttttacataaattaaaaataagaaaaataaaagtttatattttaccttcacttatttcttctctaatacttttcttttctttatgtagtaccgagtttctgacctctattattttctttctctctgaagaactttaaatgtttcttgcaaggcaggcctattggcaacaaactctctccatttttcaatatctgaagaagaagtctttatttctgaaaagataaagaattctaggtttctgggtttttgtttgtttgtttgtttttttctctccaaacttcaaatattttactacattcccctctctcttgcatggtttctgaagaaaagttgaatgtgattcttaggtttacttttctgtaggttagcttttccctattgctttcaccccagcttctttccagactttttgtatctgtaattttctgcggttggaatatgatatgcttaggtagcttttttgacatgtatcctgactggtgctctctgagttttctggatccgtggtttcgtatctggcattaatttcgtgatgttagtcaaaattatttcattttttttgttcctttccgtttttctggtatgctcatattacacatgtgacatcttttgtcattgttgcctatttctaaaatactatgttccttttttttcagctttttgtttctctttgcttttcagttttgcgggtttctattggcctcctgaaactctgatgatgtttcctcatccatgttcaatactaatgaatcatgaaaggcattcttcatttctgatacagtttttaaatagactcaagtctatttataacatttttgttcctcagtaaaattgagaaattacagatgttgcccttatgccctctgttcccacatacacataaccttccccgttatcagcctcccctgacagaggggattgtaacatttgttacaatttatgaacctacattgacacatcattcctacatggagtccataatttacagttggtttcacttggggttttgaacattctatggatttgggcaaatttataatggcatgcatctaccatcatagtatcgtacaaaatagttttactgtcctaaataacctgttcatccttccctttcctataaccctatcaaccactgatttttttttgtcttcatagttttgcctttttagaatgtcttatagttggaataaccatggtatgtggacttttcagactggattcgtcagtaatgtgcatttaaatttcttctgtgtatttcatggcttgataagtgcatttcgttttgcctatggaaaatattccattgtctgaatataccatcatttatccattcatctgctgaagggcaacttggtggctttacagtttttgcaataataaataaagctagtactgtaaacatctgtgtgctggtgtttgtgtggacttatttcatcttctttggataaatacctaggagtacaattggaggattatgtggcaagcgtatgtttacctttgttaaaaaaaaaaaagtatcaaaatgtcttcaaagtggttgtaacattttgcattcccaccagcaatgaatgaaaattcgtgcccgggcacggtgactcatacctataaccccagcacgttgggaggccgaggcgggtggatcacctcaggtcaggagttagagaccagcctggccaacatggcgaaaccctgtctctactaagaataaaaaattagccaggcagcgtgacgcgcacctataatcccagctacttgggaggctgaggcaggagaatcgcttgaacccaggaggcagaggttgcagtgaatggagatactgcgccactgcagtccagcctgggtgaaagagcaagactctgtctcaaaaaggaaaagaaaagaaaagaaaattccttttgcttcaaatcctaagtagcatttggtaacattttgtaatttttaaaaatttacaaaatattataaaatttgaccatcctgatagatgttgttatggtgtttttttgtctctaatataattttttaattcttttctagaactcatatttcttggctaacattactgatctgtccttgtatgttatttacttttcctgttagatcctttggcatgttaatcacacttgttttacatttctggtctgataattccaacttttctgctgtatcagagtctccctgatttttgccttttagtatgccttgtaattattgttgaaattgtcatttgaagaaaatgataagacttgtctcaatcgtttttggagatttatttgccaaagctaaggacgcatctaggaaacaggtctatgcctttttccaaagatgattttgaggcttctcaatttaaaggggaaaagggtgggatgatgagaagtacacagttttcccataaacaaaaggggcaaaggaaaaatgtggggaatctgcattttatgtaagataacacagacccaaaggggtaggggaacaatccgatatgcgtttgtttctggcagctgaggccactgcacctgcaaagataagctatcaattagcatggccatggtgaagtttcaacagctcaccaggaatttccttgtgggcaaaatatggggaaggcaggtcgcttttcatcattttattcaggaaccaaaaggtggaggcaggtatgtgtgaccgagttcgcagtttggcatttccctttggcttaatgagtttgtggtccccaaatttaatttcctttcacaaaagtcacacatgatgtcctctcttcccacatatacataaccttcccattatcaacatcccctggcaaaggggattgtaatatttgttataatttatgaacctacacggacacatcattaccatgtaaagtccataatttacagtagagtttactctgggtgttgcacattatatggatttaggcaatagactctgtaataaatagactgttcaagatgtggttgttgagtgtaggggagaagaaacattctgcagtcctatgattaggtcacagtcttttattgagcctgtgctgctgggctgtacacttcacaaatgcttctcaattttattccccttttcaggtaagacaggatggctagagggggctggagtttgtaactccatttctcccaagtcaattagactctgatgaaatatgaaatagtttcttttgaagacaggacttgttaagtaagaagaacagtatcctctgttgtatttcaaaatgtctccttttcccctcctcctgtgagaagccagaggatatttttgtgtcatctttactgtgagaacctggtagaggccctggaggtaaaactcacacaagtgtggggtttccctatgactagactccctcccctgaattttttttttttaggtctcagacttgtccatattctgcttccaaaaattcatgaattacgtttactttttccttccccgggactggttatgggttttggctgctggcaagctgggattccccatgtccccctatcagtctccagttttggagacaatggtttgtcctgtggccctccttctctgatggatctaagagaagttgttgactttcagtttgttcagttttgactttttgtcaggataaagagatgactcccaaatgtcttacatgccagactggaaatcagaagcctcaaatacgattttttacaaatttggtgatatatgtaccaaaagtttgaatatgaagacctaaattaccttgccatttttagcagatcttgaaattttacttttattcatttcttcactcatttcctatgaaacaatatgatgcaacttatcttgagaggacctaactcaagtctattaagtggccctcattgaaattactggcttcagagccagttacagtgaggcagggaacataaagccaattcacactgacttcctagaactgaataaaatggaaacacctcagcaatgacagaaatgtgaatggctttataacttcacttcatcctccccatttacataggacacacacacacacacacacacacacacacacacacacacacacacacacacggtgagttcctctccatttatatagagtgcataccaagtaaatgtctttgtaactttacttcattctcttctttgatataggacatgcaccaagtaaccagtgggaaacctctagagggtattgaaaccccagaacattctgtaacctgggcttctgagcccctaggcttgggcctgctcccacactgtgaagtgtaatgccaagaacctggacaccttcaaccagttacaacaggaccacatgaggaaaaaaaagctttattatttagttatacttgaaaataattttccttaaaaaaaagatactgcctatcttgctgacctcatatgccaactattgtcttccttgatcttgtatttcctaaagattcatttattgaataggtgaacatttggtttcagcctgtcgccaggttaaaaaaaataccagaaaggaacttgtagtgaattctttgaaattctaaaactcttctaatacatggcagtaattctgaggcaactatatagcttctccaagtgatctcataaaaaaatacagtgaattttttaaaccaccgctaatacagatacagatggtcctgacatgggatggcttcacttaaaattttttgtctttactatggatttatcaggacatgactccgttgtaagtctaggagcatttggacttgagatggtttgacttacaatttttcagctttatgatgggtttataagggtattaaatgcatttgtgacttatgatatttctgacttacgctgggtttattgggacataattccaccttaaatcaaacaacatctgtatactgaagtcataaaaagaaaacagtacaaagctgcatactatggttatccaattaatgctagttatgattaactctctaacaattcatgtacataggcagctgtgtactgggatagtcataaaagatttcacaatttttgcctatattttgctttttactttcaacagtttagttttggaaatcataagcatttactggagaaccaaaatttattccaagttacaccacaaattagctccagaattaattggaattcaggtactttcagtaattcatctttttcagaatatgacagagtaaattagttgtgattgaaaaaatagcgtttacctttagttttaagtttcagagttggtctgaaatgttaatggaagcacattactagcccaaattcagttgactatgaaaatgtctacacatagttttatgaacttcaatgtatgcagaaaagacatattttaacctaaatattttagcaaacaattaaatatgagaaaacgtcctggtaaaagctctggtagatttcaaaggcttactttctgtaatccatgggaaataactggttggtcctttacttgtcctcacactagcaaactgtggttgggaaaatataattaaaaacagaattctcttccagctcaggataggggagaaaaagtagtatctttttttttgtctgagaccactataacaaaagacagattaacaagagaaaatcacccaaatttatttgatgtgagcattatgtgatatgcaagccttcagcaaagaagacccaagaaacagaaaaataatacgtatttttatgaacagtcatgcagaggtatgattgagagacaaaacggtatgatctaattggaataaactaggagaaaatggtaagtcctgtttgtttagattcttggtcactatgagtctttggcttattttctgctgggtgtaggcagaacagttgcttcagaggaaggtcagataaatcttttatagcacgcttccggggaaaaaggtgggagaaggtcagagggtgacattctcacttccgcagttttctcagtttccttcagtttaaagtagtctgagaaggagcatgttctaagttggaaacttctttacaaatgtaatagagaaatcaaatagttttattattgaattagaattaaaccagaatcagccagacatggtggctcacacctgtaatcccagcactttgggaggctgaggtgggcaaatcacctgaggtcaggagttgaagaccagcctgaacaacatggtgaaaccccgtctgtactaaaagtacaaaaaatagccaggcttagtggcgcgtgcctgtaatcctagctactcgggaggctgaggtgggagaaccacttgaacccaagaggcagaggttgcagtgagccgagattgtgccactgtactccagcctgggcaacagaatgagactctgtcttaaagcaaaacacacacacacacacacacacacacacacacacacacacacacacaaccacaatgtgataagcatcacaggtaagcaaaaaaagagattgcaaagacagacagaaatctcacttttcaatataggcaagcaggtacaacccattgtctataggataactaaccctcccctaagaggacttgacagccccatttgtcacacacagttaatcctaaatgcacttggtaattggggtaactatctgccatagctatttggctttattaaggtaaaaaaccaaactttttgtatcttcatgataagagagagttttgcaatttggagcaaggctcctatgttcccacagaaacagggagataggagcactaccttgatatttatatttcagacagatggtttccggtccttaagacagacattcctagattataaaactgtaaaaaggacgatctagttttcaaaaggatttgtgcatttcaaagagtggagatagtacttacaagttttctaaagtaaatgctctgagaaaaataaggggagggaaatctcatcccttattttcaacagggcaaattaaggctctcagttggtattgatacaaattatggcagagttgggagtatacagtagatgagttaaaatagaaaaaaattctaattaacatctagtttatcattattcctctttgtgtaggattttgtataagcctaaactcagccaatgaaaacgtatttaagaagtaaggaaatgagacagtgaaggaacaaaacattgcagtgggctagagctgagtctttctttttaacaaaagaaatgcttcaggaagcattagcaccgtatctccttattccaactctcctaccattaattcgctctgagcatgaaattacttgtgtgcagagtgcacccctgataaaggtaattccagtgcacaataaaaaaggggcacttattaggcaataccaaatcaccctgagcatgtgtctaggtacaaacaggttccttaaattgtctgagtcatagtgacagttgataagagctgaaacgaaacgatccatcccccaaaatgaaaaggtcataacgggtgatcttttctgtagaaatgtctcttgtgttagaagaggtctgttctctgggcagacaacatcttatttcttcacacacagtgctgtagagctttagagaaccagagacaagaacaatatgtctctcattgattatcactttaaaatcaaagtgtcttgggtcctttaaagttattgctgaaagtgagcagagtacagaagctaagctccaacaccatgaaagtatacatagataatgaggtctcaaccacactccagtcagttaattatttattggattcttcttacgtgacaacctcttttaagaaattaattcaggacaacaaataccaaagactaccaatttacaaggatacatgcaacagaaccagcaatgtcaaagagcattgaaatcacttataaaataggttgttattaaaaggcacatctgaaaacttcttctaaagctaagtggatctgggccttgtcaaatcaaggtgggaaataaaatttcaccttgcagttgcagcctctctagtgaagggatctgggctgtgctagcatcagttcaaagtctgtgatgatgcacaagaaagatgcatctgactttgaaatggccatgtacttctgtggtcatagaaatcagttattggtttggattagatttggcaacaaaagatacaaaatgcaaacccccctggggtgcatgtttcttcacattcctcaggatttaaataaagagagttgagaaattccagcctgtagttggctggaggaaatatctgatcactcacaaaggaaatgaggagggagggaaggagaaaatccaggttaatctcactgctttttgttcagtggtaaacagttggtgtttcctttttcctcatttttaaggaagaaaatacgtattagaaaatatgaaaagataagaagaaagacattacattaatctaaaatcacttttctaggtggatttttttttcttggggtttggattaatgtttgatcccatttcagtctcatgtctgcccaataaaaattacaataggttgacctctggctgagccactgacttacctcctcttctcctaagccactgagtacctgggtaggtacaaagtttctaaacagagatgcttaatgcatcagaatcatcccttccatcttttcaggttgcttcctatatttcaaatctgctctgcctgagggtatctcaggtaaatatctacgtaaaatcagtgtaaattttaaaccaccaaacttcatttctaaaatgcttatctataactttataactcactgagaagtttgaaagtcgagttttctggagaagcacaattagaccccagtactcttcttgggggcatcacatcttatgctaacctacatttttacaatttccggcttatttgtcagcacaagccatgtgtgaagtgtgcatggatctagatgggttgagaatctttgcttgtcctgctctaggttcctgcatatgtctctctctctctttttttttttttttttaaacctagtttcaattgtcccagtctgttttactgcaataagacttagaatgatctggacagtctggcccactggggagcatatcctttctcagattttttccacattttctgcttatgtgttttggccttaattctccactcttacttctcaaaggaccattagaagggtgatatcattgcaccacagtgtgatatgaagtatgaaagaggaatggctgtttttcatcctgaggcaagtgcttaattcataattgtatatgagaggcagtgtggaggggcagaattagagatgtgaaaatgtttataagtaaaaattaagatatagtctattacctgatctcttttacacctgtttttccctgtgtggattttttaattttgttttctacagcttttcagctacttttttttcattttttgaaacagagtcacactctgtcacccaggctagagtgcagtggtgccatcttagctcactgcaagttctgcctcctgggtttaagcaattctcatgtctcagcctcccgagtagctgggaatacagacttgtaccaccctgcccaggtaatttttatattttgatagagaggtttcaccatgttggccaggctcatctcaaactcctggccttaagtgatctgcctgcctcagcctcccagattgttgggattacatgtgtgagccacagcacccagccttagctccttcttaaagtagtgaaatcatcttgccaaacggagactcttatccccttaatatagaatacacagatacagagctgttatgctgtggggaagaagagctgaagctccataaggtctgtttttcaatccaagtccctctgtaacccttaggttattttataaaaccccagggttccaggaaccaaagttgctaactgtattcaagacagtgcactcgcatccagaatcttatgcctcacttttcttgctaactatacatattgtcaaaagaacctctgacctcgtaaataataataattgggaaaaaaaagtttaatttgacagaacttcacccatgcaaccctgtttccattcctgagccattcctcccttgctgagttctgggagccctttgtattagtacgtatcatttgtcatttaaatgtaggaacttgtattgctcttatcacttgatttccctcttattttcaagaccagagacgtctagagaccagcaactgaattttataactgtttgctttccagcacttatatcagtgggcagtgcttaccaaagtctctgtgtgtgtgtgtgtgtttctgtccacagtgatgatgataactttcagatattgggggaaaaaatatttcaaaacaattctgagtttaaatgagttatgtttctgtacatgatttcttttcactgtttttacaatattaagtaaagtgtggatttgaagctttgctaatattcgcagcttcccaagtggccaagaaggttttgacaccttcccttcatcttgactgaacttcatctaatttcttactgagtaggctcctgaccagtgtcctgatgtctccttttaaagataatttactttagaatacttgcaattataaatcatttccctgcccttttgaggtgtaaatctttttaaaaaatcctcttgatagtgttataacccaggactatgctggggctcagaaataaataccctaacatatggcactttgacatattgggcaagagaaaaagcctcaaggtccctctgaccttcctcccaccacatcttctgtttttcaatcctctgtctaccctaaagcaaaggatgaagttgttctctaaagttccctaatctgcataaagttcagatctgtcaaagaagaaaacaatcacctctggtcccttccctgagttttcattaactgaaatcatattgcagaaggaaagactaaagtctgtcaacacgcatggacagacttcagttgcatctgttgtctactctatgagaccaacagactttttcccaggccatgtatgttcttaaaaaccaattaattgccctaaaaattatttactacctccataatgtgaaagcacctttgcaaaaattatatttgtgagaaaataataacagtgaaagaggtctgacctaactgactccatcttgctttcaacctccaagctgtccttgttcattcctgggttcaggacaaactaactaacttagtttacagtttaaaacaaagatgatagtagccctttcccaaaatttgcttttgtaagactaatcccaaaactggttgtctaagactaacaagttagccacaaaattagaaattatgatttaggagtcatgcaattacaggtcaccagattctaaacgtcgccaattgctcctaggaataatatcactattgtaaaacttgagattggtgcttgaggtatttttcagacctttcacttgatggatcaggtggtgccatccaaatcaataaatcagctcatctggtcttatggccctcactcgggaactgactgcgtgcaagaggaaagctttgactccctacaatttcatcttagacccaacaaatcagcactccccactccctggccccctatccaccaaattttcctcaataaaccctggccccaaaatttctaggagactggtttgagtagtaataaaactccattctcccaatcagccagctatgcatgaaataaactatttctctattgtaattctcttgtcttgataaattggctctatctgggcagcaggaaaaatgaacccattgagaggttacaaatttcatccacacttctccatctccctttcctctaagaagaaaggtatataatcatttgtacagcattgcatgaggaggtagttactctgtgatcctcctccatgagcattactaaattggtataccatttctcctaatttgtcttatttttctttgattttcagtaaactttgagtggtaaaaggaaagttttcccttggcccccataactatctttctcaaggatttgggaaccatctgattaaaatgtaatcatcaaggaagatattgcccttatccctgtcttctgtggcaggattccattctaagttccctggtgcatcttgctccaagttgcaaaattacctcgtgtcaggaagatatgagaaagttactttccctctgagtaaggccaataagcacacattgatggtttacaattacttaattcccccaaattctcagctattaaaaactccctagtcctttgttttagtggaattgagctgagactgacttttggcttctctctgttattgcaatagcttcaaataaattgttccttgtctgtttaactttatgaagtgcaacttttgctttgatagagacttctattaaacaccaagaacaacaaaacattcctctgctcaaatttaacttgccaaaatcaaaggaaactatattgtccagagagtgataaatttattccaacattttctttctttttttttttgtaaggaaaactttgcattgtttttaatagcagttaaaacacttggagaacatagtttcaataaaactgacaaaaagctgcaattaattggtttactctgtgtaaatacattgaccttctgtaaatcattgagctagtctcttcttctctatgttattttcttgcgtgtaacttcatttagaatgagcaataactttttcactactgaggaactaactctgtagtatactggaggtacattttattgtctattaataaattctaacattattcccccttcttcgtgttaaagtaacataatttgagtcatacagatttagaggtaagcgctcatttgagccttttctgtacttctttctcagctaggctatctactccaggctgatttcatggggcaacacttgagtatatacctgactccccactctgaattcacctatagtgatttgagggcagcagaattagcccaataagatataaggaagtagaccaacttcataaaattttaggctgaaaataatctttggggttatagaatcccatccttatattttgcaggtgaagaaaatgtgtgactttctctgagccatacaatgagttaaacatacaaataaaactgagaattaggaatcatagaatcctagtctattacttttctattattttccatttctgacattttcttctatttaggtagtttgttattttgccccataattctgtgcttccatgaggtatcacatagatccaagatttgaaaatttcatccctgttaaagttttataatcttcaagagtcactctgtctaggaatatgtgtttttttaaaagaatacagataatattttaaaaattcataaacaaagctgatagtggaatttctttctgcagaattttttttttttttttttttactggaaaagcgtagtttcttctaactctccaacaccctgtgctatgcctgctacagaaagaaagctctgccaaaaaaatttagtgataaatatacttcagatagaagatagattatgtgaacacaaaagactttaacatacaactcacaaaaaggtgacccaatataatatcatctaagatttttctatccagactggagggacatttaattggcacattataatttctctttactgaaacagaaatgaaactatgaggattccaagaaataaccactactgcttagacagttctatctctttttatgtctctttcatttattagcttagatttaactgaagaaactcaaacttaaaaataaaagagtgtagggattaatccatcaatttatattttccttcatctaaataatgattttctttacatatactgcaaaatattagcttctagtgtcattgataagcaaatatcttcatactatctgaaacatatagactgtttatatactcagctttactggaattaaatgccgttagagagtgttttagttttttgcctttccaacctaactcctggagtcaaaaaaatattcctgtcttttaagatacacatgttcccacagggctattccttgaacagataaaagcttagagtagaactgaccttttagcagatccttcatttttattctttttagcaagttgtatgttttttgtttttttttaagattttatcccagtttatagaaatttacaggtttacaaattttcttttctggtactattttagcacaatttttgcatgtactttttgtttgtttgtttgtttcttgactttttatttttttatttttttatttttttattatactttaagttttagggtacatgtgcacattgtgcaggttagttacatatgtatacatgtgccatgctggtgcgctgcacccactaactcgtcatctagcattaggtatatctcccagtgctatccctcccccctccctccaccccacccacagtccccagagttgtatgttttaagagctatctttgtgaggtttttaagtctgtggatctattttgtagtttccctctcctacacaaaatacctttctctaaaaaaggagaagtgccgggcatggtggctcatgcctgtaatcccagtactttgggaggctgaggcaggcagatcacttgaggtcaggagttcgagagcagcctggccaacatgggaaaccccgtctctactaaaaatacaaaaattagccaggcgtggtggtgtgcacctgtaatcccagctacgtaggaggctgaggtgggagaatcgcttgaatctgggaggtggagattgcagtgaacaaagatgttgccactgcattccagcctgggcgacagagcaagattccatctcaaaataaaatgaaaataaagaaagagaagtaaccttgtttaacataaaatactagaaaatcgcgggaaagaaaaatatgctaccccatgatatatctttttctggtatatttcaagatggctattctgagggaccacaggcacttcaatagctctaaaaagtcatctttttgtgggggagatttctatgtgcatataatacatatttacaccttttctcctgttaatctatctattctcagtttccttgactcaaattatcaaaacttcagaaagataaagaaaagttcccttcatctctaaaaggaatctatatgagaaacaggtctaaaatacttacaatgattcccaatgatattaaatatggaggagtacagtaggacatataataatagaaaatatttgaatttatagatgaaaaaagtgaaaacgagaatatgggtaagaaacaaggacataaataaaatctattttttattaccttattttcctcatagtcacaattttaaatgctggcactagaattatgatgttaccagtgtcattctattttactcaggaattactatggtaacattaaataattctcaaggtaaaattcattattttgtgttacaattaaaaattataaactcatacatacttcagaagactgaatttaatatagttttagttatcaagcattgaaattgcctcaatcttaaaaaaattcgtttctacaagtatgaaagcctttttgagttgagatttttgtctattttgttcattactgtatcttcattcctagaactttgtcccagtgcaaattaggtacttagttaatatttgctgaattggtatcctgaactagcgtttctcaaagcattgtcagaagaacactggagcattttttttttttttgtcactagtatacagtgtgataagagagttctctggtaaaagaagtttgagaaccacaaggtaccagggtaatattttagatattcaagttctatataatcagatgtcctgaaaactacctatggttaacttggtcagctatggtaacatgttcacaatgaaagctgtggtcactttcctgttccagtggaaaatgctgctcagagctgcccctgccctagcacagtatgtgtccttacacccaagtgtatgttcaacaggagatccacttggagttcagattccatttaggaagtcatttttttaaaaaagaatcttgagactcagcacttatctttgatgatccttgaaagagtaaagttctcatgaggtagcacattcagactatgataaaacagaaatttactcttttccaagtaccattttaataatttacatgcactcatcatttaatcttcaaaataagtgtataagatatgatttcatcaattcagaactttggctttttgagagacactattaagagagtttacatattctcactcataggtgggaattgaacaatgagaacacatggacacaggaaggggaacatcacactctggggactgttgtggggtggggggaggggggagggatagctttaggaggtatacctaatgctaaatgacgagttaatgggtgcagcacaccagcatggcacatgtatacgtatgtaactaacctgcacgttgtgcacatgtaccctaaaacttaaagtataataataataaaataaaaaaaagaatttaaaaagtaagtcatggactcaaaatactttaaatatatttaataaaatcttagaatataactagaactctcaaaagccaacaataataataattgaaatcagaaaactgaaaaaaaaaagccaggtaaattgtttgtgattgcctaggtttttggccatcagccaaaatgaagaattagcttaagaattagatgaaggatattgatagtgttgttcaattacttgattcccttactgagaacacagggccaaatattttgacccatgttcatgaatgagatcaccctataatttttctctctatagtgctcttctcaggtttatatattaagattgtgttaaatgccatgaaataagttgacaagttttttatcctttttttcattttctctgggaaactctgtataatactgagcttatctttttctttgatgtttatatagattcatcactgaagtgatctttttttattttcattttaatagtgaattttttattactgctttaatttattcaataattttaggacttttcaagttttttgtttttttctgagtcagtttttgcaaggaatattttactatgaagtttccacttctaaattttcatatttattaccctattgatttattatattttcataacattttagaatgtatagcttctctacatagtgatagtataaaaattcatcaaacagtttataagtatacgtgaattatcaatacaactacagaatagatacaggaaactttgtgatataagataaaattttaaaatggcacttagtataattattttatatcatgtgtagaaataatttttctaccattcataaagaatgattctctgtatactcaagaatttctaaaaatatagagttcaaagcttatccccacggagacagacatctgggagctttttcaatagatataggaatcacagttcagaaaatctgtttactctgttaacaatggtgcataccctgtcattggtctgaaagtgatttctcagaacacaatgagaagaataaaacttctgtctttcatcatgtaatatcacctgccctcagcactactttttagccaccatgtcctccacagataattttaaaaaggaaagcacctgataaaaatgtattttccaaactcaggcctattcaattgtcttagtttgtcacttagtaatatatttctccatacagacaatcctgtacatatacttaattgagaaactatatctaaatgtcccattttgtaggaaacatcagtactataaaaatttccatatgtaacgaagatggtataaccagacacaagtccatctgccagccacttgctgagtcccatgagcaagaatgagatctggtggaaagtaagtggcttttattccaaagcttagctgaaaggaagtggtacaggttcctgccttaaagggagctgcttccgctttctgggcagaaagcagagtcttttaaaaagggacttggtgttaaaggcatggagggaagggggtgagtagaggcaagttctgcgtgatttgctgtctggtgccattgcaggcagagctaggttgtaaactgaccattctctgaggcagtctccttgtgggtaggtacctagtttgtttcaaggttcggtctccagaacttctaagtaaactcatagttaggtaatcttgctatgtagtataggaactatccggtggtgagaaggtaaaatttatgactgtattcttaaagagccacgtaggaggtaggggaaaatgaaaaaggttaaaacaaatcattttatttttctttaccattaggtgtatataagaaaattgggcatatattataattggaaatatataagaaggtagaaaaagatcattagcatgtttccatgaaaatgctataatagttgtaataatttaaaataatttgcagctgggagcagaggctcaggcctgtaatcccagtatttgggaggctgaggcaaacagatcacttgagaccaggagtccagaccagcctggtcaacatagtgaaactccctcttgactaaaaatacaaaaattaggtgttcatggtggcgcatgcctgtgatcccagctactcgggaggctgaggcaggagaatcacttgagcctaggaggtggaggtttcagtgagctgagattgcaccactgcattccaggtagggcaacagagggagactctatctcaataaataaaataaaataaaataatttggaacataagtaaaagattcttaaaataagatttttatatatgtaggaaagaagaggagttcaattaattcaaatactttatttcaccataaatctgtaagatattcaaaaaggccttcagtgttgcaatgactgctggagtgtatttcttaaatacatttttctgggtggaaaaagtctttgtctcttagtcaaacaaataaatttgtcaagcagcatataatcgattaatattaatgacaatgttttgttgagtaaaatttttatattattggggtaacctctccctttaaacaaatggaatatattgaaaagctctattaactcgttgaaaacatcagggtatcagtttttctattttccattttggccaaagttacttatttaatacatattgattaaatagctttcattttttaacatcttattatataggcacatgctattcaaacttgagaaattaattgcactgtgaaatagaagaaaaccatggactactatctaaagaaaagtataaccaaataataaaaattacttggaatttcaacgctattaacttaggaaaacaaaaaatggtacaaacaatactacaacaaatctttaactgttctgttttgttttgttttgtttttgagacagagtctccctctgtcacccagtggcatgatctcagctcactgcaacctctgcctacctgttcaagcgactctcatgcctcagcctccctagtagctggaattacaggcatgcgccaccatgcccagctcatttttttgtatttttaatagatacagggtttcctcatgttggccaggctggtctgaaacttctggcctcaagtgatccacccaccttggcctcccaaagtgctgggattacaggcatgagctgccatacccagccccagtctttaacccttaaataaactcagaaccattagttctttaaaataggcattttttctaaatctttctatttctaattttattgattttttttttcaagaagaatggtaatgactttgctataactacctgcacatattgatgctgcatgtttttactggaaaatgagcttaatgtggacattgattaattttcatgttttgttctttgtaagtgaaatcataaacatacacccatgcaggtgacagtacaagtgatcatattctattgccaacaaaaataaaatttaacaaattagaattccacaatttattttcccccaaaggtggttctaagaatgattcccagctttccagtaagagtacttttgcaccataggtttgggaatgtgctgagcaattttgtcttgggcaaatgtggaacatactttaaaatgagtacctagttttcagagaccaagtaagcatccaagaccatttgcatttggtgattactaactaaaatcactctaagtaagtgaaagctgtaataggcagatttgaatagatctctttaatcaaaataatcctgaactcaatagcttaatttttaatttaaaaatttttcatctgccccatgcttcaagttcttcatttcagcctctccaatcctgttttctttaaatcatcaatttgagctaacctaatattctatgtcttctaagatttaatccctttatggtattttatttgtatacattttaggtgacgatagatgatgtcaaaaggaaaatattttctaattttatttttttgatttattttttaaaaattctttcttgtaacttctcaagcagtgatgtgcatttacatcagcaaaatatacacaaaaatagcctcctttaccacttttctagttcattcatacatgctgcctagtcttacctttcctataggaggaactattccattactaaatgtgccagcttcagggacacctttttttgtttgtttgtttaaatggagtctcactctgttgcccaggctggagtgcaatggtgcaatctcagctcactgcaatctccacctcctgggttggagtgattatcctgcctcagcctcctgagtagctgggattacaggtgcccaccaccaccacgcccagctaatttttttgtatttttagtacgacggggtttcactatgttgaccaggctggtctcaaactcctgacctcatgatccatctgcctcggcctcccaaagtgctgggattacaagcatgagccaccgaacccggcagggacaacttttggttctccatggcttatgtttcccgtagagttctgctgccatcttcccttagtcctcccacatcctcctcacactgtctgctctcataactcttaagcaagtcagaatgttccttacaatatgctgcttcatgcatcctgactctagctgaatacaaatcctggcagaatcccaactttttctctcctcaagaattgatttagtgtaagagattttgcttcatggatagaggtggatatatatttagtgtaacatattttttactcttgtaattcttgacagcaattagtctctttgaaattaatattgggcttttattttactagggtttacagatgtcttcttaatttaacaaagttttagaacttaaattcccctactctttatttcattgatttttaaagtacactatgaccccaattttctccaagagatagaaagtcaagaacaattaaaaaaaggtaaatgtctcccctatgcagtttcttaattctttttcatagttacttccagatacctgcaatctctttgctgctattctcccatatagaattattttgctagctctggaattgttcacaattatatattaacttaattgtctcggagagacaatttatgacagattattgtcactgattttattagcatggtatctttcatccaatagggacacatcgatgaaagaattgtggaatttgagcacattatggcaaagggcttgcattgaagtatcttaagtagaccatctaacttagaattcaacaactgcctgcagaaccgagatctcttaaatctttgtcatcctaattgtgatacacgagtggtctagaatgatgccagccaaattccaagttcagaaaagccaaaattcggacaaaaatgcacaggataatctattatgtatggttgaagtgttggttcaagaagtctcgaagtacaaattggagatcagaatccatcagttctgctctcccaaaagtaatgaatattcttaactgggacctcagctgaggtgggctggagccaagacacaggacaaccttctggttcactgccaagaccaatgtctgcaggtagttgagtcttttcaccaaggcactagtatgcatgattttttctggaccccttggcagatggttttggtcaaggccaaatgtgactatagccaagcctcttggagaatggggctatttccaggcttgagcctaggtgcataatcagcagatcaaccacttgggtatcagactgcactcaaaataactgtcctaggtcttgggcatcattggtgttgcataatctcctacctgaatcctgaggcttctgcagagaggcttttgtctatggatggattaagaattcttgttgctgtgaggggatgtgattgggttacctcctatcctaccatcttgctaaagttgattttaaatagcacaggctatgctgccaatattttctcttaatgggcatatgttctgaatgaatacatgcccctgaatgaatgccctgaatgacttaggtgacataaaggtactgttctctagttgttctcagttcctgaatgccttatcaaatgtaagtgtcttactctactgactatgtttctactgtttaaaaataaacctttttatgtgaaaagaatcaaaagccaaaaattttatctggaactcaaaaaagaaagcaatagtaaaatagactaatagttttggaaaagtatattgaatttaacaaagaaaatatatttatgtgttcaatgttagtattcctatgagattttcaaaaataattatatgcaatctttaccttgcagattttcaatcctaattccttagtagatgtcatttctgtggaatggtttataaattaataccttgtaagattctcgaacttagctttgtagtacataattgtagatttgactcacatttaccaaaaactgatccttcctcattctgatatcttaatcgataaaacaatgttgcaatcaatataattgcccatgctcaggctaaaacctctagggttgtcatctgaaatgtctttctctttcatatgtgtatttcaataagtcctcaagttctgcctgcttccaaaatattcctcaaattttaacatatcccctatgtctgtagcaacaactctcgtttccatcttcatctcttcctacatgatttcctgtcatgactaattacactgttttcttctgcgactcctaaagggattctcttcacagctcccagacctcagtgttttttccagttgtaaatttgatgacacaacctttttgtttggaaaacatcagtgttttcccaatgcaataagatttaatccaatccctttacaatggccccatttaatctgtcccctgactgtgtttcaagatggtttctcctcctcataccagttcccaatattttgacaactttcaacttatttttgtcctctggacagactgagacttattcgtgtctgggagattttgtatttactcttctctcaggcaaaatgcccttccccaagatttttgcctgtctccttctatggctacagcacagtgtcttcccacgccagactcttatattctatccctacactgtgtttaattttctttacaacatttagcatttgtagaaattatgttattcatatgcaatattttatgatgtggtaagggagatctgagacaataggaactgtattttgcttgttcacaattgtagtatccaacacctagaggaacatctggcagagatggagagagagccttcagatgcctcccatctgatgcacttggattcaggtggaatctttttgcaagtttccctcatatcaccccatcatctttttctctctcttatatctatatcatctgtatctaattctatatttgtagcattcttattttttgttcccttcccttcatttcctcccttcctcccttccttccttctttttctctctctttcattcttctattaattatctataaccattctccagaaattcttaaatgcaaatatttaatcgtagtatgaacttaaatcaataggttaactctttcataagaccttattattttaatatttttttttctaaaatagaaaaaagaaaaaacttgactagaaagggggcatggatgaggacacgctctgaagccctggagctacttcatcgtccagtaaccttcttgggcacgtgggatggtcttagattagaagacaatttatatccattttactctcgagacacttatttactaactgttgatgcaagtctcaggaacgctaatttctcttggcagcttaataaggtgtttttgatttgcatatttagaatttggatgactgtatttgaaattaccattgtatacttatatgactttagaaaaaaatgaaagaaaataaaaaacagaagactataatatagcattacatttgattctattcagttccattcatttctaatttatttgtggaaaaaataaatagaaaaatcaaatatacatgtaatatccaaaccttcgaccattcaattaggtgcataatattaaccacaaacgttgccaaaattttctgaatcgaatagcaacatattcataagccataatcttctcattaacaagtctgctattatgtaatactcagtttctccctaagcattctcttggggttaattattgactaatctgagttttatcttcaagtaccccccaaattctagtaaattaacaataatcagaggatttggcaagaggatggcagcagaaataaataaaaaattaaagtacatagttataatatatcaacagttaccccctggttgcatgtagcatgaatttggtattgtgccaggcagcctctaacgtggcctcacatgattccaacccccagatattccctccattatgccattgttttccatttagtgacctgcttctaatcagtagaacatgacaatgttgaggagatgtcacttccttaatcaggttatagaaaataatatctttcttgatattagactgtttttctcactcttttattgtctttgatgaagtaagctgccatgtgggagaagaccgggtgataggaaaatggcataattcctctgaccagcaggcagtaaggaactgaggccggtaaccaaatggtccctgaagaactaaatcctcctgcctgtcacgtgaactgtgagctagatccttcctcagttaaaacttcagcctcagccctggctgactccttgatttcagcctcatgaaagtccataaactagatacagagagacccacagaaatcagttacagattttggacacacagaaaatgtgagataagaaatgtgtgatgtttaagacactaaggtctgaggtatttttttatacagcaatagataaataatccacctatttacatgcatacatagaaattgcatcctaataaagaggtaagataatatagcccacttatcacagacagttcgacttttcactctgttattttattcctttttgagtccatcagaaatgtctttaacaatagaatttttctcagccactatggagactaatttgaataaatcaatgatcagattttcagttttttcatagtttttatacagttaatttgagcactttttagcactgctcttttggataataatagcttatattactaagccagtgacaaaaatactcacaacgggaggctgaggcaggagaattccttgaaccagggagtaggaggttgcagtgagctgagatcgtgccactgcactccagcctggcaacagagtgagattccgtctcaaaaaacaaacaaacactcacaagataaagtttctgcaggcttcagtaaacacatttatttttctttttggtctaggtttgacattacagttactgtctttataatcttttgtcatcactcattccaatttttattccactttgttttttgtttgacaaagattgttctgaaatttccatctaacagatttttattaaatatctatacacctatatgtattattctgtaatatgtattttatatattaattaaaatataacatcagacccgctgtacccagtaaactcctgcacatccagcaagaaacacccagtgctccttcctcacactatacgacaaggccttaaaggggtccctaagcatttcgttaaagggaatgacctcaagtagttcagcctgtgctcttggtgaagaatattcaactggtaaacatttctttaggagaaccaatgattttttacgagccatagagatatatgatcatcacagatggaatgccatgtaatgtatgcccacatctgctccctgtgaagcaaactgttctgtcattttatgagtcaattttgtttctgaaataggtgaatgataaagatggctggattgcaagagtttgatacaaaatgaagtttaactctattggaaggaaaacaattaagccagtagagatttataatgccacacattgcttatttttatagcttgacttcatcatttcaaatatacagctttaaacataaaagatcaaccaaaacagagaaactgttacaagggtatccaagatcctaaaaaaacataccactctctcctgaattatctaggacattgcttacatctgaaaaatcattttatctttgatgatgtatctctagggtgcctgctttaatgatagtcaactaaggaattcactaattttatattgttattattttaatgcacaattcatttttatcaaaatgattataaattatcaacatatagttgctaatctattgtgttggtttatgaaattatatttaaagtgatgaatggatcattataaaatatgctgctcatagtaataatacttccaagaatatatcaaataaaaagtgtatatcataacagcatcaaggatagtgaaattaataaattagcaaaaagtagtaacaattattgactattttgatgcaaaatccattaaggttgtcaaactggaggaatgcatcttactgatgctaatacttcagtgagaacacatgagttaaatgatggggcaatagagaataaaaataaaatatgaaagatagaaggataaaaggaacagactgacatgtaaatgtgttagggtagaaaagtcaaaagatatttatttaaatatttaacagtttgagattaattaattttaactaattctacagcattgggacaatctcagtggccccagtagattaaaaagtgatacaatctttagaggagtaagtacattggttagctgctaaatatgttaacatttttaatagcagataatttggaaatagtctctaatattaaaatggtccataaatgtgtatattatagaaattttatttctaacacacccaaatatacatgtaaataacatgaaggaaacagttctaagattgtgagtcatatttgaggctgaaactgcaaatgagtataaaaagagatatttttaactgtatgacgctacatataataaacaatgatatcatgattatattttaaggacaatataggtaaagattataacttttatgagttaatgtggctggttcgaactaaaataatcagatattgatttgatacatttgtttcatatccttaaaggaaatgttctcagtattgggataccactcaatattaaaaaaaaatttttttgggggggattaaagggttattatatctgtataatatccatatatatctctttatctcattgttttagttattgatgtgtctcattgatcacacgttaaagaaagttttttggtaacatgtaaatatttcagctaagtaaaaccgtgtttaatcattataaaaaattagtcatgtatcaaagggccatgtgaaaagagaacagtgtgttttaaggaaaagaagcacttttcaaaaggaagagtgtggcatttgatctcagggttctgcagtggatgatgacttcaacaaaacaacaaagcaacataaagaccaaggacctaaaagaccaagagctcatacacagggcatgaggtgcacagaaaacctgataatatagctgctgcatcattttgtgaatatgtctaaaagaaattcccatgtaaatactatattcgtttttgtttcgtttaatagtaacccagtactttgtgaatgatccctgtgggaaacactagtgtctttagtcaagagcattcattgaggaacagactgtttttgataatgttgcaaaaagtcttaaattttttaatctgatactcaattaaatgaaataatagagggtaaatttgccatctaaataagcaagcaaaccctagtctagtactttaatggaaaatgaagaatgtgtagggggagcatatgtgattgcattatttcacaacaatatattctaaaaataatttctatgatgcagatattattctacatagctcatagtggtgctcagtggtggagcagtgtttgaaaatagatatgtctctgaaatctatgctctttatacaccacagtgtataatttacagcatgtgaaataatatgctgagtgtgtcaagataatttattgtataatttgacagctatacttgtcatttctgctcaggttccatgtctaactccttaatgtaaaaaatttgacattcagtaggattaactagattttaatagcacctcctcaaccatagtcaacttaatgaaaagtggcaaggtagacctagctgcctgaaagcaaccattctaatgtaattttatacgtacatttcatagtgtagcagcagccagatgacaacaaatatgttcacttactcactgtgacttctccaatatcatggcattacatacaaattatagtttctctagatatgttacacctttatgtgcttagcacacaaaaatacatgcactcccgtcccccacaaaaacaagattagaaaatgggatgcatctaaaacccaacccgaaatgaatttaatataactcttaaaaattgcaaataaataaaagtaatatgatttttcacaaaaccagaataagacctaaaaccaatttttttcttaacctaaagtgaattaaaaattatttatacatatacctaacgataaattgccaaaaattgaattcagaattaatgtatgctgtcatcaaaacaaataaaaaatacatttctctaagctatgaatgctactagatacattttttaattagaaggcaggtgtattagtctgttctcatgctactgataaagatatacctgagaattggtaatttataaaggaaagaggtttaattgactcacagttccacatggccggaaaggcctcacaatcatggtggaaggtgaatgaggagcaaagtcacgtcttacatggtggcaggcaagagagagactatgcagtcaaactcccctttttaaaaccatcagatctcatgagacttattcactatcacaagaatagcaccagaaagactcgcccccataatttaattacctcccagtgggtcccttctacaacacgtgggaattatgggagctacaattcaaggtaagattcaggtagggatgcagccaaatcatattattccactctggcccctcccagatctcatgttctcatatttcaaaaccaataatgccttcccaacagtcccccaaagtcttaactcacttcaacattaactcaaaagtccacagtccagtctcacctatgataaggcaagtcccttccacctatgagcctgtaaatttaaaagcaagtgagttacttcctagatacaaatggtgggggtacaggcattaggtaaatacaccctttccagatgggataaatgggccaaatttgtgagagagacattttaagtggagttttagcatgcttgaagagtgctatggttgctcttatctataggccagaccttacagtggagactgcagtcaatgaattgtgtaagctgaatgcaatgggtataattggattctgggaaagcagtagtgaagtggtgtcagtcagtcaccaaaggcagggtaggcatgtttatcataaaagtcagcacagtcagagcaacaatgagaatatgggtgtaccttggagatattgtgggtttggttccagaccaccacaataaagcaaatatcacaataaagtgagtcatacacacttttttgtttcccagtgaatataagttatgtttatagttttctgtagtctattccatctgtctacaatagcattatgtctaaaaatgtacacacctcaattaaaaatactttattgctaaaaaaaaatgctaacacttatctgagccatcagtgagtcatatcagcaggtcataagctttttgccattggagagtcttgccttgaggttgatggttgctaaatgatcaaggtggtgattcctgaagattggggtgtctgtagcaatttcttaaaataagacaatgatgaaatttaccacgtcaattgattcttcctttcatgaatgatttctctgtagtatgcaatgttgttagatagcgttttacccacactagaacttctttcaaaattggagtcagtcctctcataacctgctgctgcattatcaatgacatgtatataattgtctaaatcctttgttttcatttcaaccatgttcacagtatcttcaccagtagtaggctgcatctcaagaaaccattttctttattcacttataagaagcaactcctcaaccactaaatattcatcatgagattgcagcaattccatcccatttttaggctccacttctaattctagttttcttgctacttccaccacatctgcagttacttcttccactgtagttatttccagatgcttcctgaactcctcaaagtcatctttgaaggttggaatcaacttcttcaaaactcttactgatgttgctattttgacccactgttatgaatcatgaatgttctcaatggcatctaatatggtaaatcctttccagaaggtttttaattgatgttgtccagatccatcagaggaatatctctttcatacataaccttataaaatgtatttctttaataataaaacttgaaagtcaaaattacttcttggttcatgggctgcaaaatggatgttgtgttagcaggcatgaaactatcattaatcatattctccatcagggcttctgggtaaccaagtgcattgccaatgggcagtaatattatgaaaggaatatatatatatatacaaatatatatatatttatatatatatacatataaatatatatataaatatatatatatatatatatatacatataaatatatatataaatatatatatatttatatatatatacatataaatatatatataaatatatatatatttatatatatatacatataaatatatatatatttatatatatatatttatatgtgtatatatatatatttatatatatatatttatatgtgtatatatatatatatatttgctgggcaataggtctaaaagtggacttaagatatttagtaaactatgctctaaacagatgtgctatcatccaggctttgctgtgtcatttacagagcacaggcagaatagatttagcctaattcttaaggaccccagaattttcagaatggaaaatgaacattggcttgcacttaaagtcaccagctgcattacccctaacgagaggtcagcaagtcctttggaaatttgaaggcagtcattgacattttctctctagcatgaaagtcctagaggacatcttccaatataaggcgtttcatctacattgactattgttttgtgtagtcactttaatcagtgatcttagctagatcctctgaataactcgctgcagcttctccatcagcacttggctgcagcttctccatcagcacttgctgcttcatgttgcacttttatgttacagagatgacttatttccttaaacctcattaattaaattatttcaaactcacttctgtagcatctttatctctctcaggcttcatacatttaaagagaggcagggtctttcttcagactgggctttggcttaaagaaattatgtggctggtttgatcttctatctagaccccctaatacttttccataatagcaacaaggcattttgctttcttatcatttgtgtgttcactgaagtagcacttttaatttccttccagaactttttctttgcattcacaatttagctaaccatggtgcaagagatctagctttgggcatgtcttggcttttgacatgttttcctcattaggcttaataatttctgccttttaatttaaagtgagagacatgtgactcttcctttcagctgaatagttagagacctttgcaaatcatcaatggccctgtttcaatattgttgtgtctcagtgaatagagacccaagggaaaggaaaaagatggtggaatggcaggctggtggagcagtcagagcgcaacatttatcaagtaagtttgcgttttgatatgggtgcagtacagtgttccaaaagaactacaatagtaacatcaaagatcactgactgcagatcaccatgacagatataataacaaaaacatttgaaatattgcaagaattaccaaaatgagacacagaaatattcatgtgagcacacgtcagtgggcacacaatgttagaaaaatggcactaatagacttacgcaatatagggttgtcacaaacctgcaatttttaaaatatgtagtatatgcaaagtacaccaaagcaaagcacagtcaagcaaggtatgcatgcatctctttgaatcttagcaatcacaagaagctgcatgtttgggtggaccaggaagtggttgggtgtgggtaacagaggtgcacagctgctactgtaccagtagcacagatatgataaaagaaaaaaaaaatccaaagttcatcaaactcaaagattgaaagtagataagcccacaaagatgagaaggaatcagcacatgaacagtaaaaactcaaaatgccacagtgccttctttcctccaaaggaccacatcacctctccaaaaaaaaaaaaaaggttttgaaccaggctgacattgaaccctcagccttagcctgactgatacgactgatatgacaggaatataattcataatatgttaagaacggagttcattatgctacaggagtacattattaaatcataacaagccgtcttttggaccacagagcaatcaaattagaaatcaagactaagaaatttgcccaagaccacacaattacatgtaaactgaataacctgctcctaaatgaattttgggaaagtaataaaattaaggcagaaagcaaggagttctttgagactaatgagaccaaagacaacataacagaatctctgggacacagctaaggcagtgttaatggggaaatttatagtagtaaatgtccacatcaaaaagttagaaagatttcaagttcacaacctaacattacaactaaaagaactgcagaaccaagaacaaaaaaatttcgaatctagcagaagacaagaaataaccaatattatagctgagctacaggagtttgagacacacaaaaaacatacaaaagatcaacgaatccaggagctggttctttgaaaaaattaataaaatagactgctaacttgactaatacagaagaaaagagagaagattaaaataaatccaatcagaatcaataagggggatatcaccactgacacaacagaaatataacaaccatcagagaatataatgaacacctctatgtgcgtaaactagaaaatccagaagaaatggataaattcctggacacatattgttccaagactgaaccaagaagcagttgaattcctgaacagaccactagtgagctctgaaattgaggcagtaataaacagccaatcaaacaaaaaaaaagcacagaaccagacagattgacagctgatttctacctgatgtacgaagaacagctggtactattcctcctgaaactattccaaatagttgaggaggagggactcctccctaactcattctatgaggccagcatcatcctaattccaaaacctgacagagagacaagaaaagaaaaaaatcaggccatgcaaaaatccccaacaaaataatggccaattgaatccagcagcacatcaaaaagcttatctaggatgatcaagtagcctttatccgtgggattcaaggttggagaatgaccagattattgtaagcttaaccagatgtgtcttaattgcagctgctgtaccagatgtggtttctttgcttgaacaaattaacttatcctctcatacctgatgtgcaactcttgctctgaaaaatgtttttatttcaatacctgtttgtaaagaccacattagtagtttgctttaatctggcaatactccttcaccatcttacctcaaggataagttggcacattagccttgtgtcataattcagttcacatggatcttgattttctttcccttccatgagattatcacatttgtctgtcaccttaataacattatgctgttagatctagtaagcaataaatagcaattactccagagtaattggaagacatttatatgtcagaaggtgggaaataaatatgacaaaatttgaggggcttctacctctgtgaaatttccagagtttcagtgtggcgtgcagtcatgtcaagataccccttttaaggtgcagagtaagttgttgtatcttgctcattctacacctaaaaagaggcacaatacctagcaggcctctggatttcacatgcaacacattcatcatgtgggtgtgttattctggtccatttactaagcaacctaaaaaactgctaattttgagtgggtcccagaacaagagaaggctctgcaacagatctagactgctaagcaaactactctgcagctttagctatgtgattcatgcgatccagtggtgcctgaagtatcagtggctgataagggtactgtctgaatactttgccaggcctctacagatgaatcacagttagtcccttaggattttggagcaaaggtctgccattctcctcatataactattcctctactaagaaacagctttatacctgctacttagtagagactgaaaatttaaccatgggcaccaaattaatgtcatcacatgacctgagcatctcattatgaactggatattatctaagccataaagttgggtgtgcacagcagcacaacacttaatcatcaacagaagtggtatatatctgataaggcccatgcgtaccctaaaaatacaagtaagttgcatgaaaaagtgtcccaagtctccatggtccccactcctgctacattaccatagtttcatggagtttttgctatgatcacctgtcagaagaagagaagattaaggcctggtttatacatagctttgcatatatgtaggtaccactcagaagcaggcagcttatcacatttgtctattactttaataacattatgctgttagatctagtgagcaataaatagcaattactccagttattggaagacattagtatgtcagaaggtgggaagtaaatatgacaaaaatttaaggcccactgtttttgagtgatgcctacatatactcaaaactatgtctctatgagcgctgtagcctcttactgagacatccctggaggacagtggtgtggagaaattctcctagaaggcagaaatttgtgcagtgcatctggttgttcactctacttggaaggagcaatgaccacatgttgactacatactgattcatggactctagccagtggtttgggtggacggccagggacttggaaggaacataaatggaaaattaatgacaaggaaatttgtgaaagaattatgtgaattgacttatcttaatagacgaaaaaccctgaacatatttttgatcaacatgcatgctcaacaaaaggtgtcctcagcagaggaggattataatgaagtagataggatgacccccatcctgtggataccagtcaacctacttcacaagtcacccttgtcattacccaataggctcatgaacaaagtggccatggtagcagggatagaggttatgcatgggctcagcaacatggacttcaattcaccaaaggccacgtgggtatggtcacactgctgggtgtccaatctgccagcagcagaaaccgatgctgagtgtccaacatgcccaatatgacatcattccctggggtaatcagccagctacttgttgataggttgattaccatttgaccacttcagttatggaagggaagatattttgttcttattgaaatagccacatactttggatatggatttgccttcccagaaaacagtgcttctgccatgccaaagctactatctgtggacttattgaatgccttatccaccatcgtattccatgtagcaatgcttctaatccacaaagttacttcaaagcaaaggaagtgtggcagtgagcttataatcattgaactcaatgttcttaccatgctccccaccatcctgaaggagctggcttgataagtcagtggaacaggcttttgaagactcaagtacagaggtatctagttgtaaataccttgcagggctggggcaagattttctatttggctgtatgtgctctgaattagcatccgatatacagtgatatacagtgctatttctcctgtagccaggattcatgggtccagaactcaagggttaaaatgggagtggcaccattcgccattacccttagtgactcactagcaagtttttgcttcacattctcatgaccttctgctatgctgacctagagatctgagtttcacagggagaaatgcctccacaaagactgacagcagtgattccattaaactggaagttaagactgccacctgaataccttagactcttcatagctctgaaacatctggtaatgaagagagttactgcactagttggcttaatgctggctaccaaggggaaattaaacagctactgtacagtcaaaactcctgtacaaaggaagagtatatttagaatacaggagatcatcccttatggtgtcttaatgttaccatgctctgtgacttaaggtcaatggaaacctataataatgcaatataggcagaactactaatggcccagaccctttagaaatgaagttttaggttactcaaacaattaaagaatcatcaccagctttggtacttgcttaggaaaaagggtgtatggaatgagtagtgaaagaagggttgttataaataccaaatatgattgtgaggccaattacagaaataagtgctgtaataggcatgagaatttcctacttatttgttatggatgtgtgtgtgtgtgtgtgtgtgtgtgtgtgtgtgaatttatatatcaagtatctttgtcctcttttatttccttgatatgtatcataaaatatattgactttatataatggtatttaaatattttaaattttacatcgtatagtctttaagttatgggttatcaaggaaaagagtcaaggccactcaagaattttcaatccccttctgtggaaggggttagtgcacttattattgtatgcaggatagttccttgattttaggcagacctgtgaccttgttattgtctttatttgaagattaagtgtgatttaaacagatatggatgtgttaccagtggaaggcatccaagttatgggagacaaatccctatgggtctacagcaacctcaattcttgcgtcctctaaagaaagaattcaactgaggggcataaggcagaaaaagagaccaaggcaagtttcagagcaggcgtggaagtttattaaaaagctttagcacagtaagaaaagaaaggaaaggaaagaaaggagaaagtaggcttggaagaaggccaggtggactgcttgagaaaccaaatgcaccatttaaccttgattctaggactttatagtatgtccccttcaggcatcttaccccccttttccatgtttcttcctttagggtgggctgcccacatgtgtagtgccctccctacccttgggaagtgagcatgtgtggtgtgtttaggaagttgtgtatacgcccatctgaggctttctttccttttccagtggagtgcctctggaaatgatactctgccatttttgtctcttaatgtgcatgcgcaggaattttcttctccctggcatctgcattcaattaacactttagtgttaatagctgtggaccattacaaattggtttctccttggcacaagctgccaatttatcccttttagaaaggtaatatgatcattgccaaccatcacctgacatttctggtgggtgggggagagccctctcctgccctgctcatgcctgtctacctgtaacagatgggtgccaagtggacaaggggtaggcttgcaatggttaattttatgtgtcaacttgattgggcagtaaggtactcacatatttggttaaactttattccatatgtgtctgaaagggtgtttctggatgagatacacatttgaaccagtagactctaaagcagtttgcccttcccagtgtggttgggcctcatccaattcacagaagacctaaactgaacaaaagtaagagagattagttttctctacctgatggtctttaatctgatacaatggtttttttcatgccttttgacttggacatagactggaattctaccattgtctctcctgggtcttcagtttgcctactatagatcttgggatttctcagcatccatgaccatgtaagccaaatccttatagtaaatctctctctctgtaggaaatatatacattttctattggttctattctctggaaaacccagactaatacaattgggaaataagaaacagcggaacaaggcactggggaaaatagtgtagttctgtcttaaatgggccaatgtttttttcaagtttgatagaaagatattttcagacatccaagaagtcagaaaatttataagccaaatacatttcattttttcttttctgcaagtctttagaagtaagtaaaacctgaacattatttttgttcaacatttattaaatgttagtctatattctgtggcatattcaagattccctgttggctttaggtttattggcctgacttgttctgaattcatggatgttctctgctttctcccttcctgtgtttcaactcctcaatacccagtgggacactaggtgtcaggagaggaaacttcagcatgattataacacactggactggttcctagtgcacaaggcaaccatcacaatccccatgctccatgttagtcctgatgaacacacactccagcaggctcatcggaactcctttattccctcttgagtgcccaaggaatacaacaccaatgaaggacaaaaccccaaatttatactttcactgtggttaattctaggctcaagagagtgtcttggattaggaattacctgaacatgtggtactcatccaattttcttggagtcactgaactttggtttgtccctctatgaatctgggctaaacatgcccgctctgcctatctcaggaagttcttttcacaattattgaattcacaagtgagactgtcctttgtaaggagctctaaaagttaaagatttcttttatctgatgaaacatttgtcaatcaaaaaatctaaaaaaatttagtggactctgattcctacgtttagaccttttcaatataatgctatgaataaactgaggttaatataaaataaaattacagtgtaaacttataaaataatctgatataaaattgcagataaggatacaaaagtgagaaatgaagcttgagataaagtacattaaaggtcctctattttggagagaggctgttatttggggagtactgatactgtcgcaagtgtatatgttaatactagttaccttagttaaaaatttgatctggtagattcacaaaaaaattggattttcttgtcattagggtacagaaaatagaataatacatatttgtcagtataaaataatatattaataatgaaacaattttttaaaattgagaattgcaggaaatagaaacatctattgttcctccagctcactatgtcaccttctctctctgccttcctaagtaaccagggccaaatggtttgggcataagttttatcaaatctttgagaacataaatcctaatgctatttatatttagagactgtttcagatcatagaaatagatatatgagactgaattgatgttacacagctgaataaatgatagaagcctagacacagataaggaaataaaatctgtgatcagtttcacctgtgaaaatgttcacgcaggtccaggtaacttattagcatactaaatgtgacatttccactacaaatgctatccaatgcatcattttgtctaatagcaaatattagtgataagtcagatattcttaagagggaaataattaactaaaataaaaacatctcatagttacttttaagaaagatatatttgcgcatgtctagaacatgttttgttctagacagaaaaaaatcatggtacaaagcagtatatatgacattatcctctttctgataaacatagctgtgcacacgtttgtgtattatgcatctgtgttaaaaaaaattctaaaaataggccatatgtgatggttaatcagtgaatcaggaatgcatatttctttgaaattatttgaatttctcagaagtatgtatacatttttattgttgaatttataatttttccttaagactatcagagtagttatggattatagaaatagtatcaacattacagtttcctttctttggagtaaatttaaatgcttaaaaaattttaagcctatttatatgaaaatctctctgagggtataacattatttctcaccctgtgtaatctaagttctcattgataatgtttcagactctggtccaagagctatagttgcttaatgttaatgtccaacatcttcatgggtgtattaatatcaccattaaaaaatgagctaaagcgttttgctaaaattttaccaacaataaatagtgaagccaaggtttgttccaagaacactatgatttcacagcctatgttctcaaccatgatattaatttaataaacctaaaataaatatacctaaaataaataatttaaacctaaaattaaaatatatagtatttgatgaacatcttacattttaacattttcttaataattatctaaatatttaaacagcctaattgatatacttggggaagtcttaatatgcgtgaaatgattatagtgaccttcacagaattatgtcataaatattaaaagaagaaattccctttagcattttacttagcacacaatatattttgtttacttcatgagatccttggaaagccttttgctgagattttgctacagtttgtgctttgacttcaaaatttaaaatgttgttaaccaagatccaaggtttcctgaagaacaaaattgctctgaacatcacacataaactttgtaatatactgtgcttcatttcacctaagaccttagatttcctagtagctgttaatcctctttgcttgatagagaaaagacttttgtagataatacagccatacctttactttgccctagagtggtttggttgtaatctagagattattgattatctttcctcttctatatcctctatttcctcacagggcctagaatataaaatggaaggaacattccctgaatgtaaggttggcacaaaagagaagttcctgttgaataggaaactaggtaacagcaacatgttttatctaaaaataaatagttgtgatgagtaattatacgatttcaattattacccccaaataaacatgagttgtaaaattttgcatgggcaaatatttttggcaacaaattaacaatgggtagtcaaatgataaagagttgtaacatctttttgagttctttgcaacacgcccagctttgcctacccagccacaaatctgggtgcttgaggatcatgtgcaccttcttcctgctctgttcataagccagcattagtaaatcttatctaagcaaacaaattaaaagtcttaccttgatatttttattacatttttcatgaaatgaatgaaccttaagtgttaggggctctcacatgtacagattctttcccttgttagcagtggcctagcctatgtgttttgacagtcatatgtttctacaactttgcaaaaataaaataatttaccacattgaatgaatgccagtgacttgttccatgcaactttcttcactgtactttccctcataccagatacctttggagtggccacgtgtatttgctgatatccaggcaggagaaagtgagtcagagatacagcctgtagtttggatttcataggatgtagtgatgtgcttcacagtcatttccacatgtagttaagttgtttctagctgttccagtgtagaaatgactactgggaaacctaccaccttccactgtcaactcacttagtattgtgacagaaagaggcaagagcataggttgctttcaaacttgaatgtgtcctaaggtgtgcataactggaaacttgtgggtggtgggggagacgaaaggacttgaatacatggagctgaaaactagtctgtggaaaattcctccaaacttcatttaggtacaattgtacatggagaattctgttgtcattcacaacaagtcaaaacagaagttacttcccaaaagcatatactaagtaatgtgcatatacagttattaatgtgccataaatacaggatttctaagaatctctgtgtttctttggtacaaatctgtaacagtactataaacagtaacggaggccttaggcatagccactgtcaataataataaaaaattaggtgacactaaggaaaagattgaatattctgtacccatttcatggaaaatattataacattattatatgaagctttcattttctaaatatgaaaacattgaaatgtcctcactttttcattttttttttgaaattattccactttaatgtgaacactctgtcccatcttcagctccatatattctcttgtccttgccaggttgaattttttcctaagtgaagggggggtatagataaatggcttaagccaatctaatggaatgttacaatgggtctctctcttgtttctcatttacattggagcagtgacaataggtgtcaactcctcccaattccagaattagaggctaaagcattataaatgttacagactttctataaataaatttgtgacacttactaattgtattagtaatccttctccagagaaatagaactaataagatctatctatctatctatctatctatctatctatctatctatcttccatcctccctccctcccaaaaccaagtaggagatttatatgtatacaaaatgagatataaaatgaagaattagctcacacaattatgacggctgacaagtcccaggataaggtgtctgcaagctggagacccagaaagccagtggtataattcagtgcaagtgtgagggcctaagagccagaggagtcaatggtgtaaatcccagtccaagggcctgagaagatgaaatgagatgtcccagcccaaatagtcatgcaggaaggaaaaaagaggtgaatgctgtcttcctctgcctttcgttctattcagacccttgacagattggatgatgcccactcacactggggagggccatctgctttactgagacctccaattcaaatgttaattgcatcctgaaacatgcttgcagtcacacccagaaataatatttcatatggacaccctatggctagtcaagttggcatgtaaaattaactgtcacactaattaaccatttttagacaatgcaagtaaaggtagggattcagccatcaagggcagaaattaagaagaaatgcctttggtgaatgctattggagtattacagcacttttccaatgtagcttctgagagggtaggaagggaattcttagcccttccctctattaaagctagagagtttttaagggctaacaaagacataataaatatgtcctaaaaagcttagaaagaaccaatttctgttgtaacccatactgagaaaattttaaagggaaagactgtggctgtcgctctctctttggtggaaagtaaaaagagtgggatatattggaaggcagagcactgcccctgaaggcacaacagtgtgcatagttccttgcagttcactgtgggtcacatagggaagaagccatcatgtgtgtggttgtaaaagatatatcatccaaaagattgtccttccagggatgaaatgacattaacagaaaaaagctgttgctgttttgttggacgaaattcaacctcatatgcagcttgtcatagagaaagcactctctgagacaaagaagctacaacagaggttaacagaggggacatctacaaggagtccataaaatgctccctaaagaagaccaacatgagcacaaatgacagatcatgactgttcgtgacaagaaaagtctgtgctgtgctgcctatgacttttccctacccctactcctgcaccttacaggatccaaggctgcaggtctcctaaattcaacttagaataaaagaaagagatccctaatacatccttctgattccagcccaatgtaggtttttcagcctactgcctcccgcagctaacaaagttaaaagtctttactgcaaaaaaaaaaaaaaaaaaaaaaaaattcaaaatcagatttaaatggactggagcctcattgttacagacataaactaaaagatatcaagagggctggatcagaaatttggaagcaaagtgttttgtctagcaatagtcactaaagtcaaggaacccatagatggaacaaagaaccttattgctcttatcacctttctccctatctcctggtcaaaaaataaataaataaacattggagtattacaaaagacaaattgtttatatcaacattagcccgttggacctcaagaacatttgggaagaagatatagtacagaactaaaggggtgcaataaaggaagagaagatggtagaacaaatatgcgttgctcattagaatctggtggaggaatttaagtaaatgaactcattttcgtaggacacattcagaataagagatgaagccctcagctggactgctcagatgcatacttcttagttccccttgtcatcctctggatccccaacatcctttctcttattttagagagagtgatcctgtctaaaatagctgtttttgacacttggacctttttgttctagtattcacagagcttttttaaatattagaacagcataactttatttgaagaattaatgtcagaggtaaaaagaaattcatgtttcacaggaatggctgtcactgaatgtatagcagaagttggtgtataaatacaccagctcccccaccccttgagcgggataactctgtggcccaggctctatattagatcccagagtctcccagtggatccaactccttttgataattatgctaaatggctggataatgtacttgtttttttggctgccttccatcacctatctcttgtccttactcctgtatattattttctgagataacacttcaaaaagatctatgttgcttaaatgccaaggtatacagggatctaaaactaagaatctgatttggactaagtcccttttaagtattattgccagaaagtaacattattctattaatatatatatactttatatatttacatatatgtgtctatataaacatatatttgtatgtatacacctagagttcacgtggctagagattagctgtagaccatgttccttgcagaaaactttctatctgtaggagattaattcaaatttatatgtgttcttttgtaaacaaaaataaagcctgccatgacgagtgactatacaacagtcagctcctctaccatcagagggtaaacaatgacttccctgcttcttcattccatccagatatgtcacttgattggaatgagttatttctaagagccacagcaaatgtgcaatttaacaagggtcatctgatcaccaaaaaatcaggctgcattttcccatagaaatgctatagaagaaatgaaagtgactactagagactgttggggaaattttgttttaagacagactcaaattcagttcaagaaaagagcaggagcatctgattccatggtaaatactcaccttagaaaagtagggtatagttaatgtaattaccaatttgtcgttggcatctcctcaactgtttactccaatctggacaataacaaagcaacatgcagtgtcatggtatgattgacctaccatattttccccctgacttaagtttggggtggggtggggggcacaaaatggaaaattatctcaatagtttaggggaagaagaatttaagatggaccaaagttttcttgtttctacctggattttggggttactagcctatgggttaattgctacaatcctaccagtaccttcaataggagtaactaggagctgttgaggctggggcgagtatttcatactctgttcagcagtcgataagagtttacttgtataacgcacttgcacatgtaaccctgagcttaaaataataaaaagaaaaaagagtttgaggtcaggtatggtggttcatacatgaaatcccagcactttgggaggccgaggtgggcagatcacctgaagtcaggagttcgagactagcctggccaacatagtgaaaccccaactctactaaaaaaatacaaaaattagccaggcgtggtggtgtgtgcctgtaatctcagctactcgggagactgaggcagggagaatcacttgaactcaggaggaggaggttgcagtgagccgagatcactccattttactcgaggctgggtgacagagtgatactttgtctcagaaaagaagaaagaaagaaagaaagagtttgaaaacaactgccctatgctcctggaagacagacaaggattgtcaaagtaacctacaggagacaattaagaaactggtcaattgattccagcaatgtagaaaaaatattattgcaatgggaattaagagccaccagggttgtaaagtgagttacttgataacagcaaggcatgttaatgcacatattctcttctaacgactacaagatacagttaagctttactagctcatcaggccaccatggccctctaacttaactccaaagcaaggataatcactgagacaaaagtgactaatgaagatgtcaggaaatatgcacatatatgtgtacatgtatatgtgtgtatgtgtgtgtgtgcgtgcgtattttcatcccaaaaccacccaacacaaatgctatggctgttggtactgctaaaaaaacaaaacaaatagtcaagcttctttacagccagaaaggccagttcattgcaaagggcgaagggcatatgtccatagagccagtggctttatccaaccctgctgcttagtgagagacttgcccctagccaaaaccatgaagaggctgcttatttcttaggctaaaacattctgattatatacagctggcagtaagatgatgtatatttcagtagagcttcataattttgctcactttccgtatggaaaatgaagagaaaataaatatttggcatttacaactacaaatcagatcatgtaagtttgttgtatgtgctacaaggatcaatccattaacagcttatgaaatcaattttatgcttaatcatcagcattttcttacttagattaaaaaattaaatatacttttctgaaactttattaattttctatatgtgtatgtttgtgtatgtacagtctgagacaaaagtgggtagcactcaaaaattgttgtaagctgttgatctcagctgcttaaataccaaaaattttaaaggaatttctttaagtagcattttatttttcttcaatatctgtaattatagtataaatattttcttatcacaggcctagcccgtgaaacaatgataaaagtcactgaagcctgttaactccaattgaatcaggggtcagagaatagagtgtgtaagaaaaatgtgaataaattcacaagagtgggaaaagactgaggcatttattaccttacctgtttggggaaaattaagtgaaaagctacaatacacttcaaatttagttctttagtaccacttattttcacctgaggaaactggaagcattttaattgataatttgtttcttctctagatattagctgactctcatgaagtaataatcttttgctgcttctaagaatgtttaagattggtttcagtactgtaagtctcaagatcacacactgattcataaattcattagaggcgtgtattacattgagatgtcttgaaaatactgagtagtcaagaggaaaaataacattgaggcaaaactccaggttagataccgttgtattatgagatctccaaatggtagcaataacagaccgtctaactgtaggatattttctcaagtttgtaaatcgcttgatagtacggtatatttttctttgcttaattaattgattcaatgaatatttattgagaacctacatgatgccaggcatgtatccctagatactataaaatctagggattcaggcataagcaagcatcattcccactctgacggtactcttggacttaggaatgcagatatgaaaacatgtactttcaatgttgtgtactgtgcacacgagcaatgaacagaaatggccaaattttggtcactacagaagagtggtcaggaaagaaacaaaacaaaacatatagtttatgtgactagggcaaatagtaaaattgttaacaaggaaagagagagacaaaggaaaatcagtggttgatgatattggaagaaaggtttgaatcaaatcatataggatactgactactgtcttaatacatttggacttcttccagaagaaactggggagcagttaatagcttgaaacagagaaattatttaatcaaatttcaattcagaaagtctacttgggctataatctgaagaatggagtaaggagggtaatacttagcattagggaaatctgttgatatgccgttgtagaaatttcagtgtgaaattatcaactatgacataggcaatggtaatgaaaaaaattgttgaataattccatatattataaggtgagtatatggaccaatattcataactttgatgttagcaaggagagttttttttaaaaaaagtctaatgattttagcttggatgactgacaatgatgtctcatttataattaagattgcagaaaaataaaataggtagtgtatttctaggttaaaaaaaaagcttaacttttcgagtcagtggtggggatgtccagtaatcagtttgcaatatgagcacaggatgacaagaatatacgtttagaaatgaagcaatgaggattattgatatttaaagaattagtggaagaagagttcaagctaggaaatgtcaaaagtggttagagaattgtgaatgaaaaatcagaaaagaataacagcatgaacgtcaattccatatactgttattccccaaactgcgggattttaaaaaatccctgataaccccaggatgtaaaacagcagttcttaagaaatatacacagaaaaaatacaagaactaacctggaactcttttatccttaaatgtatgcataggcaggaaatgaatcctggagaagagttgtattatcagttactgatgaatgtggcggggagaattagcatcagggaagcctaacatttgatgttaatttttccaatgcacttttgcatatgcatatctgtaaatgtgttattaataatttaatgtttgttttatttatgcaatttttatgttttatacatacaagttaatttttatgtttttatatttgttccagttggcaaactatgtgccgtatccagctttaacaatattccaggcagctcaacatagggaggttggccagcttcatagttgcttggaggcctacttttattccaatgtgccccacactttggagcattccaataatcattctctgttttcaacatttttaaacaattcagttatgaattttatcagagtaaacaagtgtgaaatgaattttctatcacagtttaggaattccaagagagtgcatagatcagtagcattgaaaggcattggtgcttcatgctaaactgcttctttttatttaagtagacaaattcctttgagcactattttgaaatcccaaggaaagcagtagctataattttggagcaatatatctccccttctctaagtacatttctctcttataatagtctgggctatttaaaatcattccctgtattttatgattataattagctattatatcatttctatttatataaatagaagaccataattatattcatcaaacaatgaacactgttaaattcagtactaattttgaaaagtttttaattgtttaatgtttgtaataccttatttggataattgatttaaagatatgtcatattacttcattaatttttaaaatattgaaacatgaaaaattaaatataacaagcgggtaaatatctgtgaatatttttcattctgtcaaattgcagattaggtccattcttgaagaatacaaaagtggcctacacctttcaatgctaacatttaacaagattatcaaatcgcatattctcataactcacaccctgattattttacacatatacactcacatttaacatcataactattatttgttgattcagtggatttgaattcaaatagtttgtgtgaagaaaactacaaaaacaccagattttgttttttttcctccttttgtttattcaaagacacttgaaataagttttgggcctttgatataagaaatcattctttaaaacaaagctttgtgtaaatttttatttttaattgacaagcaataattggctacatttatcggatacaatgtgatgttttgttatatatatgtatacattgtgtaattatcatatcaacctaattcacttatccatcaccttacatacttgccatttttttcccagtgagaacattcaaatttgattttttgaatagttttgaaaataaatttcaaattgtaaagaattatacaagaggaataattctttttaaggtcatagtgaggatgggttgatttgttaccagataattgcttgaggtggcccagccagactatttttccctctgcttggctgaggcattataaaatgtatgatgataataaatagaactgaaggtaaatgcccagttgttttctgtcattgtacaatataggcctcttccccatggtgcagtatttcctttggtctctggaagacaaagagaattgctgcaaaactctgcagaaagacagcaattttttttaattttttaattttttaatttttattttttaccagtccaattaaactgctacttcctggcaggaaaaacactgtgtcgcgaaaaatccaatagttttaaggcgtaccttctgccaaaggattctgtagatgaagcttgaatacactctgatgtgtttcctcagctctcatgtagcaacatacagctattccctgagtatttgctactttttaattgcttcttgcccatttatatcttgttcctaaaataagattttcaaactcaaggaagatcgcaaagtcttattttctctctgctgtaattatagatgaaaatctcctcatgatacaggtttatgatgtggacagtggttgtgttgttggtcaattgaaattttaaacttgtgtggcttaaatgttcagcagttaaagctattttatttccctaatattttcttttcaatggcgaatgtgtaagaatactgaacataatctttcctaacttcccaaaatgaaaaccaacacaccataatacaaaagtaagagaaatctgaggagggattaggaaagaaagcttaaataattacttaaaaaaccatgttcagtttaaggaaaccagcatattttcccattctgttcaccaacagtttcctcatgaaagataatgactaaaaaagaaattcaagtggcatgaaagatgaaaaggctatctaacacctcagaaaccagagcttgacataaagctggaaagctatgtcttgtgtaacttattttttgaggtgtctcaagtagtgatatttttgttgcccaaacactgtctttgcagaactaccagaaaataatgaacaagaaagttgtgtatacttacatgccatctgacgactggggtggatatacgtggcattttttttgcttcatgggagaaataatcccaacaaaaaagcgtctgttgttagggtggggagaagaaacctggtaacagtgtgtaccaggaatcattgctttttatgtgattttaaaaattagagtatcagcaaattaggagcatgttacaggcagaacttttttctcccacataacttgtatgctgaagccctaatccccaatgtgactgtatttagagattggactttagggaagtaattaagatcaaattcagttgtaagagtgtaccaatgtctttaaaagaagaggaagaggcattagagatctctgtgtgtgtgtgcatgcacagagacgaggccacgggaggtcacgatgagaaggcaggcatctacaagtcaggaagaaagcttaaccagaaaacaactttaatggcaccctgagggccgtctggtctccagaactgtgagaaaataaatttctgctccttaagccacccagtctgtggtattttattatggtagatagaacaaacagagaggataaggaaatatatttcctttttaaagaagaacaacatggtttgagaacctgccacctactgagaattagctgtgcactgaatcccaggtgtagatcaatgacacttacttaaagatttcaatataagatggaaaatagggaaaaggaagcccaccaaagtgcgcaatgccaagcacagaatttggctcatcttatttaagaggaaaaaagaaaccataagattgataaaaaagctatttataaaaatatgttaatattacatgaacttcacagaatgtacctcttcaaataagtgctgcagcattcagaaaaaaaatgttagaaatacctatggaattcttaatacaatgttgaaaaatatagtgcctctgggaaaacagagaggaacaatgaagatatacataaaaataatcagataaaatgagaaagaaatttagatacatttaacatgtgatgccagaaataaagtcaacaaattgatgtacttgatgttctaaaaaactgaaccagtgttacacaaaacaagttcaggaagttattccagagggtagagataaaagaaaaatacataaatagaatgaaagtgaaaataataactataaaagacaaagtacagaaaaagatagggtataaataaatgaaataattatcttttaacttaagaatatgttatagaccagcctgggcaacatggcaaaacccatctctaccaaaaaaaaaaaaaaattacaaaaattagccggcatggtggcatgcacctgtagttctagctacttgggaggttgaggtgggaggatcacttgagcctgggaggcagaggttgcagtgagtcaagatcacaccactgcactccagcctgggcaatagtgcaagacggtgtctcaaagaaaaaaaaaaggttattaaatgatgggaaactaacagaatggctaagccattacaaaaaggtgttttgtctttactgtaatatgaaccagataaattcaatgacaataaacatataatgaagattattgctataattccaattatagaactcagagacatctatttctgagaacatagactaagtgtattttaaaattattcctgctaaaaacaattaaaaaccatggaccttatgcataaaagaagcataagaaacctgtgatacatagagaaaagagggcagactgactggacatcttggcttttcttttgcctcatatattggaggaaccaacaactcaaaacagcaacaggttcagacgaaacaaaagcaaacaactccaagaaaagcgtctcctctttctatccaaaagaccagaaaagataaaatctaggagaatgaaaaacttttaggcaataagcactctagccatacagaaaaaatggtgaccctattctcatctctaccagaaaagattgaatggggaggctagacttctactcttaccaagctgtaatgaggtgccgcaactcctctatcaaagaggcatcagagaaagtgaagttggggtggagattttcatgcctgccaggtggtacagacccttcactcccactctgtagtgttagtggagaccatctgggaatgctgggcttgtacatcgagctagtgataatgaggcatctcttcaccttgagctggggtagtgtcagaggaaacttagtgaaaagttaggcttcccaccacagctcaactgtaacaaagccaccttctcccaccaagttggtggaggccaggtggagacagtaatgagtcaccccttctcctcacagcaaggtggtgtctgccaaggtggaatttatagccacttaactgtaaccacccctcacccctatccccaaggtgttgatagaggccaattgtatccccatcacttagcagtaatgtctaatgttgtattaaggtgttgctaggcccttgcttccaatgatactctgggtagaatctttccttgcctcttctttgctgggtggtggctgttaaaacttgatgttccttggcttgcagcagcactacttcatgacaatttctcattagaaatggatcagaagaaggtgggctgagcacagtagtgtgtgcctataatcccagctaccccagagagtgaggcaggaggatagcttgaggccaggaggtgaaggccagttctggctagagccccatttcaaaaaaataaataaataaataaaacacaagaaaaagggagagaaaaaatgagaaagaggttggaagaaagtggctgaaagaaaaaataagaaaggttggaagaaagtggctgaaagcaaagaactctcaacccattttctgaatgtagaattctatattcagaaaatattcttcaagaataagggaaaatggtggcatattgtgataaaaactaagagaatttgtcacgatgagggatattataaatgaacagctaaagaaagttccttaaacagaaatgaaaatgataaattatggaatcctggaacatcagaaaataataaaaattaaagaaacaataaaatacaataagaactacaatagaagtaaatacagtagaatttccttgtcatgttttctaaattatgtttaatggttgaagcaaaaattgaaacattgtataatgtggttttcaatttgtatagagaaaatacttaagacaattataaatgagagagggtgaaaaaaggtaaggttctatacacatcttgaaccagtaaaatgtcgacacatgtagactttgcaaagttatgtgtttataacctaatgcgtagagcaaccagttaaaaaaatctaaacaaaaagatagactgaaaaatactgtagttaatcagactagaaatttaaaatatatttacgcaacctgtaggaaacagggaaatgaaaacagaacaattaaaaaattaaaacagaaaataaaacacacttaaaccatagcatatcaatagttatattgaatgcaattgatctaaatatgcacagtaaaacacagaaaattacaagtggacctaaaaaatgacccaaacatatattgtctataagaaactcacttcatatataatgatacttatatttgttcattttcatgctgctgataaagatacccaaaactggaaagaaaaagaggtttaatggacttacagttccacatggctggggaggcctcacaatcatagcagaaggcaaggaggagcaagtcacatcttacatggatggcagcaagcaaagagagcttgtgcagggaaactcccctttttaaaaccatcagatctcatgggacccatttgctaccatgagagcagcacaggcaagacctgcccccacgattcaaccacctcccactgggtccctccccctcccacaacatgtgggaattcaagatgagatttgggtggggacacagccaaaccacatcaacacttgtaggttgacagtttaaaagcaaataaacaaacacacatcaaaacagctaacaaaagtgacaatatcaatcattggcaaagtgcagagatactgaatcttttatttattgcaggagggatgtaaaattgtacaactactctgaataatagtatagccatttcttttaaaaactaaattatgtacttaccatgcaacacatcagttcaactcctggatatttatccaaaagaaagaaaaacctatgaccacaagaaaacctgtacataattgctcaaagcatcttcatttgtaataggcaagaactgaaaacaaccaaaatgtccttcaatatgtaaatggttaaataaactgtgttgtatttgtagcatagaatattacccagcaatgaaaaggaatagattattaatacatacaacaacttggatgaaactcaaaggcattagaatgagtgaaagaaaatttcaaacagtctcctaccatataatagtaatcatataacattcatgaaatgacaaggtcatagaaatggagaacaaattagtggttggcagtgattaaggataactgggaggggagtgagtgtgagtttaaagcaattctcaaggaacatctttgtgatgatataattatgtgtatcttaattacagtaggtggacacagggatgctttcatgtgacaaataaaacagctatatgcacacattatgccaaaagaaaaaaagccaaaaccttaagtactatggcgtattttttctttaagcacaacttcattgttttggtaggactacatttcattgtaactgttcaaaacttagcatctcagctgaattttctaacatggtataaaaataaaaaaatataaaaaccttaaagaaacctgaatgtgaatataaaagaggacaaacttattctagagagagatgatatatgatgttagtttagcaatttaaattcctaaacaatttaaagctgggtttaaaatttccagcttatactaaggaagatatatacatggacctatatgtgcaaatacatacatatctacaggagacagactgtttaagttagccttatttttttcattgttctttaagtgtcctaattgacttcaatacatattaattactattgaaatttaaataaaataaaaagggaagaatatttctgcttttgaaaaattatacattattcaataaagtagatattttataatactttgacaggttttattgtttgtgtatcacaaaacatgtaaatgtgtaaataataggaaattattaggttctaaatattaaatatagttaaaagttatataattttgcagtgtatattcagtttgaggcaaatgtttttaaatgaatactaacattactagtcatttacttggttattttgagcaagggaaaagcaggtcattgttataagttaacagctcatagttgaaattatgtactgggggactaagcttcattattattcaaatgaaattatataaaacacaaagaagttaagtaacattgttttcttcctaagaacttaaaaactacatagcagaaaggtatcttatgaattcatcctcctcacttaaagtgcaatcacgatcacaatcttctctgagtctacgttaacttttgtgataaaatattgcaaagaggttatgccatcttttatcagcttctgaaataatgccattaaacattgtctttatagtttacttttctttggcaatataaatagcattacataaaagtagattgctttcctctttgaactcaagttctgtttctttttttgtaagtcccagaactacctgctgtgtcttgaatatctgtttttttcaaatatgtgtttttttcaactgttacgttagtaggttatgttagtaaaaacaactttcatgatgtgttaaagtattcattctaaaataattatgtgtttctgtaggttgctaaagaaacaaaccaaatcaaacaaagaaagtggggaagggagtttagacgcaagaatgaaaacagtttttatcatgatgtcagtttaaataaagaatgcatcttttacattaaatttgtcttctacagcagctccctagaaatctgagcatgagcaaaagaaaacaaaattatgtgtttccttactcacatatggcttctaacattgttctactttaaatattaattttacctaattagtccttgcctcaagaacatacaataaaaataaatcatcctagtgacaaatccaagttatgttttgtgtttgttttgcaattattaagttaaatattatattggcatattttgaaacaactacttgggtagctgctactattatcttctcattacttctcattttttcagttttaaatggaagctgtaacaaattatgcccaaacttttacatgcaaatttttattttttattttaatagactatattatagagcagttttaagttcacagcaaaattgagtagaaggtacagagatgttccatatggttgcagtggtttaaaaaaccattgaggtgttttttaataaagaacagttactgtggttggcccagtgcctttcaattaatttgccacagaaactccttttaaatgagaaaacattcacctaaacgtaatagaaaaagtattgaagatactctaaaagagtaattataaatatttctcggcattgggattgtgaataacttaatggacttctttttgcttacccacattttttatgtatactgaatattccaagacttctagtataagcatgcatgaatttaaaccataataagtaaatatcataaacaaaatgaaagtgtttatcatggaaaagcactgctgtgaaccggcgctgaactaattgtctgagatggagttaggatattcagtaggatttgagtatatgctgatgtgctcttacactagcatggaatgaatacagttgtgaaaggacataacagcaacatggatgagtagtaggagacactaattaggaagaaaatgtgagaacaaattctagaggctcttaagaacctggattttgacaatgcgattccaatcaaaatcccagcaagttattttgtagatataaaaaaactgttcgtaaagttcatgcagaaaagcaaaatacctcgaatggctaacacagtattgatgcaaaagaacatatttggagaactgatactatccgacatcaaatcttactgcagacattttggaagataatttagtaatttcttacaaaattataaattcttaccatacagttcggtaatcatgctccttgatatttacctaaaggagttggaaacttacatccacgcaaaaatctgcacatggatgtttatggctttattcataaatgccaaaacattgaaggcactcaagatgtctttctataagcaaatggacaaataaacttgttcatccacacaagggaatatgattgagtcctaaaaagaaatgcactatcaaaccatgagaaagacatagagaaatccaaagttcatattgctaagtaacagaagccaatataaaaggctacatactatacgatttcaaatatatgacattctagaaaaggcaaaactatgaagacagtaaaagatcagtggttaccggatgtgtgagaggggtgggagggatgaacaggcagaactcagatgattttgggggcagtgaaactactctgtatgctattgtgatagtggacacatgtcatcatataatttgtccaaacccatagaatatacaacactcaaagtgaaccctaatgtgaactatgaattttgagtgataatgatgagtcaatgtaggttcaattttaagaattgtaccactgtggtgggggatgatgtctatatatgtgtgggggtaggggttatatggaacatttctgtaccttctactcaattttgctgtgaacttaaaactgctctataatatagtctataaaaataaaaaataaaaatttgcatgaaaaagtttggacataatttgttacagcttccatttaaaactgaaaaagtgagaagtaatgagaaaataaaagtagcagctgcctaagtagttgttccaaaaatatgccaatacaatatttaacttaataattgcaaaacaaacacaaaacataacttggatttgtcactgggatgatatatttttattgtacattcttgaggcaaggactaattaggtgaaattagtatttaaagtagaacaatggtagaagccatatgtaaggaaacacataattttgttttcttttgctcatgctcagatttctagggagttgctgtagaagacaaatttaatgtaaaagatgcattctttatattcttcctgtcaaaggcatgaattagctttttgattatacattgctctaattctatcaagccaatgcaatttgagttattattaaataaaatattacatttctcttttgataaactttgaatttttcatgtgcttttttcagtacatgcatttttactttttaatcttctttttctttgttattcttgcataatataggatcattttgcttaggtatgcagtacggggtttcaccaatggcgttgtaaaaggagggatatttattaaaatgttcccttatctaagattgtaatttttttttattaatatttgttaaatcaattttcattcttaggttttatttttttattttattattattatttttttgagatggagtctcgctctgttgcccaggctggagtgcagtggcacgatctcggctcactgcaagctccacttcccgggttcacgccattctcctttcttagcctcccgagtagctgggactacaggcgcccgccatcacgcccagctattttttttttttttgtatttttagtagagacagggtttcaccgtgttagccaggatggtctcgatctcctgacctcgtgatctgcccaccttggcctcctaaagtgctgggatcacaggcgtgagccaccgtgcccggcccttaggttttatttttatattttatatttcacaacatatctaatctcattataaatgctttctgatgctataattatgcttatttgtgttaaacaataggtatttattgctaaaagatgcacataaaatcataattcataagctataaaaaatggccccatagacatttatgaacactctgaaatggatattaatgttgacatgtgtatttattataagtactaaattttcttggtatcctttgatacatttacatatattttccctcaatatttgagttggtgttattttcattatttccctatattctcttctctgctttctggttttgtattttactgcccttttacaggtgtctaatctatatagccaaggagtcaagctactgagaatttccttgaagcaggaaatctgtctacgagctgaaaaaatgttcaatgtcctctgtaccagaagacactcacggttcattattgatatgagtaccggcaaatattcatgttcatcacagaaaagatgcaataattcttgcttcaaacactatctacactatctctacatttataattatttcagtgtccatcatccttaagtagcatgaaaaagtcatcttccatgtcttacgtaacgtcagaaagcacacagtctttaacttgatgcttcaaaggttatcagtgtaattctacttgtgactgtgaaaaaaaaaaaagaaaaaatgattaagatgataactttgtgtaaatgtagtcaataattttctaagaccacttgtttaatgtaacctaaaaatggtgctcctgtcatgtttttgtcatacttatttgagatttttgtaaaactttttatcgagaaataaacaattttttataagaacttaagagtggttgaattagtacaattttaattattgagcagcaatatatttttcaataaaattattttaacttatttatataattttttcttggagttagaatttattaaagcatatgatgccatgtatcttttttttatactttaaattttagggtacatgtgcacaaagtgcaggttagttacatatgtatacgtgtgccatgttggtgtgctgcacccattaactcgtcatgtaacattaggtatatctcctaatgctatccctcccccctccccccaccccacaacaggccccagtgtgtgatgttccccttcctgtgtccctgtgttctcattgttcaattcccacctatgagtgagaacatgcagtgtttggttttctgtccttgcgatagtttgctgagaatggtggtttccagcttcatccatgtccctacaaatgacatgaactcatcattttttatggatgcatagtattccatggtgtatatgtgccacattttcttaatccagtctatcattgtttgacatttggcttggttccaagtctttgctattgtgaatagtgccacagtaaacatacgtgtgcatgtgtctttatagcagcatgatttataatcctttgggtatatacccagtaatgggatggctgggtcaaatgatatttctagttccagatccctgaggaatcgccacactgtcttccacgatgtttgaactagtttacagtcccaccaacagtgtaaaagtgttcctatttctccacatcctctccagcacctgttgtttcctgactttttaatgattgccattctaactggtgtgagatggtatctcattgtggttttgatttgcagttctctgatggccagtgatgatgagcattttttcatgtgtcttttggctgcataaatgtcttctattgagaagtgtctgttcatatccttcgcccactttttgatggagttgtttgttttttgttgtaaatttgtttgaattcattgtagatgctggatattagccctttgtcagatgagtagattgcaaaaattttctcccactctgtaggttgcctgttcactctgatggtagtttctaggtatcttttaaggagccctttaaaattatcaattgatatgaattattaaatattgaaaatgtgtctgatgattgtatctatatatctgtcttataggtatttgacaaatggtgcattttcttaaggcagactaatttagagaggagagattaattttaataaaaacagaatacaaactatttcaagaaaattgtcaccgattttcatgctagtgttccaatctgaaaattatctatacacctttttgttcactacagttgaaattctttaaatattactaaagtattctgagaatttcaattactgtttattatagttgagatcagtaccaggcattatttctatggctttcaagagatttcaacaacaagatgctactatcttagtctgtttgggctgctataaaaaatgccataaactgggtgtttataaaaaacagaaatgtctttatcacaattctggaggctaggaagtccaagatcaagcagcaggcagatttggtgtctggcaagaacccactttcgggttcataggtggcgtcttctgtctgtaaccttacacagcaggagaggacttagttcattctactgttatgactcctatatactctcttacattatccacactgatcctctctggccatcaaccacattaaactttcctaagttagactccactaatctatattaagtaaacaaccgtaattattgaattagttcttcttgagagggaagtggctactaattcatctcaaaacctacctgtgtattattggagagatttttaatacctggaagaatattttgacttgttggagaaaacattttgaagagaggagaaagactttttgaattctgtgtctgtttgtgtcttctaggaagcagatgccaaggggataggagggaagaacacttgtgaaagatgaaggggaaaagaagcatggtgagtcaaggagaaacttaagactttgatgcagttctgacatatggtaagaatacgaggaaagatgtaaaatttgagtttcagaaagaacctggtaccgaggtgcagctctgagactgtatggccatgccagaaatggaatgccaaagattgcctttagaggtgccccatgttgggcagaaatggccagatcccagcaaccttgctgtgctcagtcattgcctggaagtggctaaggaagaaggtgcgtttgacttgaactctgtggcagatccccaaggcactgtggctggagcctgtcagcaagatatactccttatagcagagtctcacttagcaagagatcttataaaatttgctgctgcaaatattttgcctaaaactccatactcaagtaaaaagctacactgctgtccctgttttcatgcactcaaagtcactttattctgaacctacacatattcatccagtgttttatttctaaatatttgctatgttttgacaaaagtatataattacttttatcctgatttttgctgcattcttccttttattttcattatattccattgtatacctcatgtacttacctatgtttgttcattatttaattactaaatatatacagctagtttattacacatgtaaactgagttatttagataggcagtatatgcactttgtagaaatttcaagtgtacacatacttttatctgtagtaggagactcaacttgtgaagggatccttcattaattattccataaacgtttacctttttagcacaggctataatccccctgctgtactgcaatgcatgcctgctataccatgactgttttatatatgttaaaactgaaccaaaataagaatcatttcttgcatgatttttttttttttcaagacagagtctcatgctgtcgcccaggctggagtgcagtggtgcaatctcagctcactgcaacctctgcccccatggttcaaaggattctcctgcctcatcctcctgagtagctgggattataggcacctgcaaccacacctggctatttttttttattattatttttagtagagatggggtttcaccatgttggccaggctggtctcaaactcctgacctctggtgatccacccgccttagcctcctgaagtgctaggattacaggcatgagccacagcacccagtctcttgcgtgatttcatacatcttatctcaaaaagcactctttgaggacaacctgtccatgtagaataagcataacaaaatatagcatacaagggagtagttggcatgtttatctgataaaaaacctaccgtattcctgtcattggactgctagatttgcagtttgtgcctattaaattttctttattcctgatggtgatatttgattaatgccatgtgaaaataggtggcctgtaatatatatctatttttctgttctagaaaaaaatacaaatttatgatctgagtgatgataaattaggcacacagaataaagtgaaatttgtgctaaatggcatgtctcctgaagcactgggtcttcacattaactctgagctaagaaaaagcttcagttatttctccttactgatcagcaggaattaatgccgtgaagatgtgcagaagcctggaatgtgataaaaggttcagtgtggttggccagataccattcaggatgggagttctggctgatcaagggatataaccatcttcccttttattacttattttctgtttatcctgcttattatatggcaagctttctgcaaaagctgagaaaagttgtatgtaatgtacaagacaagaagaaaacagaggagaaatacattggcggacagataggatctaagaagtgatgcagagagcagtcttgacatacaaaaaaatacagtcactagagagtgacagacatagataaattctgatcagagcctttgcctctctgagtggcagagaatcaccttcacagcaacactctgctcacaaactatttttttctttgctttatacttaatagagttgtcttcttaattatacattataatacatacaagatgcttagaacagtgtatggcatatgacaagccttctagaaatgtaatcttctgtaaagcacagtaatgctaaaagtatggcaagtgtgatggttaattttaggtgtcgatttgatcgaattggagacttagagagctagtaaagcaatacttctggatgtgtctgtgagggtgtctttaaaggagattggcatgtaagttggtggactgagtggaagggatctgccctcaatgtggataggggtccagagagaacaaaaagaatctctctctgcctttttttctctctctcctctgaagctgagacaccattcttttcctgcccttgcacccagaactccaagtggtctggcctttggactgcaggattgataccagtagcctccctcaataccctgggttctcaggccttcagtgtcaaattaaagggttttatcactgggttttctgattctgaacatagaaaatagagctgagagagtgatagacagagatcaattctttttttctttttctttgttttgttttgtttttttgagatggagtcttgctctcgctgtgttgcccaggttggagtgcagtggcataatctcggctcactgcaacctccgcctcccatgttcaagcaattctcttgtctcagcctcccaagtagctgggactaccagcacccatcaccactcctggctaatttttgcatttttagtagagatggggtttcaccatattggtcaggctggtctcaaactcctgacctcaggtgatccaccctcctagggctctcaaagtgctgggattacaggcatgagccaccacacccggctgacacagatcaattctaactagagtcttcacctctctgagaggtaaagaatcacctttatagcaacactctgctcacaaacaacttggataacttatttttctttgctttatacttaaaatagttgtcttcttaattttacatgagagtacacataaaatgctgagaacggtgcatagaatatgacaagcctctgtaagcataaattccagtcttttggacttggattgagccacactattggtttcccagagactccagcttccaggcagcctgttgtggggcttctcatcctccattatcatgtaagccaattcctctaataaatcctctcttatcagtgtatctatcaatccatccatccatccatccatcctgatatctggctatccatccactcaatcctctagtcagagttctccagatattggttctatctagagaaccctgactaatacagaaggtaatatggttcagcaagtctaggaaagggagagggagactctgtatggtagtacactgcttcctcaccattttcatgtcagagaacacacacaggtacaaacacacacacttgagtgcgtgcacttctggagagacttacatccttcaacactttggagaaaattggaaagaaaatgataagtctagtctctcactccttctgatactttaaaaaatacattatttaaggttgttgcacaggtgtttccttagagatggttttaaagtaaacagtgttaccgtgaatgtgttatttggtttccacaattcttgaagcaaacttgactggagtcagactttccagagcggcattattatgatgttcctaaaaaagctaaattcattttcctttttaaaaataaactaatattattttacacaaactgcacaccatgcataactgaaagctgagtataaacagtataattctttttcctccatatagttttatataaggaattcaaagaggattgtcagctattaaaaatagcagtaactgggtaaaagagaaatggtgcacactgaaatactagtgatgcaaactcaagaagattaaacattttgttcatgaatttggtgaaaaataatggttggtttaatggcaacgtaaaattcggactttatcccagtttgagtttaataagctaaagtgaccatcattcaatctagtattaaagattttgtgagtcaaatatacttttttccctataatatcagcaatctacatcttaaccatattttatgaatatcaaatcatcagtatttatttactgattttttccccatatatttggaagtcttaaagccattgtaggcaaaacatattattatttgtctgtgaacacaagcaatgcacacaaataagctggagctttaataacattctgtgtcccaaatagacatgtaatgtaataaaatgtttgtagttgatattaaatgtaatagattaggctaggagtgagtcatattctactctacctccattggacctacaatctaattagactgttaacagtaaatttgttgccttgttagttaggttcgctccaagtgctaattttatacaccaaataaacaatgccaggcacatcctgacaatggaatatttgtgtttgagaaagacaattcacatcaaagaacaatcagtctggaatgtaggaaatggcttaatacatctgtgatgagacatcagcttatgtactgaagaggtcgtaacactcaataagtcgggcttttacagtcaaagcaggggaatagacaacaagagaactgagagtatgaagctgagtgggcttgtatattagtaagtcctgcgaggagataagttgggaatgagaatttctctacctgtctttcattctttatgagaaaagaaaacttaggtacccatctcctgtgggaaacttaactctgcttagaaagttcttcctgtgataactgtatcccaaatgtctgacaaaagatgccctacaaaattgcattatacaaggtaaacttgatccaatgtcacagtctgggggaaaaatagtctgcatgatcagagttagatactgaaagaagaaaaggaccacttgggaagatgagcaggtgagaaaggtagaattttgaggaatataacacgtggttgctggaagaagtccctctgtgatgacaatatatacacaagaagagattcccagtgtccagaaattatttcataactagatttttgatgaaaggctagatctgaggataaaagtttagagaagcctatggtatttacacatttactgaaggagtatgtatgggaaatgaagagaggaggacagagcttgccctagtcaggtatgcaaatattttccaacttaaaggctcaaaggggagactaaagtttatttttttaatattcaattgcaacatatacaagtagttttgcttaagagaaaaagtcaatgttagaatgaatgtcctctcatttcattttataaagctttcactgatgggttttccggcattgtagacctctcctgtgtcatccatattgtggttctatgtattctgaagggagttgcagttgacttgcaatttctcatccagtattaaccttaatttatgcactcatgtgatagttctcaaatagttgtctcatcagaacaagtaaggctgcaatagcactttttaaatgttactaaatttctttttttttctgcccagcttctgtggaaaacactttcaagttcattagatcaaacttgttgagaatggctgacatctgagaatcaaaccaacactcctcagcattgagtcaaaaagtcacagaaggtattgtttaaacctccttaagatggccttgaacctccttaagatagcaaagagagaataagggctagagccattccatagaatagatagattattttgggggaaaataagatctttggaattttatattttcaaggacaaaagttaagaaagaatagcaagaaatgaatatatgatgaacatttttaaacatatagtacctggggtaaattcacggtaagagatccttagttaaatatatgttttatggcactttggttagcttatagactaacctgagttttaaaatgagtcttactacagtaaaatttcagatatctggttgtctcagagaataagaaatttgtgtgcattcaaattccaagcatagaagctttagaatgaggacagtataattatggccgaaagtgctgccactaaaagtgtggctgctgcttcctttggatagtgttactaagcaatggcttcccagccaaggactacatgtttaggtgtcttatgccaaaagttatggtcatgcgacataacttcaaaatatcaacaaaggcaattacatggatgcctttttccttctacttcctgcagagtgtgaacaggtggttcctggagattaaaaagcgatcttagtgttgtctgcagtgactatggggaagctattgcataaaaaagcagggtttcactgagggagtacttgaaatgatgggagtagatgagaccaccgggggaaagtttatagaatgaaaacagtagtaggttaaagacagaagcctaagaaataccgatacgcaaaagataagaggggaatataagaaaagcacataaataacttgcattgattggtgaaggcccttaaatagaggaacactggccagagacctggaagggactattgtgtcagtgacggggagtagagagtttgaagtgggcaatgagtgttttgctgttagcactggcaataatacaggggcacaaaagtattctttcattttgaaactttgcagttttgggaatgacttgacaataacttcaaatggatgttgggggcaaaattttgagtgtgttttgaataaggaaagagaagtggggaagtaagcaccatggagtagacagctccacagaaggttcaatgcaaagggagaagggaggctttatggaagagatcacaggctcaaaggaggggatgcgggcacatttattggttgaaagaatgaattctgtaaagggagtaaaacaacaaagatgacagggaggagatcagatagtttagcctggtcctagagaaggtaggagatgaaatttaaaatgcaggtaatggaactggatttaaagaagaaagggacagatttgtatccttggattaaagcaattaaggatgattgctgaggttggcaaatttgcagtgagaaagaggcataaattgaaccatgtccacattcagttttcctctagcctccatataataaaagatacaattggctgccttgaaagacagattggtggttgtattgctcgcatcaactctggcaaatcatccaaccatctaaataaccaattggcaaatattaatctagaatttactacattctagtaactttaagaagtatagtagcaaacaagacatgcatgttactcttttctcctttatagagattttgatgtagtaggaaatgttactaaattacaattgattaaaatatatctctttagaaaataagagaatgggatttaagtgtttatcagattgtttcttactaagtagttaaacaaatctgagggatttaacacaaacaagggagcagaccaatttacagtttgtggtttatatttatcatcatctgctatcagattaatattaaacttgaaaattcaaatgcatgacagaagtagcaaaataggactttatattgtaatgaagtgcatatttacaagaataaatataattgcaatgtctgtactcaaatggatatttagtaaagaattatggtcaatagcaaaggcctcttgaaaatttcaaagtgacatgataaatgtagaattctgctactgttataatagtcaaatctttattatttgcttgctgtctttctcttactctctcaaaagtctgtgtctatgtacatattctttagttgtgtcagagtaaattagttaccttaaatctacactattgacttactagtgactcagttgtccctacaccagaaataaatcatctaaggttaaaagtttcttcataaatttgcaaattaatttattaaaaacttgagacatttttaaaaaattaatatttatttatgtttattatactttaagtcctgggatacatgtccagaacgttcaggtttgttacacagatatacacatgctatgatggtttgctgcacccatcaacctgtcatctacattaggtatttctcctaatgctatccctccccttgccctcacagtgaagacttttttcatattcaaaaaatactaaataacttggggtttattttaaaaaaatacatagttgatatagttcggatgtttgtctcatccaaatctcaagatgaaatgtaattcccaatattgaatgtggggaatagtggaaggtattggatcatgggatggatccctcatgaatggcttggtacccttctcacagtagtgagtgagttctcgctctgagttgatgccagatctggttgttcaaaagagtgtggcatcctcgttcccccacggcttgctcccactgtagccatgtaatgcactcctccaccttcactttctgccatgattggaaatttcctgaggccctcaccagaagtagaagcagacaccacacttcttgtacaccctgcagaactgaaagccaatgaaacatctttactttataaattatccagtctcaggaattcctatataacaatgcaagaatggactgaaacaatagtataaaattagtgtaacttctgatcatggttccactttttattacagaccttcaattttctagaaataaaggaaagtgttaattataaacattttcacaatgactaaagtagttgatatggtttggctctgtgtccccacccaaacctcaccttgaattgtagtaatccccacttgtcaagggcaggaccagattgagataattaaatcatgggggtggtttccccaatgctgttctcatgatagtgagtgagttctcaggagatctgatggttttataagaggcttccccctttgcttggccctcattctctctcctgtcctcttgtgaagaggtgccttctgccatgactgtaagtttactgaggcctacccagccatgtgaatctgtgagccatttaaacctcttttctttataaactacccagtcttgggtattccttcatagcagcctgagaatggactaatacagtagttttacggggtgaaatgtcatgagccagtaaagaaaaataattattcaatcagtgaaaatctgttcttcagtaaaggatgtctttaggtcagcttgtgctacaggtacaagaaatgattattctaaaaaaattatcatccccaggcaagagatccttatccttcaaggcaagagagatggagctattggaatattctttttccttgatcaaaatatccttcatcggggaaatattctcttgcaaaaataccacagctgtctggtaagccatttatgacacagccttaaaccctttgaaggtaagtaacacaatttgatgtatatattcatttgtcatttataaactattttatagttgccctatttcctcaaaaagagtactgcttcatggcagaaaatatgtaagctctttctctcttctacaatgcctggcagaatattggatatttggaaacataaatatctgtgttttgaatacctcaatgttgtaatctgtgagactcattctagaaaaccactaaagtgctattttgatgattattgcaattttatttgaaagcattgctaaaatggactaattatgatattttgggagtttttttctaaattgttttctcatttcccatcttcataagatgcagtatgactaaataatattcacgatcccattttgaacaagaaaaataaaatgcatcttggtgttcaattaaattacaaatgacttcaaggtgtcaatgtctttttggttctagaaaagactttcaaattatactgcttaacaatgacatttataaaatgctttatatttttcaaaatgccttcacataatgaaattgttactagcaactcaaggttgcttttgattcaatagaagaaatattttggtaatgaaattttgccgcctcaaatgtgcagaaagcaaaaccatctattttatgctgcaaagcaaaccaggcattttcaagaatagctagtagtctgacgcttctgaaaaaaagttacatagtacaggtctagagggagttctggagaacattcaagaagggtctgcattgatttcgaaagcattagaatccatctactaaagtccataatagaaactgagtacttaaagcgtctttcaagccaacattttcctgctagaacatattttatttacattgtgatcacttcagagaacgaaatagtgggtgacatcattcaaatatctccttaaaaacaattgttgattttttccccataagtctacattaaaaaaatttaaagaaacttaaaaatctattgaaagttgaagtgtttattatggtgctctgagcttgagtaactataggtaaatttaaatgatgtaattatagcaattaagtgtggaactggtaggacatttccagtttattatatgtcatatagacaaattaatcatcacccaggaacttgaaatgctgtaagtgttgaattttaacatattttaaattggtgtctacctttatattagcagaacttataatgcttaaagtaaaccacccagatgtttcaaatgattacataaacaaataatattccatattattatgatttttcctgcttgtatatgatatactgttgataatgcaatccgttaggaaaagacaaacgtttctagcattgttctcccagaatgtttgaagtatttctgtttgtgtggatatgcactggacaatccaggtacataaatgatcaatgttgttctttaacagagatctaagccactgggggagaatggatagcctggtctgggggctgattttatgaagaacttctaggcgtagatacaagaagtgggttcataagcatcaagccctgcaaggcattgcacgaatgaataaaatgccttttcaaagtaggtcctccaaaagatctacctaaatggtaaagcaagaggtagaagtgttaacacaaataatcagattttgataaacatatatggcaatgattattttgccaagtcagcaattccccaaaatatggtgccttgacacgctaagtgctttgaaaattacaagggctcagaaataaaccccaggaccatggtctctctatgacctttcctctctgcccctgtctttctcatcctttctgaaaggactaggagaagctccctctagaattttcacatttaagaaaatttctttccaaaagaaatgcaattatattaagccaccctccctaggaatctcaccaaataaccaggaaagatcaaccaccaaagaagataaaagactgggggtctccaccacgctcagacagactttttaatctatcttctgtgaacagctccaacagactacctgaaagactttatctgcatagtaagacaacctttgttccagtgaaccgtatggtctgaataatgggctggttcatttccccactctccttcttctgtgaataagccatttaagcctcaatcatctggtccatctttgagttcataatttaaacaattcccatgcatgtgtgtgtacataatagtaatatatttgttattttttctcttcttatcctgccttttgttataagagtgtcagccatgactctttataaaggggagaaaagaaatcactccatttgcatctatagaaagcattatatgcagtctaggggtgatttaaaacagtggtccccagtcttttcggcaccagggactggtttcatggaagacaattcttccatggactcaagggcaggggatgcttgggggatgattcaaaaacaatacatttattttggactttaattctgttattattgtaatatataatgcaataattatacaactcaccataatgtagaatcagtgggatccctgagcttgttttcctggaaatagatgttcgccatcttgggctgatgggagagagtgacacccgaattgtgttgcttaatcctgttgtagttgctgtcactgcagaaaaccctgcttccctaaggtagaattttggaaatggaagcaggcttttcaatgcttttgtgttaacttcaggatatgcccctgccttgactttaatccagaatgtatggagacttgaagttgtctcaaacatacttttaaggtcagtgtcatttgcaagctcaagcagttgatcctcttccagtgtggacaaagccaatttacctgtttaattcacaaatgggttgcgcatccaccattccttcccagtttgggggtctttcgtggttgggaagtaatggtcaaactcttttgaaagctgagatatgtgatcatgcaccacctgggggaaagaaggtcctggctcagtctctttcaaaaatctttgctaatgtttgaaacatgtcagaagtcccagtgttcattcatcactaccataacaccactttggctttgaatgcagccactttatctgttgactttaacagagttgtcattctcccctgaaatgacagattgagtttgttgagcaggttgaatatgtcacacaagtaagcaagttttgcgacccattctgtgtcactgaaatgtgctgccagtggtgactgtttttctaaaagaaatctctggagcgactcttataactcaaaaattctggccagtgatctacctttagaaagccatctcacttctgtgtataagagaagacgtgtgtgctctgcgtccatctcctcacagagctgcacaaacagacgtgagttaacagcatgtactttaatgtggttgttaattttaatcacatcctgaaaaacgttaagttcaggtgacattttgtggctagccaacatttctctgtggatgacagagtgtgtagacttagattcagaagcgacctctttgacccgagtcagatttcagtgattatcatgttgaaatatacaattacatgataattcctattgttaatagaaatgcttatgcagtgaaaagatctatgagctggagtatttctgttttattgttttcaatctaaatattgtacgtttaatgtatgagaagaacattaaactcccatcacttaagcataataactgcctcatgtatctatataatgtttcaaagacatttttaggccatttaagctttttttttttttgagacagtttccttctgttgcccaggctggagggcagtggcgcggtcttagtgcactaaaacctccgtctcttgggttcaagcgattctgctgcctcagcctccggagtagctgggattataggcacccaccacaacacctggttgatttttgtatttttaatagagatggagtttcactatgttggccagcttggtctcgaattcctgacctcagacaatctgccctcctcggcctcccaaagtgctgggattacagacttgagctaccgcgcctggcttaagctttttaatttataataaatatccactgaaagatttataataaatatccactgaaagatttcctgttaaatttagtgcaatattttaagtgatcggcagaactttattttttatttttttttaacttttattttaagttcaggggtgcaagtgcagatttgttacataggtaaaatgtgtcataggggtttcctgcacagattatttcatcatctgtgtattaagcctagtacccgttagttattttttttttttttatcctttctttccttccaccttccaccctctgaatggccccagggtgtgttgttcccctctgtgtgtccatgtgttctcatcatttagctcccacttaaaagtgagaacatgtagtatttggttttctgtttctgagttagtttgctagagataatcgtctccagctccatccatctccctgcagaggacgtgatcttgttctttttatggctgcatggtagtccatggtgaataggtaccacattttctttattcagtctatcattgatgggcatttaggttgattctgtctttgctattgtgattagtgctacagtgaacatgcatgtgcatgtatctttataatagaatgaattatattcctttgggtgtatagccagtaatgggattgtggggttccatttgagcaatcgccacactgtcttccataatggctgaacaaattttcactcttaccaatagtgtataagcattctttttctccataaccttgccagcatctatgtttttgatttttgttttcttttgacattttattaataaccattctgactgattgagatagtatctcattgtggtttgtatttgcatttctctaatgatcagtgatattgagcttttcttcataagattgttgactaaatgtatctcttcttttgaagagtgtctgttcatgtcctctgcccactttttttatgaggtcattctctcattctgttggttgtcttactctgttgatagcttcttttgatttgcagaagctctttagtttaattacataccatttgtcagtatttggttttgttgcatttgcttttggcatttcattataaaatctttgcccatgcctatgacctgaatggtattgcctaggttgtcttccagggtttttatagtatggggttttacatttacatctttaattaatcttgagttgatttttgtatatggtgtaaggaggggtccagttcagtcttctgcatatggttagccagttatccaagcaccatttattgaataggaaatcatttaccccattgctttgtcaggtttgttgaagattagaaagttgcaggtgtgcagtcttattcctgggttctctattctatttcattcgtctgcgtctctttttatatcagtaccatgctgctttggttattgtagccctatagtatagttagatatcaggtaacatgatgtctccagttttgctagaattgccctggctatttcagctcttttttttgttccatatgaattttgaaatagtttttttttttcagtgaagaatgtcattgatagctggataggaatagcattgattctgtgaattgctttgagcagtatgatgattttaattatactgattcttcatatccatgagcatgaaatgtttttccagttgtttgtgtcatctctgaattccttgcacatagattcacagctgaattctaccagatgtacaaagaacagctggtaccattcctactgaaactattccagaaaattgaggaggagagactcctctgtaactcattctatgaggccagcatcatcttgataccaaagcctggcagagatagaacaaaaacagaaaacttcaggctaatgtctttgataaatgtcagtgcaaaaatcatcaacaaaatactggcaaacgaaatctagcagcacatcaaaaagctaatccactacaatcaagtagacttcatccccacgatgcaagtttggttcaacacatgcaaatcaataaatgtgattcattacataaacagaactgaaggcaaaaaccacatgattacctcaatagaaacagaaaggactttcaataaagctcaacaaccatttaggttaaaaactctcaattaactaggtattgaaggaacatgcttcaaaataataagagccatctatgacaaacccatagccaacatcataccaaatgggtaaaaggtggaagcattccctttgaaaaatggcacaaaactaggatacactgtctcaccactcctatttaacatagtattggaagtcctggccagggcaattaggcaagataaagaaataaaggcatccaaataagaagagagaaagtcaaattacccatgtttacaaataccagatcctatatctagaaaaccccatattcttggcccagaagctccttaagttgataaacaacttcagcaaagtctcaggatacaaaatcaatgtgcaaaaataaaaatcactaacattcctatacaccaaccacagtaaaaccgagaatcaaatcagaaataaactttcattcacagttgccacacacacacacacaaaaaaacagcaacaacaacaacaaagcacctaggaacacagctaactagggaggtgaaagatctctacaaggagaactacaaactactgctgagataattttattttaaatttaataagaattatcgctaaattttattctttagcagaacatttaaaataacatttcaatttggtatctgctattgttgttaatcttaggatgctttcttctatgctacaaaattactcaaagtaatatttgtgtgagaatataggccagtagaacatttatttattcattcattcattctttagctcattgacttgatatgtactatgctataggtacttggctagactgaggatgtagagatgaagacacacacctttccccataagatggtgaagtagagggctgagaacagacatttaaacctaccatggggtaagcatcataacaccctctctctgtcttgccctcattagcctgggccttttgtggcataagtgacttctgttgtgtagatgaagtcagtccaaagctccttggaacttgggccagaatgttgtgagtttgaatgctgcttgccactttcagatgtgtaacattggataagtttctttatttctcttatctcctcaagtgtaaagtctgggtaatatacccttgtaaaaatcataatattgaacctaaggagtttaacacattcatttaacacattcataaattagattaagaactcaaaacaagttgactactaatacaattattataattgctaaactttagtcttcctacatttttctctgttatctcacatttaatctgttaatatgtctctatctgtctctacttaattttagtgttgtaagaaccagataatagtcaatgctggtttttcctcacctttgtggatctttgaagaacatgacaaaaacaagcaatgtggaaagaattccctaatgaataactgtttttgggaaaactgactacccatatgcagaaaactgaaactggaccccttccttgcaccttatacaaaaattaactcaagatggattaaagacttaaacgtaagacctaaagccataaaaaccctagaagaaaacctagcaataccattcaggacataggcatgggcaaagacttcatgactaaaacaccaaaaggaagggcaacaaatgtcaaaatagacaaatgggatctaattaaactaaaaaaacttctgcacagccaaagaaactatcatcagagtaaacaggcagcctacagagtgggagaaaatttttgcaatctatcaatctgacacagggctaatatccagaatctacaaggaacttaaacaaagttacaagaaaataacaaacaaccacgtcaaaaagtgggcaaaggatatgaacagacacttctcaaaggaagacatttatgcggtcaacaaacacaggaaaaaagtctcatcatctctggccattagagaaatgcaaatcaaaaccacaatgtgatagcatctcacaccagttagaatggcggtcattaaaaagtcaggaaacagatgtggagaggatgtgaagaaataggaacacttttacactgttggagggagtgtaaattagttcaaccatcgtggaagacagtgtagcaattcctcaaggatcttgaaccagaaacaccatttgacccagcaatcccgttactgtgtatataccaaaaggactataaatcattctactataaagacacgtgtacgtgtatgtttatggcagcactgttcacaatagcaaagacttgaaaccaacccaaatgaccatcaattatagactggataaggaaaatatggcacatatacaccatggaatactatgcagccataaaaaaagagatgagttcatgtcctttgcagggacatggatgaagttggaaaccatcattctcagcaaactaacacaggaacagaaaaccgaacaccgcatgttctcactcataagtgagaattgaacaatgagaacatatggacagagggaggggaacatcacacactagggcttgtcagaggctaaggcctaggggagggatagtgttaagagaattacacaatatagatgatgggttgatgggtgcagcaaaccaccatggaacatgtatacctatgtaacaaacctgcacattctgcacatgtatcccagaacttaaagtataataataaaaaaatacagaaaaaaatagtcaatgcaacaacttggattttgtttcctgtttagaaggttttttttttcctttgtactgagaaaattgaagaagtattggcttatagtctaaacctagaaaagactacacttcacctgaaaaactgccagccaaggccttcatatctagtgatttgactatggttcaattattaacacagaaaggaagaaactaacaaaatccagtgtcttaataaagcaatacatcactgtcaaatagcatatggagaaccacaccaataaggccactaaaattagaacaaatggaaatctattaaaaattatgttgcctaaaacttgtcatcattgattatgtgtggagaagacaacatagtgtactaaaaacagcaaggattttattttcagaaacaaacataacttaggtgtgtcatcctaaaatattaaatatttgtgttttcacgccttgtgttatcctgaaagactgaatatttgtactgctacacctgtcccgaattgcctcctctttggtcctcaggtaacacttgattatgcaccccgctctcccattgtattggtgatgagagacagagagcaacacccctgcctccctgtttgattccgggaggtgcatgtaaccaaagcagcatcaattagtactttctgggattattatatagccttggaggaaagagaagttgcctccctgcttctaagctagaaggattcaatgctggtagtaattttgtctccctgaggaataagccaagcagcagcaagcacatatgagtgccagagagaaactgtaaagctctaactcatgccgtgcgtccatgaatccagccatggaagaaatcaagccaagctgtaaaaaagcacaactgagagagagagagagagagagagagagaaagaaccacagtaaacccattcatggaagattaactgctaagtgtgggattttgataacactattcagtaggtcacacagtggggccaggattgctctggactttgccacttgttcgggtttaattataatgtgttgcattcaccctcaaacgtggcctgctttggacaataatttatctctacttatagctcagcaactgtgttttactcaaactaaatatattatttacatcttcttctgcatctgttggcaataggcttggaaaaaaaagataacaaagaaaattttaagcaaactcatagacaagattaagtggtgtgaatctatagatttccattagtattatgtctgtccaagagtagagtaggagcaaacctgtataaattaagtggagatattattttaggttttacactttttgaagcagaattagcagagatggaatatacctggcacctccctgacgagaagatacattgtgtctacacagccttatgtgaaaaccatcatgttttatgagatgtaagaggtgcagtaaggaattatttttggtaacatatgttaatttttccaaacacttcatcaccgtacattattatgtttaaacaataccacccatattcatactctggcaagttttctagagtagaaaggcatgaccaaaggcacccagctagtacacacttcctgaatgcctatagaagtggccatgtaccatatggaagactttttttaaacaagtatttgtgaataattaccttaaaaatcaactttgctcattaaaaatgcacatttttacttctctgttagcagcacaggtctataaaattctttttggacttgaagcatggtaggcagcagacaattttatgtaaatggcatggttgcataggtcttagattctgtgaggagagagaatacatactttcagtctgatccttcaggagatgacccaaacagacaaggaaaccagtggtgtaggtgcacccactcacttcaaggcctttgcagaatgtcaatgaacagctctgctgcagtttctgtgtggtgaagagtccatttcaaatgatacctacttcagaacagattgccacttacgaattccgagtattcggtatccagttataaaactagatgactgaaagacctcacggtatgattagccaattttctttcaatagacatgaactatgtgaattttcatttcttccttagcttttcattaaaatgcacaagttaaacagtggtcccattttaaacaaaaccttccgtggcatatcttcatctcaagtgaagcttaaaaattgaaatacgaaagctatgtttgggaccttgcttgccaaacactttggtctctggttttctagttcaaacagatggagaagaccctggcacacatttggcttttgattatttcagctctgcttgcatcagtgtgtgatggggaagggcacgactcacagggcaataaatatgagtcattatacccattctggtcatataaaagtcaatgccagtctgtatccagagggacaaatcatgtgcccctaatttcctgttacccatatcactatgttattgcttttgtcctgacacagttattcagctatttcgacggctggcaatgagataagttagctatgaagtgaacatatttaattacttttcttctatcattggaaaaactgattttcatcgggggaaattagactttcaagagcaataaatgaggaaggaaaggactggcctttgtcggagttttcccaaataaacatgaaaaattgtcctggctgttaggtgaattttgaatattaaatgagtggaagtgagatcattatcttttaataaaagaaattggtatttgtgtgtgtttgacagatggtgtgttgaattggcaccacccaagtgaggctgtcgtatacctgggtagaggaatgaacaatacatcgcaggttgtgacaggcttattcctacgcttcatttaatatggaacccgcaacactgatttcagtgcaaagaactccctttccttggtctctgggaagaagtcactgcaaaatctatgtaatttgctcttcatttctcatatcccaatgaattctcaaatcagtaatgtgtgatgatatgtctagatatcttgtgctgccatattgcccatctcaaaatgatttggcaagctgagaaaacaattaaaccaaatagataaatctatcattgtaatgaaaaatattaattacaagcaaatgagagccaaatatatttcaatcagtgtttgccttgccatgtactgagatacggatgacgagaaataggtcgactgtctctgcactccgtttcttctgggatgactcccatgttaataacatactcccacgttaataacatatttccacattaataacagtgtccctgtcatatctccctcatggataaattatccaaacctctgcaaaggggtacaatcaagacgtcttcatagctaagctcaactcgatgatgcctggtaatggagtatctgggaaatactttaaatcttgtaaatggatttctcctggacaagaaatatatgttctgtgttttcgccctttctctttgcagaactgtgcttcgggtagagaaggactatgaagggagtgggtatagcctaacattgtgacatatgtgtttccattaactctgttagcttccttcatctctcattcattacttcctagggaggaaaagtttcaaattctaatcaatggctttaaagagaagatcctatcaaacatagaaaatattttattcttccctttgtcctgagagtgagctgtccctggaaagcatgcgttgtgctgggcttcttctggagctgctggaagaaagtgtagagtggcgaattctggtgcagtgttggctgcctaggtcttggtatatggtattaggaagcctagctcagctccctgagaacttatgctctattcttcaatatctgctttatcattaattaaggtgaaactttggctcttacgtgcttacacttttatttgtgaattggtttagaagttggatagaaatttgggctattcttcactgggtgttaatgctgaataaagactattctgtacgccctgaattattttcctttggagagtagacaaaccatgtagtgtcccttgctagaataatagacacagatctcacagtattaggctgactggaggcaaacttgacttgtcctaagttgaagtctctgaaaatctatgtataaataggcagctgcttttgctgattccacctgtgactcagccctctacagagcaaacaaattagtttccatagactctaaccccagttttgagttgccttagggaagagaagccaatggttggtcaaacatagaaacctcattggataggtcagatttcaagcaggaaaagatttgctttacttccaaatgtccaagcctatactttctgcagtatattttcaagataggtagctatattatcagtgaagagtctatgaggggatcatcttttgcaaatttactacaattttattctatgctacacctacacaaaaacacctccacctagctcttctgttccagtctcaacaagtgacatgctgttccttcagaatcaacatttatgaaacatatacctagtcattgtcatgtagttataaatttgacatatatatgtcaaacatcatctattaagttctgttgagtctctagaaaagaagatactcttccacagaaatcaaatattggtggctttggactcctgtgatgtttggtgttttttaggttctgaagctccatccttgtatcacttgagtcaccacaattcaaaatcgttttccattatcactgacatggcaggttactttctgaatgggaatagcttcaggttataaaggctttcaattgaaagtcaaccaaaacagccatatccttagaagaaatagactccaaagctgtggacttagatcgatgggtctcattgtgtcccccaaaattcatgtgttgaagcttaatagccactgtgatagtactagcagatgaagcttttggaggtgattatgtcatgagctggagcatgcatgaatgagtttactgaccttaaaaaggaggctgaagggaatgagctagattctttgtacccttccactttctgccctgtgaggacgcagtatcaaagtgtcatcttagaagcagagacaaggccctcaccagactccaaatctactggtgccttgatcttgaacttccaccttccagatctgtgagaaataaacttctattctttacaaattaccaagtctcaggtattttgttagaggagcacaaatggactaagatgccttcttcttgcatatggaaagtatactaatttttaaagaggctagatttccatgaaggctggaacaaaaattctagtttataataccttcatgagggaattttggtaaattttcataaggctgaggaaaggtaattttctacttaaatatatcttcatgttagttctttaacatggccgtaaatttctgataatcataatagcacttacctgcttgacctgcgctctgctccttgtgattttggttttagtacattggtaacaatattgtgcactgcagctttatgttgaagtttaggtcacaaattcagtaaaatagctttcaaactgtaatctacgtaaaaactgggggctttctagtgcctaatatctgcttagacagatacacaaagaatcctagatttgcagtcagtagagtattactctgttgtcacgctgctaataaagacatatacaagactgggtaattcataaaagaggtttaacggactcacagttccacatgggtagggagacctcacaatcatggcagaaggcaaaggagaagcaaatgcacatggtggcaggcaagagagcttgtgccgcaaaactctctttgataaagccatcagatcttgtgagacttattcactatcacaagaacagtatgggggaaaccacctctatgattccattatctccacctggccctggctttgatgcatgatgattattacaattcaaggtgagatctgagtggggacacagccaaaccgtatcaagtagtgatttacaataaacgtatttgttattttaatgtctcccggagtgtcgtggggaatccaaaatgtgtggtacagaagacggttttcaagagcctttctctatactctcacttcttattctctgatgtctcatgtctcccctagggcctctcgcattttcatccccagattgtcatttatggtgatgatgatcatcatgacagtgaaaacaatgcaaatgtataaggaaatgagatttgtatggttaagtgctttacatgcattaagttatttaattctcaacacaaataggttctgaccctgttcccgtctttctttcccctctctgctgctctcccaagtctctctcaaattacaaattttaaatagcctgatttggcctctctggctttttttcatcccttctctttttaattgtttttcatattctttatcacaggagagcaaaacagagcttttaagaactgaattctataatagaataaagtgactgaagggaaaggtaaggattcacagtggattgggagcttgcagacattagaagattttgtctcttataaacataggcttttaatagttgtgctttatctgcctaatgtacacaaaatttggttgtacttttaaaataagtatatcaattttcaataagtatatgcagtcataagtgcttttagatgtgatataaaaatcacttatcaaattagtttttaaatatgttgacataatgaatgcttaggactgaaacatcagaaaatgtcatgatgacctatgcaaaatattgtatttatgcaatatacttatttgaagtggacatatacatgtgatatataaatgtatttaccaaacgattttctgtttcttactgatttttcatgtaaaatttaattggcattcctgaaaaagacaaatgcatttaattgggcgaataaaatagaaagtacattttatttataacctaaagtaaatgttaatgaaaaagctgctgttgtttggcacgtatacaattttgagatttttaactagatctttagtacaacattggtcaagttgttatttatttatttatttatttatttatttttttaattatactttaagttttagggtacatgtgcacattgtgcgggttagttacgtatgtatacatgtgccatgctggtgcactgcacccactaacttgtcatctagcgttaggtatatctcccaatgctatccctcccccctccccccaccccacaacaggccccagtgtgtgatgttccccttcctgtgtccatgtgatctcattgttcaattcccacctatgagtgagaatatgcggtgtttggttttttgttcttgcaatagtttactgagaatgaagttgtttttgaaacccaatgaatattgacttttagttttgatgacaatatagtgctgaaatcccagagactcacaagggaatataacagaagttaaattctgggctttcattactgactttgctctatactgttaggcttgtgtcagagaaaacaaggatttttcagtacatccagagttgaatttatgagctcacattgactttgtcctgcaataagtgagatcatatttggccaggtgtatgccatcgatggcttcatcagtcagaaagtgattacattttctgtttcaacattaaggttgtctgagataatgtaacattctaaagcactctgcattgtttccaaggattggaagatgtcttccaacagcctagttaatactgttttgtacctctcaaccctttgaagctctagaaagttttgcaaatctgtctcctctagtttcttcttccaaaatggcaaattttccacactcacatttttttgtgcagcataattggtgtctttctgtggccttgaaccaagagatcccccccaccaccacttaggaggtcacatatattcatcaggtttgatgaatcatttgtaagcctttccctgcaaaattttccatcagtcatcttttcttttgcaagaagaataaggtttattttcagatttagcaatgagtggctcaaagagtgttgtctgaaaagtcagtattttctgtgcattagcagagaatgctgtatttagcacatactttctgagaaaacctctgaaaatgatggcaatcaaaggtcagtcagatgaattgaaaacttgcctgccagaaaaaatatattttgggaatttttaagaattaaaacaaaatgtcagtgcatacaggtgtggtggtgtggaacagaaccctccaatatctctgaggtatgcttggactaaaatccagattttttttctcttcgcctcttgcttaatacaatttcacactgcccagctacagatgttctaatttttctgtcagtgtcaaaacaatactatatgaaagtatattctaagtcaatatttgtatcttaattaaaaaagaggaacataatatatcaaaccttaccttatttttacaacaacaaaacccatagggaaagaagaactgaagataatttttttttggcaaagtgtaagaaggcagaacagtcacttaatgataatttttgtacatttcatgcacaaaggttttaattttatagttcatactctgacaaaaagctctttaactcaataatgattctgtctccaaaaagtctgccatctcagcaataactacttttttaaaatagttataacctgtgctctaatacagttactacttaataatggcagcatatgtatcaaaccaacaaccagcaaaaggagaatgaaaattatatgtttcaaaagaaatgtgttttgttaataaattatgattataaaaaattatagtcaataattttaatcaaaatcagttatgaaatgtgatgttttttccatcataaatacagaaaagtgatggttttgatatcccaaacataataccttgtacaaatgctgctttgcaatttcattgtgacttcttcctgcttactactactactaatagtaacatctcctgtttgttgaacaccttctaaatgctaagtactgtgattaatgcttcaagctgcattctgtatcagaacacttgactttatctggctatgcctcagttacatattcaaaattgccttttcatcattctctctaatccttcttctagaacctctgttagctggattttaaagttctgcctctgtcttctaaatcttttaatatttctttaatacttcccataacctgatgtactgaatcctgaggatattccttgacttgatattctaactaactaattccccctttaaccatatctgtttggttaatcttcccatctattgcatttttataacatttaagtttttaatgtccattatctctagattttttgtcatatgcatacaaaatcctgtcatatcttttaaatacaggaatatccactagtaccaattcctacttgttaaattaactctatttctatatatatttttgacttctgtctttatcttacatgatagaaagcagatctcgagatcaaccaaaaatagtcttcatagagatggaagcaggagagtcacattaagtaaatcaccattaattatagatgtataatgaagttataaatgatggaaaagagaatcagaaatgaaagaatgaggaagaaagaggatgagggtgagaagaagaaataataatctgtactataaataaactcagtgatcttttggagcacaggcaaccagccagcaagaggccccttattatgtaatatttcataggagagaaatataattgactatattttgagggtttttttttttcgtttttattgttgttatagcagcttagtttggattctatctaattgagttatagagacaggctagtgacccagatggctgaaaatgtccaagtcaagaaatataataaatattcatggtcaaaattcttctcctggccacacctacctttaagaaaatctggtaaatctaatttataactgggaagccattataaacttgatacattactttagtaaaggaaaatgatgagaataaaacatagaagactattagctcactctactttattgatccgtgttctcacttattctgctacctgtagctgctaccagacctatgctgggaactgaaaaaagatacttagtctttagacttggccacttttcagtacactcatgttttagttttggagtgatcctgtgcatactctttcttaacagtccactcttttcatttattattttgatttcttttaaaaaattttatgtattttgtcaattcttaaaagttttgttgggatatcaagcctataacttgccctcactccacatttttgaagagttattcaatataataaactgtctttgaaaatatatttatgataggtgggcaggtaactaatacttgttagtatctaccttgacttagtcactctactcagctatctctctctctctctctctctctatatatatatatatatatacacacacacacacacacacacattatatatgcttgtggatatatatataaaaaaataaaaatgaccatatatttatgtataaatacatatgtagttaccatacatattgaaaatgtaatcattactacaactatttacagtattttcattctcatttcacaaatatattcttctaaaaggcaaacatttattatttattttgaggggaacataaaacaaatttcaataaattttactttttatttatatctgttttattttaagttcaggggagcatgtgaagatttgttatataggttaaacttgtgtcatgaggctttgttgtacagattatttcattcagtcaggtattaagccctgtactgatgagttatttttcacaatcctctctttcctcccaccctccaatctcctataggccccagtgtgtgttgctaccctctatatgtccatgtgttctcatcgtttagctcccacttataagtgagaacatatactgtttgattttctgttcctgatttagtttgctaaggataatggcctccagatccatttgtgtccctgcaaaagacataatctcattcttttttatggctgcgtagtattccacagtgcacatgtacacattttctttatccagtctatcattgataggtatttgtgtttattccatgtctttgctattatgaatagtgttgtaatatacatgtgtgtgcatatgtctttataatagaacaatttacattcgtttgggtatatgttcagtaataggattgcagggttgaatgtaatttctgtgtttaggagtttgaggaattgccacactgtctgccacgacagctgaactaatttacagtccatccaatgagtataagcattcattttctctacgacaatgccagcatctgttatttcttgtcattttaataatagccattgtgactcatgtgagatagtatctcatcgtggttttgatttgcatttctctaatgatcagtgttgttgaacttttttcatatgattgttggccatatgtatgtcttcttttgtaaagtgtttgcccatttttttatggagtgctttgtatttttctacttgtaaatttaagtttcttacagatactgaatatttagatcaagataaagattgattaaccacctgctatattccaggaactatgcaatgaataggtattacatactagttgcctggatataggtaacataaaatttgcagtggtgaatcagttgagatctagaagaatagacaaatgactaaggactcacagaaagtaatgcaatcctatatacaaagccaagaagtttccatcatgaaagtaagtgatatagctttaatactcctttcctcgttttggcttttctctacttaatcggctttttgtctcagcggccaaagaaatatccctaacatgtttgccttgcccaagcactctttgttttgttactatcatctcattttttcaggtcttaattaatataccaatgatggcttatttttcccctcaatataaatttagccagtatttaccctttgtagtatcctatattttgttctttagtagttaacatgtttttttaattatgcacctgatttatcgtgactgactttgttttatcctcctgtagaatttcatgaagactaaaacaatatctgttagtttgttatgtctaattcagtgtataccaaatgtctagtggagcatgtggctgtcatttacctggaatgtgtttgttgaataaaagcggatgtggacatttaatcactggtagagtgcatgaccaatgaagtcagatacaagggtttccctgtcatgtcatgcactgaacctttaatcttggctgttgaaatgggtcgggggagtttgagaggtccacagagactggccagtgctgctgaggcagcatggatgtggggctcaggtggctagttatttaaccagtacagaagtgattccatatttttaacaaccaacagagccaccactacacaatctgagcatcagcataaagaggtggatcaaacagagctacatttcatcttaatttcttacttcataatttataactccaaagctctttaaaatttgaacagattcagtcatatggttttatctcatgccatgcccaaataatcctgataacaatgtacaagaatcaaatccatttgaattgggattcaactttataacttcaaaggtgatcttaattccttacctacctgctgctgatttaattctagtgaagatatcatatgaatgcaaataactcactgttgtttcaaaaaatagttggtgtaaatgttttatattttaaatttctctatggggtaatttttttctgttgtgttgaactatttcaaaagttcatatcattttcaaaatatgattcaagtgaaatttgctaaaacactttatggtgattgtaacctccttcctatgcaagacaccagctgtggcctcacttttagactattcatatagcaagcaaagccaagagttatgttttgagctaagaacctagacacacatcaaaattagagaaggtagaattctagaaaactttcatagaattaaaactctgctacatatgtttttcccagaagttttggatttttttaacatttaataattttaaataaattatttaatctgaccattaaagctttgaaaattttaagtgctgttcatttctacacagttgcaacttctgtgtcatggcatctgcctctctttgaaatctgatgaaagaaatggctttctagtgtgaccatacaccactatctttttgcaaattttttttaatcgtcatgaaagtatcatgcaatctttgtgtatgtgtcccctacctaatatgctttgcttggaatttttgttcttcaggaacttgtttatatttttcttgttaaacatttttctgattccccaacacggaattagtcatgcatcttcagagctccagcattactttgaacagatttttattttggtattttgaagatgtattgtttgtataaggtatattgctttatatttgtttcttttcttctaacaccatgaaattcttgagggtaaggtccactgttttatcatctacacaatctaatatagtacctaaaatttagtcttaagaaatttttaaaataatgaaataatcttcccttggatgtatcttgacttttttcttattgtttcctgtttaccattagtgcctttttaactcttctgtaatttatttttcttcttagttttatagctcccttcctcctagctgttggacatagaagtaaaatgtaattcaagaaatagcctggttattaaaatatattgtcataaacttttcacctggcacatttgctctgtttacctttatgcaaaacatgatgcattatgtataatgctttctccagctcgtctattaaaggcaattaaagcaaaagtaggaataatattctgcagctgcttttacccctaggaccttctagaaaaggaacaagatgggctttggtatttatgaaatttgttgtttgttagggctcttaactgaggctaacacaacctttcacataatcttaattagatttgatgttttatttgtcttcattaggaggcagattaatttttaattaaaaaagaaaagattactgcatcactggattattaaaaaacaactttccatttcttaattctataagcaagacataattataaatgactaatgaatgtctcagggcaataatctaatccattaaattacccacttctaatgggacaaagtaaaatattcaaatagtactaattggaatatttttgaatattacttccatgaataatttgagttaaaaactaaaactcttaaaagagttcttgccagcatgagaaacctagatttcattttagtaccttgtaaaacagctgggtttagatcacaacatacttagtggtagcctaaattttatttggtatttattgttttcttcttttatttttacttcagagtataacagaaaaatattcttatgggataagttaaaatacaaaaacaagacaaaggaagcaaaaacacaattaaaacattccaatgtagacacatagatgcataagataatactgcattataagtaaattgtaaaatggtgtattgaagacaaaaaataagcaaggcattctttaaaaaagagaatttattgattgaagagttgcccgtggcaagaagaggaagttagatgctataatcccaaactgttgctttccttactgctgttttcacatgatgggagaagttcaacagtagttagtagaaaataaatgagtaaaacagtaaaggcctaaaagcctgaagtttcttgctatctaaatgtgaagtacataaacagcttgatattcttggaatctttgccttcttgggaaaatcgttgtctatcacttgccattgaaattaactttaaaagcccaatccacccggggcagctccccacgttgataatggaagggaattgaaaaaggtatgctggtaaggaattgattctaatgctggaaatttagaccatcctcagatattcacttctctatcataatttcccctctaaattcacagggttgttggatagcaatccaaatcaaatgcctcctccaaaaatttatacttcctaaagcataaaaaataaaattttgaccgtattagttgcttggcaaccttgatcaactgcagttctgtgactcctttgcctctttgacctactcatctctttctctttcattgaacttatcgggactcacacattagcttctggtttggagctattcttcagtatgtagaagtttctaaaagcaaacagaaaatcacttttactataatgaaatcaaatttaagtctgttaaaattgcagcactggaataaaataaatattatatttggagtagaaaaagagaaaaaaacaaattgaacttaaattttttttcctccaaagtgaccaatattattttattttagcatcattataaacttgtgcatttagacatttttgataagtttccatctattatctcttcatgtatggcgggtaaaagattcttcatgtaggctcctgggtcctgttgataactaagtcatctttggtaatttctttgatttttgttatgacaagatgatcatggctaatcttacataaacatttcttctcctggacctgaaatcggccatttctccaatgggcagttttagtggaaaatagtattaagaagtcataatccaggtctttttagtagacaaagctaggaaatgtttgtttttttgagaaaatacattgtgagttcattctgatgtttacattttctcttatgctgaaaaactgtaactacattaacataactacttatttactctataatattttcagaataacattagaaatattattaacattgtgattactgaaaacagtacatgattttttttgcaattttttttttttttgcccttagaatcattacagtgttttatagtcatttggagtaatttttctctgtgaggctatgttgctaactcaaaacaaagttagatgcatttgtttcattgtgcttttactaagcttgtctttttggaaaatttcatttagttttgttggcagatggttccaaagtggaaaaaaatataagatctatttagatgagtgtagcttttaaccttgtcttttcccatccccagttaaaaaaaaaaaacgattctggtttatcattgtagtttttaagtaagccaacataaagcatagtaatcactttccctgatcctttctttgatagtaacatactataaagttttctctcttttcttttttagacctatgaatatatgtatcactccatagcagcatgtgaagatatttaagctttttaaaatttgtatttccatttgcctggtacacctttgttcatccatttacttaagtttcaatgaggtacaatttatatacctcataaaggtaccatatacctcatgaggtaccataaaatttgctcatttgaagtgtacagttcaatgactgttagtaaatttacagagctatgtagacatcaccacagtccaattttacatttccatcacccaaaaagatcccttgcacccatccatccttttattttaaagctttctcagtctctttcttttagatgtacctctcacattctgcacaatgttgtcatttacttcccaaaaatattttaataggtgaattatatccatttgtatttaataatacaactgatgtttggccttagctctgccactgttttatgacctatttgtttttatgtctcttgtatttgtaaataaaatatccagtctttagttatgtgattttcttgccctgccagtctcttgtctttgtataatcttttttggtatttaggaaggcttttatttttattctaaaggttattatgcaaatattttatataatatccttatgtcctaatagttgtgggggatgctatcttttggctccccactataattaactttgaaattctcccttattttcctctcccaaaacatctaatttgaagtaataactttttatttcctgaaaatacctacaggacaatcagtaaatatattctattttacttgcattatttcccttcttgcattttcagagaaatgtgctttagttacattgtcagacttataatcacagaatatatattttatggtctcctttatcatgtagctctagttctcttcagtaagaagttttgttctgtaaaggagtttcagttagtttgagagttcacagggctagatcaccccagcactatccaacctttctgaagtctgtaaggttgcctccaagttttagcttctctcaaattgatctctaagaattctaccactaataggacctttagagatgatcaggatgctggcaacctgatatttggattctctgagccgtcccttgctgataccatgctagtcttgatgctgctgctgatttattttacccacttgtattctggagttcaaaggtgttgtataataaagaatttgactgggctttgttgctggttcctctaaagttcttggaactcaccaataggaaagtgtgtattattcatgagccccttggatcactcctgaattaatgctaagaatatgactcaggatgggggtagaaaatgccacaaagatcaactgtgtgatttgagccatatacatgtctttgagccacatgatttcagcccaacttcccaaactgcagggaatagggctgatgatcaagctcaaccacatggccaatgattcaatcaaccatgtctacataatgaaaccccagtaagaaacctgagtcctgaagcttggtagagcctcttggttggtgaacatgtagatgcgtgaggagggtgatgtaccctctgtaagacggagttgtgaagatgcggccgtataatctgattcttatttgctcttctcagagatcactgtagtattttggaaaattaaatctactttttgtatatgcaaagaagtacaaatctttattaggtttgttcattctgtaacaagttttgctttttgaacatttatttctttgattttgctacttgcttttcgctcttcctcttcaaggttgcaagtatcctgttccatcagctttaaacttcctagtttggaactgattttttgttccggttttttcttggtttttctctcaagaagctccttcttcttttgtctaagttcattgtctttgtgctccagatgtttgcttgtttcacgtaagacaatcaaccctgaatccactgcttgcaattttctactaatttcctttagctgttcttctaagtatcttctttgctctaggtccacagtgacagtgagaaactgggctacttttagagatgtgttagtagaaataactttgtttgactaaaaaaaagttttcactacatacttttcttccgctgtataaatttgttttaatcaggtttcttgtattacccattcagttctttctctggtctttccagttcctacaggaacttcatgaatataatactgacagcaaaggtaactcattacaggatcaggtgcatcaaataattctctcaaataagggaaaaatccgtattgtttaagttcattcaaaggaacttaaatttttattgtaggtcaaattgtgacttagcaatctgctgtgtctatgaaaaattcctaaaaatagaatcttctgaaaaatagcaaaaataaaccatgaaaaaataaaaaaaaaaacctgaaggttctgtaaagtgaacaagcagacttttggcagggagacaacaattggaggaaataatctacataagttgagtttcacttattttctgttcctctcctgagggcactagaatttgtggcatggcactggtcagctaatgcctcaatagaaaaacattctctcttttattccagaaaaactaggagaaggagccagggcaatcagagccagcagagaatgacatgggaggtaagaaaggagagagacaaataatggaactcaaaagtctgggcatcaactttgccactggctgacccaggaacctcacaggcacagggtacatcaaaaactttcttaacagagatttcagctgccaggctctgcaggtaaacaggtttctagtttgcgtggcaccaagttaattgcctgctaaaacaaaaacaaccacacatttctaaagggtagagcggaacccagggcctcttcagcacaatatttataatgtcctggaaacattttaaaactactaaacatatggagaactgcaaaaatatgacccactgtcagtggaaaagttaatcaccagatggcaactgcaaaatgtccctgatgttgggatgatgagacaaagactttaaagtaaatattttagctatggtcaatgaagaaattatgctcatagtgaactggaagaatagtaaatctcatcaaaatggaaaaaatatgtaaaagaaccaaaaagaattctaaaactgagaaatatatccaagatatctgcttaatcagagagtgaatgtgacaagggaaaaaaaaaatcaacgagcttggcgatgaatcaataggccccattcaatctgaaattgtgagaaaaaaaaagtgatgaaaaaaatgaagatgatcccagagagctctggaacaatttcaatatagtatgggtaattatattcttagaaagaaaggagagagggagaaataaacagaaaaaaattgactgaaaatattcctaaattactgaaaggcataaattctacaagttcagcaaatggcaaatttggatagctaagtatgcctaggcacaccatagtcaagctataagaaaaattcttgaaagcaaccaaaaaaaaaaaaaaaaaacagaaacaaaaacaaaaaaacaaaaaactaacaaattacatatgggatatgaccatttgtataactgtggactttacattagaaatgaagaaagctagaaaatagtaaaaatagatgtttaaagtcgtgagaacaaagattgtcaatctaacattctgtatcatcttaaaccaggcaaggcatagtggtgcatgcttgtagtcccagctactcgggaggttggggcaggagcattgcttgagccaaggagttcgagcctgtagtgtgcaatgattgtgcctgtaagtagctgctgcactcaagcctggacaacacagtaaagactccatctcttaaaagaggtcctcctcaaatgaacattaattaatagaagcatattaaatttattatctgcggattcgcactgtaaggtattctaaaaatatttcttcagattgaaaggaaatgttatagtaaaacttgaatctttaagaatagaaaagtcaggtcgggcgcggtggctcacgcctgtaatcccagcactttgggaggccgaggtgggctggtcacgaggtcaggagatcaagaccatcctggctaacacagtgaaaccctgtctctactaaacatacaaaaaattagccgggcgtagtggcgggcgcctgtagtcccaagtactctggaggctgaggcaggagaatggtgtgaacccgggaggcggagcttgcagtgagccgagattgcgccactgcacttcagcctgggcaacagagcgagactctgtctcaaataataataataataacaaaatagaaaagtcagaaattgtgaatatctgaataaagtttcagactatattattccttttatttcatttaaaatatttatgaatgtttaaaaattctcaccatttcgtggggttaataagtagactgcaaaaagctaaccatatatattgcaattcatggaacaatcaaaataataaagcaattagtaaaaaatacaatagataattagaatgatattctaaaataatatttaaataataaaataagcagaaaagagtaatagaagaaaagagaaagatggctgttttttttttctttttttagacaaggtctcactgttacccaagcaggagtacaatggcacaattacatctcactgcagccttctcttccctgggctcaagcaatcctcccgccttataaatcaagacaaagaagaggctttaaatctaacataatcaaaagaaagaaaatagtaaagatcattagacagcctaagaaaaaaaagataggtgacccaaataagtaaaatcagagatgaaaaaggagacattacaactcttaccacaggaatttatggaataattagaggctactatgaggaactataaaccaataaactaaaaacctagaagaaatgaataaattcctagatacatacaacctaccaagaatgaaccatgaggaaatataaaacctgaacagaccaataaaaagtaatgagattaaagccataataaaaagtaacccagcaaagaacagcctgggaactgatggctccacagattaattctaccaaacatttaaagaaaaattcatattaatcctacttaaatcttccaaaaaatggagtagaagggaatacttccaaacttattctatgaggccagtattaccatgataccaaaagaagacaaacatcaaaaaaagaaaactacagatcaatatccctatgagcattgaggtaaaaatcctcaacaaaatactagcaaaatgaattcaacaaaacattaaaaagaacattcaacatggccaagttgaatttatccaaggaatgcaaagatgcttaaacgtatgcaaattagtcagtgtgacgcattatatcaacaaaataaaggacaaaaaccatgtgatcattttaattgatgctgaaaaggcatttgataaaattcagcatcccttcatgataaaatccctcaaaaaacttaatacagaaagaacatagctcaacacaataaaaaccataaatgacaaaaccacaactagtatcatactgaatgggaaaaactgaaaacattttctctcagatctggtacatgaaaaaggagcccactttcaccactgtttttcaccatagtactggaagccagagccatcagacaacagaaggaaagagtatctaaactggaaaggaagaagtcaaactatgcttgtttgcagattatgtgatctgaagtttaccaaaaaaaaaaaaaaaaaaaaaaagaaagaaagactccctaaaaaactattagaactgttaaacaaattcagtaaagttgcaagatacaaaataaacatacaaaaatcagcagcatttctatacagcaaataacttctaaaagaaaataatcccttttacaatagctacaaataaaaagaaagtacctgggaattaaccaaagaagtgaaagatctctacaatgaaaactataaaacactgatgaaagaaattgaagggaagacaaataaatgaaaagatattccatgttcatgaattgaaagaatcaatattgttaaaatgtctatactacttaaaacaatctaataagaaattaatttcttatttcttattaaattaattcttaattaattattaaaattaattaatttcttattaaattaatttcttattaaaataccaatgacattcttaacagaaatactaaaaattactaaaatttatgtggaaccacaaaagatccagcatgaccaagctattctaagcaaaaagatcaaaactgaaggaatcacattacctgacttcaaattatacttcaaagccttagtaagcaaaccagtatgatactgcataaacctggatacatagactagtgaaactgactaaaggacccagaatgaaatttctatatctacagtgaattcattttcaacaaaattgccaagaacatacattggggaaaggacagcttgtagggtccacccttacgtggcttagtgggtgttctccctctgtgcggagacaagagattgtaagaaataaagacacaagacaaagagataaagagaaaacagctgggcccggggtactactaccaccaagacacagagacctgtagccccaaacggctgggtgcgctgatatttactgcatacaagacaagggggcagggtaaggagggtgacttttctaagtgattgaaaaggtgaaacaagtcacgtgatcaaaggacgggggcccttcccttttagatagccaaagcagagagagagaaggcagcatacgtcagcgttttcttctatgcacttataagaaagataaaaaactttaagactttcagtattccttctatcgctatgtactacgaacttcaaagaggaaccaggagtacgggaggaacatgaaagtggacaaggaacacgaccattgaagcacagcaccacagggaggggtttaggcctgttgatgactgcgggcaggcctggataatatctagccttccacaagaagctggtagcagagtgttccctgactcctccaaggaaaggagagtgccttttgcggtctgctaagtaacgggtgtcttcccagacactggcgttactgcttgaccaaggagccctcaagcggcccttatgcgggcgtgatggaaggctcagctcttgccttctaggtcacttctcacaatgtcccttcagcaaatgaccctatacccgccggttattcctaggttatattagtaatgcaacaaagaccaatattaaaagctaatgattaataatgtttatcataatgattgataattgtccatgttcatctctatatctaatttgtattatgactattcttattctaattattttctttattatactgaaacagttcgtgccttcagtctcttgcttctgcacctaggtaatcctccgcccacaaaaggcctcttcaataaatagtgctgggaaaattagatatctacatgcaaaagaatgaaactagatccctctttgtacatacacaaaaaggaaatcaaaatagattaaagatgtaaatctaagatctcaaattatgaaattactaaaataaagcattgaggaaaccgtccaggacgttggactgggcgaaggtttcttgagtactaccccataagcacaggcaactaaagcaaaaatgaacaaatggaatcacagcaagttaaagaaaacttctgcacagcacaggaaacaatcagcaaagtgacaggaaaatctgcaaaatgggagaaaatatttgaaaactatccatctgatgagggattaataaccagaatatataaggaagtcaaacaactctataggaagaaaaatcgaataatccaaataaaaaagggcaaaaatttaaatagacgtgtctcaaaagacatacaaatggcaaacaggtatatgaaaaggtgctcaacatcactgttcagcagagaaatgcaaatcaaaactacaatgagagatcatctcaccccagttaaaatgccttttgtacaagacaggcagtagcaaatgctggtgaggatgtggaggaaagggaaaccttgtacactactggtagggatgtaaattagtacaaccactatggagagcactttagaggttcctcaaaaaactataaatagacctaccatatgatccatcaattccactcctaagtatataccttaaataaaggaaatcagtatatcaaagacatatcttcactccgatgtttatggcagcaccattcacagtagccaaacttggaagcaaactaagtgtccatcgacagatgaatggataaagaaaatgtggtacatacacacaacagagtgttactcagccataaaatgaataagatccagtcatttgcaacaacatggatggagaagttattatgttaagtaaaataagccaggcacagaaagaccaacttcatatgttttcacttatttgtaggaggtaaaaattaaaacaattgagctcatggagatagaatagaacaacatttacctgaatctggggagtgtagtggtgttgggagggagagtggctaacgggtaaaaaaatatagttaggagccgggtgcagtggttcatgcctgtaatcccagcagttcggaaggccgaggccgctggattacctgaggtcaggagtttgagaccagcctagccaacatggtgaaaccccatctctactaaaaatacaaaaattagctggtgtggtggcgggtgcctgtaatcccagctactcgggagagtgaggcaagagagtcgtttgaacccaggaagcagatattgcagtgagccaagatcatgccattgcactccagtctgggtgatgagagtgaaactccgtctcaaaaaaaaaaaaaaaaaaaaaaaaaaaaatatatatatatatatatatatatatatatatggtgtattgttggattcaatttgccaaatttcttgaaatattttcatctgtgttcatgagacatactgttctgtagttttatttcatgtctttagttttgatatctcagtgacattgtccttactatatatatagttatatatatataaaacttttgaagaacctacagcaaacatcacacttaatgttaaaatattaagttttcttcttaatattgggagcaaagcaaaaatgtccattctgaccatttctattaaacattgaattggagattctagcaagtcaaataaggcaaaaataattatatagtaacatagatggatatatatatctatctatatatgtaactatatatagttactataaatatatagttatagttacatacatagatatatatatccatctatgttactatttatagttgtatatatagtttatatatggtataaactatatatagtttatactgtacaaacatctgtacatctgtacaaacatacaaaattcagcaaacaatctgtatgtgtatatatatatatatatatggttatatagttaggaacaatgaataagaatgaagaagatctggtattcaatagcacagcagggtgactacagtcaacaataactcattgtacatttaaaaatagctagaagtgtaaaattggctccttttgtaacaaaaggaaaggataaatgctcaagatgatggatcctccatttcccttgatggattactatgcattgtatgcctatgtcacagaatctcttgtgccccacaaatatatgcgcctactatatgcccacgaaaataaaaatttaaaatttaaaaatttaaacagagatactaaagaccagacttaagtttaaaaacaaaacaataaaatgtacctatgaaacaaaaacctggttctttgagtaaattaattaaatcgataaacttctagtcagaccaaaaaaagagaaaaaaaaacaataatgggagtgatgaggttgacatcattagagatcaaatagatatttgatggatattaaaataatattgtgaacaacattatgctaaaaaatttgaacacgtgaaaagcaaatataattttcttgaaaaacgtaaactattaaactcacttgggaaggaatagaccaacttgattgccccttgtctattaaaataattaaaatttgcttttacatttcttccaacaaagaaacttacaagtgtaattgttttttactataattctatcaaaaaaattaaggataagtgccgggattgcgccactgcactccagcctgggcgacagcgagactccgtctcaaaaaaaaaaaaaaaaaaaaaaaaaaaattaaggataagtatcaccagttattcacagcgtctttcagaataagaactatattccaactcactctgtgaggacacagtcactgtgatatcaaaagtaaagacatgaaataaaactacagaacagtatgtctcatgaacacagatgaaaatattttaagaaatttggcaaattgaatccaacaatacacaaaaaatgaatgcactatgacccagtgggctctattgccagaaggtaaagttgatttcacgttcttaaatgaaacaatgaaatttaccactttaaataattaaaaattaaaagttgagaaaagatatgatcatctcttcagccacagaaacatccttgacaacgttctacaccaacttctgataataaatcctaaacaaagtaggaatattattaaactttcttaacctggcaaagatcttttgaagaacctacagcaaacatcacacttaatgttgaaatattaacttttccccttaatattgggagcacagcaaaaatgtccattctcaccatttctattaaacatcgaattggagattccagcaagtcaaataaggcaaaaataattatatagtaacatagatggatgatagatgaatagatagaaagatagataatcaagcaaataaataacatataaatgagaaaggaagatgtaaaactatctttctttgtaagcggcgtgaaaagttggcattttttggcttgtggatggtcttttctctgtgtcttcacgttgtcttccttctaaatcttacccctttctataaggacaccagtcatattggattagagctcactttacaccagtatggccctcattttaacttaactaattaaattcacaatgaccctatttccaaataagttcacattccaaaatactggggattaggaatccaacatatgaatttttgaaagacataattcaaccaatatcatacctctaaaaccagaaacaacctaaatatatatcaacaggaaaatggacaattttgctgtgtttatatcatgggatacaatttagcaataaaaaacagtgaccaacaattgatacttgtaaaataacagattcatttcaaaataagtacgtaaagtgagagaagccaggccaaaaaaaatacatactttatgattacatatatataaattcctagaaaatgcaaattaatatatagtgacagaaagaggattaatgtttacctgcagatggggagggaggtttgtaggaatgcaaaggggacctaggggcagagattacaaatgagcatgagaaaacatttatcatcttgattgtcaggttgatttcacagatatatgcacatatgaattcttgtgttatgcaatttaaatacatgcagattttactatataaattctacctcaataaagatcttttttaaatacaaatatttttaataaagcacccacttttcaataggagtttaaaaatggactcaataatacaaaatcctgtaactcaaaaataaactgtttctagttaaaacaagaaaaaaattaacaccgattactgagattgccaaatggtagtcaaaaaaaatagttttgatatgttgagtaacaaaaacttgaaatatagaattttatcaaaatatatatcatagaatcataaagacagagattactcttgtctccagataatctaagggaaatgaacaagttactaattgtcttctattaaatcaaaaatatttactgccaattaaaatccacgataaattttataaataccagaagtcaagtattaaaaaaaagccattctgactgttcatccaacctaaaacaaaaatgcaaacataaaattacttattttttaatcaaaatatttgctacaatgttggtcaccttcacagtcttccaggcctggtcactgtgttaaaatgataagagagtaaaaagacatttaacatagaatacatgttttcttttggacagtaccatttttcaagggcagttcgtaatctatctggatcagacatttaacagacaaaatcctagttaccaaagttactttaaccatatgtgttttatagattgagacataaatatggatgggctttcagagataacctgttctaaattcatattaagagagacagacaaattgccagctggaaatattaaatggctttcctagtgtcatacagacatttgttagtatagccagggttaaatctgctacctcttaatttatcctagaatagctttctccataagctatcatgctgcaatttaaacatattatatatagggtaatattaagatttgttagaggagagtgacaaatacaggctcccctatactttactgctctgctagagtccctacagaatgcattaattaaagttaagaagatattaagtcagcatctttgacattgaattcatgttgcctattgtgaatgactaaataaatagacattttcatagatatttttgaatgcaaatggttaaattctacaacatgagaatgaaggctgaggacctaatgccagagattgtaaacactgataaataagctatggctcctgcctttgtgaacacgatactaacagaaagggtttgtgttacataaatattaactctattatacatttattatattctagccatgagatccaatgctttgatgaaatggcattgaaaaaaactgtgagagacttcagcatccaatgtaattaacactgctaaacagagttaatgaaggtgtgagcattattacattcttaatgaaaaatatctgtaagtgtagtgagtaaacttatggtatatgttattatccaatgtcagaatctggggaaaatttacctaattaaagtagctactcttgttccagagaatagaatagagacatgcttttgaaaataagcgaagctgttagtaagtcttccttaatttttaactcatgaaatagaaaattaattggcattgtgacaattttaaattttttttggtcaaggctataaaaattactttatactaaaactcactatgtcttctgtggggtaagagtgccttagagagcaatttgcaaagtgtttaaaaaatgcataccaccttggagcattaaaaatcattatactaaatgcaatcacatacttcttaatgtgtgtatccattcaattctaattatattagttctctattcctgccataacaaattatcacactctgtgatgtttgaaacaacgtaaagttattatctcacaattttgtaagtttctattcatgtcactgaagttctattaggctgggctgatttttctactcagagcctcaaaacgttgaaaccaaggtttcagtgagccctgggaaagaatctgctcattatggtagtggcagaattcagcgtcatggagtgatagagctaaagttcctgtgtccttgctggctataagctagaggtcgttctaagttttctctaaaggcctcctgtatatcctggctcatggaccccttaatcagccttcaaggccagcagcagcagatcgagttgctgtgttttcatctctgtggtctgcccttctgccgcccctctctgactcctctttctgccatttctgactcgaacaggataacgtgctctgattttaagggctgttgtggtccggttgaatctgctggaaaatatccagcataatgtctccattttaagatatataaccttaaaaacatttgcagtgtcttttgccatatcaccaacatattcataggtcccagggtttaggacatctttacgatagggaggattcggcacacctcgtatgtgtttaaagggagtacatactttttggtaactttgccaaagacagcctacccccatccaccaaggaacttcatttcaaatcattattaagtagtttatgtgaaaaacataaaagaagcagcctgtgaaatatttacttatatatgatacatgagggcacatgactagttttgttttatttgtatcagactatactctatgcatgtcattgtctatcagtccttatacacattttttcgccagcacatattttatctttctgtttatattacacatgaattatttctagagtgataatgcatttacaaatgtaatatgttacctgacacagaatagttgctcaataattattgtttcccttcctttgttcatgctcattaacttatttgatgttccttctgtccttgttcctaaatagttaccaaaaacttacagaaggcttacttcctcatctaaactttgcagaaatattccacctcacaattgctcttccctgacatattacatcatttcacactacaaggtaataaaagaatatactctgccttgtattaattgatacatttctatgcgtgttacttttgctctgttagcaatgataggagaaggcctttcaaaatgcaaaactgtactctcaccagtgtggttctgagcacatagcagctgttcaataaaactgtggactgaagccaattattacttctacgggaatatattttcgagttagggagacaggtaagagattaaagagatgtttttatattagatgaggaacatgttattatctgattcacactgaagcctaggaagtcaaggaaaataataaagtagctaccagttttcttgtttttcagtgggcttattattaactatatggggttattttcagtggggttattattaactgtgttaataataaaactttgatcacagacaacacaggttcataataccttatctgaaattccaaagccacatgagttcttaaaatcaagtgtttccaaagctcatatgccaataatacctaacttgaaaaaattaagccaaataagaaaataatgcgagtttttaaagtagtttccctttatgccatttagtatgattattaacacatttttggcagagattttaacgtggttgttgcagatgctgcctcaaaaacctgttaggacatattgtatttgcaatgcaatacttttctgagaaaaaagaaaaagaaaagtgtgaattctgaaacaaatttaagtcaaaagttttggttggaaatggcaaaatcttacctctgtaaagcaataaggtcactctagcacaaaataatgaagaaataccttcttgtaggtgaattataaatataaaaatatgttttaagactcgacaattagattcttagtgtagtatttatatattgtctaggtagtttcttatggaaaggtctattagaggaagtgggagactttctcaatgataacagatttttacaggtcaaatttttcaaacaggtattgaatccactatatttccttgagaacttatgcctctgatcatactaatgaagcttagttgtgtatttattgttggcacacgtctaaaatttaaaaataaatatgataattaagatgctgtataaactgtaatcactaaattttctgtttacatcactcaattaattatcaactgtataaatgtataaatactcacattaagtattcttcattctgtggcagaatttcctatgtaattataagactaataatgatgaatttgttgaaaaaccataattgaatagtacaactagaaaacatctggctctagaagcttatgcaaaatatagttttactgtgaacaaataaatggtattagcttttatcttttatttcacaacacagccttaattttttaaaactatattttgaaattttgaaagcgttttcttatcttctgtggggcagtggtccattcaacactggagaatgtgaaaactatagcaaatgtactgccggctgtataatataattcatctttgtagaatgaatgcctcattggaagaaccaatagtacatctctactacagaaatctccagtggaggcaaaggggtatgcaaattactttattcaaaatttctatctaaatatgtttaccctttatgtcagaattcctagcattgggtaaagaaatcgaagttagcaagtgagaaaagtgaggactagatcaattgtgttattatctgtccaaaatgaacgtaatctctactttagtgatgctagaagacaggaaagaacaatgtactgaaaaatgccaaagcatgaacataaaataccttattcacatttatggaatttggaagtaaaattatgtttattttattttgcataaaaggattttatgattacaaacggggagtttccttttggaattcataggggaaaaatccattctgtttgagtaacaatgagaactaaaacttcttgctggcttgcttcgcacaccccaccaaccccatcaaattagtaattaatcaaaatgtattggtttggaccaaattaaaaatagctcaaagtaataaacattttggcagtttaattttattattatttaatttagcttttttattttgatcatttatttttttagagacagaatcttgctctgttacccaggcaggagtgcagtggaactgtcatagctcactgtaaccttgaagtcctgggctcaagctaccctacctgcctcagcctccaggagcaggaactattatgtcttttactttatacatgaataaactgagggaaatgcagaagtattggagttgaactgtttggccacaggaggtgtaatcttaaccactaagctatacaggctattctctgcccagaatcatgcctgtggattctgcctgcacgtcagaacatgcaaagggagacacagttctgatatgttattagagaactatgtaaagtgaagactgcctctattgctgagggaaaacaaagatgcacaatttcaatgtgattttatgtggttagtaatctgtaacatttattatcttgttgtatattatccggggaagtatttgattgtaataaatgtcttgcaacttccatgtctagcaagaatatattggctcattttcattacccatcaaaatggattagatgtctttaaagttatctaaagcttagtaatttataattaaagttttccttatataattttcaatgtatttgtgtaatagcatttgcatagattatactcagttggacaatattatctatagttaaaaagatggagatttttgaagagttagttgtaagagaaaaataattgtatgttagaccagtttattctcgtcagatattaaaattagccatgtagggcaggtagaggtcagatgtattttcttttgattaaataaaatgctgaaactaggtattaataaacagacaaactagcatgctttaagcaactcaggcaaaatccttacgactgaaggcattggggtttagaaagatcaaagagttctttcatggtatattattagtaggtagcagtgctgagatttgaatccaaatctgtccctacagttccagcggatcaaactgctttatccaagccacaggcattggcttgtttgtggattatacttttctaaatttactttgctgaggttacataaatctgttggatttatctgtagtatatgttggctatttaatgtggagggcatattctagagctaattgggcagaagttaacaagatgctgcttgctttactttgcaaatactgggaggaagaacaagttgttgccatttcagctataaaatctcttcactcttcaaccgtatttccaagagcttcaatctctttcatcacatattaagtccagccacacaatgcaaaatgcaaattagaaagacattgattatacaccgaaataaactttgagatcatattacacactttttaacacttatttcctggtatctgtgcaatttcacaaacatttcttgagctcaccaacaatatgtgagattctaagctaggaattgataatataacaagaaagaaagcagacaagataactgtccccatgaagctcacctttacacagaggtaaatcaattaataaataagtaaacaagtctatgtagaatacatcaaagtgagagagtgctgtgtagaagaacaaatcaaggttagggaaaacaaaagtgttggaggagggaggctcattctgatatttatttagagttttcaagaaaggcccctataatcaagtaacatttgagcaaacatgtgagtaagaagaacatttccagaaaaaaatgagctgaaattataaaggtttggaagcagtaaaaagcatggtttgatcaagaaacaggaaggggttgctcttcctatgttaattttcttaggattatggcctctgactacatgcatgatgctgcaaaggacatgatttcattctgttttatggctgtgtagtattccacggtgtatacgtactacattttctttatccaatctaccactgataggcacctgggttgattctaagtctttgctattgtgaatagtgctgtgatgtacatatgagtgcatgtatctttttggtggaataatttattttcctttgggcatatacccactaatgggattgctgctttgaatggcagcttgcttttttctttgagaaatctccagactgctttccacagtggcttaattaatttgggtgatgagattcatacccaaacctcagcatcacgcaatatgcctgtgtaacaaatcttcacatgaccccctctatctaaaataaaagttgaaattaaaataagaaaagaaacagcaagggggcagtgtggcctgggcacaaggagcagagagagctccagatagaactccatcagagctgagcctcatctggtctggtcctggctcagctctgatggattttgtcttccctcctactatcagagatgtggaatagtctgactcggtaagaggatctttaggggtatggtgtggaatagactggaacagagcaggaagaagacatagggagactaggtaggtggttactgcagttgcctgggtaagagatatttttggcttgactcagggtggtggcagtggagggagaggagatcagtgattcatttggggatattttaaatttgtgatgctgctaattgtttaagagaaaagaggttgcgtagttcagtcgggcttcagaggagatagttaaaaatataagacaggagattgaatgaagttagctacagagacagagaaggagaatatacagaggtaacaatgataaagagagcaaggactttatgagtcagagagaataggcagattcaggaccagaaatagaaggtatggctggggtatgggaggagaagcagagggagcagggcctgggagctcaagtggaggaagcgtttttaggagggaggagacatagatttaaatgctactattaagaggtcaaatagaaactgaaaactgatggccagttttatcaaaacacaggctatcgcagctggaaaagaactgttgtaatgttgtaatgaggtatttggaatgaaagtgtgattgcagtgagttcaagactgaaggagagaaaagggctggataacttcatgaagttttggtgaaaatggaagcagagaaatagggcataactggaggaggttgtggattcaatatagttgttacttaaaggtgttttctttgttgctttttttaaacatggaataaatatgaatagtatgcttgaacgttaaagagaaaaacaaatggataattcaggagggagagaggagaattgccggtgtagtgccctccagaacctgaaatgagaatctgtgggccacagaggggcacgtttgagcagctgcttcgacatctgggtcatggtcatggtgatgaaagataggtagggctaaaggcgacaggtcaatggaatgttactgagtgcttgtgaatgctacttttcatgatttctacgttctcagtgaaatagaaagaccattgagccgggcgaagcggctcacgcctgtaatcccagcactttgggggctgaggtgggtggatcacctgaggtcaggagttcaagaccagcttggtcaacgtggtgaaaccccatctctactaaaaatacaaaaaaagttagctgggtgtggtggtgcctgtctgtaatcccagctacttgggagactgagacaggagaatcgcttgaaacccggaggcagaagttgcagtgaaccgaaatcacaccattgcacttgcaacagagtgagactctgtctcaaaaattaaaaaataaaataaaataaaaataaataaatcactgagaatgtaggtgaaagttttttaaagatttgaggagagaagtgagagtaagaactaataacttaaaagaataaaggagaaatagactgaaaaatgaagagggatcataccttcgaggattaccaaagctagaattttcgtttgtttgtttggcctggcggtggggtgaggagagggagaaatgcttttagtcaagtttgttttattcacataccattctcttaataaagtttttattctttattttagaagttcaaggaaaataagcacactgtgctgttaattaaaataaatattttttctgtaacgtcctaaaagaatcatgagcatcctacacttatttaaaccttttactttttatttctaaaatggtgttgatgctaaaaatatttgaatgaatgaaattctgctgaattttgaatcagtaggccctgatccacaaaccagttctttcctgtgtgattctttcttctgcagaaccttttaactgtgaaggattccttcaacttactttgcatgaaattatgaagacagtgcttggggaaagctaactatatttccctttcctttaatagaaacagaaaaaaatagtgttagaagatggtactaatatctcccaagtggtatatatgccatttaactatcacaaaataattgaatgaatgacagttataatcattagaatcataaaattttggaactagaaagtgtcttccagatcatctaatatatttaattcataaaagataaaacaaagatctagagatgtgagaagtttgctgataatctcaaaccttctgatgaacttaaacaaacattgctttacaattagcttgatgcccttttcactgatcactgtccatcttttttgtctttaatccatttctttgtgttaaattatttagcaaattgttattcagtaatataattgctcacattattcagttatgaaattgtttgtatattaattaagaaaccaatacacgtccagtggaatgctttgctctgtggatgctatcacacgtaatgggttgaatagtgtatcatatcttcccagaatctcaaaatatgactttatgcagaaatatgatcttcacaaatgtaattaaggtaaggatcaagataagatcttactggatgagggtgagccctgaatccatagggagtcacaggagacagaaaaaaacaggatacacaagtacacagataaagcaatgggcagatggaggcagagattggaggatgcatctgaatatcaaggaatgacaatgattacagaaaccatcagaaattaggcgtgaggtttggaatattttctccttcagacttactggaaggaaccaaccttgtgacagcttaatttcggagcctcctgaactatgagacaatacatttctgttgttttaagccaccagtttgtggtgatagtcctagaaaactaatataccatagaagaaaatatcaaagcctatgacctggaaaagcagtaaaatagaggaaaaagaaaaaggaaaaccagttcgttagcctatggccattagtaagcattactatgatgcctccccactcaattgataaacatgtcccttgttcattggagttgaactagaaaaatgaggttttttaatttttataatgtataacagcaccacagtctacattacaaaggctgtgtgatgccatattactggacagccctccagaatttgtcatatatttttccatgccaatactgaaaaatatttgttttatcagtaccgcctgagaactgtgacacataatatggataaaagagcaattatttaaaaactagccactccgtacccgtttctgtgctaaggagctttacatatgtgagctcatttaattacaaagcatctgcattggcatctgtgttagtttgtcattggtataaaaagtgaccacagaagtaatggcttaaaagaacacacatttattatctcacagttttgttgggtcacaagtctgtgaatggcttaataggggcctcttctcagggtctcaaagatgcagtgcaggtatcagctgccctatgaacatctgaggctcagggtcctcttgcaagctcattctacttgttagcagagttcaggtttttttttttttttttttcatgttcttgttgaactgagattcctgttatttatttatttatttttattttttatttttttggctatgggctgtgggtgctgtcagcaactaaagtgtcctggtcatgtggtccctccataggtagttcacaacatggatacctcctttttcccaggccagcaggagattgcctgcatctctctgactctctctaactctggcccagatttaaaggcctcattagattaggtcaggtctatttaaaagcaaactagtaagggactttttattttaaaggacagggtcttgctctgtcatccaggctggagtgcagtaggatgatcacagctcaatgcagccttgaacttctgggccgaagtagtccttccacgtcagcttcatgagcagctgggactacagatatgtgccactatgcccagctaagtgttttttttttttttaatttaaatttttttttgtagagacaaggtctcattctattgcctaggctggtctcaaactcttgggatcaagcagtcctccttactcagcctcccaatgtactggtattataggcatgagccaccctgtccagtctaattagggatcttaatcacatcattcccatatagcataagcaaatcatgtgaataaaatcccagaacatctgcaagttcttctcacactcaaagggagaaggttatgcaagaagtgtccaccaagagatgggaatcttggaaccaatttagaattctgtctactacagcattcctaacaaataatgtttactgattcctagtttgtactttcatacataattctcaggtgtagaatattagtcctggcagggattttggagattgttagcttgctgttctggctccttgcttgcatttccttgtttctttagcatttctttttatttaataagtttttagaataatacacgtaaaacacggccccagtgatttcacgtttgtgttctcatttattagaaatggcttggctgtagaaactactatcagtgtgaacaggcaacctacagaatgggagaaaatttttacaatctgcccatctgacaaagggctaatatccagaatctacaaataacttaaacaaatttacaagaaaaaatcaaagaaccccatcaaaaagtgggcaaaggatatgaacagactcttctcaatagaagacatttatgcagccaacagacacatgaaaaaatgctcatcatcactggccatcagagaaatgcaaatcaaaaccacaatgagataccatcttacaccagtgagaatggcaattattaaaaagtcaggaaacaacaggtgctggagaggatatgcagaaataggaacacttttacactgttggtgggactgcaaactagttcaaccattgtggaagacagtgtggcgattcctcaaggatctggaactagaaataccatttgacccagccatcccattactgggtatatacacaaaggattataaatcatggtgctgtaaagacacatgcacatgtatatttattgcggcactattcacaacagcaaagacttggaaccagcccaaatgtccaacaatgatagactggattaagaaaatgtggcacatatacaccatggaatactatgcagccataaaacaggaagagttcatgtcctttgtagggacatcattgaagctggcaaccatcattctgaacaaactatcacaaggacagaataccaaacaccacatgttctcactcataggtgggaattgaacaatgagaacacttggacacaggatggggaacatcacacaccgggtcctgtcatggggttgcgggagtggggagggatagcattagcagatatacctaatgtaaatgatgagttaatgggtgcagcacaccaacatggcacatgtatacatatgtagcaaacctgcacgttgtgcacatgtaccctagaacttaatgtataaaaaaaaaagagagaaatggcttggctttccttcggtttcacttcagaacagcaatacctagagtaaaacatgagttatatattttatgaatggtattaaatagagtaaggtaatatgttttagagttctgataacatatgtacttgtttgattgcattttagaaaattagtagaagaaaacaattcttcatttctaggactaaaaatatttatctgagataattgaatgatgggggtgatttcccccatacttttctcatagtagggaataagtctcaccagacatgatggttttataaataagagttgttcttcataagcttttttgcctgccaccgtgtaataacacacgattttgctcctcattcgccttctgccatgattgtgaggcctccccagtcatgcaaaactgtgagtccatgaaacctctttttctttataaattaaccagtctagggtatgtctttattaacagcatgagaacagactaatacacaatatatgattgagaagtgctaaatgtatacattttgagaactgagagaatttgcagtaaagaaatgatacttaaattacagtagaacgtagaaggaattccccatagttttcgaaaagggcaaaagggaataaaaatattaagggaagaaacagtaaaagatactttatgtgagttgaaattttaactcagaatatttggcatgaagttattttgcttgtagataacatgatattgtcatcaattatatgcgtatatcgaaaccatggaccatcaaggaggtacttctatcaaaaataacttcaacatgcaaacagtcaaatatttgctttggtctgtcatttttctggtctgttggctctctggctatgaaaacgtgtctgtctagttggttttttgaggtgtaatctagctccaaaacttccagttgagttttattttcactgttccaacccaccaccgctttatgtagacgcagactttttttttgttgttgttgttggcaaacagtttgagaataacatggaataagccctttgctatatcttagagaatttccaagcaaagttaaaattatctaatatagttaaatgggaagcatgattaaactttgagtaatcttttctttataaaaagactagatacaacagctccaagaaatatctgtaatatttcaaaagaaaaacctgaactctacagccgactctacgtacacacactcagagaaatgagcagaatgaagaactaagcaatttgtgcttagtgcataatttatttgattagtgtaatgagctggtatgtaaaatttagaataaaatttttgtgttacaataagaaaacatagaaaacaacttcagaccttgaggctggggataaggctggcagctaagattacaagctaagctataaacttggtctcttatttgtattttgttccacttctaaataattgataattcgtgaattataatagttgttcctttagctagctttctagggatattcatctaaattgtgtactcccccgccccgacaccaccattatctagaaagtacagtttcttctacttcttactgaattgtcttcagggagactccatttctggaatttatcttttgccaactatagccaaatatttcattacagaattgattttattttttcctccatggacacatcccatagatactacccacccagcatgacatctgttaaattgttcaataaatcactctcttactcagttgccttgccaccattcaggagaaacctggggtaattgatcctgatgcagtctctctagaagatctatttcaccaatcaacagggacttttcaactgtcccactgaattctcccagcagttcccaaatgatacatggaatcatatgcttttccaaggggaaagaaatttttgaaagttttaacttcagaagaaagaaatctgtgacaagttgctgtagcctcttgtgtacttttctccaggctctcttgtaccacttcagtatcactgatttccatgtgactgctttcagcaagttttcatgatcctttgcttattgtaaatcaagcattgatgatcatccaaggctttattaggccacgaaccgatttctattggatctggctttgtgagcctagtcacaggagcaagaacttcatttcatggttgtcttaaaaataatgttaggcacatcatcagtcttgttttttttttttttaagttttttaatttgaaagctaaattggtaccattgacttagtgcctgacccttgcatttttcagtaagttcttaaacagttgacagccagatttaagatcagaggtatattctaaatgcttacaaaggagtggaagagagttgccaaactctatctcacgcaacatctgctctaacacgttgttggaagaccggaaatgcaattgagatattagaacctcaaaaaaggctaatacttattattgaagaagcatcagtatgacaaggcatttattcatcaaggtttctcgtgtgcttattttcatcttaattatgacacaaacctaaacttcttaagcgttcttaaaaaaccacccccatcagcatgctaaatgagaggcaaatcaaagcaagaccctggggttaagaaaagaatgttcaaaggcttgttaagaatcttcaattgaaccattaacattatactattcttttaaaacaattggagtaaaataaaaataatgaatctgaagcttgagcattacattttcctaacaagatataaatttttaaaataaaaggaagatttctcttagatttgaatgaatctcaaatgtagtatagttaatttcatttatgagctgaacatatcatattgctggactttagatatattaatctgaattggataactttaacattaaaatgttattagcaggtatcacttttgggaattaagccttctggaccttcccaaacagaaaactcattaaagtgcatattaaattaataatcttattgcgttatgtaattcctgcagccatagttcaataaatatttaagccatccttagctttaagagggttttctttaattgtagtttgtatataattagagccatttaaattttctttaatttttttttgtatattttacaaagtaatagaatgtactttgccttgaatgtagtatatgttttgcttatatgtttaggtttcatattatcagtaatgcaggagttagaaacatacctggaaaatgctgtaaaattatgatttgatctccaaagggtagttctacataatgaagtagatgctggggctgagttaatttctgggaaaatgtatgcataagaaatactcttactataccaagaaatattctagcctctgtgtaaagctgtcagggaagtctttgtggtacacttataattcgcaaacaaacagatctgcaaacaaacagatccttgaacacagacgcttttagagcaaactacagtctaggaaacaaatgtgatgctaactttttgtaagactaagaatggttttgacagatgagcatttgtgataggtttgatagtaaggaactctaactttgaactccagttaattgaaattttatctcccttatacataagttccattcttctcatcagtagacttctattagcaaattttaaaaagttatcaatttttgtgattgcatttattttattttattttattttttactgatgcataatagatggacatagtttgtgggtatgtgtgaataatttaatacatttgtataatttgtaaagataaaaatcaatgtccttgcgatatccatcaccttaaatatttgtcctgaatgtttcttttataggtattttaaaataaaaaagagaagaacattttatttatgtatttatgtatttatttatgtatttatttatttatttatttatttatttatttattctgagacagtttcccttctgttgcacaggctggggtacagtggcgcaatctcagctcaatgcaacctccgactcctggattcaagcatttctcctgcctcagcctcccgaatagctgggattacaggcttccaccagcacgcccgcccaactaattttgtatttttagtagaggtggggtttcaccatgttggtcttgagcccctgaccttgtgatctgcccacctaggcctcccaaagtgctgggatttacagatgtgagccattgcgcccagccaatattttttatttttaaatttaatttaattttacattctgggatacatgtgcagaatgtgcaggtttgttacactggtaaacatgtgtcatagtggtttgctgcacctatcaacccatcacctagatattaagccctgcatgtattaactatttatcctgatgctctctcccccacaacctccaatgacagatcccagtgtgtgttgtttccttccctgtgtccatgtgttttcattgttcagttcctacttataagtgagaacatgtggtgtttggttttctgttcctgtgttagtttgctgaggataatggcttccagctccatccatgtacttgcaaaggacatgatcttctttccttttacggctgcgtagtatcccatggtatttatgtaccacattttctttatccagtctatcattgatggacatttgggtggattccatgtcttttcttttgttatacatatatatatatatatatatataaaacatctgaatatatatattcatatacatatatatttgaataaatatatatatgagattaattaactatggtcaccttactgatctatgtatgactacatcttatttcttctatcaaaccatgcatttatacccattaatcaacttttctttatcaccccttcctcttacccttcctagcctctggtaaccaccaatcgactctcaattattgtgatagcagttggaatttcatcaatacgtatttgtgaaaatggttttatcttttgttttagaagtacctatatagccttgattttgcctcttgattctcaatcttaaaatgtttaccatctagccttttgcagaaatagtatgcccacttctgttttagagcaacatgtgaatgtatactaaaggaccccagtcggttaagagcaacaactttgtattcaaagaagtctaaatggagttcaggaactaccatttctgaaatcgacgatcttggacaagttacttgcactcactaagctttaattaactcatctataaagataagtcataggattacaatggagttaacaataatggcacctatttcatagggtaactttaaatattaaattgccaggagcatagaaagataccaaaaataattatttatggtagtaaaacaaatattcagatgtttaagctggttttatatggaaagtcagcatttggcaatcccgaagcaaagtcacaatcacagaaggcaaatctattccaaatacttcaagtgagagtttgaggcatgtgctcttcctttatcagagttttgtttatttgtttactttttgtttgtttttcccttgctaatgattaagggttagatttaacaaggcattatgatcaattacattctgtgataagtcacatgtttgatatatggatacctaccaagcaagaggctttctggaaaggagcccctcccgccccaaacctttggacctgatccaaggtgttttttttttccagaagcttgatgtcttcacctctacagacctaggaagtaccagacaagtttgcccactgaagttgtccccatgtccaattgcccaattggaatggatccgagtccttgactgtattaactaactttcacataaaaagactgagatcccctttcacctgtatctcctggacggccacctcaacttatctcctgttgatctctggtctacatgaaaaagggaagtaactctgcaccattgcttcatagccgacttctatgaagcaagagggatgccaggctttcctttaaaaaatgaaacctgacaccattagcaagtacctggtaaggattcttttctaaacggccagagtacacctttgcccaagaaagtctccttagaggagcggtagggaggaaatccagtggcgatgcctggcatgggaagtgtccagctgagaaatggaggctcccagaaatgggcatcttttttttctctctctctttctcaaaaaagccacaaggaaggttaagtggccctctcttttatgcagtgtgacgttatgtatccgatagccccaaggaagaatttcagaggagcacgtgcttggtcacagagtgaaacttacataaaacaagtaataaaatggagtatattaagttatcaatgctttaacctgatgatactttagcatctaggaacactgaatcttagcaatagcagtgaataccgaaagtttccatttgcaatagcatgactttttgcatatgaaaaataaaatgaaccaaacagaataaattatccagaatatttcccattggtattccgtaacatcacaaggtattgtatcttctttaatgtaaagaagattgaagatgtggttgatatgctttatggtggctgtattttcccaagatgaataacttgctttttatgaacatttcaaaaacagatgagagatctatttgcatacctcattaatgatccctttttttaagtaggaacatgttttcaattttatatatccataaacatctcttttcattatgtgaatgaaaaataatatgtcatctgccagaatttattcttggctaccagtgtttgaaaaatctaaattatgctaaagatttcaacatttgaaatgaatgaattacaatagtgatattactcataatgtgttgatagcatattaggctcttactttcttgctttggttcttctattttcatttcacttggccaccatcccctttctgttttgctgttatttatgctttctaatctgaaaatgacagaaatatgatgctaaggaagaatgtttaatttttagacatttgataaaacagtattttctttaaaaaatgtatttgttattacagacaaagatttctcttagaggtgttttttttctttttctttctttctttttttttttaattaattaattaatttttttttttttgagatggagtctcactgttacccaggctggagtgcagtggcatgatcttggctcaccgcaacctcctcctcccaggttcaagcaattctcatgcctcagcctcctgagtagttgggattacaggtgcgtgccaacacacctctctatatttttgtatatttttgtatttttattagagacagggtttcaccatgttggtcaggctagtctcaaactcctgacctcacacgatctgcctgcctcagcctcccaaagtgctgggattacaggcatgagccattgtgcctggcctagagggcttctttttcttattcttactcttcctgtttatgatataacatgtcacaactgagaaaaaacaaataaactattttttatgtctaaggcacattcttcagcccacccactgctcctcagaatgatagaacactaactacgaatgttagtaaacttaggtaaaatgtaattatttgtgttcaaaataaccctaatataaatttcctggagggaattgcatgcatgacttcacttttctccattcattctaaagatatttattgagtgtctgctatgcattagaaactgtacaaggcacataagttaccaaaatgaatcaaccagctcagttctcataaattcaaatgagataaattaaataattagaggaagagtcatatattataaaagtatacacattagaccttgagaggacataagaggacagtggattttatgatcaaggaaggcttctcagaagaggtgatatatgaactgagcttccaacaataaataggagttagccgggagaaaagaggaatgtcgttccttaagcagcatatgtgaaaatttggatagccagactgcttttaggactttatatactaagtaataagagagaagcctgaaagcgtaggttggaaactagagagtttgtattcatgtggaattaagaactttgaagaagtttaagagggaaataactatagggaaaaatgaaattttcattttcttagataagtgccatgcagataaaacctttcccatgtgtaagcccagacgttggcttgtctttcacctttttgtggaagtttcttttccccacacacagtagttttcaattttaagataaacatatttgtgagaacttttatttttggcttatttacatccttaatattttattttatgaaatctggatatgattatagaatttaatatgtacaagctcctacttcagttcccttgtaaaataaagatacttgggcatagagagttaagtgacttggttctttgattgcctttttagtggttaaacagcactagaagccagaatttttcatgttcttaggtaagtgttcagtgcaattgaacacagggaccttttcctggactacttttccacttccaagatcacagtgaatattctaataaggtatttaaacaaacaatcacagttgtaaacatacaagtccaaattggaatgattttaggtattagtttgttaaacatgcagtctgtgccaaaaagcacactaattgttcagctgctcagaaagaacctgtcaaatcattagaggtggtcatcagtcagatgatatctcttttccaagtggcagctgttcctgtctggagtgtagaaaatcaccatgaaagtatgctgtggattaaccatctcatctgcctgtgctattagaagaaacttgggaattttctttataaatctgtcgtttttcttacagatttctctcagtagctacacctttttaatcattataaatttcaacagacattttctatcaaaaaacatagtatcattgaaggaatggaaactgtatctaattctaatacacaaaaatatttacatctgtatttatttactagcaattcgtgaagtggaatatcaggctaattctgaaacattctgctgaaagtttatccaaatagagaaagtattatattacttttgaagagtcagaaaaaaatattataatgctagaccacttagcttattagaggaggataaatccaaacaataaattatatcatcaatcttaactggagaaatgtagtgacactgaggggaaggggagtgaaattccttttcatttattcatcttttcaaaatttctcactcccacctagcctcattttcttttcccttccctcccttcctttctgatatggtttggctctgtgtccccacccaaatctcatcttgtagctcctataattcccacgtgtgtcggggagggatccagtgggagattattgaatcatgggggcgggtctttcccgtgcagttcctgtgatagtgaatgggtttcgtgagatctaatggttttaaaaaatgggagtttctctgcgcaagctctctctttgctgctatccatgtaagacatgacttccttgccttccaccatagttatgaggcttctccagccacatggaactggaagtctaattaaacctgtcttttgtaaattgcccagtcttgggtatgtctttatcaacagtgtgaaaacagactaatacacctttcctcttttcccctcccctctcctcccctgtcttttgcttcttcccttcccttgtctttttttttttttttacattagacttcttttgaaaactgcaataaggaattgctgttccatctagccccagctctccattactgtttcctttctctcactccccacctcaggatcctgaagttgatgtgtatctttgtcattcacttctcgtgtgatttttgtgagatatgcatatgcccaagacagcatacgtgtgcacttttccaaagcaaatttattattgtttatgtatgttttatgttcataaatggtgtgatgctgttttgttctgtattttctctttaactcagcattatgtgttttagatttattattaatgcagattttgttcatttatgtttgtgtatgtgtgtatttatatatgcatttatatatttctgtatccaatgactatctactatcttgtgcacacatgatagtttctacttggggacaacctagccagagctagctcatgaggcatttttatgagaaatgataggtacccatattgggtatataaaaccccatatcagtgtacatgacttgatggacacagaaaaaaatgagttgggcccctcacttactccttgcctaagccctcttttccaggacacactttgatggcaccaatacatcctagaattagaatcactggatccttggggatatatgactataactttacttggtattagcaaatttctctccagcatgtttgtatcagttatcaacttctcagtagagtttaacaacttgcaatttcccacatcctttccaaacctgtgtattgttagatattttctatttgtttctctatttgatggatgtgaagaggtacattatagtttccataatataatcagttctaagacatttataaaggtcggactttttccatgatgcccagactttggcttgcctttcacctttttatcagagtttcccccctacacacagttttcagttttaattttaagacatatttgcaagagctgttatctacaacttatatttattatacatcttaagcttaatcatgtgatggctggagaatgtgacaattctgggaatctgcataggagtggtagctacctacgagttactgtcccatgttagacaccacattctactctagtctctcaaactgcattagtacataaggctttaaaatgatatcaatgcctgtggttgtcatttttggttcaagacaattgcatcaatagtgataaaatatcgagctagatacttggggaaaaataaaacattccaaagccaagttaagtaaacagatgaataaaagatttaatggtaaaatcattttaccatttaacagtaataaaacccattatgaagatgctgaaggaagatataggtgaatatttttgtaatctttggggttcaaaaatgtttattaaattttaatgtaactggccaggcacagtggttcatgcctataattctagcactttgtgagggcaaggcacctggatcacctgagtctgggagttcaagaccagcctggacaacatggtgaaaccccatctctactaaaaatacaaaaattagccaggcgtgatggcaagtgcctgtaatcctgttacttgggaggctgaggcaggagaattgcttgtacccgggaggtgcaggttgcagtgagcccagattgtgccactgcactccagacttagtgaaagagcgaggctctatctcaaaaaaaaaaaaaaaaaaaaaaaaagaaagaaaaaaacccaaaaaacaaaaaattttatgtaacttgcaggtcataaataaatcgtgattacatttgaatacctaagggaaacatttcgtgtggcaaagcactgtaagatatgaatacaacaatgaaagtaaagagaaatctaagaaaaagataagacatgtctttgaaacaaatgtggcacacaaagcatttctattttcattaaataaaaaatttagaaaccacaagaaaataattacatattaatagaaatgttaataatgcatacaaacaagttactattaaagagctgttaatactcaaataactggtcttctagtaattgcgaataaaaactgaggtgttaatattatgcctactagattggataaaaatcaggatttatcagattaaacaagattagttatttaaaatatgatagttaaaaaggtagttttataaagcttgaaatacaacttatatggtaaacattcaattggtgatacttatgcaattatagcactgcttggggatatggagaaaacagcactcatatattcactgaggaggtttaaattagtatagtcggtgtttcaaaaatatactctgactgcagtatataattgtttggtaaaattaagtgtaaggttaaatgtattaaaaactttcatcaaatcagtgtttataccagccgcaaattggaaagagcttaaataatcacattagagaatttgattacattaattgttgtgtatcaagataagcaaacactatgatcccttacaaatcacacatttgtaagtgggaaacactgctaacaagggtttagactgtaccataatttttttttttttttttgaaacacggtctcaatctgtcatccagtctggagtgcagtggcgcaatcttagatcactgcaacctcaacctcctgggatgaagtgattctcatgcttcagcctcccaagtagctgggactgcaggcacacaccatcaagccccactgatttttgtatttttagtagagaggggttttcgccatgttggccaggctggtctcgagctcctgacctcaagcgatccgcctgccttggcttcccaaagtgctgggattacaggtgtgagccaccccatcagggctgtaatgtaatatttgtgagataatgtattatatttcataactatttaaatatattaatattactagtttatattatacagtttataatagatgaactatgtatgtatatttaaataagttaatacatatgtgtatgtgcatatgtacatacataatcttttccattgagcaagcttgacctagtaaaattcataaagaaagctgctttgtttttctcagaccagtgcttcaatcacagtctatcagatcctcattggctttggatgatatttttgacaaatcccatatgcatcagtctgggtcacatcaggaaacagatggcgcagtcagcattgaaatataaaggagtttaataaggtggtgtttacagagataatggtaagatcaaggaaactgagaagaaatcctgaagcacccagggactcccgacagtgggagctaatgcgctgtagccctgcagaggtagggttagagagctgaaactgtagctgggggaccccacagggatggtccccatgggtaagaaacacaggcactagccagctatacccgtggtataagtttaggtgaaataaataccttgactgtcctttcctccctgtctctactgctctgctgctacctcattggctgggtataatcagaagctgaagacatgggagcccaggtcatgcagtgtgtggagttcactcttctgggcaaggagcaggaagaaaagtgcaaaaaatgcattagatgtgcaaacggagtgaccggtacagtacagcttcttggtgaattttaggccttcagttatctcattttcaagtttcaacgttcagccaagtttatacaaaaatgtgaatctcacatttagcttaaaatgactccctttccaccccacggcattcaggccgccctgaactccgtattgtacagcctttttctctcctcccctgcccatcgttttgcctgtggcttctccaggacagaggcaggtcttgtgggatgtgaatgagagttaagaggacattgacctttatactcagttagtgttgtttcttgctctagagcaactgaaaaatacttctcatcacggcaagcatccagaatgatcaatcatttatgggctacttagtaggatagttacggaccatcacctggtaaaccatatccttgacatgatccatgccctcttctcctgctgtttggagacatctttcagcttctgtcctttggtgatgtcaggatattagtgtctgcataggtcacctgtctgagttacctttccactaatttatagctttgtatgttgtagaaaacgggtaggaaagcatgtgattcatttctacagtaatggaaattgtgtctggtagaatgcaattgattattgctctatggattcttgccagctttgcatttgcgtaatagatgcaaaactggcaagaatccattttttcataaagaggacaacagaaatactgcagtactgttcatattataccttagacattctacagtataatttgcatctattacgcaaattataatttcaacgttcctggtgggcttttatatttgtctgtcctttggattcctttcatgaccttttactgattctatcatgagcaaatgagataaaaactttgattatgtgtttgttttgtaagagagtcatgatgtcatcttttttttgtttttctttaaatgctgtttaacagtatagcataactcttgacttctagtatctacttgttccagcaggtagggttcttcctggatgacttagccatatctgactgctttcttctggtcgatgggaattcatgagcccttggcccactttgctaccactcctatactcttgtctcattcctctgttcagtatagctccagacaggcttgggtcaaggaggaagctttatttagtttgaaggcacactcaatttctcaagccctatgttttgtttttcatttggagcctttttgcttggcttaaaaggagattaggagaataactattctccctttttttcataaagaggacaacagaaatactgcagtactgttcatattataccttagacattctacagtcatctccatcttagacccctgattcaattgtttcatcttccctttcattttcagagccagttagctgttgttgtggattgaatttcctggaaagcaggctctgagatgaagagtagtatgctaactgattggaattgcttttaacttaagtgatgaagtgaagaaagcaggatttgggaaagagagaggtctagctgtgatacagtgtctgtaaaggccttaacagctcttgtggaaagctctgaggctgggaaggccttttagagttttcctaatttgattaaagaaggctggtccttttaagttctttatcattcagttaatggatgtacaccgccccttggaaggggcggtgtgacattggaagtggtagctctctttagctaagaacaagttgtgtgggaggcactctagctgctaaaagtcagaagttgggaaaatgagtgttttgtcgtcgagtgggtaggcccacgaatgacaatacagctatcttttatcatgtataccattatagaacattttgatgtattttttatttttttaacttttttttttttaggttcagggggacatgtgcaggttttttatgtatgcaaattcatgtccttgggatttgtcgtacagattatttcatcaccgagtagtaagcctagcacccaatagttttttatttttttaatcgtctccctcctcccaacctccaccctcaaataggccacggtgtgtctgttgttacctctttgtgtccttgtgttttcaacatttagctcccatttataagtgagaagaagcagtattcggttttctattcctgtgttagtttgcaaaggataatggcctgcagctacatccatgtttccacaaaggacatgatctcgttcctttttatggctgcatagtattccatggtgtatatataccacattttctttatgcaatctgtcattgatgggcatttaggttgattccacgtatttgcaattttgagtagtgctgcaatgaacatacacatacatgcatctttatggtagaatgacttatattcttttgggtatatagccagtagcaagactgctgggtggaatggtagttctgtttttaggtctttgagaaattgtcagactgtttttcacaatggttggactaatttattatccaaacaatggtatataagcattgccttttctgtgcaaccttgccagcatctgttatgctttgacttgttaatgatagacattctgactggtgtaagatggtatctcattgtagttttgttttgcatttcactaatgataagtgatattgatatttcttccatatgcattgttggctacatgtatgtcttcttttgaaaagtgtctactcatgttctttgcccactttttaatggggttgtttgtttgttttcatataaatttgtttaagttccttatagatggcaggatattagaccattgtcagaggcatagtttgcaaatgttttctcccattctgtggattgtctgtttactctgctgatagtatcttttactgtgcagaagctcttaagtttaattagaacccatctatcaatttgcttttgttgtaattgctttcggcgtatttgccatgaaatctttgccagtttctgtgtccagaatggtattgcctaggctgtcttccaaagtttttatagtttggggtttcacagttatgtctttaatccatcttgagttgatttttttatatggtgtaaggaaggggcccagtttcaatcttctgcatatggctagtcagttaccccagcatcatttattgaatggggagtgttttcttcattgcttgtttttgtcagctgtgccgaagatcagatgactataagcgtgtggccgtttctgggctttctattctatttcattggtctattcttctgtttttgtactagtaacatactgttttggttactgtagccctgtagtatagtttgaagtcaggtgatgtgatgtctccagttttgctaggattgctttggctattcgggctcttttttgtttgtttgtttgtttccatatgaatttcaaaatagttttttctagttctgtgaagagtgtcattgatagctggataggaacagcattgaatctacaaattgcactaaacagtgtgaccattttaatgatattgattcttcctatacatgagcatggaatgcttttccaattgtttgtgttacctctgaattatttgcagatacattcacagctgaattctaccagatgtacaaagagcagctggtaccattcctactgaaactattccaggaaatggagggggagagactcttctctacctcattctatgaggccagcataatcctgataccaaaacctggcagatagaacaaaaacagaaaacctcaggccaatatccttaataaacacgaatgcaaaaaatcatcaacgaaatactagcaaaccaaagccagcagcacttcaaaaagctaatccactatgatcaagtagacttcatccccacgatgtaagtttggctcacaacatgcaaattaataagtgtgattcatcacgtaaatagaactgaggacaaaagccacatgattacctcaatagttacagaaagggatttcaataaaattcaacaaccattcaggttaaaaactctcaataaactagatattgaaggaacctacctcaaaataataagagccatctatgataaaccgacagtcaacatcatactgaatgggcaaaagctctgtcccttgaaaaatgacacaaaataaggatgtcctctctcaccactcctatttaacatagtattgatagtcctggccgagcaatcaggcaagagaaagaaataaagggcatccacataggaagacaggaaatcaaattatccgtgtttgcagatgacatgatcctacatctagaaaaccccatattcttggccgaaaagctccttaagttgataaacaacttcaacaaagtctcaggatatgaaatcaatgtgcaaaaatcactaagagtcctatacgccaagccaagagtcaaataaggaataaactttcattcacagttgacacaaaaagaaaaaatatgtaggagtacagctaactaaggaggtgaaaggtctctgcaaggagaattacaaaccattgctcaaagaattctattttaaatttaataagaattataaataaattttattcttaaacctaaaatttaaaaataacattgcaatttggtatctgctattgttgttaatcttaggatttttttctatactacaaaattactcattcaaagtaatatatgtgtgagaatataggctattagaacatttatttattagctcattcagttgatatgtactatgctataggtacttgactagactggggatgtagagatgaagacacacaactttccctataatatggtgaagtagagtgccaagaacagacatttaaaccaaatatggggtaaacaccataacacactctttgttctgccctgattagcctgggccttttgtggtgcaagtggcttctgttgtgtaggtagaggcagtctaaagctccttggctcttgagcaagaatgttagggtttgaatcttccctgctgctttcagatgtgtaatattgggtaagtttcataattcctcttatctcctcatgtataaaatgtgggtaatatacccttgtaaaaataatgatattgaacttaaggagtttaacacaattcataaattaggttaagaactcataacaagctgacattaatagcaattattattgctaaactctagctttctttttctctgctatcttacatttaatctgttaatgtgcctccttctgtctctacttaatgctagtgttgtaaaaaaatttcttatgaattttaaaatactttttctaattctctgaagaatgtcattgacagattgataggaataacatttaatctataaattgctaggggcagtatggccattttaatgatattgatttttcctatccataagaataggatgttttttcatttgtgtcatctgattttttttcagcagtgttttgtagttctcattatacagatctctcacctcccaggtgagttgtattcttaggtattttattctttttgtggcagttgtgaatgggattccattcctgttttggctcttggcttgactgttgttgttgtatagtaatgctgaaaatttttgtacattgatgtttttctcttgaaactttgctgaagttgtttatcagtttaaagagcttttgggccaagactatctgattttctagacatagaatcatgtaatctgcaaacagggagagtttgacttcctctcttcctatttgatgcactttatttcattctcttgcgtcattgctctggccaggactttcaatactctgtttaatgtgaatggtgagagagaacatgcttatcttttgctggttttcagggaaaatgcttccaggttttgcccattcagtatgatgttggctgtatgtttgtcatacatggctcttaatattttgaggtgtgttccttccatacctagtttattgtgagtttttaacatgaaaatatgttgaatttaatcagtagccttctatgcatctattgtaataatcctgtgatttttgtatttagttttgtttatgtgatgaattacatttattgatttgcgtttcttgaaccaaccttgcatcctggggatacagcctacttgatcatggtggattagctttttgatgtgctgctgtatgtcattcgcaagtattttgttgagaacattttcattaatgttcaccaaggatattggcctgaattttttttgttgttattgttgtgtctgtgacaggttttggtatcaggatgatgatggccttatagaatgaactggggaggagcccccctctttaattttttggaatagtttccataggaatcatgccatctcttctttgtacacgtgatggaattcagctgtaaattcatctgggcctgggtttttcttcagttggtaggctatttattactgattcagtttcagagcttgttactggtttgttcagggaatgaatttcttcctggttaagtcttaggaggatgtatatgtttagaaatgtattcatcttttccagattttctaatttgtttggatagaggttttcatagtagtctctgatggttatttgtatttccgttgggtcagtgataacatccctgttgttgtttctagttcgaacactttgatttaaatgtggaggcacttagcctatgctctaatcatcattccactttaacaagaattttaatagtccctgttttatgaagtacatatatacatacttgtgtatgtgtacaataatctttcaatgcatataaaatatatgaaaagatagtaattaaaatactaaaagttggaacctctaggtgaaaagattttaggattttttcattttttacatattaaatattttgaatttcctaaattaaaaattcaggaagtaaagttctgaattaaaaacaagtgagcaaatagcaacgacaacaaaaaaaacagcatctcatttagttcatgatagaatttattaaagatgatttggcaacccttggctttcagaatgaagacttcaccactaccacgcctgggcaaagataccaaaagttacattgctgacgctgggcataggatactatgactactgccaaagttttgatgactgtatgatcacatttgcccaaaaacgaattccatgtggacactcacttaccaatcagttttgtatgggtgtatctaatccacaaggtctgtgtcaccttcaggaattataaattagggaaatctccaaaatagaaaatgtattagaaagatgttgagtagacagaaaacatggcaattgaccattaccatgtatagccctaatataaatagaaaaaaataaagttttatttatttgacaaatttcttgacttctgacctcctttgcacaaacctattgtttatgctttgaaagtaatttttaaaaataaagttggaatacgaattacctagttgaactatgaatcagctagtaaaactagcttgtgttcacagtgttgctgcttcttctaaggtgtacttttccttatttgtaaaatagaagcaatgatacctgttttgccggcttattgtttgtatcctacaaaattatttttaaatggttaacttgtagtagacattatgtaaacagtaattgagtattgttaatattactggtatcattcttgtcattgttgtattaacatgaatagagcaggggtcacaagatttttaggctgattatttctcctgagatttttggtaatttatgccatttttttaaggaaaataaataatattgacaatttttctattggctagaaaaattgtggctattcccaatataaatagaaaaaaaaagtaaatgtaagttgtcctgtcagaccctgtgcatacagaatatataccacttttctcatgagccacactgttctttagcttcttgggaaatgtatgatattatatatttttcttgtcactggttttcctcttctttgttcatgatatatttacttgtagttattgctgcaataatcgtgaacattcttttttctgaacaagggaaactcagtaatgaagctcttggtttgtagttagaaagaggataatactgtggtataaatttataggtgaattaaatatttatttcattcttagaaataaaatttctaaagatcacttgaccatgaaaatattctagggcagctttctggtacagagcattcttctatttattattttaattaaagatgtcttactgtatttcactcagaagtctgtcttcatcagttagttttatagtaaagatgacatatttgagatgtatctttacttgaaatatttttgtataatttatgtaaattatatttggcagtagctaagataaacaaaaagggactttaaacatcaagaattatatctaattttcaaaaatgataacatataacataatgcaatataactatgtgattttttttctcttttaactacactgtaaacttcaggaagacaggtgtcacttttctttccattctaccctagtctagcacaagaaaaagtataatagctaactttaaaaaatgttttggaatccagaattaataattttgcaagactatgggaaatcattatagatgttattaaaagcattttaatatattttactctcatactctaaagaaactttgccagctataatttgctaccggaaggtgaagaaggattgaaaatataggaaatatactgaaattaaataagaaagtggctccttcacacaacatgctgatggaactggcatatatcagatgcctgggtgtagtaaaaaaatttaaaaaatgaaaaaaagcggcgttctttggcctgacatggctctaaggattcagagaaagcatagaacctgcagcttcaacagcacggaagcagaggagtggaggataccttcaacatccctgaccttttattgtgctgcccaaggaactggtttctgtcctgcctcacttgtagcactgaagaaattcccacagtttggagggtcagctaacaggaaaggaaaatgagcaggtggcttgaagtacccggcgcatctcaatgagattgggataagctagaaaactcaaagcatctccatagggaaggaggaagagaagtagactgtgccattagcatcacagtctgcagtacatcaacatctgcgttacaacagccagagagcaagagattatggactcatgaaaaaaaaaaaaaaaggaaaaccaataaatctcatcttaaaatgacatgcataagtccagagaagaaacatctgtataaaatatttgagagcttcccagaatctcaaattagagtgtttggcaaaactctatctgtgtcaaagccagttggtaaatgtaacagagagttacttgtttcttcaaatgccgagatggcaaaatatgcaagaaacataatcagttaaacatgaccgaatgaagagaacaacataaatattatataacagattcaaagcaatagagatttatgaattgcctaaacaagttttcaatatacttataaagaatttcaatgagctgctagagaatacacataaataactaaatgaaatcaagaacacaatacatgaacacaattagaatagggacaaagtgattaaaactatttaaaaaaggtgaaattctggaactgaagaatacagtaactaaactgaaaaacttactgaaagacttcaataacagattttatttagcaaaaggtagaacatttgaaataatcccagtcagagtcgcataaaatgaaaataaagcataaaagatgacataatctcgtatgtagaaaacattaaagaccccacaaacaaaaacaacagcaaatgcaaattgttagggctactatatgaattagcaaagttagaagatgcaaaatcaacacacaaaaatcaagttgtgtttctatacattaacatcaaactatctgaaaagaaaattaaaacaatcccgcttaatatggaataaaatacttagacttaacattagtcagtgatatgaaaagcttgtacacttaaaactacaaatcaattatgaaagacattaaagaaatacaaatagataaaaaaaccattatgttcatagattgaacacttaatagtgataaaacgttcagactttcctaatcagtctacggatttactgcaatccctatcaaaaatctcaatgacttttttttttttacataatttgaaaagtaattgtaaaattcacatggaacctcctcccctcccgcaaaatgccatgaacagccaaagaagttttgagaaagaaaagcaaagctggaggcattatacttcttaatttcaaaatacattacaaagcaacaaaaattaaaacagaatgatactggcataaagacagacatataaaccaataggacagaagagagagcccggaaataaatccacacctatatagttagctggccttcaacaaagatgccaagaatacacaatagagaaagagtagtctcctcaacaaatgacattggaaaagctgaggattcacaaacaacaacaacaacaacaacaacaaattcaacccttatatacaaacatcaactcaaatggagatttgaatgtaagatctgaatccattaaacttgtaaaagaaaatataagggaaaagctttatgacatttgtctagggaatgttttcttggatatgacaccaaaagcacaagcaacaaaagcaaatacagacaagtggaactacatcaaactaaaaacttttgcataccaaagaaaaaggtccgcagagtgaaaggcaacttactggatgagaaataatatatgctagctacatatccaaaaggggttaatatctaaaatgtataaagaatttctacagctcaatggcaaaataaaatagcaaaaggacctgaatagacattcttaggaaaacttttgaatggccattgggttaaaaagatggcaaaaatgattagtgaatcatcagaaaaatgcaaattaaaaattccagtagcacctgacacacatcttacagtgatcaaaaaggaagaagacaaggaaggaaggaaggaaaaaaggaagaaggaagttaacgtgctagggagaatgtgaagaaattggaacacttgtacgctggtggtgagaatgtaaaatggtgaaatggtgcaactgacatgaaaagcagtatggagattcttcaaacacttaaaaatagaacaaccatataatccagcaatcttacatctgagtatatatccaaaataatagaaatcagaatcctgaagagatattaatattcccatgttcattgcagtactaatcacaatacacaaaatatagaaataacttaaatgtccattgatatataaatgataagtatattcaaaaatacatattttagtttatgtttacataatgtatagttaaattatgaataattatatcaatattttagaaataggagttttttttagatagatgtctctaagttctccttaactacaaaaatttaagccactgtgaaggggaactttcatgatacaatttttattcagatttatgggctccttaaatattattaaaattgattaggtgcggccaggcgcggtggctcacttctgtaatcccagaactttgggagaccgaggcgggcggatcacgaggtcaggagactgagactgtcctggctaacacggtgaaaccccgtctctactaaaaatactaaaaattagccaggcgcggtggtgggcgcctgtagtcccagctacttgggaggctgaggtaggagaatggcgtgaacccaggaggcggagcttgcagtgagccaatttcgcgccactgcactccagcctggacgacagagcgagactgtgtctcaaaaaaaaaaaaaaaaaaaaaaaaagcattgattaggtgcaccactgaaaaacaatcctacatgtgaggcttatgttgtcagtgaaggaccccgaagtcttaaggtaaaggagaaacaaactgctgggttgttgttcctgggttgtttttcgaggagtcagtgtttggactcatggggcttaacatcaaagtcactaaaacatgctgaatggaaaactgtacacatggtatggggttaccagtgtagctgcttgtagttatctgggcattagataatacaaaataattcatctattcagttgcgataaatagattatctgtataccaatctttattgaatctttaagaatacattaagtagaggttttcaaagcattcagctaccattgaacccgcaacaaaaaactggaaagatatttggcagaaaagatcaaaggagaggaaaggaggagcgttctaaaggaaaagaacatcagtacgtgtacaaaaagagggaatttttctgagaatatagccaggcattctccaatgaggcaacactatatgtatctataaactgaagtttgttgcacagaaggattctatattacataaattgtttttcacaaagataaatagttttccatatttttgacatcaggtacacagtccctggcttttgtttattaaaatatgccctgtagtaatagttaagagaactttaccctatatatgttgaagggcgttgatgtttttaattttaaatcaatctgtattgtatttctgatttttggtatttttataatacatatctctatcatataaatttctcaatatttgtccgaacgcatacacatatattgacaatatgtcttacctccttcttggattattggattgagttttcccccttttaattgtgattcaaaggaatggaacaattttacaattacaaaaaatgaggaatggaacaattatttacatttcataattgttctgggcttttcttagactttgaacatgtgtttttcccttctgcatgatttctttgaggtacttcttgcctggaataataataatgtaaattttttttattaacattttttgctaaataaaactaatattggtatcactcttccaaggatatcatgcattccaatttattgggtatgatttagaagaaataagactatgttattaatgcttgcaaatgaaaaagcacctttgaatgcttcgaatttgaatcaacaagtagtaaattatctaactgccttttctatatttaacattggatttatcctcatttagtttttttgttttgctcagtttttttttaacttttattttagtatcagaggtccatgagcaggtttgttatatagttaaattacatataacaggggtttggtatacagattatttcatcattcaggtaataaccatagtaccagacagggagtttttggattctaattctccttccaacctccaccctcaagtaggtgccattgtctattgttccatagacattgcctttgtgtgcatgtgtgctcaaagtttagctcccacatacatgtgacaatatgtttgttttgattttctgttcctttgtttgctaaggataatggcttccagatccatccacgttcccagagaggacataatttcattcctttttattgctgcatagtattctatggcatatatgttctgcattttcttaaccaatctgccattgatgggcatttaggttgatttcatgtctttgctattatgaatagggctgtgataaacatatgcacaaatgtgtctttatgtagaatgaattatattccttttggtatatacccagtaatgggattgctgtgttaaatggtagttgtttttagttctttgagaaatctccagaccactttccacagtggctgaactaatttacattcccataagcactgtataagcattgccttttctctgcaactttgtagagaattttgaagttggggaatataaagtctccagttttgttctttttccttaggattgctttggctatgtgggctcctttttggttccatatgaattttaggatagttactttttctaattctgtgaagaatgtctttgttagtttgataggaatagcatggaatctcatttacttttaacaggagaatgttttttaaaaaaacatgtatatttatacccataaaccttttacagttattcaaggtctaaatttcaaaaagataaattaaataaaaaggtgctctaagaacaaataactttttaaaggtcctatataagaaaagcattatgaaattatataagattgtatcattgctagttctatacgttattactaaatataaaaaatcacacttttctagagtctttctgtagcttgagcacagatgtcatctgaactcttgtaaaagggaaaatgatgatccggttcttacacaatttgtatgtaacatataattttatatacctgtcacaaataacatttctgtcacatatttataggaaaacagaacttatgagtctcaaaggtagcaagatgggagaattataattcaatatgacaggctccattcaacaaatggaaaattcttagggtaaattaggaagtttttatttttcgtaagtgtcaagttatccaagtatgttttggataggagtctttgaagcacatctttgcaaaatagtgtggggtgacttatacagtcaaatctcaagtaacagtattgtacactgcttaaaaacctggagcagcattccacaacatacagttcagtatgatattctgtgttaaaaatatttctctgcttaaataactgggagtcattataaaatgtttctccaccttgacattattctgtacaaagtaaaggctttaacaagtaaacttgtttgacttttactttattttattttatttattttattatactttaagttctggggtacatgtgcagaacatgccggtttgttacataggtctacatgtaccatggtggtttgctgtgcctatcaacccgtcatctacattaggtatttctcctaatgctatccctcccctagtcccccaccccacaatgggctccagtgtttgatgttgccctccctgtgtccatgtgttctcattgttcagctcccacgtatgagtgacaacatgcggtgtttggttttctgttcttgtgttagtttgttgagaatgatggtttccagcttcatctatgtccctgcaaaggacatgaactcatcctgttttgtggctgcatggtattccatggtgtgtatatgtgccccattttctttatccagtctatcattgatgggcatttaggttggttccaagtctttgctgttgtgaatagtgccgcagtaaacatacatgtgcatgtgtctttatagtcgaatgatttataatccttttgttatatacccattaatgggattgctgggtcaaatgatatttctggttccagatccatgaggaattgccacactgtctttcataatggtttaaccaatttacactcccaccaacaatgtaaaagcgttcctatttctccatattctctccagcatctgttttttcctgactttttgatgatcaccattctaactggcttgagatggtatctcattgtggtttcgatttgcatttctctaatgaccagtgatggagacctttgtttcatatgtttcttggccgcataaatgtcttcttttgaaaagtgtcttctcatatcctttgcacactttttgatggagctgtttggtttttcttgtaaatttgttttaagttccttgtagattctgaatattagccctttgtcagatggattgcaaaaattttctcccattctgtagtttgcctgttcactctgatgatagtttcttttgctatgcagaagctctttagtttaattagatctcatttggaaattttggctttttttgtcatcgctcttgtgttttagtcatgaagtctttgcccatgcctatatcctgaatggtattgcctaggtttttttctagggtttttatggttttaggtcttacatttacgtgtttaatcatcttgagttaatttttgtgtaaggtataaggaagggatccaggttcagctttttgcacatggctagccagttttcccaacaccatttattaaatagggaatctttttcccattgcttgtttttgtcaggtttgtcaaagataagatggttgtagatgtgtggtgttatttctgaggcctctgttctgttccattggtctatatatctgttttggtaccagtaccatgctgttttggttactgtagccttgtagtatagtttgaagtcaggtagtgtgatgcctccagctttgttgtttttgcttatgattgtcttggttatgtgggctcttttttggttccatatgaaatttaaagtatttttttccgattctgcgaagaaagtcaatggcagcttaatggggatggtattgaatctatattactttggggagtatggccatattcacaatattgattcttgctaccatgagcatggaatgtttttacattggtttgtgtcctctcttatttccttgagcagtggtttgtaattctccttgaagaggtccttcacgtcctctgtaagttgtattcctaggtattttattctcttggtagcaattgtgaatgagagttcgtttatgatttggctttctgtttgtctgttatcggtgtataggaatgcttgtgatctttgcacatcgattgtttgactttaattacactgactttcctgtgggttttgttgttgctgttcagtgttttgttttttggccatatgatttgttttcccaaaaattgttgctgatattttgtggaactaagtgttcaatgaaatgtatatttgcaaacactgatacaatgtaacatgaatctacactaagagatttatatcccagtctgagtagagatgaatactgccttcttctgcatgatggttctcataaaaaatttgttgaagataatacatgtttgcagaacattctcagttttgacaacaaaaaaatactgtcataatttaaaaaactaaagaattggtttgctttctaagtgactatttcagttttgtattcacttggttagatattttgattctttataatttatttaacattattttcccaaataacatttttctaagataaataatgccattagaatagtaacaattttctatttaatatgagaggcagatatatcgtatttgactgcagtttgtgcattttatatttttatttacatttacttaaaaagtcagtataatgtacatttaaaaattttacaatgtattacatgtatatattttttgaatatttccaatataaatatgtttctaggaggatataatacagtatgtagaaactctattctaatgtaaacatgttattacaataatttaactaaagtaatatttaaaattaaaatgtgcagtatttttgaaaagtatgcttatgcatattaaaattatatagtgacatgaactaactgacataaattatactgtcccagtaagtgcagttatgttgtcaaattttttttttctgttacgtgaaatatatggcagttattaaattttttatttcgataaaattctttcatttttaaaaagcacaaaatgcatgttaatctatggaaatcttaaaaatttaacattgtttcaaaaaatgcaaggttttgaaacaggaggtttaacaaagaggaaaaacaataaaaattataagatgacagcgcactcaagctaggcaatgatatttttctgaaaattaggcttatcctcatgaaaaatcatggacttcattgttctgtggaaagaattaacatttaccccaagaaactaagggtgtgtgtcagattatgtaaacttaaggtaaatataattatacagagttccctatacatctcaagtaattataaagtaattatgtgaatggccttgagttcatttgagtcatgtaattttcagataaaaatagagtatttttattagtgtagaatgaaatttagatgcaactaattaaattttctatagaaatgcagttactaaaggaattctacttaaaatttctcctgttgcctattttacgctaagaaaatttaaccttttatcttagaaagcaatctaattttgttaccattgttagtttttggaagtagggaatttgggtgtttcagcttaagacaattttcttaaaacagtctattttgacttcctgaataaagcatcccaattgtatcttaacttagttgataaatgtatttgaagagaggttaaaacgattaaaggtaaactttcaggtactgtattattattagctgaaacacacctccagaacataagattcagaaagatgccaacttactcaatgaacaattgatattttcagccaagtaatttaccttctgtttgttgatttttgagacaagttttcttttctaagatcatgaaaaaagactagtctacaaatcatggactgagaagccaggctggcaagaattgtttcacttgaaggatagcatctgcctattatttgtgtattacatatatatttcaattgttaaagccatcatggaggggaccatatttgcaaataatggctttgagttaaacataaattctgcatttttatgagaataattgccttcaacttttgactactttttgcttatccatttcctttaattttcaaaatatatataattatataaactatatatatcaaagactgatcactgttctaaggcaagtaaacatttggaatttccttggattatcatttgcacatcattacagaacctagtgtcattgcaggacacaaagaaaaccattttctgataattaaaataaattttgcctttacacacatatgttaaatatatttctccattatagcagaggaacttaacacagtgttgcagataaaataccattttttacattttcttgcagcatttgaatttcagaatatatgaataaattatgtaaaaaagaactgtacatgtttaaaaaatagctatcaagttcaaacattgctctaacctttcttgcatgtactcttttaaagttaacagtttttgcatttatcacattatcaaattaacccaactggatcaatattacttcaactaataggagacaaaaaaatagagcacaattgtatgtaaacatttcctgaatgtggattaaaatgttgattataaataacacaaaacaaaaacaatgagaaagataaagttcaagcagattaagttcaattacttttcttctcactggtcttcaatatagtaagtatttttttaacctttgtgattatgatctgaatttgggcaggccactctcttggcccggaattaacaaagtaactttaccttagttaaagtaaattattaaacaacacttaaatactatttcttagaagaatgtgtattttttttagaagtccagatgaaatttgtattaatttgcttatacctgtttaggggatggcaaaaataaggtatgtcatttttttttttttaaccaatgtgggcagttaatggataagtctcatactgcagaggcttgggatgtattttagtgtcaccactgataataggtatagcaccaaactgaactgattcagctttggaaaccacagagttaatataatgcaaaaggcagtttcttttaagttgctcatattagatactggatctctgtttccattgtttttctgtgctttaattgttctaattacttcttactattcattttccatggtgcctatgatgagataaccatgaacacaatcacaagttggattcaggaaaatgacctggcctgtatactataaaatataaaatctgaaatttcctagttgaaaagttatctgatccagacttctctgtataacgtattgatagtttcaaagttgaatatttgggcttctaaatgctacagtgtttttaggctaatcaatatggttggctatgaagatttatcaaactataccctgaggtaccctaaatagtataaaacattaggataccccattttaaaagaataatttaccctacttctgtctcatttatatgattccacctccttttagggttttttaaccataatttaggttcataatttaatgtgttcattgataaatatttttaaatgccttcacagtaattcaaaatgctaataatttatcacttaatcattataacatttcagggatagaaagaatcatgccaaaccataatgaagactacaaataagatattccacaatgatgtgggaacatctgactcaacagatttgtccgagggagggaggggagggctggggagggagggagagagagagagagagagcgagcgagcaagagtgcacaaaactgtgttagcttggcatatatttagtggtaatactcaggttaattttatagctaactcattctaccacacctcacatgaggagaaaaagaaactccaaaataaatctttagacatgaaatgagccatactgagagtttctagcattttataaaaacagagtccagatgcaatatggcccccggtagaatgtgattacacaatgagcacgcattcatattactcaggacatcaaggttcacatttcccatcactagagtccccttttgagatttttggagcgagtgggcattccaaagtaaaaaaaaaaaaaaaaaaaaaaaaaaaaaatagatgcttagtactgggtcatcctcacactcaaactagcctagttttcctcatgccaccggtaggtaaaatcaacaggaatgatggtctgtgttaaaatagaatttgtccaataccatgagaaagtatcttacatgtgagtcattgaaaatgtaataccagttcatgatttagaaagcaactgtagatttaaaaattacagtaaaagtttattcttgctttttatttctctagttatagcattcttttatccatttgaaatccagcataatatcttagccactcatctcttgactctattttcctaattgacaccctggtattcaaatgtttgaggaggcgcatatcctactacagaaggcctttataattagaaatgataaagttcttatttttaacacacttctcataataaatgaaactcagcctgtgaccatgccattgcttattttctttatagaattttccacatcatgacattatctcgtttatttatttttatgttatttgtagtctccatttctcccactgcccaaaagctccaggagagtttggccttgcctatccttgtttgattgaccaggttgttcagcagcacctagaataatgcctgatatatggaggtgcttcttactatttattaaatacatgagcaaatgaatgaactaaaatatagaaaaagtaatacattaatttctctgaaacacagttttcttgtctataaaacttggattagttgaacttaattcaaaaatttttgagattataattttaaaagtaaccaattaattcattgtacaataaacaatatatgcttaattcgtgttagtttatttacttttatctttgaagagcatactaccaagtaaagttgttatccagaactcagataacttccataacccagattattccattgggtactttgaattacataatggaccataatttgtcaaatgcgtgacaacttgccacctcagttgccaccttccttattcctttcatttcagtacatagctccatatgttatacttctatattagaataaaaaatatgatagcacaggattaaatacattaaaactgtaaaggatactaaagtaacattgatgcatctaaaaaatatttggcattcactccccttattttaccatcaggaaacaggcccagtgttgagctgaaaggccttgagatcatctgactgaaaaaatagaacagatgtgcgagtgagtcaatcattccagaactttgacactacaaatgatcatgccacttttctggagagcttaaacttattcctaaaccattctcaatatccagggttccattgtgatagcccttttcaactgatcagagttagcatgccaagtgaaatccatgtacaatcacatcttgtctaaacttctcacttagattaggtgtatatagattattgaatgacatctaaaatgaaacacaggaattaaagtctgattttttttacttcaaatttactgatcctccttttgaaaaaataaaattcattttacttatggatttatatttcttcaagataaataacaagtcattacaaaataaatacagacttcaaaagatgaaatgtaaaaggaaatgtatatttattcttttaattttttaattagaagtttcaattcttatgaatttttgtctattagacttttgctttgaggtaatttattaaatttatttttcaagactttcagcttacttttaaatattgacttcatattctgtgctgtgcattcaaaacttagtggaatgtcattaaatcagctataaattcaagatgatctataaaatctaatttagtaattcagttgacccaatggaacaaagtattacgtatttctagaattttggctatgtctttcttcggctttatatttccttaattaattttgaaagctaataggtgacttttcttatgatgtctcaaaggctttagttgtggtgcccagtgaattcagaatcttgtagcaagttgtaaatagtaggaaagtactgggtttatcgtgttcttaaaatttagagttttaccaagactttttatctacaatacttttaaaattgttactcttttacattgcatgatcaactcatctatagacactattatataatacacataaaactgtataacaagagaaactagatgcctttttggaaaaatatctggctagttcacagatgctttggatccattctatttatgttcgacattttacacatcttggtattttatgcatattttaaggattcgtaattgtgaatcaattgaggttttcatgctttgcagtgctctgaacaatcccataatatcttctgtaactgttaagtaaatagataaaaagcactaaaattattaataaatctaataattttaataaaattaattttaatgttaaaattttaataaaattaacacatcaggttttcttcatccttgaataaataataatctcttagatttaacgtaaggaaatattttatatgttatgaataaatggtgtatatgttctcaaaagttgagaatgacgtatctatactatttccccttaaatctttggcctacaggaaacttaaacatacatgtaatattcaacacacttaatagtcatattgtttatcctttttgttatttctgtctcctctatggtttttctttaatatttttgtcttactccatattgtaagaaaacttacatccttctggaaacagctgtatagagaaaataagtaacatagaaaatatggctagatctactaaaaatatctgcaaaaactaatttgatgtaacatttagttgtagcttataaaatatactaagcattattgttggactaagccagtttactcattttagcttcatgatttatatgcaccacttaaaaaaattagtgatttggccatgtttttgagaaactgttgagtatatatctataatctgcccttaaatctttttttctgacatagtctttctcttttttgtatcaatggtgtttctttgagtgatgaaaaaactaggtgttcaatttatattttaaataaatcaagtgatctttttttcagttagaataatttttattaactaaaaaaagtattagtgagtactataaaatgaagatttctccattaccataaaacgtgctttcagggcaagtaataattcttaccaagagggaaagagaaatgtaaaaaaaagccttcgcttcaaattttgttatgtgacctccccatagagggtaagcttctacctggtaattagaagaagtaacaggaacgtttaaaattcacacaggtgctatttctggatcagttattttagtgatacaggaatcatggtgatattattttagtgatacaccaattgatgaaaacatcaatataatattgcactgaattacctggctaaatacccattcccaacctctattctcaatagtcccatgtgtaataataagagcttatgtatcagtccctgtccctggttcttaacacagagcacctaaaacccctgtaagtagggatcctaggagaacttttcgttttcatatttggtctttaagccagttcctgacacagaattcctaagaccttggtagtttcctgagtgatagtagtgtcttttattcaaatgcggtgcctctttgtgggatcctggaaggaagctggtcaccaggaagaccaagccatgactagaagcttgggactgacagcctcactctccaatttctagcaggatgtgggggtgggaggattggagtatataattaatcattcctgtgtgatgaagcctccataacaattccaaaactatgcggttcagagcttctgggttgatgaacacatccatgtgctgtgagagtgacaagccccaactccctgccctctggacccttttaaccctcagcttacatgcctttcatctggctgttcatttgtatctttcaaaatactctttgtaataaatcagcagtaggaaataaactgttttcctcagttctgtgagccagtctagtaaattatcaaatccaaggggtcatgggatttgtagcccgttcagacaggaattgtgggtaacctggggtcctatcacttgtgcctggggtctgaaaaagggagaaatgtgtggcaatgagcccttaacctatggcatcagtgctaatttcagttggcattgaaatggaattaaacggtaggacatgcagctggcatgggagtattggttattgtggggaaaaactacacatctgatcacagtgttgagtgtgggtatagaaaaaaactgctttttccttatttgccccactattaagagaaagagattaccaaattcaggcattactatggttggtaaatggcctaagaatctgctggaaataagtattcaagtatttgtttgcacacatatctgaaccgtccaaaactttcttggaaattaaagtcatagaatagatatgcttccctgagctgaaagcactcatttgtgttctgtttagatttaatatcaggaagtctgcatgaggaatgtaaacggttgtttttgtttttgtaactaatatctggaacagtgtgtagagacgcttcgacagcaaagaaaaaagctaatagtgactctttggggggaaaaggtttctcgtgaatactgtttttgtcttagttttggaaacaatgtggcacaatgtcacttacaaggtatgtacaatattggactggatatattgctaaaagttaacaaagtccatgccattgcctcaagtcctcctggattaagagataaggtaacaaggaaatgaagaaatacatcaaataagtaatgattagcatgtgtttatattattgtatatatattgtattatatttaccattgcatatatgtgtatttttgtgtgtagtttgattatgtatatgtaggggtataagtttgtgcacatagtagttttttttgtcctatcccaaaaatcaaatcagagggactctagaatgaataaactattagctaattgtttgataaactgtggtgattttatcgttaaaattcttcagttttattagtcatatatttaaaagggacagtgtgcccaggttttcattagagaagcattttatccagtatagatatatggattaagcttaatatttttaaaacatacatcttaatttaactgatttttaaaatacagaattgaaaaggtctctactgactaatactcatacccctcttctttgaactatttttaaaaactcaagaaaataaatgaaatgatatcatgtaagtttttatcctctttgttttgactatcacatttaatcatggttacatagtagcaccaaaattaggacaaattacaagaatcacaggagagatcttaaattatatgagctcattgcatgcttcaaaaggtctcatttcagagaaaaaaaggtttccaattgccaaaactttgctgcattttctctcccccaaaatataccccaattaagttccatctaaacaaaagatacaatagactgatttttgaatagatatgttatctacagtttatagggcagacagtccatttaaatagaaaaagtgattttacataaagcaagatagagtacaaaagcacagcttttgtaattttggtaatattgcaattttacaaacatgttgcatagtatgtgtaagaaaatagttccatttttcatatatctatatatacaagaaaacatttacatgaaagtacaaaacaaaataaatgaatagtggacctgatttaaagaattgtataaataacgagacactcaaactccagattacatatctccattgttaatgaatgtccttgcccatctttaaccctgtttggtttttatttataaatacgcaaacaaatgagatactaagactgaaaaaaacaaaaaataactacagttcattatatctcatttcctttaatggttttcattggctttctcaaaatgcagagccacctcagttaacaattaaaaaatagccctctggttctacaagtatttcaaattttattctccaaatagtgttcagcaagcagtgaaagttgaaactcagctgaggagatccatgctgggcccattttgggatacggtctttgcatataggttttatgaataccaaggagtttgttatgcatgtataaaagaaaagtggaccacactaatgatgtttcccttctgaaacaaaagcattccttaatttatacaactcaggatcctccaagaaggatgtttactacctcatgttataattataagcccccctattcatttgaataaattagtaggagcagcagtgttttagagttaaatacaatagaaatcccattctttggtctttgacatttaaacaactaataaatttcagtataaaacaacatgaataacagtgttcaattaaattattgattagtttatgattatttaaaatgaatacaaatgcaaatttcctttgtgataatgatattttgtagtgttcattactgtaatatacaccagtacatagagcaaataatttctccatatgtcattaaatatgatcacatgaacaactcttattagaccacagctatttgaagaattaggtgacaagacctcactcatataaaactcaaatatgaatttggctttgaggattttatagaaaatttggctattaaatactttcaatgattttaataatttaacattattatgttgacattctctgctatgaaatataacactcatatgcattagacgctctccaggctattgctgcctcatacagagataccatgtttgcaatgaaataatttattaggagttttattgtatcaaatgctatttttgtaaaacgaggcattctctgattgagtcattcgatagaatatgtaggaattttgaatggaataaaacagttcagcaattaacctctgtgatcacattatcatttcttcaaaagatcactgctttttagctttatggaggtaataatcacagaatgttcatatttggttaatatttctattaatttcctaaacagtcattttgaataagatccaaatgcattattttcctttttaacgtcaaccatattactgaatcctgttaaccaggcatgatttttccaaaggaaccttaatgttcaaatgttaagagtgtaaaagggagtataaaaaagagcataggaagtagcgtgccaaaaaggtttgtatttcaacttttataagcagctttttaaggtgcagaaggagatcacaaatgctagttcagatatggctacttaacctaagatttatgagtgcttccttaactgaatcagaaaaacttaaaaatgaatgtgactaaaggaaatgtctagtttgatatacccctctcacagataagtgaactgtgaccaacgtaattaaatatatgtcttaagtaggtaagttcacatgactagccaggggcagaactagaactggaattgctggctccattttccgagatttgaagtactgtaatctaagattcctaagttacagtaaaatttgaggtgtataattgtcttaaactcttagataaataattatgtgccaaattataaaacatatcattcacaataaaatatatatattttagacataaatgtgtgtatgtgtgtgtatgactaataagtaagtaccggatagaaattttggaaatgttgaacaagggaagtaggaaatttggaagtttttgttgttcttgctgtttttttttgaagtatttaattgaaatcttctgaaaaagaaaagaataatgtgtcctctttgcatctttccttttgtgatcccccaaacctgaattcagatacatctcggtttatccattcctggcaaataacttaaatgctagcaaaactaccaacctctttttcttcttccgtttgttccttcctggcgtacactgagtatgaagttattaagatacgggtaataagatagcttagtcgcatccatgtagtacactataaaggactcatttttctcagtgtcatttggggaagatgaaatttatataagtaaactgcattttatttatacatattgtaacataaagatggtactgggaaaacataatctgttagggtactgtgcaattaagggaccactatatttttaaaaaaaaaaaaatgcttttttgtgtttgaatgtggaaaacgaggacatttggggccattcttctaagccttcacaataggcttgatctctctgaggcagggatcttggcttagattcagaaatctgaaacagctagtcagataacttaaagcaattatttggtgttgaataggaaagccatcgctatcactatattttctactgtactgaaccgatttgttatatcatctggatacagtctaaagctctcaagcttgtaagttacttttgaattatgtctatacttctcagaatgcatttgaattaaaaatgtgtcagtccctcactggaatcggtttttacatctttttttctcactttttttttcatcttttctcctcttatgacatataatttaaaatttcatttttctcttttgccttttgtaattttgaaattagaacttgaattagaacttgaaattagaacatgttggaacagaaaggaaccccaagagactattttattcaatacttttgctgtgaagttgagtaaactgaagcctggagagattctcgaactgcctaaaacagctcaattgattagtagaagacagctgagattagaaacagggccagttcctaatcaaaagaattattcccatttgacttagaaagtttctaattgttttaatggaaggatgattagaacttgaatatgtcttaaattaaattactacataatgttttccttaaaagtccataatatagtgattagcacacataatttctcaatatttcttgtattatactttattttgcaaagaccaatgtgagatttcttatattaaattctcttattttaatataaattaaactcttgtgttataactttgtaagcaatcgtatatcataaattcttatttcaatattgatttaaaaagttatataataacacccaaatataatcacattttattttaacagtaataaattagcctttgaacccttctgctgagtacagtggaaatgagctttttcagttatttgatatgctaggttatgcaaacaagataattctggtcaaatatttcacttttcttcttgcattgccaatatttctactttcactaaccacatcttttgcaacaagttctaatctcccagttcactctgagctgtagacacctgaactccaaagactctacagccattaatccccaaaaggaagtttcaacacaaatgttgatagtgtgcatgagggagaaaaacgtttgattgacatgtgaaaattcaggacttaccttatagtaattaagtcatcttcccataataggaaatacttaatacagttttacattctttgactctgtaagtttcaagagtttgagttaaggggtgctgtgataaatgaatattcagtattctggagttgtttactaagaggtcatatacaaaaataagcattggaaaatgaaaagaactataatttttgaggtcagggtagcctaacaacgatctaataaaagtaaatatatgttaacagctgaatagaaatgggactaaattccctaaaatatgaatgtagtgaagtaaacacattttcaatatttattagcatttgtcatttttactgtttagtcaagaaattttagttagcttctgacttctttaaatcttaacctccaataaaaaatagatggagaataattctgaagatgataccccaatggaaagagaatttattctcagcattatgcatcatattagtattatttatttagaagatgtttgaattttagcagtcagaatcaagtgcagagtgagtggagcaaacaaaaattatactattaaaacctaggtgtaaaggatagcatgtgaattttttaaaaatcatctatggatttaataccatcaacatatccttcttaatcctgtcttatattgcaatagagtagatgttttgttaaaagcaaatacgtcacatgcagtagccatgtaaatactatataaggccatccagatctgaccaatgacattataatggcattttgttaattctgtaaaggatatattgctgagtgctttcaaaattacctgatgtacaaaattctagacttagtagacaaagagtaacagcacattgaaattaaagaaacagaaggaaaactcagggagagattctgtattgttttgttttgttctgttttgttaaaaaccatgtattgaatttaaattttagtaaagcaagcattacataatgctttaaaattttaaaagtcggggataaaagtttacatccaaaaagatgaatggaaaattgtgctttcagaatgtagaataagttttcttacagggttaaccatttcatcttgccattggatactgggaatttcatttatgtaatgtatatatgtgcagttcatatccaggtcctgcaaaaatctaaaactgtgtgcttcacttcgcgtagcaaaggcacctatgttattctccctttcgagcaaaagtcatgatccagttttcctgctgacgacgctttttccactgctgtgtcaatcacaccctctgtgttgagcagtacagtaaatcacaagagaaggtggtggcgaatccctgctcacactggaagttgctctgtggaccattcgaagaagctctggactgatcacaagggaaaccgagcagaactgtgaagcagacggacaggaacaaaaggctattctggtgtgaggagaaatcagtcacttcagctccacaggcagatgttgctactggactgacaagtggaacctactcctgctggagaaaggtaaagtttgccattggggcagacgcagagttcatacactgtctgtcgagaacttgaggagctgggtgaagaagatgagaaggagccagttggtagatttcccagcttgattgtctctgcatttaaaaatatctatgggaaaaaagaaattgcattttaattcattttagaaatgtagcatcgagtaatctacatccctcctcaacatggtctaataaggaagtcgacacaacaaacaattccatggtttagctgccatgctttgttgaacaaacaaattacattcctacagtagagtccaaaatatctgcagctatcttctcctttgggagatggtgcattctgacagaaagccctcaatctgaaaagcaacatcatacaatacgcttaaggggccaacccagttacttaaacaccacagaaaattaatgattttgacagtctctcaatttaatttcttaaaaaatcccatagatttccccgtcacatccccctgacaggcccggatgtgtgatgttccctgccctgtgtccatgtgttctcattgttcccctcccacttacaagtgagaacatgcagtgtttggttttcttttcttgttttagtttgctgagaatcatggtttccagcttcatccatgtccctgcaaaggacatgaactcatccttttttatggctgcatagtattccatggtgtatatgtgctacatttttttaatctagtgtgtcattgatggacatttgggttggtcccaaatccctgctattgtgaagagtgccgcaataaacttaagtgtgcatgtgtctttatagtagaatgatttataatcctttgggtatatacccacaaatgggattgctgggtcaaatggtatttctagttctagatccatgaggaatgtcttcactgtcttccacaatggtttaaccaatttacactcccaccaacagtgtatttctccacatcctccccagcatctgttgtttcctgacttttgaatgactgccattctaactggcctgagatggtatcccattgtggatttgatatgcatttctctaatgaccagtgatgatgagcattttttcatgtgtctgttggctgcataaatatcttcttttgagaaatgtctgttcatattcttcacccactttttgatggaattgtttgcttttttcctgtaaatttgtttgtttaagttctttgtaggttctggatattaaccgtttgtcagatggacagattgcaaaaattttctgccattctgtaggttgcctgttcactctgatgatagtttcttttgctgggcagaagcactttagtttaattagatcccatttgtcgtcactgcttttggtgtgttagtcatgaagtctttgcccatgcctatgtcctgaatggcattgcctaagtaagttttcttctagggtttttacagttttaggttttatgtttaagtctttaatccatcttgagttagtttttgtataaggtgtaaggaagggatccaggttcagctttctgcgtatggctagccagttttcccaacaccatttattaaatagggaatcctttccccattgcttgtttttgtcaagtttgtgaaagttcagatggttgtagatatctagtgttattgctgaggcctctgttctgttccattggtctatagatcagttttggtaccaggactatgctgttttggttactgtagccttgtattatagtttgaaatcaggtagcgtgatgcctccagctttgttctttttgcttaggattgtcttggttatgtgggctcttttttggttccatatgaaatttaaagtagttttttccagttgtgtgaagaatgtcaatagtagcttgatggagatatcattgaatctataaattactttgggcagtatggccattttcatattttttaatactcataaaagtgtgtggacttttaatccaaaggatatactaagtagctgatatggtttggctgtgtccccacccaaacctcatcttgaattgtaacccccataattcccatgtattgtgggagggacccagtgggagatagttaaatcatgggggcagtttcccccatgctgttctcagggtagtgaacaagtctgacaagatctgatggttttataagggggaaacccctttcacttggttctctccttctctcttgcctgccaccacataagatgcgccttttgccttctgccatgatggtgaggcctccccagcctcgtggaagtgtgaatacattaattgtctttttctttataaattacccagtctcgggtatgtctttgtcggcaatgtaaaaatgaaccaatacagtagctaatcagcacagtgaacaatatataattattgtctataattagatttgaagtctccatgaaacatattacctatgttcaatacctactttgctaaatcttctaacttggaaaatgctttattctaaatcatggactcaccactttgagagacagtgatcgtatggctctgacatgcatggagaaagtttcagaaaaagaaaaaaaacggatcttgaatttgagcaaagaaatagctctctccagctgtttcttgtttccactgatatatagcttatgattgtctgaagggtatccctaaattgacaggagtaggagagaatattctgctttctctctctttgccctccctcatctaaattccatttgttttgtactaggactcctgtgatagtcccctatctggcctcctggtggccgatttttgtcctcctgtcattgactttacatattcctagagtgaacttttaagaaacgcaaatcaaataatcttgctacactgctcaaaacactctgatgtcatcccccacacttcaattggatcctgatgtctttccatggcccaaaggccctacctacaagatctggcctatctctctaacatcatttcctgtaattcttcctcttgctccagttcttgcattttctcaaaaatagcaaaagcactatggcctcatagtatttttactatttcctcaaaccgaaatacttttctccagagatttaatgagtggggggagatattaactgggtggttgtgaaatatggatgggaggtagctttccacttttttgatgctttttaaatttctgaaccataagactactgcacactacaattaagccagaaaaagaattcatatatcataagtatatatattttaggtcaatttggatgcaaacaaatttgctccaattctccaaaggtcacctccttggaaataacttttctaaacactctattaaaataatgctaatctttcttctctcattaacagttatacttttctctatagtaaaaatccatttgtaatgttacatttgtattcattcattgtttgtttcttctacttacaataagatccatgaggatagggcctgtctttggttcatccatatagaatagggcatggaattgtgaagtgcatgaattacatgatgccttttcttcaccttgaacacatctctcccctctaagttacaaacccacctcccaacaaagcccagttcatctgttttctcttccatataccattccctgacgccccaagatagaaaaaccctttttttaaaaagatttttttaactatactttaatttctggggtatgtgtgcagaatatgcaggtttgttacataggtattcatgtgccatggtggtttgctgcaccaatcaacgcatcatctacttaggtatttgtcctaatgctatccctcccctagcccccccatgccagagaggacccagatgtgatattcccctccctgtgtccatgtattctcattgttcaactcccaattaggagtacatgtggtgtttggttttctgttcttgtgttagtttgctgagaatgatggtttccagcatcatccatgtccccgcaaaggacatgaactcatcctttttatgactgcacagtattccgtggtgtatatgtgccatattttgtttatcgagtcattcattgatgggcatttgggttggttccgagtccctgctattgtgaacagtgccacagtaaacatacgtgtgcatgtatctttatagtagaatgatttataatcttttgggtataatcacagtaacgggattgatgggtcaaatggtattcctggttctagatccttgaggaatctccgcactgtcttccacaatggttgaactaatttacactcccaccaacagtgtaaaagcattcctatttctccacatcctcaccagcatctgttgtttcctgactttttaatgatcaccattctaactggcgtgagatggtatctcattgtggttttgatttgcatttctctaatgaccaatgatgaagagctttttttcatgtgtttgttggctgcataaatatcttctttggacaagtgtctgttcatatcctttgcccactttttgatggtttttttttcttgtaactttaagttctttttagattctggatattagccctttgtcagatgggtacattgcagaaattttctctcattctgcaggttgcctattcactctgatgatagtttcttttgctctgaagaagctctttagtttaattagatcctatttgtcaatactggcttctgttgccattgcttttggtgttttaatcgtgaagtctttgcccgtgcctatgtcaagaatggcattgcctaagttttcttctagggttttacggtttaggtattatgtttaagtttttaatccatcttgagttagttttcatataaggtgtaaggaagggatccagtttcagctttctgcatatggctagccagttttcccaacaccatttattaaatagggaatccttttcccattgcttgtttttgtcaggtttgtcaaagttcagatggtcgtagatgtatggtgttatttctgaggccgctgttctgttttggtaccagtaccatgctgttttggttactgtagccttgtagtaaagtttgaagacatgtagcatgatgcctgcagctttgttctttttgcttaggattgtcttggctatgcaggctcttttttgcttccatatgaagtttaaagtagttttttccaattctgtgaagaatgtcaatggcagcttgatggggatagcattgaatctataaattactttgggtagtatggccattttcacgataatgtttcttcttatccatgagcatggaatgtttttccatttgtttgtgtcctctcttatttccctgagcagtggcttgtagttctccttgaagaggtgcttcacatcccttgtaagttttattcctacgtatttcattctctttgtagcacttgtgagtgggagttgactcatgatttgactccctgtttgtctgttattggtgtataattatgcttgtgatttttgcacattgattttgtaacctgagactttgctgaagttgcttatcagcttaaggagattttgggttgagatgatggggttttctaaatatacaatcatgtcatctgcaaacagagacaatttgccttcctgtattcttaattgaaaactctttatttctttctttttcctgactgccctagccagatcttccaatactatgttgaatggggtgggaagagagggcatccttgtcttgtgccagttttcaaagggaatgcttccagtttttgcccattccttatgacatttgctgtgggtttgccataaattgctcatattattttgagatacatcccatcaatatgtagtttattgagagtttttagcatgaaggggtgttgaattttgttgaaggcctttcctgcatctattgagataaacagaaccaatgacaaaaaccacggttatgtgattgattgattacatatattgatttggatatgttgaaccagccttgcatcccagggatgaagccaacttgatcgtggtggataagctttttgttgtgctgctggattcggtttgccagtattgtatgaggattttcgaatcgatgttcatcagggatgttggcctaaaattttctttttttgttgtgtctctgccaggttttggtatcaggatgatgctggactcataaagtgagttagggaggattccctctttttctattgattggaatagtttcaagagggatggtaccagctcttctttgtacctctggtagaattcagctttgtatctgtctggtccagaactttttttggttggtaggctattaattattgcctcaatttcagaacttgttattggttcatttaggtattcgacttcttcctggtttagtcttgggaaggtgtatgtgtccaggaatttatccatttcttctagattttctaatttatttgtttagaggtgtttatattattctctagtagtttgtattactgtgggatcggtggtgatatccccttcatcattttttattgcatctatttgattcttctctctttccttctttattagtctggctagcggtctattttgttgatcttttcaaaaaaccacctcctggattcattgattttttgaagagtttttttgtgtatctccttcagttctgctctgatcatagtcatttcttgtcttctgctagcttttgaatttgtttgttcttgcttctctggttcttttaattgtgatgttagggtgttgattttagatctttcctgctttctcttgtgggcatttagtgctataaatttccctctacacagtgctttatgtgtgtcccagagattctggtatgttgtgtctttgttctcattggtttcaaagaacatctttctttctgccttcacttcgtgatttacccagtagtcattcaggagcaggttgttcagtttccatatggttgtgtgattttgagtgagtttcttaatcctgagttctaatttgattgcactgtggtctgagagactgtgatggtttccatacttttgcatttgctgaggagtgttttacttccaattatgtggtcattgttagaataagtgaaatgtgctaagaagaatgtatagtctgttgatttggggtggagagttctgtagatgtttcttaggtctcctttgtccagagctgagttcatgtcctggatatccttgttaattttctgtcttgttgatctgactaatattgacagtggggtgttaaagtctctcactattactgtgtgggagtctaggtctctttgtaggtctctaaggacttgctttatgaatctgggtgctcctgttttgggtgcatatatatttaggatacttagatcttcttgtttcattaatctctttaccattatgtaatgcccttctttgtctcttttgatctctgttagtttaaagtctgttttatcagagactaggattgcaacccctgcttttttatttgactctcccattgcagttttttattttaaatatcttattctgctgatcacttaaagtggtattttatagccatcttcacaccttactttccctgctaaatacatcctcctcaaagatagaatcatattgaatttttagtaattcctaccatgtttaaccctgtagatacaccttctacataacacaaatagttattcagtaaatgaatacattataaaacaaatgaatggctgcatttatcaacagtattcaaagttaaaaagcatgattacagcttgtgtttattgatgtcagatgttgaaatatattaccccatagttacttctgtgttaagtgacaggaaagcaaagagaaagaaatgaatttgttctatttttttaagatttgtttttctgatgtgaaagcaagaagtgcacaaaactaagcaaacaacaacaaaaacccaaggcaatacattttgggggtatggatgttgggtctcatttcttcttgcttgtgatacacttgtggctctcttctccccagggaatgagagatgattccttttattggttgagtggaagaggaagtgggcttgtgtagttcagtcccttttccttacaccttttcaggagctagcatgtgtgcagaggaaaggcatcctcaagctctgaaaatgccaaaagtattctaggggcaaactctgagactgtggtgtttaagtctacaggctgggagttgagttcaccttgaagaaatattaaaagctggtgttttggataacaaaccttgagacataacacaattaaggagggggatatgaaaatctaatggagatgtggagaagagggctcatgtgggattgatcagatgactgtaagagtaagtaaggattgcaggtgacagccttagaatcaagcatgagctatggaggcctcatcaatggagtaaaccttgaagtactcaagccttatgatgagtggcttgcttcagcatagccataatggtgttctctggttctcccatccatttaggggctgctttagattgtattcggctatattacagtgcttaaaattccataagtttctgagatccaaaccatagctccacccatataaaaagtcattttttataatagataaattgattcatatggagtacttagagaaaatgatattggcttgagatagaggtataagtcataagattaaaggggctgctatatattgattctttccaacatagcattcctgcacctacctagatttgtgcagcatggatgaacttgagcatatctttttctgttctgccaaggcagtgacgctgttcactttccgacttctaaaattgatatggctcttcaatattgtcttataaaccatataatccactggttctgaaactcttccctgatctcaatcacatccctgagctcttaagtcacagtccagtgtctttcctctaccaagaattcacttatccttctgtcacctgttgaaatccggcccgggactcacaaaacaaaaaattgtttttggtcaggtgcggtggctcacgcctgtaatccttgcactttgggaggctgaggcgggaggatcacgaggtcaggagttccagacaagcctgaccaacatggcgacaccctgtctcttctaaaagtacaaatattagccaggaatggtggcaggtgcctgtaatcccacctactagggaggctgaggcaggacaatcgcttgaacccagggggtggaggttgcagtgacccaaggtcatgccaatgtactccatcctgggcgacaagagcgagactctgtctcaaaaaaaaatgctttattaattatttttctttgatcttgtggtatatatgctgttattgtattacatgtgccattataccacttacagtattctccatacaattacaattcatgttggtttccagactgagtctgaaatactttacaatactatgcctgaaatgactatgaattttcagcagtgcagaatttcacatacaatttcattcttctacatttcatccatcatttcatccatcattttagatacctcaataccatgactgatactaagtagtttaaaaactatctaaggataaggactttatatccctctatattgtttagtaaatgataaatctgtggtacagtcaatgtagcaaaatatatatatttatatgattttatatttcttcataggaaaaatacatgctgttttaagtgctgtgcctttctgtacttttattttgttactataaaaaaaaaccacagatgaaaacctgtggctatgatttatttacagcacaatactcatttgacaatgaagttataatatgtaattgaatcaaaggactctgctgataccatgaataaatgaataaaagaacatatgtaaatgattcttatatggggcaaaatagatattaataataatcaatatttattatgagcaatttgaatgaaagttaccattatcaaagcaactctttaaaaagaatgcaagatgtttaagaaagacttccgtcctactgtgttagacaaagtattgtagtctacaactgtagtggaaagaaatcctgatattaatatattatattaatatattttcaaaatattatacattagattaatatattatatattaatatattttcaaataatatattatattttattaatttatattaatatattaatatattttcaaaatattatacattagattgctagatcacttatggtataatatctgctaacactctaatatggtcctaccagtaaatctgtttttaaaaaggaagtaaatgtataattacaattcatcttgaattaataactgagataaaaaaggaatattccccttttgcctgtattaaattatgacctcatcattatatctgaagaggactgaaatactccagaacatgcctctcaacttatcctttcattctttttcttctcaatttgacctttgtgggctcataatttaaaaacgataaataacacaagaagaaaataaaacacctagggaatgtattggtaggaaaagcaatacaacagatttacactgtcaagaactttcaaaattgtagtaaaaatatatagactagcatataaatcatgtatgagcatttaaaataactaaggtagaattaaaaatgaactggcatgaaagcatctgccaagatgtccaggtttgaaaaaaaaagatgagactgctagacattaaaaacataatcactaaaattaaaagctcaatgtatggataaaatatgagattagatagtggggagaaccctgaaaatatagacctgaataagtcagtggcatgaggcacagtaagagaaagaaactgggaaggagagggtaagagatgtggaaggtgtgaaaatgcaaagttatgtcttcagagtttcagaaaaagaccatagaaaattgggaaaagaccatggaaaattggggagaggttatctgaggttatctgaagaaataatgggaatttccagaattggtaaaaatgtgattctgcagataacaataatcatgtatacttatcactttatagtggaaaaatagaacatcaatgacaaagtattatttaaagcagacagcaggagaaaaaataaatgatgtctgcaggagtagcaacaagatttaaaggaaattcttggggaataaaggtaatatagaagaaaaatactaatgtatacatcctattccaggaaatatcattcctaaacagtaaaacttttgttttccttttagataaataaaggcactctttctatggaaacaaacaaccaaagtgctttctggaagaactttctgaatatcaagatataacaagaattaaaaaaaaaaaaaggactgtcgttattcttctcaaattatatgcatatggttccaggggaagcataaagaagtgctttgtggaaaagtttaaattacacaaatatgtacttttgtttgtttgtttgtttgttttgagacggagtctcgctctgtcgccccaggctggagtgcagtggtatgaagcaagctccgcctcccatgggttcgtgaatgggagtgaatgggttgacgacattctcctgcctcagcctcccaagtagctgggactacaggtgcctgccactatgcttggctaactttatatatatatatatatatatatatataattttttttttttttagtagagatggggtttcaccgtgttagccaggatgttcttgatctcctgacctcgtgatctgcctgccttggcctcccaaatatatacttcttgaatatgagatatggtaacctaatattactttcctaagttacaactccatttattttctactgaaagatattccttcacaagtcaattataaataggacatctaaatacttgtgttttcaaagtgggcagtatagggcgagggtccaactttctgggactcacctccccttctgtagattgcagatggagctccttcctgcaggtggccttgaagtctcctgcagcagcactcacctggaccccacggggagcttccatgatcaaggatctggtgggtgattcaagcctaagggaaaaacaaaaaatcattaataggaaaaaaaaacacaaaaaaatcattaatagaaaaaagaaaatttttgataaactagaagacaacattggtcaaaacaacaaccagacagacaggcataaaggaaaagtcctaccattttaggcaaagccagaatgagtttcagaacaatttttgattgacgtatctatttttggctctttataaaaatctacatttattcacatcgagtatttactctcactttcatgacaatttgcttatggtttcttttgttgtttcccctcagaatgctcatgaaaagtagggtgtgataagtatacttgctaaaatttttaataacttaccagtatataacttactagtattaatgatggaggtttaataaaaaatttacagtttaggatgtagatatatgtattcctcaataaagagtccctgtcttgtaaacatgaatgctttaatgaaaattgttaatattgcacactttcaggcatgtgcaaaatattatgaacttgacacctctagaaactgattaaaataatgaaataagacattttctacatcaactaattctgttggccccgtgaaatgtccacagaatgagtgacatcagtctgtgaaagaaaaatcaataggagggtaatatacaagtacaaatgcgattgaaggttggctacataaattaggagggcaagaaacaagtgttttagacagtcagagttgggaggcagttttcaaactatcttcaaatataacactagagaaaaagcaaaaatgacacacaacacaggaactagaatacagtggtaaaaagtgctaggatgagaagaggtaggatccatgcactggtctttttagatcagctttctgccttggggatgcacctgcctgtgatcgccctaccacaggactttaagaggagggtcccctcgggctcacattcactgttatccagcacaactggttttgtttttgttttctgaggcaatgaattcagagttgttttgcagaaagaaccacctcaaatggttaggtctctggagttcagctccctctcagcaagaaagtgaaacctaaaagcttaaaagtgatatggaaggagtagagccagcattgagaagtggtttcaacacttccattttctttttttttcactcaccaaagcaacttaaaaattttaatccctatgggccatttggagatctagcttcatataatccctggaggggtgaggttttgaatgtgtctatttttaagaaacgtctgtattttttttattaaaactccccatattttccatagaatatttgaaaacttgaagacaatcactcacaatcctactgcttaataaaatttactattagcattttacgcacagtatctaaatgtcaaaatttgaatgttaaaatgtattttttatcactgattttccctgatacacaacccttctagaactacgcagactcttagcaacacagtatcaacaattaaatgttgtcccacttctctcttgtatggaaagtctcctgtccactgaggagggtttcacagacttacttacattatagtagaggttttcaattaaactattcatgttattataaaatatcgtctaaaaagcctgttgaaaaaggaaacccaagtttattggtactacttgtggatttctatgtaattagtcagtgaaattagtgaattataattgtattcatttttataattgtattcatttggaaagcactacagcaaatatagcagtaagtttcagactggctttcacagtgggtacctgggattatggcagagagaaggatagtccctctaccacctggtttttcaaagcattctgtttttttatggtgtttatgtatcaaagttgcaacaagatacagtttttaaggtgttatgcaactatcaaattaaaaaaaaaatctgtggcctaaatctctagaattctcaacattcagaaaaaagaagaattcagactttaaaacaacctaagttgcaagaggcaattattaaatattaagcagaacttaagcatcaggagaaacagaaagaaagagagggaaaaggaaaggaaagaaagcaaataccctactttatcattatgttcttctcataggtagaagaacaccagccaagcaatttacccctttattgaggaaatgtctcagacaaaatcctgactgcttaatagagtttttttccttgaatatattaatgatgtgtatttattaatgatgtgtattagagctatgtgtttctagagattaacttggagcctgcaaaccttaatatttctgtgttaagctgtatttttgcaacaatgagaattatgaaaagatgccaattatatgattaatctgcacttggattctgtaaaatgaattaacatttattttcttattcagtagttaatggatctcagatccaaaaaaaatctttaggaaatgagcactgtataattagtttcatcactttttaccataggtacagaaactcttcaaactgtagtaacttaactatatattaatgtaagaaataaaaacaaacattaggctgttctgggcaaatttactgttatgtctttgttaactatttaacatgttttttttagccttttaaaatatagactcctagtacaaaacagtatcatcttatctaagaaaaattcaaagaaaatccacagttttaaaatgcacatggaaactagcacagaacttgagaaatactagacactcactcatcaaacagctgctgaataaataagttatagaaatccactacatttcttcaccaaaatattaatactctattaataaacttttgaaatgtatttcttttctaaagtctttttgttcttcacaataacaaaaccaaagaaaatgtggctacttactccctaaattaacattttattgacttggccaaccaatgaaaccgtgttgattagaagtaggcatcaaccaacaaacagtacttacctctctgaaaggaaaattgtcagcaaggcttgtaaagtttttctcagacaccctgcttttaattttcattatacaaataaataattgaatacctacataattactctacttttcttctgtttcagtttggaaatttagtaacacttatcttgggggttgccagtctgcttttagaaccagctgataaatccagcttagtgcaatgtttacataatgatgaataattagaaaatgaaaaccagaaacaccatacactagatgtaatatcattcgcattttcacttatgaattgtgaaatatgtcagcaagataattaaaataccagttggttcttattcctcttttaacaagactttccacagtaaaaattataaaatgagcatatagttaccaaaacgttagaaataaaaaaaagttctttaagtataaatttaagtaaatttaaaaatacttctataaatgtattttaagtttattgaataaattggtaaacagctgtgtctatattaaaacacagatgaaaaaaattggaatcaatgctcttcacatgttcctttgtaataactgcagccactttccttatatcccattcatttagttaatgtcctcatttttcagctttgctaagtttcagtaattcacattaacaaatacttattgcaactaggatgtggtaagataacagtgctggctgctacagcattaaggataaacaaggcagatgtgtatcctgttctaatggaatttacagtttgttaggagaagaaagatacaataaatattttcacaaaagttgttgaattcctgcctgaaaaaagagccataaatgaagaccgtagcatcctatgagatgctgtttacacacactcctcagcactgctgaatccctagggtttctatatagagtaggtaattatcatgttgctcttctaaaataagtcttagtccttgaagaaggccactttttttcctaataaatattgttccctagcttgtttgaatctgtgttactcaagtagtgagaaactgagttgtttaggaaattttatcataggactctgactaaaaaatttactgttgtaaagtatggtttcgttgccttaaagattttcaactttatttattttttgtttccatctgagtacatatacactcatccaatgtgaagggctaaacagcaatccttatgaaataaaaaggttttgtaacttaatgtttttattttgcttcccaagacaccaactgtgtctctcaggttgatactatgatccaactttaaaagtgacttttagtatgtgactagtttttatcagcactatgtgcatctttccttttcctatacaatagtaagtgcatttcagaatgtaatttagctatcataaattaattattattaaaccataagtaatcaccaaatcttacgtattgaattaagaacaggctaggcgcggtggctcacgcctgtaatcccagcactttgggaggccgaggagggcggatcagaaggtcaggagatagagactatccggagcaacatggtgaaaccccgtctctactaaaaatacaaaaaattaaccgggcacaatggcgggcgcctgtagtcctagctactcgagaggctgaggcaggagaatggcgtgaacctgcgaggcggagcttgaggtgagtcgagatagcaccgctgcactccagcctgggtgacagaacgagactccatctcaaaaataaaaataaaaaaataaataaaaaaaaaaaacatccactgagcagttttgtattagggatctagattttattattttgaatgtaatcaacagtggtaataattatcctgggaagaattccctataatgttggaattttcctgggtagtgagagcttttacatataaatgcctcctagaaccatcacactgtcaggacatagcttattccattggaaatattagactgaggaaccccatcatagtccagttaagttctgcctttgtctgatttgcttccatattaccctctatataatactccgtggtcatttatagctttctcagcgccctatttgccctgtctttattcctatatacaccacacatttcattatatatgtcggattttccagcattcctttttttgtttttgtattgtgttttgttttgtttttacagatggggtcttgctgtgttgcccaggctggagcacagcggcatgatcatatctcactgcagccacgacctcctgggctcaagcaatcctctggtctcagcctcctgactaacttggactacacatgtgcaccaccatgctcggctaatttgtttttattttctatttttcgtagagacagggtctcactatgttgccaggtcttgaacttctgatctcaagtgatcctcctaccttggcctcccaaagtgctggggttacaggtgtgagccaccgtgcccggcctcaggatccctgtttttattagttcttctcacttactgtataactgcctttgccttttctttttttttccacattcttcctatctaatatattcatttttgtatttattttaagtatattgggagaaacatttgtctagttgtctattttagttcttcatatattaaggattatcaacaatgatggattttatgccacaggtataagaggaagcccttacctgagatcttgggatggctctgctctgatgtgcggcgtctccacagagtgcccaaatacggctccttcagtgcctgggggtagcatgaatatagcagtcagtataagcaagtccacacagtggctttcatctctatgtttatgcatcaaatattcttccaaaacagagaaaacttaaaacaggtacatatgatgtattagtccgttttcacactgctgataaagacatatccgagactgagaagaaaaagaggtttaattgcacttacagttccacatggctggggagccctcagaatcatggcgggaggcaacaggcacttcatacatcgcggtggcaagagaaaaatgaggaagacgcaaaagcagaaacccctgataataccatcagatctcgtgagacttattcacgaccgtgagaacattatgggggaaaccacctccatggttcaaattatctcccaccaggtccctcccacaacacgtgggcattataggagtacaattctagatgagatttgagagaggacacagagccaaaccgtatcacaggatatgaatgagaagaattggaagaatatcaccaggcagggaagagtcaatcaaggtaaatctaaatgtcattatattaaccaattttaaaattaaattatttataaaagtcaaaagtcagtgagtattcccactctctctttaaagaacaaaagctcatctctgtcccctgccttattttccagttaagtgaaattgagggagggctaagtcacaatactcaattctgtgtttctataaataatagcaggtcatgaatgaaaatgtggaggtgagttccagtgtagcctattattggttttttaaagacaaaccctcatagatgtttagcagttctcacacatagagctcccacctttgattacagtaaccacgaaaagctagagaacatgtcatgttactttgacctctctggagttagggcttaatctaaaatcatgaactgctttaaattctggtgttatagttggtttcatatggaattgtagctttccgaagaggtcatatactctaacacttttctcaggaggttgaaggatactctatctcaactttcatttactgaatccatttttttccagattctcatagctttttcataatttaactgagcaaaatggaaggatacttcaattaccaaaatcaagtgggaaaaaaatgttccaaataagatgacattgagaaaatcttttctgtaattttgcataaatgtctttatcaccctcaaaataaacttgatgattttgttttctggtctaatcttcttcaaagttcttgctttaagaacctcatacctgttccatcagtggcttcaacactagataaactatacaatgtaatttaaaaatatgtatttgaagcatacaaaacaaatctgtttttgtctaatgagaaaaatcatgtaaaatatattaattcaagaggcaatgatgaaattgccactaggaaattaaagctaaaattccaattccttaaaactaaattgctatatatggaaatgtattagaagcatcagatgactcctttgcataatatagcaatacagaccttgatcatgaatagaacaggaagagatttttttttcaaagactatatgatttcatctatattatgctgctgagggcaaacttacttaccaggttctgctgcagtaaatccctaagattacagatttctgtttataagctaaaagctattggcatttgttgaactcttaatgggcttaatagtgttctctcttctctctctctctgtcgctcctgagactctgtaggacatatggtccttgtttttaaaactttttttcatgaattttgagaaattatttaagcggtttattcttttgatattttggaagatatttattttatttctactagtggaacattcctcaaggtgggtctttaaaagtaaaacagtagtttgaggtaacactaattttgtgattatagtggggatagcatttgaaagaatattacaagatatacatttgtatatctcaaagagagactctggcattttgtaataagatatgcatcccagaaaagatagtgaaaattaatttttaaactttgcacatggataactatttcatgattatgaaaatttcccagataaggtgacagaaatataattaaacatcggtaatatttactttcaaatacataatggcatacttactaagcacaaactctatcagtgaaaataaaaataacagaatgtcatcaaagtttaaattttcagtgagaattaaaaactgatagaggtctcaattctgagtgccaatataaaaataatcatttttaaaggattcttgaagaaataaatatgtaatcataccacgtaaagggcgaaattttaaactaaataatacgagtgattaacaaaatgcaggcctctagaaaatgagaaattcactctccctgtttttgtcctgaatgagccaaaggtacaaaattaataagcaacacagataatcttaaaggaaatcagtaagggatgataaaagccacctgaaccaggtatgaagtctaacagcataaaaaaattaaaaatcagaaaatgcacagtggctcgtgcctggaatcccagcactttaggaggacgaagcaggcagatcacttgagggcaggagttccagatcagcctgtccaacagggcaaaaatcctctcctctctactaaaaatacaaaaattagctgggcatggtggtgcacagtagtcccagctgcttgggaggctgaggcaggagaatagtttgaacctgggaggcaaaggttgcagtgagctgagattgcaccactgcattctagcctgggcaacaaacggagactatattaaaaataataacaacaacaacaacaacaaactttaaaaaaaaactgtctctctcaagaattgaaaatttttaccatgtagattactagtagggttgtgagatttagcaattaataatatatgacactgagctcatttgaatttcagataaacatcaaatcattttttagtataagtataggatatttacaggggatatacttatactgaaagcatatcttgagtaatcaagtaaattcaaaattagtaagacatcatatacttgatctggaaaccctaacaatttgtcaacatttgtttggtacataaggacagatctgacttacttatgctcacttagagaaaagacagactgtcatgaattctcatatcacaggctctagaaaccatagaaacaaaaaagaaggatagacataaaaaggacaaaaggaacacaacagagacacatattaatatgtatatgtaaacttattgaataaatgtttgtttttcattgctattttaaggggctgttcaaaagggtacaatgttcaacactgcttgattataaaatcctacaaaggatgtttcagataatttaaactcactacaatgttacaagacatagggaaaacctatactgttggctactgcaattgtcagaataaaactaagaaaattcagggtccaaaagtagtagaaaccattcatatgataatttctggcttctgcaggaaagaataaggatggcatattctgctttgccggaaaggagaaaaggcagatatggattatggtcctactttgtatttaaagaccgtttaagacataagctaggatactaccctttacaaatgcctaacataaaatgccacacgctcaaaaacaaattattaaaattaaatgtaagcacctcttctgatgtggctatctatattctaaatgctatctatactataaatgttatatcctacgctactcattattcaccgattgacatccatgtattttttacagaagtcactggtcccagaagaagaggtagcacaagaaaaggaaacccaagaagcaccagagagaaagcaaacaaccaagaaaggcaagaacacctcacattgagaaaaagaaagtcaggcaggaaattatatttttaagttatttgacctgatatgtgccaaatgagaacttttgctggcctttatttttccaataaaatcaactatgatcatgaattttttgagtttttttttttgtggggggggggtgcaaagaagggaatggattttatgtagatatcaacatgatgtgaaagagcaactacaagaggaatccagagtccatggggcaaaggttaacaggacataaacagctagcctcccagccctatggcacttgacaggtatcttagcttttcaggtccagggatatttttctagatctcaaggaacagaagattcctatttatttatgatcttcaaatttgaatctgtgttagtaaatatattcaaactttttggaagtcttcctaccttactttctttttctttatttgcttctgtttcccccaaatctaaattggtactaaaatctagattaagctgggaatagacttgtcttattcccaggtttacttataatttgtttttaaatcttggccaagtatttaaagccctttggtttttatttgtaaaattaaaaaccagatcatgaataacatgatctctaaggtacttgcaatttctaacagaattatacgattattttttcaaacacgtcaaaacttgtatactaataactcttctcattcctccttaaatactagtggaaatgagtttgcaactccagatcaacagaaaataaattattttggggaaaggatggagtaacaatactggaaaaaaatattaattggcatttattgtattccattaaaaaggattgctttgaatactgaaaaatttattacctctcgaaagaagaaatgtcaacctatttcaacatatactacatctcctatttgtgttattttaataatctaagtggtgtttttgcctccacttaccaccacaaaatacaacctatacattgctggagtgattttatcaaaaccattgatatctcacctgtgcaaaaagctataattattttcctggacactgcttttgcccagcattcaatactcctgtaatctgagcccatttgtgtgttcaaacatcttttcttccacttacgtataaaatatctttactaattttcccacctcttaaggcatatgcagatttcttcattctctgaacatatttagggtttactgcctgtagtacttgtctttaaactaccatatctattcttacattttatatttttaattataacagttgcttacgtttcaggccaaaaaaattgaagatacattccttatatgccattgtattcttgcgcaccacatgatggatgggaggtaattaataaatattgataaggatccagatttccagccttttttgagttttctccttttgttttttaattctagtttgattaatggtaaaaccatattccacacaaccaggtgaacccgggaagtatactgagatgtcctttcttgttcaacatccttattagcgtacttgtttccacagcttcaatatcacatacattttctgctcatgattcctccatactggtgccaaatgatgttctaaaacacaaaattgactttgtaactctcacttaaaatattttaagaacccagtgtctgtagaagtcaagcccagatttcttaggatttactgcttagcagttgtgtggattttacatttcagtgacaagacaactcatgagaaccccttcttgttctcagcatatgcaacctctttctcctcatttgatggtaatctcttctcatttttcaagatctgaatctaaattatagtatctgtgaaacattttcttggttcttgccgcttgcttctccttctgcccagttgccgcaggtccttgtaaaaattactggtatatatttctaacattgcattgcaatttgctttaagctcttatccagtaacttacgactttcttgaagtcaaagcctgtctcgataacagttgtatacttagtactgatcatggattctgctacatagttaaggatcagtaaattaaagaacatgaataaaataattaacaaaagcatgcataaaatgctttctattttataattgataggtaaaacatgctaagtttctgtttcctagtgtatctccttgtttaacactttaacacaaatcaacatcctgcgatgattatctgaatgtattgaaactgttattatgagcatagccaaagtgatttttttctagtgaaacagggaaataacattattaattgtcttgggaggaaagcaaaaaagaacaccatattgttcatttaggactgaaaaataagctgccaggatttctaaaaagaaattgtttcaaaatctgtttggacttttcatttggcatttttttcatcatttaaaaaaatatttgaaagcctttactcttggatgccaaataatatcctctcatccacttaaacagtgtcagaagacaaaaagagataaggaaaaagactgctggtgatcaaaaggaaaatgcattaaaataaagctattttcttcaaaattaagtacatttcagaaataagttgtttgttactaatgaaattagactaaaatatatcagcactggaaacgatccagacttccatatggctctcattttgtaaccttcaagaagttatgttttactagcagttgtttctctgagttttaggaggaaaagctcttcatttattatttctattccttttagtcaacaataagagtaatacttgaaatttaaaatcacatgtaaagaaaacagaattaaaaagaaaataaattatttccaaattgaatgaatatgtggtttgatggaaacgacatttttaaaaattgtacataaataatccattttctaattcctacctccaaaaaaaatgaaaaaattacagtggacgagcagagctttcttcgttactcttacatccaataactcttgagatatatattctcaggaaatagttaattccaaagtatgtgattactgaggttgttgttttgccctttacttaaataaaaccagtaagcaaatgagaagtaacatacacacctgaggcttctagagaatcctgagtgagaaagcataatcaagaatgcccctttagcaaacataatctctatgggtatgcactttttaaaaggcagcaatatttgattcaatttacagcttcattataaacattataattttaacgagttgaaatgcaaaaatatgcattaacctatttgatagcacatgagctacccatactgtcatttattacatttttaaaaattttattaatgattaatgatgaaactgagaagattaagattcctaggtaaattatctttttaccacctttacataaagtctagataagctttcaacgtacttaatccagcagtatattttgtcttaagatttggacattttacctaaaatacagatatgatagctgatactagtcttggctctttgaactcacacttattcttatgaacgtaaatcttttttaatttttttttgtataaccctttccttgataacctctatcattaatccagtgaaattcaagctttgtggaaattcatttatttagaaatctcccatcagttacaccataaactgaggtttctttggggggtgggggtggaaattagtaaattccttaatcctatcttttttccttattttattcttcaagctcttcaccactatttagattactttctgaagagaaacaaaatgacttcctactgctagtactcataaagggagaaactgtgttttccactggcaggtcataccgaccattaccaaatggaatgcacagcgctagagattcatctcagcagcactttcattgcttaattctttattccttaggacttctggtacattgatatcaaagtgctttctatggaaaataaaaatcagtaaagaaattgtctaaaacagatggtacataattgtctttgggggcttcaaatattgcattggtttatagatttatctgaaacttctacaaatattttttactctgaaaaacaaaatattgtatgttcaaaagatgctaattgtatcaatagctttatgagcctgagctgcatagttaatctacataaactgacatatgaaattattttttaacatagtgtctcatgaaccacaatttatttagaatttccttcttacctcaagatatctaagagactttaaaacatcaaagttttacctacaatttttttgggtctctctgccgatgagaaaagattcagaatcttcgtacacacagcttgccttaatatgtaattgtcattcatttactaataaccaggttttacaaaaattcacgtaaaaactgaaagcctcataagcctatcatccaataacaagatagtacgacatgcatagagtccaaatgagaatcagaacatgtgtgttaatgcccagataaattctcttcatcttttttgtttctgtgagattatttaccttttgttgctcaaggttgctcctttgatttttattttatcacttgccatgtaattcatgtataccgataggtaaattttagaaagctccatttactttcatttgttttttaaccataagaggactggtagcattctttttacttttaactaaagaaatggcacgtttctccagaaccaatgtctggtttccttaataatgaagtttctacagcaagaacactcatcacatgctcagcgttgattactgtgaacactgtatatttttcttagaggaatttcaagcagagtaagccattactgctttttgcaatttataacgattaaaattatccatagtttacagggaagtccaagcatcttcaaaattattgggctattatggtaacctgtgttttaaaggttgccataatatctttaaagatggcatgtatctttaaagatggtcgtcctatgacctacaaaatgtatctttaaagatgtatctttaaaggtgtttgtcctctgacctacaaaaataatgcattagagatgagcattagacctgctgatataaatgggcctcttctgataagtcagaggtaaaatacacaacttttataatccagatatgtgcttttacattttgggaatcccttgatccacttagcaaatatctcaccatgaacagggtaaacagatattcaatattttcaataggtagtgtttttttttttttttgagaaagcttaaattgtgacactgagatgcacacatctgtgtgtgtgtgtgtgtgtgtgtgtgtgtgtgtgaatgcagagtatagcatctcactggggagtacttgacccgtgtgtgtgtgtgtgtatgtgtactgacacatttacaaaataaaattccaatcttgtaaatacctttccagagaattgaaaaaaaagctgatgccctaatatatgaagtttttattatcatactttaagttctggagtacctgtgcagaatgtgcaggtttgttacataggtatacgtgtgccatagtggtttgctgcacccatcaacccatcatctacattaggtatttctcctaatgttatccctcccttagtcccacatcccctaataggccccagtgtgtgatgttcctctccctgtgtccatgtgttctcattgttcaattcccacttatgagtgagaacatgcagtttttgattttctcttcttgtgttcgtttgctgagaatgatgttatctagcttcatccatgtccctgcaaaggacatgaactcatcctttttatggttgcttagtattccatggtttatatgtgccacattttctttatgcagtctatcattgattgacatttgggttggttccaagtctttgctattgtgaacaatgctgcaataaacatagctgtgcatgtgtctttatagtagaatgatttataatcctctaggtatataaccagtaatgggatttctaggtcaaatggtatttctagttctagatccttgaggaatcgccacattgtcttccacaatggttgaactaatttgcactcctaccaacagtgtaaaagtgttcctatttctccacattctctccagcatctgttgtttcctgactttttaatgatcgccattctaactggattgaggtggttttgatttgcatttctctaatgaccagtgatggtgaggtgtttttcataattgttggccacataaatgtcttcttttgagaagtgtctgttcatatccttcacccactttttgatggggttgtttttttcttgtaaatttaagttctttgtagattctggatattagccctttgtcagataaagagattgcaaaaactttctcccattctgtaggttgcctgttcactctgatgatagtttcttttgctatgcagaagctctttagtttaattagatcccatttgtctattttggcttttgttgccattgcttttggtgttttagtcatgaggtctttgcccacacctatgtcctgagtggtattgcctaggttttcttccagggtttttatggttttaggtgttacatttaggtctgtaatccatcttgagttaatttttgtataaggtgctaggaaagggtccagtgtcagttttctgcatatggctagccagttttcccaacagcatttattaaatagggaatccttttccaattgcttgtttttgtcagatttgtcaaagatcagatggttgtggatgtgtggtgttatttccgaagtttctgttccgttgcattggtctacatatctgttttggcaccagtaccatgctgttttgattactgtagccttgtattatagtttgaagtctggtagcatgatccctccagctttgttctttttacttaggattgtcttggctacgtgggctcttttttggttccatatgaaatttacagttgttttttctaattctgtgaagaaagtcattggtaccttgatggggatagcattgaatctataaattactttgggcactatggacatttttatgatactgattcttcttatccatgagcatggtatgtttttccatttgtttgtggcccctcttatttccttgagcagtggtgtgtaattctcctcgaagaagtccttcacatcccctgtaagttgtattcctaggtattttattatctttatagcaattgtgaatgggagttgactcatgatttggctctctgtttgtctattattggtgttaggaatgcttgtgatttttgcacatagattttgtatcctgagagtttcctgattttgcttatgagcttaaggagattttgggctcagacagtggggttttctaaatatacaatcatgacatctgcaaacagagacaatttcactttctttctatttaaatacacattctttctttcttgtgttctgattatccaggccagaacttccaatactatgttgaataggagtggtgagagaggttaactttgtcttatgccagtttttgaagggaatgctgctttcagcttttggccattcagtatgatattagctgtgggtttgtcataaatagctcttattattttgagatacattccatcaatatctagtttgttgagagtttttagcatgaagtggtgttgaattttatcaaaggccttttctgaatctatttagataatcgtgtggtttttgtgattggttctgtttatatgatggattacatttattgatttccgtatgttgaaccagccttgcatcccagggatgaagcccacttgattgtggtggataaactttttgatgtgctgctagattcagtttggtagtatttttttgaggatttttgcatcgatgctcatcagggatactggcctgaaattttctttttctgtgtgtgtctctgccaggtttggtatcagaattacacaagaaagaaaatttaaaggctcacatttattcctagggatagataccaaatttctaaaaaaggtattatcatatggaaaccagcaataaagaattatcaggaccattcctttaacatctatcactggaatataagtttggtttaatggcagacaattaataaaattcaccatagtaattgactgatggagaacaatatagaaagatattagaagatagagaaaattcattcaaaaagttcatcatgattaaccacaataattgtcactgtttaggaaatgagaacagaagtaaatttctccacctgaagttgtcaggtacaacataacctctatcaacatcaaacttattggtgacatgctgaaacatttcatttaggaacagggatatttcacttaagaacattacacaaaagtacaatgtggttttatatttggctagaatcaccactttaattcaactctatactatatatagttcttgtcttactaaggaaaaatatagatctataatatgtatattgttttgaggaaaaaataaaactaacatggttcacataaaatatggttttctatagaaaaaaaatccaaaagaatctacagaaaattaaatacaattagaaaacaaatttgacttgagaaaaatgtaatgcatgttctgtgagactgctactgctatggaatgaattattaaatttaatcaaaaggcattaaagagatgttaattataatgagaagtataacataaccatatgtaagattatcctatcctaaagttaataattttaccaaaaactttgaataaatttaatgcaatcttaatcagatcatcaatgatagtttcatggaactggacaagctgattctaaatctctatagaagaatatcaggaataataaggcaatctgaacctcctccacaaaaaatttaagtaggcagattttcctgtccagataacaagtattattataaaattctaattttactaagtcaatgtgactgtgaaatagagaaatagcctaacggctaagagagtccccagaaacagagcaatagatatccttctcacggaaactcaacttaatggcaaagtcaatgttgaatattgaacataaaatttagtattaacatatattcaacattcaattaaattacattaaatatattcaactatattatattcagtattgaatatataatattaaatattagaaaaatcaacatgtcacgctgtcatagctgagataaaatgttattcactactattctccactttaggctcatagcaaattgatgccgttataagggtgtttaaaaagtgactaattttgtgaaacttataaaaacaatatttgcactgaaatagaaaataatgctcttttttaaagtacccgtttaattaattgtttttaaaaaatatgtgatatcttaccacacttccatgcttctttcaaattatacagggtttttttggtattgccgttattattgttgttaaactgactaaaatcatacatgaaataatagaaatcaggcctaacatcagatagacttttccattcagttaagttattgtgtagcaaaatttattttgtcagttcactacacagtgtgacagtatatagtttctctaatagagtaacattaaagaggacatataatataaccaaaaatttgagttccagataagtttggtgtctcactagcaagatgacgttaaataactcatttaatttttttgaaatcttaattttctgttctgtaaaataaaaagcaatctgtctcttgtccaaaagactatgtaggttttttaaaaattttttattatgtcatatacatgtgcatacattgatacataaatagccctacaatgtatacctcacagttgcttagcattatgatgtctgaggtcagttagaagactttaaggaggccgggtgctgtagctcacgcctgtaatcccagcactttgggaggccgaggcgggcagatcccaaggtcaggagatcgagaccatcctgctaacatggtgaaacccggtctctactaaaaatacaaaaaaatagccgcgcatggcggcaggcgcctgtagtcccagctactcgggaggctgaggcaggagaatggcgtgaacccgggaggtggagcttgcagttagctgagattgcgccactgcactcggcagcctgggagacagagcaagactcagtctccaaaaacaaaacaaaacaaaagactttaaggagctatggtgattcagagataggaacattctcattcactgcccatgagagggcaaaataacaaaaacattctggggtcctttccctttgaacaaataattcaatttcaaggaatttatcccaaagagttctttatgtgcacagagatgtagctacaaggatgttaagaacagtccatgtaggttcattgtatttaatcaaaatgttcatcaatagggaattatctaataaactattgtgattcaacaaaatagaatacttttagccatttaaaactattagaacactagtgaattgagtaacctaaaaatgaatattaaatatccataagatatgcataaatgtctacatttttaaagagtcataacatcttcactggctaattccagttagcagccatattttcaagttgtggtcaactcatttcttctccccttgtttttaggaattcttctttctcccttatccccattagaaactcaaatatactgttcagtatgcagagaaatttgggaaacattatcacatcttaaaggtttctattttaagatattttctttaaaaagtgagccagctacctcaacaaaatgtttatcattctttttaaaaggtagcagtaactcaactgaatgtcatcttaaatagaagtatgttgtaatcccttttagagataaagtgaatctttttagtcaattttgactaaagataaatcagactgtcctgagaagtcatgatagttctgtcaccaagtgttgaaaagaagaacgaccaaattacaaagacgtaagagagaagattcaaacttttttggaagaatgcaataaaacttaacgtacattttaagcctgagattccaagatatttatttcatctgccaaacaataaaggggtgatgagtaaacagactgattctgaaagtttgttttgattcacttgtcttaaagaccgaaaataacaaagcaaacaatcagtaattgccaattaattattcatttggttttacagttgtaaacttaaaagaagccatgcaatgaaacataaattatttgccaattttgttgaaatgtgggaaatgaagtgatgttaaacaatttgtgggtaaatgggaaaatgatcctataaatgattactatacttaatatagagagatttgaaaatattatattgtgattaaatcattcttaaatatcatccatcctacttttcaaggcatgtcacatgagattaatagttcacatccagagccatgaccaagacctatatactccatcttctgaatgagttatttctctgtagcaatgcaaaaacagactaacatagtaggaaactattgcttctatcttctagcagttttcaatttaatagtaaaactatttttaaatgaaacagatcaattatcaatcaattagaatggtagacataatcgtgatctcccctgccctcaatggtctccatcctaatccctgaaacctgtgaatatgtcacagttaacaggcaaagggtaattcagatgacaaatgatactgattgctcattggattatcttaaaaacaggattatcctgcattatctaggaggagccaaaataatcaccaggactattaaaaatggaagagagaggcacaagaatagtctgagacagacagttggctaatgttgttaactttgaagatagaggaagggccaagagctagagtaatgatgagggtctttaggagctggaaaagcaaaggaaacagattgactcagaagggagctcagaccaggaatcaccttgatatcatcttagtgaaaacaggttcaaacttgtaacctctagaactggaaataataaatttgtgttttgtaagctgctaaatttttagtaattataacagcagcaccaagaaattaatacaaccatttaataattttaaaatgtaggcagtccattcgagcttgaaatattttttcctttgtccttcactccctctttctcctctctctctctccctttttacctttactgtgaaatgacagattgccttggttattatttacatgaacatggcaattttatccaacttatgtgaaacacacccacacaagaccccaaagatgaaattaggaataaaatttatttttatatactccagcaagttccttttgaagacaatggtcagcttgattaattaatatacagttgacttaaaactaaaatagtgcttctcaaattgcaatagacatttaaaattgcagatgaagattatattactgttttaccaaattgattataacatcaatcattcatcttaatctcttgctctgacattgttaggcatatcttaagtttccaatttacatagctacatcaagataaagagtttctccaggaggaattgtgatttagttaagaaagttacatatttaatattcaaatatgctcattcttattcacttctttttccagcacactaaataaatctgcttgaaataacctagctacaaaataaattggatcctaaaagcccatcttcttcttatagaaatttctattaagaacctaaaggtattatatatacattcatgtgatgacacaaataaagtagaaatgaagctgaccaaaagttccttaaactgataagcaacttcagcaatctcaggatacaaaatctatgtgcaaaaatcacaaaaattcctatacacgaacaaaagacaagcagagagctaaattatgaatgaactcccattcacaactgctacaaagagaataaaataccaaggaataccactaacaggggatgcgaaggacttcttcaaggagaactacaaaccactgataaatgaaatgagaggacacaaagaaatgggaaaacattccatcctcatgcatagtaagaatcactattgttggccaggcgtggtggctcacgcctgcaatcccagcactttgggaggccaaggtgggtggttcacaaggtcgaggtgggtggttcacaaggtcaggagatcaagaccatcctggctaacatggtgaaaccccgtctttactaaaaatacaaaaaaattagctgcgtatggtggcgggcgcctgtagtcccagctacttgggaggctgaggcaggagaatggcgtgaaccagggaggcagagctcgcagtgagccgagatcacgccactgcactccagcccaggtgacagagaaagattccgtctcaaaaaaaaaaaaaagaagaagaatcactattgtgaaaatggccacactgcccaaagtaatttacagatttaatgctatttccatcaaactacaatggacattcttcatagaattagaaaaaatactttaaaattcatatgcaaccagaaaagaacccttatagccaagacaatcctaagcaaaaaggacaaagctggaggcatcacactacctgattccaaactaccaggctacagtaaccaaaatcacatggtactggtaccataacagacatatagaccaatggaacacaatggagataccagaagtaagaccacacctctacatccatctgatctttgacaaacctgacaaaaacaagcaatgggaaaaggattccctattcaataaatggttggtgctgggaaaactggcgtgccatatgcagaaaactgaaaactggatttgttcgtcacacattacacaaaaattaactcaagatagattaaagacataaatgtaaaacccaaaaccataaaaaccctagaagaaaggctaggcaataacattcaggacataggcatgggcaaagattttatggtgacatagccaaaagcaattagaacaaaagctaaaattgacaaataggatctaattaaactaaagagcttctgcacagccaaaagaaaccatcatcagagtgaacaggcaacctacagaatgggagaaaatatttgcaatctacccatttgacaaatgtctaacatcccgaatttacaaggaacttaaacaaatttataagagaaaacaacaatcccatcaaaaaatgggcaaaggacatgaacagacacttctcaaaagaagacatttattcagccaacaaacatataacgaaaaaactcaacatcactgattagagaaatgcaaatcaaaaccacagtgagataccatattatgccagtcagaatggctattattaaaaagtaaaaacaaaacaaaacaaaacaagatgctagagcagctgtggagaaataggaatacttttccactgttgggaatgaaaattagtgtaacaattgtggcagacagtgtagcatttcctcaagaatctagaaacagaaataccatttgacccagcaatcccattactgggtatatatccaaaggaatacaaatccattctgttataaagatacacacacgtatgtttactgcaacactattgacagtagcaaagacatggaaccaacccaaatgcccatcagtcatcaactgggtaaagaaaatgtggtgcatatacaccacggaatactatgcagccataaaagggaatgagatcatgtcgtttgcagggacatggatgaagctgtaagccatcatcctcagcaaactaacacagaaaatcaaacaccacatgttctcatttatatatgggagctgaacaatgagaacacatggacacagggagggggacaacacacactggggccatctggggggtcagggggagggagagcatcaggacaaatacctaatgcatgtgtggcttaataccgaggtgacaagttgatagatgcagcaaaccaccatggcttacctatgtaaggtaaggtttacatggtttacctatgtaagaaacctgcacgttctgcacatgtatcctgggacttaaagtaagataaaattaaaataaataaataaataaatgaggctgaattattattgtcagtgagaaagcataggtctggttcccgttctgccactgatagctgtgtgtattttctataaatcatttaacctgagaccagaggttacagagtaacaataataatacacatcccctaaatactgaggagcaaatgaattactataaatgactgtgttttgtcagtggcaaagcatatgccaatatgttaccaatctcatcactttgattaattttaatattgtgatttatttattcatttttatttctatttatttatttttttgatactgagtctcactgtgtcacccaggctggaatgcagtggcacaatctcggctcactgcatcctccgcctcccgggttcatgccattagcctgcctcagcctcccgagtagctgggactacaggcacccactaccacaccaggctaattttttgtattttttagtagagacatggtttcaccgtgttagccaggatggacttgatctcctgatcttgtgctccacacgcctcagcctcccaaagtgctgggattacatgcatgagccaccgcgcctggcctgttttagaattttttaacttttattttataattggagatacatgtgaagggttattacataggtaaactcatgtcacaggggatttttgtacaaattctttcatcacccaggtattaagcccagtacccgataattatcttttctgctctgctccctcctcccaacctccccccgcatcaagtagaccaaagtgtctgttgtttccttctttgtatacataagttcttatcatttagctcccacttataagtgagaatatacggtatttggttttctgttcctgtgttagtttgctaaggataatagctatcattaaacagtcaaaaataacagattctggcgaggttgtggagaaaaaaatgcttatacactgctggtgggagtgtaaactatttcaaccattgtggaagacagtgcttcgattctaccaccattaaaaaatgggcaaatgacataaacaggcatttttcaaaggcagagacataaatggccaacaagccatttgaaaaccatttttcagcaaaccaacaaaccatgttgaaaaaatgctaaatgtcactgattatcagagaaatgcaaattaaaatcacaatgagatatcattttacaccgttcggaacagctactattaaaacttgaaaataacacattggtgaggatgcagataaaagggaacgcttatacactgttggtggaagtgtaaattactacaacctctatggaaaacagtatgcagatttctcaaagaactaaaaatagaattattcttcagtccagcaattccagtatttggtatctacctaagggaaagtaaatcattttatcaaaaatacttgtaactacatgtttactgcagcactattcacaatatcaaaatcatggaatcaacctaagtgtccatcagtgaatgtctgaatttaaaaatgtgataaaaatgtgatgtgtgtgtatatatacatatacacacacacacacacaccattgactactactactcagccataaaaaaagaataaaatcatgtattttgcagtaacatggatggaactgaaggtgatcatcataaatgtaatgattcagaaacaaagtcaaaaacgacatattctcacttctaagtgggagttaaataacagccatacagagtggaataattgacaatagagactccaaaagtggacggtggagaggaggatgagggatgaaatcctacctatttggtacagtgtacactttttaggttatatgagtacgctaaaagcccagacttcaccaatatgcaacacagtcatgtaaaaaaccttctcttgggtcgggcatggtggctcatgcctgtaatcccagccctttggaaggccgaggtgggtggatcacctgaggtcaggagttcaagaccaccctggccaacatggtgaaacccctctctactaaaaatacaaaaaaaagctgggtgtggtggcaggtgcctgtactcccagctactcaggaggcagagagaagagaattgcttgaacccaggaggcagaggttacaattagccaagatcgtgccattgcactccagcctgggtgacagagcgagactccgtctcaaaaaaaaaaaaaaaaaaaaaaaaaaaatctgctcttgtactcataaatttatagaaataaaaatttgaaaaataaggaagactgaaaaatccataaacatgtagaaattaaacaatagcctcttaaccaatgggtaatgaaagaaaccataacacatttaaaaagagacaaatgaaaacaaaaacacaacctacccaaaattttgcaacaaaggcagggctcagaaggaaatttaaaaagataagaacatccattataaaagaagaaagacttcaacaatctaactttataccttgaagaagagaagagaaaactaaacacaaatcagtgtttctatacgtcattaaaaaaaatcaaaaaagacattaagaaagtaattccattgacaataacatataaaataatataataatagttaggaataaatttgacaaaaaaggttaacagccaaaccactgaaaatgacaaaacattgcccagagaaatgaataaagacagaagtaactggaaacacataacatgtccataggtaagaagatttaatatggttaagctgtcagtgttatcgcaagtattcttcagattcaatgcaatccttatcaaaatcacaacagccattttgtgcagatatggaaaacgtgatcccaagttcatatgaaatgattatcagtcaaaataatcttgaaaaaggaaaacgaagtcaaataactcacagtttctgattataaaacttaacacaaaactacagcaatcaaatcagtgtggaactagtataaggacagacatgtaggccaatagaataaaattgaaattaaaaagaaactcacaaatatatggccaactgatttttaagagtgctaagtctattcatgtatataaacacacacacgcaatttaattacggtgcaaaataagaatcttggtagaagctaaacctctaaaatgaaaaaaaaaacaaatgattcaaaatgtcagaacttttctcttttatcactatataatcaaaatatattattgtcaaaaatatggagataagaaaaagaatcatagctgttaagaaaatatagataacagtccttccttccacgatgtgagcaagatagctgactaggggttcctgccatgtttattcccacacacaaaaaaatgaataaaacaacaaataaataagcagtttttgactagactgcctgaagaagaaggctaaagtacagcaagtgagtggaggtaacacaggggctaaaaagaaattatttaggcagatagtgagggtaagagagtccttggtgggatttccttttaataaaaagcagccactaaatcatttattttctaacgaaaaacagcttgaaaaatcaagctgcagacataggtatgcaagctggatgcttgcataggtaaatgccagcagctgtgccaatagaaaaagggaccgtacctggaaggcaggtatgttttttcatagaggctctagcttcccttttctttgttgccgtgtgtgcagtaagcaagcaagcaacatggtgccagccaggtagagaatccagttgcataaaaaatattagggtggagtagccaacttcttcaaatgctatgtaaatggcacagctagtccagccaatcctttgtgccctgtgtaaatcagataccacctcctcaaactcatctataaaaccagctgcacctaaccacgaatagggagatctgtttggaacgctgtccctctgcaggagggatctttgatcttttgcctatcaaacttctgctcttaaactcactccttgtgtgtccacatccttgatttccttggaatgaagcaacgaatctctagtattaacccagacaaaagatgccgcttcagaggtatcttgatggagtacagaaatccagggtggcaccttaaagggaggagcaaagaacgcagcctttgccacatcatttccctgtcaggatcagcttggaaccaaaagggacttcttgtagacaggtaagcagtaggcccccagaaatgcagtttgttattaccactgcaaacacctacagttcttggttgacaagttgttgttgtttttgttctccatagaacttttagcaatttctgtatgttattccaattgtattctggcctctatggttcctgatgacaaattattgatcttattgagaatcttttatctatgacaagttccttctctcttgctgctttatacattccctttttgtctttgtttttgccagcttgattaaaaagtgtcttgtctgactatctttcagtttatcctacatcatgtttgttaagcttcttggacaggcatatgcacgtgtttcatcaaatttgtaatgttttaggccattatttcttcaaataagccatgaaacagataacattttagtcagcaacagataacatatatgacagcgatcccttaatattgtatttttatagtacattttctatgtttacatacacaaatatttactactgtgtgcaactgcctacagtattcaatacagtgacatgctgtacagctttgtaacctaggagcagtaggttattttatatagtctaggtggatagtaggctgtcccatctagggctgtgtaaatacactctatgatgttcacataatgatgaaaacacttgagatgcatttctcaggatgcatgcctgttgataagtaatgcatgattgtattttgcccctttcttcttatttgacctccatgatacatatattggtccatgtgatggtgtcccagaggtcccttagcctgtcttcaactttccttattcctttttttcatttctgctcctcagactcagtaattttgcttggcctgtcttaaagtttgctatttttttcttctacctgcttaaatctgctactgagcttggctagtatatgttctatttcaattattataatgttaaataccagcatttcagttttatttttgaataagtttattcctcttaaataggtaatatgtgtacacaacacatgattgcaacaaaatacaaatttcaaaggcacagaagcatttacagtgacaactacttctctttcccatccttgtcttccagctatccaaagtcctttgtacctaagacaaccaccattactaatttcttgtatatcgttacagaaatcttctaaacaatacgttctgtttgttttatactttctatttaacaatattcttattttgtttatacattatttacttcatgttccttagtttttgtccatgtttttctttagctacttgaacatattttaaatcgctattttaaactctatttattaaatccagtgtctgaatttcttcagggttggtttctgtccatttatcttgttccttttagtagccttttcatttctgtttctttgtatgaattgtgactttctgttgcaaactgggcatttgagtattataaagtggcaactctaaaatcagattctgccaccttttgcgaattgtgctggtttttgttgttgttgacacttttttaaaattgtaggaatttatttgcttagtgacttttgttaacttttttctaaagactgaaattcgctttgtgtgcagtctctgaacctcttttccttgtgctcagctagtgttttgagaagatttccttgaatgctaggagctgtaacaataaaaaaaacaagcacacaaacaaaaccaaaatgaataaaaaaaccacgtttctcagttattgcagattggctctgtattggggcactctttcaacacttagccaggggactgagcctggggatcagcccaaggtgaaaacttaaagtgacttcagttcttttgtgaacatgtatcttgccctaagcatatgtgcagctttctcaatcgcccaccccgtacacatgtgattctgaacgtcccaatttcccagagaaattctccacaatgtttgctcctgatccattaatgcatctattttatattttccatttaatcttttaacctaacatctgtctgtcattaattcagcttgcattgttttttgagcaattccattccattttccaggaagattttatggctagagttctgagacagatgaaacagagaagagcatcttttctttcacgtagtctccagacaggttacaagagacacatacaataatttgtgcataaggtcttctctgcttcctctggaaccaggggccaggactctgttctaagaacactaattgttggtgtctgaagactgccatagagccaggaacaggattgggtaggacaagtaaaaaactcctcaaagatttttaccattttgaagtcacttttttactattttttttaatcagtgtttacttggttgctgtaaacctttgactctttttctgagttttgacaaaattacttttgacagtttctgctttttttttaatgcttctttaggaggatgaaagcttggagctgctgctccatcatttcgctcatattaacctcaacatgtattttaaaattaccactacattatactgcactccagttttgtgtaacttatttcccttttccaacattgactacttaataaatatatttaggtactatgccaccagaacatttatttcctcaggctgtgtgtattgcaattttacttcctatttcaaattgatccaccagaattcagtacatgaatatgcatcagaatatgatagaatccaatacattatgatgtataaaaatgttatttcacatgtgtgaggtacagctacaggttatgttatacgagcataacaattgacaaatatctattttacatttacatttgtatacactgcattttcaaacatattcttgacaggagaaaacttccattttcactaggcacaattagatattagataatagatatgtgaaattttacaaattcaataattagaatattttccataaactagtacctcatcaaataatttttgtcctccagaacatacacactttcagagccagtacatgtatcatgatgcagggaaaggcagcctaatggcctgtagaagtattcaagcaagtaattctatactatgaaggctaaagatgacaggtatgaatgaaagtgaacatatgaatatatttgactatatctcaatatatgtgtcattcaaattaactgtgcctgtaatttcctgtgtctgaggaaattggcatagaaagtaatagaattcttaaatatttgagttactgtatgttattttgcaccacttaaaaaatatatcagagccacaacaaattgtcagggctctcaaatttaagcactgttcgcttcttggtaaatcctctttacctatgtgggaaaaaataccatgagcaggtgttagctctcagcctatctgtataggctgccgcaaagacttcgttttctctgtgtcctgatttcacatttctgtttttttaaatcagggtttggcaaattggcccatgatccataccaagttctccacctgttgttgcctggcttgtgagctcagaatggtttttactgtttgatatgttttttaaaaacatgacagatataatagttcatgatgagaatgttaaattaaaactttaacataaattattatgttattattgaaacacacagtagcgtatccacttacatactgtctatagataccttcacactatcacggcagaatggagtagttaaaacagagtgtatggtcaaaattgcttaaaatatttattgtctaaccttttaaagaaaaagcaaccaccacccagatcataaattctacattaacaggataaattccattacgctttctactgtgtttcctagaatataatagagtactaggcatatagtgggtattcagtaattttgtttaaatgaataaataataaaataaattcaaagctttttcacctgtgtaacaaaataatattttgaattatttcactttttctccttcactatctcttcctttcttcttgtttataattatcttctttctttaaaggggctgatgtgataggaagaaagcagaaatatcataggcatgcctaacttgtttctaaggtgggggaaaatactggagagttatgtggctttgaagaatacaaaagaagtaagaggataacagggctttctcccagatgagtgaatgactatcttgagtagtcatgggcatagatgggtatagtaatctgaagaaagactgaagaaaatgtagaaaaaaatgaaaaaaatctcacaaaatgcaaactattaaaactcaatcgacatgaaataaacaatctgaatagtcctgtaactgttaaagaacttgaatttgtaactgaattgcttccaaaaaaagtcttcaaacacagatagttttactggagaattctaccaaacatctaaaaaatgagttagcaccaattttacatatcttccaaaaaacagaagaggataaaatactaactagttttatactaactagttttatgagattggtagtaccctgataccaaaatcagaccaaaaaacagtattaaagccaaaatactatagaccctggagaattctacaaaacgtttataaaaggagttagcaccaattttacatatcttacaaaaaatagaagaggataaaatactaactagttttatgagattggtagtaccctcatacccaaaccagaccaaaaaaatagtataaagccgaaaaactatagaccaatattgcacatataattacacagagaaatcctcaacaaactattagcaaataaaatctagcaatagataaaaagcactacataccacagccaaaatatgaaatgctcttcaaacactaaagaatcaactggatgatggttccaagatggccgaaaaggaaaaactccagtctacagctcccagtgtgagtgacgcagaagacaggtgatttctgcatttccaactgaggtaccgggttaatctcactgggactgcgtggacagtgggtgcagcccatgaagtgtgagccgaagcagggtggggcatcaccttacacaggaagctcaaggggtcagagaattccctttcctagccaagggaagcagtgacagatggtaccttgaaaattgggacactcctgccctaatactgcgcttttccaatggtcttagcaaatggcacaccagtacattatatcccacacctggctcagtgagttccacacccaaagagccttgctcactgctagcacagcagtcccagatcaaactgcgaggtggcagcgaggctgggggaggggcttccaccattgctgaggcttgactaggtaaacaaagctgccaggaagctccaactggatgcagcccaccacagctcaatgaggcctgcctgcctccatagactccacctctgggggcaggacatagctgaacaaaaggcagcagaaacttctgcagacttaaatgtccctgtctgacagctttgaaaagagcagtggttctcccaccatggagtttgagatctgagaatggacagactgcctcctcaagtgggtccccgacccctcagtagtctaaatgggaaacacttcccagaagggccgactgacacctcatacagcaggtgcccctctgagacgaagcttacagaggaaggattaggcagcaacatttgtcgttctgcaatatttgctgttctgcagcctctactggtgataccaaggcaaacagggactggggtggacctccactaaactccaacagacctgcagctatgggtcctgactgttagaaggaaaaccaacaaacagaaagaaagagcatcagcatcaacaaaaaggacatccacaccaaaacctcatctattggtcaccatcattaaagaccaaaggtaggtagataaaactacaaagatggggagaaaccagagcagaaaagctgaaaatttaaaaaaccagagcacctcttctcctccaaagatcgcagctcctcgcaagcaacggaacaaagatgggcggagaatgactttgtcaagttgacagaagtaggcttcagaagatcagtaataacaaactcctccgagctaaaggaggatgttcaaacccatcacaaagaagctaaaaaccttgaaaaaatgttagatgaatggctaactagaataaacagtgtagagaaggccttaaatgacctgatggagctgaaacaatggcatgagaactatgtgatgcatgcacaagcttctgtagatgattcaatcaagtggaaaaaagggtatcagtgattgaaaaccaaataaatgacatgaagtgagaagagaagtttagagaaaaaaagagtaaaaagaaatgaacaaagcctccaagaaatatgggactttgtgaaaagaccaaatctacgtctgattggtgtacctaaaagtgatggggagaatggacccaagttggaaaacactcttcaggatattatccaggagaacttccccaatctagcaaggcagaccaacattgaaattcaggaaatacagagaacgccacaaagatactcctcaagaagagcaaccccaagacacataattgtcagattcaccaaagttgaaatgaaggaaaaaatattaagggcagccagagagaaaggtcaggttacccacaaagggaagcccatcagactaacagcagacctctcagcagaaattctacaagccagaagagagtgggggccaatatgcaacattcttaaagaaaagaattttcaacccagaatttcatatccagccaaactaagcttcataagtgaaggagaaatgaaatcctttacagacaagcaaatgctgacagattttgtcaccaccaggcctgccttacaagagctcctgaaggaagcactcaacatggaaaggaacaaccagtaccagccactacaaaaacatgccaaattgtaaagaccatcgaggctaggaagaaactgcatcaactaacgagcaaaataatcagctaacattataatgacaggatcaaattcaaacataacataacaatattaaccttaaatgtaaatgggctaaatgccccaattaacagacaaagattgtcaaactggataaagagtcaagacccatcagtgtgctgtattcaggagatccatctcacgtgcagagacacacataggctcaaaataaagggatggaggaagatctaccaagcaaagggaaaacaaaaaaaaaaaaagggggggttgcatttctagtctctgataaaatggacttcaaaccaacaaagatcaaaagagacaaagaagggcattacataatggtaaagggatcaattcaacaagaagagctaactatcctaaatatatatgcacccaatacaggagcacccagattcataaagcaagttcttacacacctacaaagaaactaaaactctcacacgataataatgggagattttaacaccccactgtaaacattagacagatcaatgagacagaaagttaacaaggatatcccggacttgaactcagctctgcaccaagcggacctaatagacatctacagaactctccaccccaaatcaacagaataaacattcttctaagcaccaaatcgcacttattccaaaactgaccacatagccgaaagtatagcactcctcagcaaatgtaaaagaacagaaatcataacaaactgtctctcagaccacagtgcaatcaaattagaactcaggattaagaaactcattcaaaactgcacaattacgtggaaactgaacaacctgctcctgaatgactactgggtaaatcatgaaatgaaggcagaaataaagatgttctttgaaaccaatgagaaaaaaaagacataacatatcagaatcactgggacacatttaaagcagtgtgtagagggaaatttatagcactaaaagcctacaagagaaagcaggaaagatctaaaattgacatcctaacgtcacaattaaaagaactagagaagcaagagcaaacacattccaaagctagcagaaggcaagaaataactaagatcagagcagagctgaaggagatagacacacaaaaaacccttcaaaaaatcaatgaatccaggagctggcttttgaaatgattaacaaaataggtagactgctagcaagactaataaagaagaaaagaagaatcacatagatgcaataaaaaatgataaaggggatatcaccactgatcgcacagtaatacaaactaccatcaaagaatactataaacacctctacacaaataaactagaaaatctagaagaaaatgatgaattcctggacacatacaccctcgcaagactaaaccaggaagaagttgaatccctgaatagactaaaaacagcctctgaaattgaggcaataatagcctaccaaccaaaaaaagtccaggacttcatggattcacagccaaacactaccagaggtacaaagagaagctggtaccattccttctgaaactattccaatcaatagaaaaagagggaatcctccctaactcatgttatgaggccagcatcatcctgacaccaaagcctggcagagacacaacaaaaaaacagaattttagatcaatatccctgataaacatcgatgcaaaaatcctcaataaaatactggcaaaccaaatccagcagcacctccaaaagcttagccaccaagatcaaatttgctttatccctgggatgcaaggctggttcaacatatgcaaatcaatagacgtaacagaaccaaagatcaaaaccacatgattgtttcaatagatgcagaaaataccttcgacaaaattcaacaaccttcatgctaaaaactgtcaataaactaggtattgatggaacgtatctcaaaataataagagctatttatgacaaacccatagccaatatcatactgaatgggcaaaaactggaagcattccctttgaaaactggcacaagacaaggatgcccttccaccactcatattcaacatactgttgaaagttctggccagggaaatcaggcaggagaaagaaagaaagggtattcaattaggaaaagaggaagtcaaactgtccctgtttgcagatgacatgattgtatatctagaaaaccccatcatctcagcccaaaatctccttaagctgataagcaacttcagcaaagtctcaggatacaaaatcaatgtacaaaaatcacaagcattcttatacatcaataacagacaaacagagagcaaaatagtgagtgaactctcattcacaactgcttcaaagagaataaaatacctaggaatccaacttataagggatgtgaaagacctcttcaaggagaactacaaaccactgctcaacaagataaaagaggaaacaaacaaatggaagaacattccatgctcatggataggaagaatcaatatcatgaaaatggccatactgcccaaggtaatttatagattcaatgccatccccatcaagctaccaatgcctttcttcacagaattggaaaaaaactactttaaaattcatatggaaccaaaaaagagcccgcatagccaagacaatcctaagcaaaaagaacaacactggaggcataatgctacctgacttcaaactatactacaagcctacagtaaccaaagcagcatgttactggtaccaaaactgatctatagaccaatggaacaggacagagccctcagaaataataccgcacacctacaaccatctgatctttgacaaacttgacaaaaacaagcaatggggaaaggattccctatttaataaatggtgctgggaaaactggctagccatatgtagaaagctgaaactggattccttcgttacaccttgtacaaaaattaattcaagatggattaaagattcaaatgttagacctaaaaccataaaaaccctagaaggaaacctataccattcaggacacaggcatgggcaagaacttcaggactaaaacaccaaaagcaatcacaacaagagccaaaatagacaaatgtgatctgattaaactaaagagcttctgcacagcaaaagaaactaccatcagagtgaaaaggcaacctacagaatggaagaaaatttctgtaatcaatccatctgacaaaggactactatccagaatctacaaagaacttaaacaaattacaggaaaaatcaaacaaccccatcaaaaactgggcaaaggatatgaacagacacttctcaaaagaagacatttatgcagccaacagacacatgcaaaaaggctcatcatcactggccatcagagaaatgcaaataaaaaccacaatgagataccatcttacaccagttagaatggcgatcattaaaaagtcgggaaacaacagatgctggagaggatgtggagaaataggaacacttttccactgttgatgggagtgtaaactacttcaaccattgtggaagagagtgtggcaattcctcaaggatctagaactagaaaaaccatttgacccagccatcccattactgggtatatacccaaaagattataaaacatgttgctataaagacacatgcacacgtatgtttattgtggcactattcacaatagccaagacttggaaccaaccaaaatgtccaacaatgatagactggattaagaaaatgtggcacatatacaccatggaatactctgcagtcataaaaaatggataagttcatgtcctttgtaggcacatggatgaagctggaaaccatcatactgagcaaactatcgcaaggacagaaaaccaaacaccgcatgttctcactcataggtgggaattgaacaatgagagcacttggacacagggtggggaacatcacacaccagggcctgtcgaggggtggaggcatgggggagggatagcactgggagaagtgcctaatgtaaatgacgagttaaggggtgcagcacaccaacatggcacatgtatacatatgtagcatacctgcccattgtgcagatgtaccctggaacttagagtataataaaaatttaaaaaaaaagaaatatgaaaacacatacacacaaattttttttctaagaacaaaattctaacaggaacaggaggggagctgggctggctctaaagtgttcccaccataatgtggaaaatacacacatgatgatatatttgattactaagatcccattaggcccatttaggcactttatgtatttcctttgctctggacgttgagtcgttttctgctcagtttgaagcaactggcttattgtctcagagtggttctagaactttgctttcaggtgtggctggggagggagccctggcatttcaagacaggtggaggtgatatggttggactctgtgttcccacccaaatctcatgttgaaatgtaactcccaatgctggagatgggcctggtgggaggtgacgaggccatggaggtggcttctcatggtctagcaccatcccccaggtgctgtcatccctgttgtgagttcttgtgagatctggttgtttaaaagtgtgtggcacctctccccttgctctcttcctcctgccccagccatgtaagatgtgccagcctctcctgtgccttctcccatgatcataagtttcctgagacctccctagaagcagaagccagtatgcttcctgtatagcctgtggaaccgtgagccaataaaacgtttttctttataaattaaaaaaaaaaaaagaatcaaccaacataagcccctgtgtcaataggctaaaaaagaaaaatcatatgattatatcaattgatgcagaatagcatttggtgcttaatataacgccaattcaaataataaaaatatctcaggaaactagaaataaaggagacctttctctatttgacaaagaacgtatttttaaaaacctatagcaaacattgtacgtaatgatgaaagactggatgagttctctctaagattgcagacagggcaatggtgtccaatcacatcattcccttactaaaatagcacttggatttctaaccatttttgtatagcaggaaaaagaaataaaatacatacaggttaaaaaggaagaaataaaattttctctatttgaaaatgacattattgtctacatagaaaatcccaaggaatgtgaaaacaattttctataactcataaatgcagtcagtaaagtcagaaggtcagaggatataagaacacattagaaatcatttacttttatatattaataataagcctgtagaaacaaaattctgaaacaccatattggaggtagagcaagatagcagacatgtaggctccaccaatcatcccctactgcaagggcaccaatttaagaactatctacatagaaaaatcaccttcataagaaccaaaaatcatatgagcactcatagtcgctgatttaactgtgtatggctgaaagaggcatgaagagataaagagccctaaatggtcaatgccacccttcccctctacaccccaccctccctacatctctgcagcagtagtaaggagaggagaatgactctcagtgctgggtgagggataacacggcaattgtgaggcattggactcagtagtgtcctgttagagcagaaggtaaaactgcatgaaactcagctgatgcccatccacaggggaaacatttaaaccagccctaacaaggcaggaatcaccaatcccagtgacccaaacttcaccaccaagggatacagtgctctgtgtctccaaataaacttaaaaggcactctaggccatgaggacttgccaactcttggcaagtcctagtgttaaactaggtccagagacagtggattgggagggcatgtgactgacatactgagacaacagccgggacagccaaggtaatactggcatcatccgtcccataaccctaggctgcacaactcatggctccaaatgagaccccatccttccacttaaagagaggaaagtggatactttggacatcttggataccagcttagtcacagcaagataagtcatagtcagagtcatgaggactccgttccaggccctagctccaaaatgacatttctagatagaccctgggccagaagggaatccactgctttgaagaaaaggacccagtccttgcagagttcataacctgctaactgaagagcccttgggccctgagtaaccagtagcaatacccaggaactatgttgagggcattgggtgagatgttgagacatggtggcttcaggtgagactcagtactttaccagctgtgttggctacatggcaaaactctttctactggagaaaagcagagggaaaagtaaaaggaagaccaagtcttgtatcttaagtatcagcattgccacatgggtgtagagcaccaagcaggctcctggagtccccagctccaggacttgactcttggatggcactatggacctgctgtgggccagaggggagcctattgccctgaagcatgaatcctaggccatccagcattcaccataagctgatataagagtccttgggccttaagggaatatcagtggtagtctgaccgtactccttgtggcctggagtggtggtggctactgggtgaggctcgtttgtctttggaaagggaagggaagagtgggaaggattgcatcttgtggtttgattgccagctcagccacagtaaaatagaacaccaggtagacttctaaggtttttaactctagtcctaactccctgatggcacctctggatctacctgaggcccaggagacctcactgacctgaaaagaaaaagacataggcctggctggctttgccaatggctgagagatacagaggcctgggacaagacccagtgctgtgctggcttcagttctgaccaagtgcagtcatagtggtaggggccacaggggtgcttgtattactctacccccagcttcaggacagagagaatcttttttttttagaaagtaagggaagataacaagagtctctgcctggtaatccagagaattctctcagatcttgtccatgaccatcaaggcttaatatgcagatactaacaacccctatgactatgcaggaaccactgcatttactgggcttgggatacaccctatagcagatacaggttagatcacaacacccaagtcctttcaaatacccgaaagtcttccagagaagaatggctacaataatcccagacagtggagactctaacaaatacctaactcttcaatgcccagacaccaaagaacattgttaatatcaacactatccaggaaaacatgacctcagtaaatgaactaaaaatagcaaaaggaccaatcttggagaacggtcacacgtaacagagatacgtgaccttttagacagagaatttaaaatagctatgttgagaaaattcaaagaaattcaagataacacagataaggaattcagaatgctacccaataaatttatcaaagagattgaaataattaaaaagaagcaggaatcctggagctgaaaaatgtaactggcatactgaagaacacattagagttctttaatggcagaatcgatcaagctggaggaagaattagctctaagacaggctatttgaaaatacacagtcagaggaggcaaaagaataaaaaacaatatattgcctataggatctagaaaatagcctccaatgggtaaatctaagagttattgtccttaaaagaaggtagagaaaaaggtatgggtagaacatttattcaaaaggacaataacagagaagttctcaagcctaaagaaagatatcaatatccaagtacaagaaggttatacaacaccaagcagattcaacccaaagaagggttaaactctcaaggcatttagttatcaaactctcaaaagtcaatgataaagaaaggattctaaaagcagccagagaaaataaacaaaaagagctccaacaggtctggcagccaactctttcagtggaaacttacaggctgggagagagtggtatgacatatctcaagtgctgaagcaaaaaaatggttaccctagaatagcatatttagcagaaatatcttttgaatatgaagaagaaataaaaacttccccagacaaactaaagccgagggatttcatcaacatcagctctgtcttagaagaaatgctaaaggaattattttgaccacaaagaaaaggacattaattagcagtaagaaatcatctaaaggtatacaactcactggccatagtaagtaaacagaaaaacacagaatattataacactgtaacagtggtgtgttaactactcttatcctaaatagactaaattataaagcatccaaaaataataactacactttgggaggccgaggcgggcggatcacgaggtcaggagatcgagaccatcccggctaaaacagtgagaccccgtctctactaaaaatacaaaaaattagccgggcgtagtggcgggcgcctgtagtcccagctgctctggaggctgaggcaggagaatggcgtgaacccgggaggcggagcttgcagtgagccgagatcccgccactgcactccagcctgggcgacagagcgagactccgtctcaaaaaataaaaataaaaaaaataataataataataactacagcaacttttccaagacatagtcagtacactaaggaataaacagaaaaaaaaaacccaaaaatttagtaaggagaaaaagccaaggcttagagttttgagtagttttcttcgtatcagtgttaagttcttatcagattaaaataatgggttataaaatagtatttgcaagcctcatggtaatctcaaaccaaatatgtacaatagatacacaaaaactaaaaaacaagaaacgaagtcatatcactggagaaaatcaccttcactaaaggaagacaggaagaaaagtaggaaggaagagatcacaaaacaaccagaaaaagaaaatggactaaattatccaatcaaaagacagtgactggctgaataaatgaaaaaacaggacccaatgatctattgcctccaagaaacacacttgacctataaagatacacacagactgaaaagaaaggtatggaaaaagatattccatgccaataaaaaccaaaaaagtgcaggagttgctatactcatatcagacaaaatagatttcaagacaaaaactataagaagctacaaagaaggtcatatataatgacaaaggtatcgattcagcaagaggatataacaattttaaatagatctgcacccaacactgggacatccaaatatatagaggaaacattattataactaaaaagagtaatatgtccaaatacgataactggaaactttaacaccccactttcagcattggacctatcctcgagacagaaaataaagaagcatctgacttattctgcactacagaccaaatggatataacagatatttatagaacatttcataaaatggctacaaaatacatattcttttcctcagcatgtggatcattatcagggatagactatatgttaggtcacaaaacaagtctgaaaacatttaaaaaaatggaaataatgtcaagcatattcccataccacaataaaactagaaattaataataagaggaattttgcgaactatacaaatacctagaaattaaaccatgtgctcctcaatgatcagtgtgtcaataaagaaattaagaaggaaatggaaaaatttcttgaaacaaatgataacctaaacacaacataccaaaacctatgggatacagcaaaaatagtactcagagggaccattatagatataagtgcctttatcaaaaaagaggaaagccttcaaataaacagtctaacaatgcatcttaaagaactaggaatgcatgtggaaaccaaacccaaaattagtagaagaaacaataaaatattagagcagagataaatgaaattgaatttttttaaaaagtacaaaatatcaataaaacaaaaagttggcttttaaaaaagttaaagaaattgacaaacctttagccaaactaagaaaaaaagatacaaataaataaaatcagaaacaaaaaaggagtcattacaactgacactgccaaaacgtcattagtagttactatgagcaactatatgacaacaaattggaaaatctagaagaaatggacaaatttctagacacataccatctccagagactgagccaagaagagatccaaaacctgaacagaccaataagaagtacaagatcaaaggcataataaaaaaaaatctaccagtaaagaaaagcctgggacccgatggcttcactgctgaatccaaccaaataaacatttaaagaggaatgaataccaatcttactcaaactattccaggaaatggaagaagaggaaatacttccaaactcattctatacaatcagtattaccttgatatcaaaaccagacaaagacacatcaaaaaaagaaaactacaggccaaaatctgatgaatattgatgcaaaaatcttccataaaatactagcaaactgaattcaacaatgcattagaaaaatcattcatcatgaccaagtgggtttacctctgggatgcaaggatagttcaacatgcacaaaccaatcgatgtggtacatcaagtcaacagaatgaaggataaaaaccacatgatcctatcaatagatgctaaaaaataattcaaaaaattccacatctcttcatgataaaaacccccaaaaacctgggtatagaaggaacatacctcaacataacaaaagttctatataagacacccacagctagtatcatagtgagtggggaaaaactgaaagcctttcctctgagatctggaacacaacaatgatgccaattttcaccactgttattcaccatagtactggaagtactagctagagccatcagaccagagaaagatttgagcatccaaattgaaaacgaacaagtcaaattatccttgtttgcagattatatgatcttatactaagaaaaacctcaagattccccccaaaatgattagaactgataaatttatggaatttgcaggacacaaaatcaacatacgaaattcagtagcatttctatatgccaacagtgaacaatctgaaaaagaaataaaattcatcccatttacaatagcacacataaaattaattacctaggaattaaccaatggagtgaaaaatgtcagtgatggaaactataaaacactggtgaaagaaattgaaaggaacgccaaaaaatgaaaataaatagttcatgtatatggatcggaagaatcaatgttgttaaaaagttcataccacccaaagctatctacagactcagtgcaatccctatcaaaataccagtgactttcttcataggaaaaaaaaaaaaaacacaatcctaaactttatatgaaaccacaagaaaatccaggatagctaaagttatcctaatcaaaaagaatgaaactggagtaatacatcacctgacttcagattatactgtggagctacagcaacaaaagtagcatggtattctcataaaaacagacacatagacaaataaaacataataaacaacccagaaacaaatccacacactacagtgaactcattttcaacaaaggtgccaagaacatacaatggagaaaagacagtctatcaataaatggcattgggataactggatatccatacaccaaagaatgagactagacccctatctcttgccatatacaataaacaaatcaaaatggattaaagacttaactctaagacatagatctatgaaactactacaagaaaacaacgagtaaactatccaagacattggtctgggcaaaaatttcttgagcaatacctgacaagcacagacaaccacggcaagaatggacaaataggatcaaatcaagttaaaaagcttttgctgttatgatcaacaaagtgagtcaccaaagtgaagagaaaacccacaaactgggagaaaatatttgcaaactacccatctgacaagggattaataaccagaatacataaggagctcaaacaactctataggaaaatgtctaaaaattcaatcaaaaaatgggcaaaagaatagatatttctcaaaagaaaacacacacatggcaaacaggcatacaaaaaatgctcaacatggattatgagaaaagcaaatcaaatctacaaggagatgtcatcttacctgttaaaatggctttcatatccaaaggacaggcaataataaatgctggtgaggatgcagagaaaagggaacccttgtatactattggagggaatgtaaattagtaaaaccactatggagaacagtttggagcctcctcagaaaacaaaaaaaattgagctaccatatgatccagcaatcctactgctgggtgtacacacaaaagaagagaaaacggtgtatcaaagagatatctacatgcctgtgtttgttgcagcattgtttacaatagtcaagatttggaaacaacctaagtgtccatcaacagatgaatggataaagaaaatgtggtccatatacataatggagtactgttttgccataaaaaagaatgaaatccagtcacttgcatcaacgtggatggaactggagatcactgtgttaagtgaactaagccaggcacagaaagacaaacatcacatgttctcacttatttgtgggacctaaaaatcacaacaattgtactcatgaacatagtaaaacgatgattaccagacgctgggaatggtagtggggatgcgtcaggtgaggtgggaatggttattgagtacaaaaaatagtaagaaaaaatgaataagacctgtttgatagcacaatagggtgactatagtcaataataacttaattgcacattttaaaatgtatcttaaagagtataattgaattataactcaaaggataaatccttgagggcatgaatactccattctccatgatgtaattatttcacattgcattcttgcatcgacatctcatgtaccccataaatatatatgcatactatatgccaaagaaattaaaaattaaaaaattaaaccatactatttataatcacttcaaagccaaattaaaaatttatcagaacatttacagataatttatgctgaagtttaaaaatgattcctgaaagataccaaaaaaaaactaagtaagtgaaaagacataacatttttatagatcagaggattcaatatagtaaaaatgacaattctcctaaaatttttacacatgtttaaggcaattaaagcaagagtattatgaagaatataaatacatattctaaagtcaatatataagaatagaaacacatattctaaaatcaatacataaagacccaagcccaagaataacaataataatattgaaataaagaatacagttggaggaatcactttacctaatgtaaaggtctattatgtggctacagtaatcagctgtgatattgtcagaaagacagatattctgattcatagaatgcaatagagaagtcagaaatacacaccaatttacctaacagacttttgacaagtgtgtaaaaagaaataatggaggaagaaaaagcttggaacaatggcatacacaacagaaaaaagcaaaaagattgacttaaaactcacattttgtacaaaaatcaaccaaaaatatatcatagactttaatgtaaaatataaaactataaaaatttagggaaaaatgtagaaaatattgctatgtagagttaggcacatagttcttatattttacaccaaaagcacaattcatttaaaaaaataggcattggatctcaaaaatattaaaaatttgtctcatgaaagacttgactaatagaataagaaaacaagctatgagagtaggataaaatatttgcaaacttatatatatatcctatagaggactgttacctagaatatggaaagaacctcaaaaccataacaaaaaaaactcacaaagaattcaattagcaaatgggcaaaagatgtctagacattttactaaactgaatatatggctggcaaataaacacataaaaaggtgttcaatgtcatgagctattaaggaaatgcaaactaaaagcacaatgagttaggcaaggtgacaaatacttgtggtcccaactatatgggtggatgagctgggaggatcgcttgagcccagaagttcaagaccagcctcagctacatagcaagatcctgtctcttaaagcacaatgaaatatcactacacagctgttatcatatgacaacaccagactggagaggatgtgaagaaattgaattcttgcaggaaaggatatgaagtgttataatcattctgcaaaaaaagtttataaaacaaaacttgcatccaccatatggcccagcaaacacacccctagatatttatctcagataaagaaaaaaaattgttcacacaaaaacttgtacacagggttcatagtagcattggtcataatagccaaaacctagaaacaactcagatgttcctcaatggatgaataattaaataaactgtgatacattcatactataggttaccaattagaaataagaatgaaactattgatatatacgacaacttggatgaatctccaggaaattatgctgagtgaaaaagaaaatccggaaaggtaagtaaataccatatgattctgaatataacattcttaaaccatcaaaactgtagaaatgaagaacaaataagtgattgtcgggggttaacgtgagggtggaggaaaaggagtgaggtttcaaaaagacaagggatgcccacagtgatggaactgttctgtgtcttaactggatcaatgtcagcatcctagttgtaatatggtattacagttttataagatgttaccattgagaaaaactaggtgaatgttgcagattctctctgtattatttgttacaactgtatgtacactgataactgtctcaaaataaaagtttataatcagtgtttaggtagtaatttcccccataaactcaggatttggggacttcaatctgaacacgaacctcggtctgtaagcctattcaaaacttcttccaggggaaagttttgactttgtcaaagagtgagctccagcctacctctgaataccagtgcaaggcttagaggaatcagttacctaacctggtcagagtaattgggagtgcgattctattgca

SEQ ID NO: 32 - DNA, 57578 bp, Homo sapiens
taatcagtgtttaggtagtaatttcccccataaactcaggatttggggacttcaatctgaacacgaacctcggtctgtaagcctattcaaaacttcttccaggggaaagttttgactttgtcaaagagtgagctccagcctacctctgaataccagtgcaaggcttagaggaatcagttacctaacctggtcagagtaattgggagtgcgattctattgcagcaatgaaatgatacatcccatagagtaaagtgaccataggtttcatactgtcactgagaagaacaaagagagaaataaaatggacccaaactttaggattctctttcatttaataccacaaaaggcctgtgtttcagccacaggcaggtactacagtcttccattgtttggaattcagctactataaaccccctaccaagccaactgatactcaagggaaagaggctaaggaccacatagccattgatgtgtctagaatctcagagatctagcatgatatcatatgctgaaatcctaaccctcaatgtgattgagtttgaagatggcatattgagagacaattaggtttagatgaggtcatgaggatggggtcctcttgatgagattagtgcccttatgagaagaagagacaccaggtcggtcagtctgtctgtctctctctctctctctctctcacacacacacacacagacacacacacacacacacacatatatatgaagacacagcaacaaggcagctgtctgcaagctagtaaggagtctttatcagagcctgaccatgttggcaccctgatctcgaacttctagcctctagaattgtaagagaataaatttctggccgggcccggtggctcatgcctgtaatcccagcattatgggaggccgaggcgggtggatcatgaggtcaggagatcgagaccatcctggctaacacgctgaaaccctgtctgcactaaaaatacaaaaaattagccaggcgtggtggtggtcgcctgtagtcccagctagcaggaggctgaggcaggagaatggcatgaacccaggaggcagagggtgcagtgagccgagatcgtgccactgcactccagcctgagcgacatagcaagactctgtttcaaaaataaacaaacagcaacaacaaaaaaaaaccgcagaaaataagtttctgttgtttaagccactcagttcatggtattttgttatgggaccctaagctgatcgagacacatgtgagtaattcttttgtattctgaaacatgttacccgtggtttattaataattttgttgcaaattttatttttgtttgaaacaattttaaacctaaagaaaagtcatgtgcataatttttaaaaattgttgtatattctttgggacctcattcaaactttgctaaatctgattggctttaaaacatgtctacaagttctttagcgctccttttataaaatggtagaggctgtttcagaaaatttggtacagcttcctcctctctccctctttgaaggcttactcttctaatacaggcaccatgaattaaggaaacggaggtacatggatgggccacatgtaggtgttctgacaggtagtcctatctaaggtctctgatgacaactatgatcagcttccaggcatgggggtgagccagtcttcaaatgataccagccctcaaattctgagctgtctcagctgtcgcccagtggagcaggtatcagctacctccactgaaggccgttgaaattgcaggttgcgagcaaaataaatgccatcaactgatttacagccactctgttttggagtagtttgctacagagaaatagataactagaaaaccatctgttccagtaacgcactctgtagacaatgaatccaatctagaatcacgtggtatacacagctggcaaatgtccagtttccttcaacagtttctcaatttttccttgattcctgaccttaatatcttccaaaatgtttctcaatttcagattgtgctaaatctcttcaagttaatgctcaagttatgcgtttttgtctgatataatatagaagttttttttcttcctttaacgtcttatcagatgttgcctgatgtctctttggcccatgactggtggtagttactttcactagttgactaagactgtgacagccagaggttcccactggagttacttttccctctattaaaattaatgttttaaaaatgtgcttggaatatatgaaaaaaatcatgtctcatatcattttctcccgttagtctcatcatccattgataattttgcctgagataaatactactcagatcattgtgaaatggtgcttttctaatcctatgatttcttgtacatttttagttggcattctatagtaaaaatgatatttattcatttataatatggattcaaagatttttattttattcaatcaaacgtattgtcattatatatgtaaaatatatattatatatttatatatacaaaggcatatatctaaatatacagtcatgtgttgcttaacagagtgatattctgagaaatgcatcatttggtgatttcgccattgtgcaaacatcacagagtgtatttaccaaaaacctgacaaacctaggctaagtggtatagcctactgctcctaagctacaaacctgtacagcatgttactctactgaatactatagtcagctgtaacacaatgttaagtattcgtatatctaaacacagaaaaggtacagtaaaaataatgatataaaagattaaataatggtacacccctatagggcacttctagtcctgaagcttgcaggacgagaagttgctctggatgagtcggtgagtggtgagtgaatgtgaaggcctggaactttactgtccactactgtacactttataaacactgtgcatagaggcgacgctgaatttatttaaaaatatttttcttggccactcacagtgtctgatgcctgtaatcctggcactttgggaggccgatcactaggtcaggagatggagaccatcctggctaacacagtgaaatcctgtctctactaaaaatataaaaaagttagccgggcgtggtggtggtcgccttgtagtcccagctactcaggaggctgaggcgggagaatggcatgaacccaggaggtggaggttgcagtgagcagagatcatgccacttcactccagcctgggtgacggagtgagactccatctcagaaaaaaacaaaaacaaaaacaaaaacaaaaaagttctttctttcttcaacaataaccttaacttactgtaacattttaatattatgtaatttttaaaaactttttgactcttttgcaaacacttggtttaaagcacaaccatgtatagctgtacaaaactaaactatttctttctttctgaataatattattcaaaactattttctttctttatactcttattctataagcttttccctatttaaagtttttctaaaaaacatttttgctaaacaccaagaaaatacccgtagcccaggtctacaaagaatcaagttcatcaatatcactgtcttccagctccacatcttgtcccacttgaaggtcttcagagacaataacacagatgaagctgtcatcccctatgataaaaatgcgttcttctgaaatacctcctgaaggacctgcctgaggatgttctccagttaactttttttataagtagaaagagtataatctaaaataatgataaaaaactacagtatactatagtaaatacataaatcagtaacagtatttactgtgatcaagtattatgtactgtgcataactgtatgtgctatagttttctatgactggctgcaaagtaggtttgtttacattggcatcatgacaaacatataagtagtatgttgtgctctgaccttaggatgcttatgacatcactaggtgataagaaattttatctccatcataacctcctgggaccaccaatgtatatgtggtccttcattggctgaacattatatagcacataattttatatatatataaaatgtatatacatattatatttaatatacaatattatatgttatatacatatatatgcctctgtgtgtgtgtgtgtgtgtgtgtgtgtgagtgtgtgtgtgtgtgtgtgtgtgtgtgtatgctcagcccatagaagcatctcccaactggctcatatgtctttttgacatgtccccatcattgagcatttttcttactctctaacacaggagacttaagtgtttggtatttgataatactatttttaccaagtgataattttaaataacattactgttatttatttgttagttgtaaaataagtacttgtgcagaaaaataaaaaaaaaacatggtcagtagattaaaaaagaagaatgttgaaagtacaggaaatgtgaattgtatattcactataagaaatataaaatagtacttcttactaggtatctggaaatagttgatgcttctagagaaaatgtaaaaagagggatagaagaaggtgggtaagtaatactagttatatccccataatacagtagctcaaattatataaagtttattttctctcacagaacactgaagacatagacatatgaatagtctgatttcctatagatcatgatgttaaaaacacacattactggccaggcacggtagctcatgcctgtaatcccagaactttgggaggccaaggtaggcagatcacttgaggccgggagtttgagaccagcctggccaacatggtgaaacccccgtctctactaaaactacaaaaattatccagggtgctggtaattgtgccaaaattgttccagctttggtcctaagttattttcacatgtctttttttttttcctcatcaaaaccctatgtggtaagtgcttcttataatggtcctttaatagaagaaaaaacaagcctagagagattcatactttgtacagtacagtaggcagaataacctcttttgtcctgccaaagattttcatactttagattctagagactgtgaatatattattctacacagcaaaagagattttgcagatgtaatttaggctcctaataaattgaccttaaaataggaagtttatcctggattagccaggtatccgggtaatgcgatctccacagagcaacctggcaatgtattcccaacagctataaaagctgactagatggtgcccacctagattgagggttagtctgcctctcccagtccaccgactcaaatgtcaatccctttagcaaccaccctcacagacacagccaggaacaataccttgcatccttcaatccaatcaagttgacaatattcactatcacagtggagaaattcaagccatgagaggaatttgacttactgttactggaggctagatatttggaaaccatgagaagtccgcatgagcagccagcagtgcaaataccaggccctgaatgatggccagcaaggagacaaagtaactacgaccaagtcttgcataccatattctatatatatatagttttctatgtttgcttgttttgagatggagtctcaatctgttgcccaggctgcagtgcagtgtcaggatcttggctcactgcaacctctgcctcctgggttcaaatgatcctcctgcctcagcctctcgagtagctgggactacaggtgcccaccagcacactggctaatttttgtagttttagcagagatgggggtttcaccatgttggccaggctggtctcaaacttctgacctcaaatgatctgccctccttggcctcccaaagtgctgggattacaggcatgagccactgcgcctggccagtaatgtatttttttaatatcatgatatataggaaatcagactattcattgatacatggcaggataaattatgagattttgtgggtctaagacctaaagctataagagacactttaaacatcaaatggacaattttaaaacctctacagagagaagtgagttgatataaccacttttttggtggctgcaggtggaggcaggggaatgaactgtcctcttttatgactgttctcccatttcacctgttatttaattatattttcaagaagttttgctttcacaaaactatatgaaatatttaaagcttaaaaaaataaatcatgaagaggaccgttggtaaggtgcttagaggaaacagcttattttgtgaagatggcattctttattatttatacacttcaaaacctgaaatcaggattcacctggagacttaaggggaaggtggggtggtactaatatttagtgtcttgggaatttttattttcagtaagttcaaaaagcaactagaaaactgagttgagtgactgatccaggtctacaaactttaaagtttcagcagagaaaatgaagtgattgcacgttccttttctcagcacctaatctaatcacatttcttcatgggttgtttgaacaaagcggctccatcctgctgccggagtgttaccgcattcttggcatttggacagtgaagaggaacaatggcctatctaatagaaaggttgagtccaaagctgaccccatcgcagtgtgccaatttaatagacaagaacaaggatgtagaagatgaactaataaaaacaaaccagaagatattgattggaacccagaagcatggtgtttaatttaaaagacagctcttcagaaagtcctttcttctgttgtcaaacagacatgggaacttgcctagacttccaagcattcaattagaacggaggcaaaggactgatagtcttggctttcaaacaaacgctagggcactgggtagatgcagagttggatttcacgattctttcaggtttttagttttaattgctactgtctaaaaaaaagcagatatgctttcttttgatatatttaactgctgtcctcttttacatcatagaaaaaaaacaggtctagatctaagtctaactaatagcttttaatttaccatgaaacaattctacggggctgatgtctttcactttttaaagcagagtggcttattcgtgaaatttgttttctaaagttaatatactatgtggaatacgaatgaaactgcagattgcagttgattgattctgcctgaaagcattaaatttaagagacttccgtgtgtaaaggtttattcctttttttgttgtgttgactaggtctcaaaagataattgaattaagtcatacctttggccaatagtagggaatacaaaataaaaatatagttttcaattgtgcataggtgagctaaagtataaaactcctatatattcagtgatacagagaggacatgttaaggtcaaataagtatcattatactaagatttaagcaaacttctcctgggcaagacaagtaatgtcaagagtggaaaattacaaaccttaagcatgtgattgctctttatggtgatggggtattgatagatggtggtgttcaggtatgtgtttaccattttacttctgtgtcctcacacccatgagtatctgaatgtatcaggtaaattcctgctgctttgtaggtagagtgaacgtaaatatcatgagctacgctaggtctgtgaatcattatagtcataactgactttgcctcagatatacagacacatcccttgtctaaatgaatccatccactgaagtcatcctgaaagacaagttcctttataaaatggcattgctcaaaaaatataaagctgcaaggcatccattttaattcctataaatattgcttaaatagaaaacatttgtgccacaaatttgaaattctagaataaacttcacacatatctgtcatcacatgtaactttgaagtcctgtcagcacaggtatctaatttatatgaagcaccctggagtcaatgtctctttgtactgttatttgtcaaatgattcaagcactgctttaaagtatatgtgaggttactagtcaatcttaacgctctaaatctgcatgctatgctacgcacatttttttcctctaagcacatgaaattctaaattatatttgcctttgatatttttatttttctttctttaaggaatatcacgggaaagcatgaagctgttataaagttaatatctgctattctggtaaggagtaaagtcctggcaagaattagtttgtctatgtgcctatgtgtatgtttgtgactctagggtgtgtaagtggtaaatgggctcttctaagagacacagaaatgtgattggatagtgaggacagttctaatcaaatgaaatattctctaatttaccatttattgattaccaatattcaccctattgtacatctgcatcaggttaaaggtcaacattgtttgctatgggcaatctcatagtttgtgggtgtttctttcattctaagtattatgttccaaccttttacaataatctgcttgtaattttattattttattaagatcatctgaaagtatatgacatagacttctaattaagtaggggtgtctgagataattggaaaatatagatcaatcgagaacattataaagaataaatgcaatactatgtgcatatatttgagacagagaaagaaatgaaaagagagagccagtgtgaaacacatatatgtatatctatacatacagtcacataagtcacatgtacacatcacacacacatagacacattttacacacacatgggatggggaaggagaagcaataggaggaagaagggagagagagagaaagataaagggagagagaatagataactgccttaaggcactgaattaaaaagcagaaaaacttagatttttcaggaagcactttcttgccaatttgggctaaggaagcacttagtccaagcaacatttcaaggatggcatcggggctactaagcaaaagcagaaaatgaatgtgaccatctgcctttacttcgctggaacaattatgagacaggcaaaggtaatacaaatatcagaagaagtgaaaattccatgagatcgtaaaagctgccaagaactctagaatctccctttacttatgattgtaaagtacccaatgagaatatcggaatatggattaaataaatttttgataagtgtgtaatgtcctagaatttatctcaggattatgttggtctcaagagtgatgaccagtaagcattaccagggttcaaagattattaatgttgcccagttcccctgaaggcatttctaccctaaggaacctcacttactcaccaacaagcaattcaaatgttagtgctcagggccctacaactaatgtcctttctgatttgtctgtgttctatgacaaacagaactctctttctctctctttgtccctgctctcctaactcaggactcaagaaggtcaatctgtaccctccgtacgtgcctcctttcctagccttcccaagaagtcttaagaaaaatggacatcaaccaggtgagtattcatggggaccatcctaaacactcacccaatggtggaggctccaccctctcagcagaacttgctcccaagggacaggagggacaggcgtaggggtaagggtggtaggatttgattcaggccaggggatacccagtgagggttcccattcaataatccctgttgaatttcatcaccatttaataacacatctttttattttattttactttcgagagagggtctggctctgtcacttgtgctagactgcactggcatgatcttggctcattgcagccttgacctcctgggctcaagccatcctcccacatcagcctcctgagtagctgggactatggacacacaccttcatgcctggttaattttcaaaaattttggtagacacaaggtctcactatattgcccaggctggacttgaaccaagcgattctctcacctctgtctcccaaagtgctgggattataggcatgagccactatgtccagccaatacactttttttaacttttaagttcaggagtacatgtgaaggtttgttacagaggtaaacttgtgtcgtgggggtttattgtacagattattttgtcacccaggtattaaacctaatacttattcgttatttttcctaatactctccctcctcccaacttccgcccgcttacaggctccagtgtgtgttgttcccctctatgtgtccatgtgttctcatcatttatagctcccacttataaatgagaacatgtggtgtttggctttctattcctgcattagtttaatacacctttcttgaaatcaacacaggccctcctgtctctgacatttgcagtatcaatattatcatcattaataaatataaagagccaacacaacctcttcattatgtactgagcacattctcatcacacaactacacacacatgcatttaatttgaccactaaagttattatcatttcaatcattcagatgagggaaaatcagaggcatctagagttgaatatatggagaggcagaggcaggattcaacccaaacaacccaagaacagagttgatgttcttcaattgccatgctaactgccctcacctgacccacaggactgtttgacccaaattaatatggatagatacgcatgagctgtttccaaactcaagtttgggaaacatgaagtcaaatatactttattattttcttcttgttttttaaaatgtagacctccttgggtactttcaagggattgttaaatgtgttatcaaaataaaatttgtcatggttgtgaatcaagtaattcagaagagattgtgcttaaaattgtcatcaaattattccccaatcctggtcccacttttaccttttttaaaattttaatttcagctggtggttgactttagtgaccccaatattataataatgacttttaaataatatgtgtatagcattagttttttatttacatacttttgaggataattatgaaagccatataaaattaatttagtttacttttattataacttcccccttacttaattctaaagttaaaatttccattttagttccttcgcacgtcttttattttaaaataatactcccaaattattatttgttagtcccctttactcagaatttgcatttcatctccaccccgcccagccacatcattttcttccccctgcctccacctgagagatggctttacttttatgtcattgaggctgctaatatttgcattcttttctacaaccacaaccagtgccttccatttgaaggctacttgaagaacaaacgttgtgattatgtaagactctactttaggcataggaatcatccatcttattaagaagctccttgtgcagttgtatattctttaaagaagtaaacaatttttcaagacctccatctacagtacctgtaactttcagcttttcagccccaatggtaatctcatcttcatctgcagaaaacagcaccctgccatcttcactggctctcacttcaaatcttttacactgagcttccacagcatcagctcctatggtcagaggaaaggtttaaaaatgaaactggtatgcaggaaaccattaacatgtattttttggaaatagactagaaatgcatatattatttaatttgtttatctctgctgtatgttttgcatctgagttagtatctttaaattgtcaccattttcaggaggctaatttgggaatgtacttctgtgctaggctggttaggcatacaggtgacctctggatgtctgacatagcatgtgagtttagccagttaagagcccttcacatatccacaaaaagagacaatgtttgctttgttctctgttgcaggctgaaaccttggcatcatacctggcacctgctggatgcttaataagtacttgtggactgagtgactctcatgccttacctctgcagtgtagacaatagtacccatgcttgctacatcacggaggacttgttaagcattattcaattatgaatctttagctagtctacatgtcatagattctaatattgatgttttctaccctttaatataagtgaattttaatccattttatagtacatcttgaaattatatatataatttccttagtggtacctaatgtatcttccaatcaataattttcctgatttattgaaaaacggtattaaataaatgtaattacaaaaccaacttactggccaattctacacactgatctatacacaaaactcaaagccagcttccatatttagaaaacacaattagtttgagtattaggctttggcaagaaaatctaactgggccttgaaggtgaatgttaactgaggaggaagaaatttgagataatggccagcagtaattcatcttcccataattcatattatgtccaaatttctttggacataacacttttggcatatggatctatagttcccgctcctattaagataggaaaccttcctcctcttctatttatattaaaagctcttatcagatagaacccagctgagtcagggaagtaggaatcacacatgtggggcatagttcttttcatttgtctttatgtattcactttatttattagatatatgacacccaggagctcaaagcaggacatcatctttgtattccaaaacatccttaaattgggagatgtgtcgcttctagtagcaccagtagatgaatattaaatagatgaatgaatacttaagctttcatccattcattggtccctaaccccacctcagcactactcccagtgctagccaataggctgcaaaaacttactcctccccatcatcatagctgctgaggagcattcatcaagagaaaaaataatttaaaaccctaataacatgtaagctaatttctccaaaagccatatgtattttttttaatattctgaaactacatacatgcttccaggaccacataaaaatttgaaaagcttcaactagggctatgctaagtaagattaaaactaatgttaaacttttgggctgtaaagtttaaaataacagatttttaaaaatagaattcatgctttttaaaaatttttaaataaatacctttccttatataatttaatgaaaatatggaaaccattgaagacctattgtccttggtcatagttgttgcatttgatcttgaaaacattatttcgacagcttgtattcatttgagtgtgatttgttctaatcatagtctaatcttattttgtgccatagacgacaatgagccatagtaatccaactattgggtgatgttcaaaaaactgtgccagaggccaatgtgttaatacatgtgacttactctgagggacccaggcacacattaaccctgaactgcctgaaaggtattatagatatcttacacataaaacctcaatatttacagtacattgcttccttcaaatatactcagttgctgagcataattgattctcaaaatatatcgctgactttaatggcatagatgtacattagacaacattaaacacacacacccacacacacataataccaagacttttcttggcataacacttaatgtcattatatgaaagatacattattaacataaacatgctatattgcatgacatataaactgttagaaaaataagtggagaggtgtctggatatggtgaagtgaggtgaaaccttaattcattaaatgtaaataagcaaaggcaaataagcaaacaagaaaatatttacgcacatagatgagatgcatctaagccataaataaatgcatgcagagtcatctaattgaaaaagagatataaaaattcatactgcagactacactttattcatcatattagcataattacagaaggcaaaattacaagcaattagcaatgcattgatagtacataaatattctaaatcagaaaataattttgaatatattgcatttatacattgcttttctttcctgcaaatggaaaatgatatgttcttggggatatagtcaattattagggatatttatgcttaaagttaatatattaggctttatgaaactgattttattatattctaagatgcactgtgttacttatctgtttttcatgtaacatcacatgttctctaagataggtcaaggcaggattcagttacttagagaagcaacaatgccccattcaatcttaatccaccaatgatgctgccagtgttgcaggaaagcaatgtgtctagatgactctgggtaaggagctctgattccttaacaagtagatcataggtgatgggattatctgggtagtgctatattttcttagtcatcttaaacaccaacttgctaactaaagtaccaagactaaacacttccttaggaacatctctgagaaagtttatgtcaataaactcacaatcaacaaagagaagtcaaggatagaagaaggaaagagaattggcaagaaaaaaaaagatgtaagcaaaataataggttccataaaaagactggagtattagatatatgtgcaaatattttctctacttttttaaatgttctatatacattcttaaaagaacaaaccaccaccatcaccaaggacaagcataaagccaatttcttgcttctctcagagatggctccatcactttttttgaacattcacatctgttgcagtcttaatcaacagccaaagtcatctttggctgacaaagagagataattcagtaatttaaatactggtctttgtatgttctacagtacatcggtcaaatacatgaattggaaatttttcttctattacataaaaatcttcaaagaggctcaaatatatattttcaagattcctcttggtactatttagcagtaattcaaggaaaacaaaacaaagataaaaatggatatagctgcttgtttctagtgtgtcttcctcaaacttgtcatgatcatcctttcttttctatataactcttcactttaatcttagatgcctgtcagtattttcaaggccttgaagaatagtattactaaaagattcaaaatttccacaaggaaaacaaaaatgagattcaaaattaccaactaaattctatattcagaaattcctggtttagaattgctgtgggccaaatcagtcaaccaaccaacaacaaactaagtttaaaacaaaacaaaataagctgctttcatgaaatataaatataaatatacactgtaatatggtttggttgtctccccacccaaatttcatattgaattgtagctcccacaattcccacatatcatgggagggacccagtgggaggtaattggatcatgggggcaggtctttcctgtgctgttctcatgagtgtgaataagtctcatgagatctgatggttttataaaggggagtttccctgcacaagctcttatcttcccggctgccacgtaagatgtgacttgctcctccttgcctgcagccatgactgtgaggcctccccagccacgtggaactgtgagtccataaaccgctttttctttataaattaggcagtctcaggtatgtctttactagcagtgtgaaaacggactaatacgcattgtgagttcttttattttaccctatgctagtcattaagaactcattgtgcaacatttgcagaaaatctgttatatgagatccctggaaaaggaattgcctactttttctttactttgtccctagattttccaaacaaaacttcaagttaaccatttagcggacttactatatgctaggcagcaatggaagcattttacaaatataaattaattaatttaatcctcataacaatcatgggaggtgatccctatttgaccgatgaggaaaccaaggcactaagatttaagaaatgttcctaatatgttatacgtaatgcactctagagttaggattcaagccaaggctgtttgagtactaagtcctaagtgctaagttctaagagctaagggagtctttgtgtggctctattatattcctaacttttatacctcctggagaaggtacaacttgacattccacaagattaatatttgggggaacttttttgctaatgatgtataacaaaattaaaaataaatttctgaagaatgtatgttgactcttccttcctctgccagctactgtctccccctgctcccagtaccccatcctcctaagacccttggctgacaaccttcttgaaagcatcttattgaacaccattttcaattcctccattcgtagtctccttaaagccaactccaatcaggcattatctcgtcagtattaccagtaacttccaagtcagtaaattaaggggccaatccttgattttttaccttacttgatcttttaggagaatctgacacactttcatttacttttcctggaaatctttgcctcactggctcccaggacatccctctgctgcttcctacctcctttgtcacccatgtccatctcctttaccaacaacacacttcctgtagccagtccacaggggtatgtggggctggctatctttcgctagtaattgtccagttctgttatgagcattattttctctgaccaaagcaattgattcaagcataagcagttgactccaacactctcttgatacaagttttgaaaaagaggcatatttttgtaagactataggtaccgagcatgatataaacttggagcttttaaggctagctgtacctccatatggatgcagtctgcttgagaattcatccagttagtgaaaaaagaaagaaagggctgaaaggcagagaccagcatagaaagacactcttggagaaattgctgaaacagctggatggagtcagaaacaaactttcctattacttgaatcagtaagttaaacaccccaggaatacttgaatactttgtaaattttaaattgggttctttcacttgattttttttttttttacttttcctttattctttgagttttcatatattattctctgtatctctcatcttaacctttattaaatagaagttttagaaatcttccactttcaacaatcactgcatctccccccgcaccgaatccacacgtacaaatcctcagtatttaattaaaagaaaaaatatgctctagcatttcctgaagtaatgctgtgaggaaaggtacaaaaacattctgaggtgaattttctcatagcctttgtattaggtaaactacatttctatttagacaatttcaaacctgatcttaatggcataaatattatatttctaacacttgtattcttagatctttttattcctaaaataataatattaataaaggaattgtgtgactacctagcaagccatttaataaactaacaccaggaatgtgatattcattcctgggcctggcctctatgaattttaagaggataaggtaaaaatgatctctctatccacttctattgactacattgtctaagagaagtgaatgcagatggcctcaacccactgttttatttaagggtcccaatggaacaacatatgtacaaaatattgtttttacattgtatacaaacataaaatggcaatatttccaaactgtagctagaacaaagttgacgggtgagacgttattttgtaaatattttttacacctcatagtcattcaaataggtacacgtcctttttgactcgttaagaaaaaaatagaaacaaaaaatggcatgtcacatgcaatgaacaaatactatgagaattattatgcaagtgtagaatcaatgaatacttaaggaatgaaaggagattgtgattaactgcatttcaggtcattacttttgaagaaaaaaaggataataatcctagtgtcttctggtaatctcacattcgctaaattcattttggcagttgttaatgtcaaaaatgttactgtataatttatggaaggtatgtgggtagaaggtggaagttgcaaacccatttcttgaaaatattttactaaaatgttttgcattgcatcttgttactttttatttctaatatgtgtttcattaaaaaaaaaaaaaaaaaactaacacctcagaatttttttctttttctcatttatcatccctggtcttcggctacattttgacacatgtatcagggtagttttgcataagttgttcatacttcatttttctttctaccatgcattttctgatattttgtttcaaataacatcttaaaaagagatcttcatgttgcactttaaacacaattatgaagagttggtgcaaagttttctaatttatttttatgcatctttcctctaaactatatgtaacataacttgtttagttgcagaagtaaaatctgcagatgtattcaactggtagtataatctcctagtaccaattcagtacaagttccacatgaaatttcaaattttttctctattttaaaaatattctattttgaatatttatcacttaaatatcatactgaaaggcattttaaaagtacatatatttacattttctaacataaaaaatcgtatacagaaaccattttaaatggagaatgtattatctcattaaaatgttatcaaagagtttctatcttttcttgagtacctcctaatatatttatttatcctaccacttatgccttttaataaggatatctaagctatgcttattgacatttagtttttatataaaaattattctatgtttcatcttgataacagtaagatttcttgtttctgaaattcatttagtggaaacatgcttttagtgtcataaatcagtgaattaaatgctgaacaagaataaatgtcaaaattaacaatttaaaaaatcctattatataactgtttcattacaatatcttaggcaactgcgttactattttttttatagctagtgtatatggaatgcttagaattgcttgctttgaagagtattatttgtggttcccaaagaagtatcacagaaagtctggtttctgaaaaagatgaccagataaggtatttgcattaaagctcttatataacaaatgatgacctagtgttttatgcaagagaataatcttccaaattccacacaacaaagacttattttttgttcatgcccatttccagcatgggtcagcaaacatgctttaattactgtaatcacctacaaattcaaatgatgaaggctttatctcaacacagtctttcaagattgtggcaacaagagaaagggatatggccaactcagcactgcctcacctttcatttggaaggaacacatcacattttatttcattagcaaatgaaaattacattgcctggtctgtttttagacatgcaggaatgaataatcccactgctaaactgaaaggattattggttaacagcacgaacggcgccatgcctctcaaaggccatggtggaaaaatgaatcttggacttattttctcatgtaaacagttataaaactgggcaaaatgtttgttgtaattgtctttcagatattagacaaaagacaacaggatggtgatctctgaggcaaagaaatacaacgtgtactccacattcattacatcgttttcctaaggaccatttgcaaatcacagtacagggaaatagagcccatcggtgttggcagctagcaggaggagagatgagatttcaggaaattgatatggacagaatttgtggggcaatgaaacggagaaagggagctgagcttacaaggctctccagaaaacttataggagcactcttcaatctttgtaaaaaggctgcattgtacatggacaggatgataccatatgataattattagataaagactactagggaatgtgtgagatgaacaaaggttatcaatgcaaaattctagatgttgggcttccaaccagagtgttggtatttccctaagcaccctggacatgaagttgaggcccctgagtgccacagtttagaactaaaactatttagactgtaaaataataactattttagattcagtctagaaagtctaaaatcatacttgaacaggagcaagctgatatgctaataaactaacttcctgctttgagagttttttttttaagagagacaacaacgtttattctttcctaaaattactagatgtgcaaaaatgtgggaaaattgacactaaccaggagaaaaatcagcaatagaatggggcccagatttgctccatatgctagagttagcaaagatatgaagttattataaacatgttcaaagatgtaaaggaagacggacataatgaatgaacagaagatgaatcctagcaaagaaattgattttaaatgtaagaaaaaagaaggaaaatgaaatgcatagggctgaaaaattcaatatgttaagtgaaaaaaatcagcaaatgggactaaattcgcgtattataattccttctgaagaagaaagaattagtgaacttgaaaaggtgtgtataacaactctccaaatgaagcagcagagataaatgaagactaggaaaagcataaatacaacgtccatgagcctgtgaaacaagtaaaagaggcttaactaaaaagccaatactggagattaaactgaacattaaaaagtactcaactgatgaaatggagcaggaacagaggataaaataaacaaaagatagaggagatgtacaggaaacagagcgagatgatagacaaatggaaacatatcaataattgcattttaaatataaatggacagacactaaacactgccataaaattcttacaaaaacaaaaatttaaagtttacaaatcttacaagagatatatttgaaatataaaaacagacatgctaacatacatgactgcaaaccttttaataagatattagaatggttatattaataactgctaagtaaacctcaaatcaaggaggataaagagttttaaaaagctactttgtaatgagaataataatgaaaaatagagtttcaaacaacatgaaaagtaaaacaaaatatatagaataaatagataaatccaatccaatacaattttcatacttaacttaaaaattatacagacaggtaagtgacctggaatagttaatacaatctttaaaaagaacaaaattgaaacactttacctgttttaaagacatactatcaaactacattaatcaagacactgtgatattgcataacgatagaaaatacatcagtttatcagaataatgagtccataaacagactcaatgcatgtagtcacatgtacatggttcaactgattattttacaaggatgccaaacaattttctggagaagaaaatgtgttcaacaactgtagctgaaacacttgatcatacatgtacttctaatttaaatttactggtattcctgacagagaggagactgaatgaaacacacaaattcataatgaaataatgaaagacacaaactcaagaagttcaatgtatgcccagcctactcccaagaaataaaatccccacctaagcgcatcttagtgaatatgcagaacaccaaaataaaaaagaaacaacactgagaaaataaagataaattaccttcaaagagcaatatttaacctaatactgacctctcaatatgaaacggaaataaaatagtggaatatggtgtgccttgccagggctgctgtaataaagaccacagtctgggtggcttaaacaatacaaacgtattgtctcacaattctggaggctagaagtctaaaacaaaggtgtcagcataaatgcttccatcttaaaggctctgagaaaaggatttgttctggacttcttttcttccaatatctcttgacatcatcttcccttttgatggatctgtgtgtccaaatttcctgatttttgcaaggacaggggtcatattgtatggtccaccctattaatctcattttaacttggatatttttattgccaaataagaacctataccaaaataaggatacattctggtactgaaggttaagacttcaacatattaattttggggtgggttgaggggcatatcattcaacctataaaatgtgtcttcaatgccctagaagaaaaaaatttttaaatgccaatctctaggattttatgtctagcaaaattatcatccaaggttgaatggccaaagatatttacagactaataaaacctgagagaacgaatcatgaacaaatttatgtgaagaaaattataaaggactattttcataaaaaaggaaatgaagacagctcaaaaatcagagacatgggaaggaattctttttaattatagtggaaaaatatgagtagatgtaagaagtactgaatataaaaagcaataataatgtcgtagtttgagaaatatagagaaataaaatgcccataagtaatggaatataaatttggaaaagaataaattagaggttatgcattctgaggttgcattatccccaaccatcttaagatacaaagtaatagactttggtaaatcaaatttttactttttcttttggcataactactaaaataatagaagaatctaaattagtatgtttaaaaacactattaataaaaacaacatgcaatccaaaaaatgctacaaggcaagagaacaaaacaaaaaaggaggtagaaaaggagattaaatactcaaatatgtcactaattacactaaatacaaatggactaaacactccaggttaaaagtcaattataatctagctggatataaaaccaaatccaatcattggtagtttatatcacacaagactaaaacataaaattcaaaaataattaaattgatgagataagaaatgatatattatgcaaataccaaatgaaactgtactggtatacctgtagttacaaagcattaatatatctattaggtgttattccataacgacaaaaactagaatcaccgtgaatctatttcaaattttgcatcattatgaatgtatgattttcaaaacacaaagcaacattggaccaaagaacaaaaagaaattgtcaaatcctgaatcttaataggagattataaaatgctttctcagtagtacaaacaaaaaagtaaataatgaaacaaaacattatcatcagtgttagcatactggtcctacacagaacccttagtccaacaatatgccataaagtacttcttttcaactgaatattttacaaggcaggttataattctggcataatgcaaattttaacatattacatcatggaaattacaaaactttttatctggccacagcataattaattttgaaatgaaaaacaaaaagtaactaatttttatgtttataatttaaaaactttaaaataagccatgagccaaattctaaataactgtaattagtaagtgtttcaaactgaataattacaatattattgtcaaaacttgggaaatattaccaagtcagtactgacaaagaaatgtatgtcctcaaatgactgtattagaagtcttaatattaatagtccaacatttaagttgagaagttagaaactaataaatataaaaggacaaaaatataaattctcaaaatgtatgcagtataaactctcccccaccaggttactcaagggcatatgtccattgcttggatcaggctaggttcaagtgggtggggggccaagaacacgatacccagcctaggagcaggtgtcagaccccaaacattatggagagtatctgagatgctatcaagcaaaactgtctcattgctaaaccatagtagacaaagagccagaaaattagctgaaaagcaatttggagacaggaggcagtgaggatcttgaaagctctcctgttgccatccaggagtgccttgtatgtaagtcctaataaactcaagaacacatcaaactggacttgtccaagtcattctttggtctctgagctccttcctactttgggagcaggacacgttacatcaccaaggttttgtgtaacggttggtatacagacaaggatcgtagagagtaagcgatgagtcactgggaaggagcatctgtgggggaaatcctggagtggtcagcaacatgcctgtggggtggagttgcctcgctgcttgacttctgtgggttgccagatgagtatggggacacttggaaaatgccagtggggactgggcacctattgcaaaaagctacgatattaaccataagaataccaaatgtgctgttgttgcaataaggctggctactgagagcagggaagggagaaaggattgaaactcctgcaaaagactgaacgcatgacaggttttctagaactccagattgttacatattacggccctttcttgtgaacataatttaactgatgagcaagttacaacaacaacaaatcagcgctcaaacggttaacctacaagtatagagttaagtaaaatcttttaaagctatctgtttccttttttgtttgtttgtttgtttgtttgtttttgagacggagtctcgtgctgtcacccaggctggagtgcagtggcgccatctgggctcactgcaagctccgcctcccgggttcatgccattctcctgcctcagcctcccaagtagctgggactacaggcgcccgccaccacgccctgctattttttttttttttttttttttgtatttttagtagagacggggtttcaccgtgttagccaggatggtctcgatctcctgacctcgtgatccattcgcctcagcctcccaaagtgctgggattacaggcgtgagccactgcgcccggccctctgtttccttttctatctgctttgaatctgctgtttttaaactactggtcttgagataaaactcaatgttactgccaattcaaggccacttggagattttatttttcttttttccttcttttctttttttttctttttttttttttttttgagacgaagtctcactctgtcacccaggctggagtgcagtggcatgatcccggctcactgcgacctctgcctcctgggttcaagggactctcgtgcctcagcctccctagtaactgagattacaggcatgagccatcacccccggctaattgtgtttttgtggagatggggtttcaccatgttggccaggctggtctcgaactcctaacctcaggtgatctgcctgccttggcctcccaaagtgctgggattacaggcttgagccaccacacctggctgattttgtttttcttatacagttcagtcagttctagctaaatgtaaatattgaaaccatttgaagctaaaggaaataaaaagtaaaagaggtttttagaatacaactgctatagcaactgccttactcaaaattttggtccatagccgtcattagattacctattgaggctagcaaaccatgtaaacaggtccaaattttgttagaaataatttagatccagctgtcttttataaaataatgagtttatgatgctttctcatgactagagttctgagataaaggctattggatgtttgtctgttggatattttgataagcaagactaatttgatactattggttaagtgagaacagctgaattttctgaatcaccagcaaagatgcccatgtgtttaaacttcttgcttaggtaaacacctgatattcacaggctacacaaatggttaacaggagaataacttggaatgatgactagttttgtctaatgtctaggttatcatgaataatacagataaactgttaaagataaataaattgagtaaatgtaaatgagataaatgcttacaggagaaacttttatgtacttcaaaagcttaaaattattttaggaactcattaaatgtctaggtcatttccaatgtaaaaagggttacgacatgaggcattggtcacacttctgagcccattaatgggaaatcagttctgtgataggaggaaagcactggcagacctcattgagctaaagacaaggattgagtccataaggtaatcaggaaacaaaaaggagatggatgcttgtacacttgccccggccaaggcaggcagtaaatgtaaaacaatattatctgccagggggacactctaaaaccacccaaacaatccagaaattatgtaagatacaaattgtcaggtcagcccaaagcccccttctcaacagtcccatgtgtcctgtgaaaaagccagatggcatctagagaatgacgggaaattatcataacctaagcaatgtggtgccccctgtacatgcagccgtatccaatattgctcaattgttaaaacaagtggtccttaggctggaaagcatccacactgtgaatgacttgggctaataccttttctagtatccctttagcagaagattcacaagaccagttcgcctttgcttaggagggcctacagtggacttttcaggagctaccacaagggttcctgcacatccccactgtctgtcacagtctggttgcacaggacctgtctagactctctttgcccacctcagtctccctgtttcactatattaatgataacatgctaacctcagagtctcttacaaatcaggagactgctctacaaatagtcatggatggcgtaaaagacaggaaatgggaaggtaatccccaaaagatacaggggctgagcacagtcatcaaattcctgagagttcccacttgggtaagacatgtaacatactctaagctgtcactggtaacatggcacacagcagcctgttccccagacagaaaactaactccaggtattcctatacttactgggctgctagaagatactcattcctcacttggtataaaccctctacccattatacaccccaataaataaaaagtgaaaaaaaatcatcactggacacatatagagcaagaggtatttgatgaaccaaacatattggtgaaaccggcccaagcactaggggcctctctgccacagcactcttttgtattagaagtcaccagagatgccaaagggatatattgcgatttgtggcaaaaataaccaatgagaatggtacctgcagggttttggtctcaattatggaaggaggcagaatcccaccatacagtcttagagcaacgactactggccatgtatagggcaatgcaacaagtggagcccatcaccaaaaacagtctgtcacaataaaaatcccataaaagggtgagggcgagttgaaggcctcctagccaagcccacctccagggtggcataattacacaccctgcagaaatgacacacttatctataacaaaggagtgtcctgatcactagtccttcaagcactgcaggaagtgcttggacctatccactctgaatgcggggagggggccagcatggcagtggagccacctaccaggccaaccaccatatggggaccccactaataactctagggcctggtacgctgatgggtctagaaagaacgtatccaacactgagcactagaacaaaatatagactggaagtcccatttatcatataacccaacatgcgcagtctcattgaagaaaaaaaaaatgacctgttaaaaaccgaattgccagtactgttccaggagtgctctttaaggccctggactaagaatctccctaaagggatacaaacttaaaataagtcacctactaccacacatggcatcactccctatgaaggtttgtcatggcctttaaaacaggcctgacaaaccctcagggttacctctgaaactccaagccatgctcctgaagcaggtggccagactgtgctcctgagaacaccaatggatctgccaagtggcgatggctatgtgaacctgaatttgagctggacagtgcccccatactagattggttttacggcagtggggagtgccatgaagactaccagaagggaggtggttccagctatacttgatagaaatctaagaggcttacaatatcaacatgaggcagcaccaatacctgtagagcagtcatagagtcgataccgtttgcaaggcctgaatttagcaagcggctattatgccccctcctagggagggaagccatgtgtgatagtctaagccaggcctgaggcccacagtagtctccctaatagggccaacgggagaaaacccaatggtaataatgttacaaaaatggatacatttatgagggtccctactaaatacccgtgttttcaaccataggtggttattcttcctaccttgggagctgaaaatatctttctgaattggtctgtgactacaacagcaatcagcaacaagttcaattgttgggtatattgatacctccccctatcaaatggtaatggtgtgccttaaaatactctgcttttctaatgacagaactaaagtgactgtttaaaaagaaatagtaatacaactcagactcactggggattgcatccacccagaggtaggtgggcatcccccatccccaaatcaacagagaaccaacataagctcttaaaggcgttacctgttgatatggtttggctgtgtccccacccaaatctcaccctgaattgtaataatccccatgtgacaagggcggggccagatggagataactgaagcatgggggtggttccccaatactgttctcatggtagtgaatgagtctcacaagatctgatggttttataaacgggagttcctctgcacaagcgctcttgcctgctgctatgtaatacatccctttgttcttcctttgtcttccgccatgattgtgaggcctccccagccatgtggaactgtgagtcagttaaacatcttccctttataaattactcagccttgggtatgtctttcttagcagcctgagaacagactaatacacctgttacaattatagccctgataaacacagtaattttacaaacaccttaaattatttgttaactcagagccatgagttaacccaattaggtttctctgactcattctcaaattggttacatacctaacctcaaattggagatatgttttactagcaggcatcataaatatagttagtttctcctttgcatgctgctatgtatactgtatatgtggcctgtacgcataagccatgggtacacttataggcctgtatagttcttcctctcatactctactcagggactctgacacaaaattgggggaaagaatgcaaaatctagagaacagtatggattgtagtgctacagattccacacaagtttgcttaagggcatatgtccactgattgaaccctgaaggctgtgcagtgagccaaggccatgatgcccagccgagcagcaggtttccctgagaatccatacatcctggagagcatctgagaaccaaccaggaaatccagtcttattgctcaagcacagtaggcatagagccagaaaattagctaaaaagcaatttagagacaggaggcagcgaggatctccaaagctgtcctgttgccatccaggagtgccctgtatggaagccttactcatctactcatccagctggacttgtccaactcattctttggtctctgctccttctcaatctgcagaagggaagagaatattatagtacgaaggttttctcataacaatgtagatggaaaaaataataaagacaagaaaaggaattaatgaaatgaaatatagcataaaatttgttagatcagtgatgacaaaagtagattataataagcaataaaactgactaatgtatggccaggcatgatggctcatgcctataatcccagcactttgggaggccgagagggggcggatcacctgaggtcagaagttcaagaccagcctggtcaacattgtgaaaccccatctctactaaaaatacaaaaattagctgagcggggaggcaggcacctgtaatcccaactaggtgggaggctgagacaggagaatcgcttgaacccaggaggcagaggttgcagtgagccgagatcgtgccattgcactccagcctgggcaacaaagagcaaaactccgtctcaaaaaaaaaaaaaaaaaaaattactaatgtgtcgtaaagttgattaagaaaaaaattaaacatttgcaaataaatagtaataaaaaacacattattacaaatattacaggtgttaaaatggtacaaatatttcatggcaacattataaatctgaaaattttgttgacatgagtagatgcctacaaaatattgccaaattgacttaatcagaaatagaaaacctggatactcctgtagtattatagaaactacagaaatagttaaaaatttttacatgtacacacacacacacacacacacagattctaggttttcaggaagaaaatgatagaaaatcataactcttcttgagaacagaataaaaatgggaaacactctccaacagatttcatgaggttagtagaattttgccacaaaactcaacagagatagtacatgaaataaaaattacaagataattttgctgataaaataaaaatcctatgcacagtatctgcacattatatttactctgggaatgtaaaggtggtttatactagaaaatcattaaatgttttaactaccttgagagtttgaaagagaacacggaatattatctcagcatagttacaaaaattgtttcacaaaatttaacaccacccatgagaaaagcgtttaccaagcttgccagcttaacctctaatctacctatacgtattaaacacttgataataatgaaatattgaaaggtttccctgtaaactaagaaaggagaaaacaatgcctattgttaagttatattaagcattattctggaggtcctaaccagaggaataaaactagaatggaataaaagtattgaatatgttataagaattggaaagaaataaacaaagctaaattactcacagatgaaatgactctctatgtaaaaaaattccaaagaatccacaaagaaatacttatagttaagaagtgaacttagcaacgtctctgaatacaaggccaatatataaatatcgattttatattagaaaacgaaaggtaaatgatgctatgtgcattatgcacaacagaattacaggtaaaaccatcatcattttcatataatgtaaatttattccacgagtaacaaagaatcttaaaaaatcattctaatgattaaaaatttaacaaattccagtatatttaagaataagtactgattttaggattttgatctgagtgtagttttacatgggcaaatgtgtacagattatctgtgatctcatatcagcaggagctaaaatattcccacccccaatagcatctttataactcatacacttatggcctggacataaattagaaaccaagaagcattaatttatcttgaagtcatatttaaatgatttttagtcttatgtaatccagagtattaattatcaatcaattgaaaagttctttattaaacatccactatatttcaggcattattaggctaaatgataaatgtattgaaatgaataagatataaagtttctgtatcaaagaagattattatatattggaactactaaacactgtacagagctgataaagccaaacctacacggattgtttgattatgttatcaatgctacttcctcactagaggcatcacagtcaagctatgggtcctcaaaagtacattatttaaaagtatctagcatagttttggactaaaaacagatattttccaaataaaggaaagcagtgtttaagaagagaagtaccttaaactatggtttttccatatgtgggcttaatctttcatgattttggatcagtttacctgatattactagagcaaattttgtttaacaaaagtgcccctctaacttaaaactataccagaatacattagagcatgaagatttagtatcttataaaatatagcaccacaacacttatgattggtatagcaataaaattttttatcattatgtctctatcgtctaatattgactaaggggtagtaattttgttttttaattagactttataacatttaagtttcttttcaacctttataatacagcaaatgctttagttatgtatttgtactacaaaatttttccacgtcaagcattcaatcaaatctggctttcacccaggcacggtggctcacacctgtaatcccagcactttgggaggccaagaggggtggatcacgaggtcaggagatcaagaccattctggttaacatggtgaaaccctatccctactaaaaagatacaaaaaaattagctgcacatggtggcacatgcctgtagtcctagctactcgcaggctgagggagaagaatagcttgaaccagggaggcgtaggttgcagtgagccgagatcacgccactgcactccagcctgggcaacagagcaagactgtctctcaaaataaataaataaataaaataaaaaaacaaaaaatctggctttcattctcattactcagcttcaattgatctaatcaatatctaccatatactttattttttttcaaaattcagtggcttcagacctcatttcatgtgatctttctcactagcatctgactcattcaaaaactgtcttcttccttaaaagctcctctcatagtacttttgtgaaatcatattctcttgacttttcttctatcttactacccattgttttgttttgttgtgttttgttttgttttgttttggtctatatccctgctcactcatcgtctttctattctctaaatatttacatgtcctggagctcacagtaaagactcttaaactgtgttgtatgtaaaaagtctccagcacaaaagaaaaacaaatgaaattgagcagaccccttctctacttatattcatttatcttggagttctcatttaggttcatggctttaaataatatctacatgttgaatcccaaattctcaccatgtccagtaatattcaccttggaatctgcgtttctaatcatatgattagtttggatatctaataggcattggatgttagtttgtcccaatacaacctttgagttgcacacacttgccaatttattttttccttctataatcctcttctcagggaatggggccacagggctccccagtaatttagcgctctactactagagttccttgtctcaggttccttttctgtaatgacaatgtgaaagcttggctaacatgccgtccagtaaaacagcttaaaatcattttgaaaacaacaatttaatgtttcaggaaatggtctaaaggacatgcagcaagtgaagaaatatttattgaagaaaattttttaaacagcagaagcagagagagactgtatcattttagccatgaatctctctatttccttcccaccccatcctaatgtgatggaaattccactttatgtaggtgcagccaagaacacaggaatccttcttcatctatgtcacagtattttcccagcagagggagatgtcaacatttcttaaatccatggccctggccctggttctttcataggatggagggtccaggccacgataggctagacaagaagactaaaggcactccccaacccctactataacaagtgcttagttcctaagcagagattttactgagagagaaacttaccactttttctgctttcggatacacagctatagtgcagacattttgcgcaaggagagaggcaggctgtaaaacagggggttctgaagcctattcaaatgaaagctttatttgccacagtgctagaagaagttcaaacctaaaagtactttataaaataatgttgtgatgaaagtaattaaaaggagaccaaaacttcatcggagacatattgctaggctacagggtagctagtttagtgagagagccaggcaaagagacagttaagagctctgagtcagaacaaatttcaaaactgagctgagaaactattcctggaaaaaagttgggatttaactgcatcagtccatggagcaattcatgccccagatcattcttgaaaacaattgataaactctaccaattgctggctgattatcagctgggtctgggtcagggaaagagaagtcaaagagagcactgtcattctaaggtggctgagtacacatgcctaagactgtaccctctgaggaactgtgggtcagggaagaggcaaaggataaaaacagactttaataaattaatccagttcatcattaaacaaacaagtaaacaagttctaagagttggggagtgaggaaatccagagttgggattatccagatttctcaaaatatgttacctaaattttccaatgttcaacaaaattatgagataaatgttttaaaaacccgagaaaagtctgaaccatagatgaggaaaaaagcaggcaacagaaactgcttgtgagaatgagcaaatgtcagacttaaccaagaattcaaagtaaactttataaatatgttcaaataattgaagacaactattttgaagaattaaatgcaggtgtgatgaaatgtctaatcagatggagaatatcaacaaagatataggaattataaatgaatcaaatgaaaattctggagttgagaaatatactgattgaaaaaaatcactaaagtgttccacagtagatttaaactggaagaaaaaaagaattaatgatattaaagataatagagattataaaatctgtagagagaaaaaagaatgaaaaaaatgacaactgcaggacaccattaagaatgtgaacgtgtgtgtaataggaataccggagtagaggaaaggagaagaaaacattcaaaaaagtaatgactaaaaattccttaaagtttattgaaaaacaataaagtacacattcagaaaactcagagaaattcaaataagataaacacaaagagacccacacatggatgcatcataataaaaatgatgaaagccaaagacaaggtgaaaatcttgaaaggagcaagagaaaaatgactcattggttataaggaatgcttaataaggttaacagctggcctctcatcagaaacaatggagaggaagtagtaggacagcatattcaaagtgttcagatttaaaaaaaaagtcaaccaagagttctataggcagcaaactatcttttaaaaatgaaggcaagataaagatattcccagataaagattgagcaaatgtgtttctagcagacctatgttataagaaatagtgaaaggaaattcttcaggcagaaagcaagtacattctgaaagtaattcaaacttacacaaagaacctagtaaagagagttataccagcatcagaaacagaatacatgcatatttcttctcttttcttcctttgtgtgatttaaaaggcaaatggatccgtacagtaaagttttatttggccttagaaaggaatggagcagtgatacgtactgcaacattagtaaaccctgaaaacattatgtttggtgaaaaaacccagtcacagaagactacattttatatggttatatttatattaaatgctcagaatataaaaatctttgaatgcagaaagtagggtagtaattgcctagaggggtgggacaggtctgtcggtgctgagagcgaaagggttcagagtttcttctggggataatggaaaaattctgaaattgactgtggtggcacaattctgttaatatattaaaaaccactgcattgtacatttaaatggatgaattgtatgatatgtgaattatattccaataaagcagttaaaactcttctagcaagtttcattgattcatccttcaacacatatccaaaataataatcccactttttccagatttcttgttttttttttgtttgtttgtttctttgtttttttttgtttgtttgttttttgagatggagtttcgctcttgttgcccaggctggagtgcaatggcacattctcgtctcattgcaacctccatcacccgggttcgagcaacctccatcacccgggttcaagcaattcttctgcctcagcctcctgagtagctgcgattacaggcacctgccaccacgcccagctttttttttttgtatttttagtagagatggggttttactatgttggcaaggctggtcttgaactcctgacctcaggccatccacccgtctcagcctcccaacgtgctgggattacaggcgtgagccactgcacctggcccctcttgtgtcttctttgtcaaaaccactatcatctataatctgggctgctgaaacgccaatcttagtgggtaactctgctttccatcttgttgctttacttcccaatatatcttcttcacacagaagccagagtcatatatttttaaatgaaaatcaaactgtaagccttttcgtttcaaatcccttcaacagctccttatattactcagaacacattctcccttttcaacacggtctggaagacctctctggttcttgcttctctttcagtactcatctcaatctctgctttattcccaataatccttttgccatttcttaaacacaatgactttgctacacacacaggcttttacactttctgatccttcaccctgacatgttctcagccggatcttcgtgtgctttgctcattgttttatttagcttttcataatgagccgtctgctcagagagctcagccctgaccactgtcttcttcctgtgtcctctctagagaaacttgctatgtcctttacattgttggtggccttacctgaccatgatatctgaaacaatcccattcctcccatcacttttttccactttaacctgctttgtcttatcacttttgtttgcttggctatttttgaatacctcactaaaatacatgcttcattacttccaggatttgtatctgtcttgctcatctctgcatcttcagtgattaaaatgtttctaacctgtaagagaagttcaataactactgatagaaaatttgtttatttaataagcttcttccatttagcataatgtcctttaggttcatccatgttgtcagaaatgggagaatctactttttctttctttctttcttttttttttttttttgagacggactcttgctctgtcacccaggctggagtgcagtggcgccatcttgactcgctgcaagctccgcctctggggttcacgccattctcctgcctcagcctcctgagtagctgggactacaggcgcccgccaccacgcccggctaattctttgtatttttagtagagacggggtttcaccgtgttagccaggatggtctcgaactcctgaccttgtgatccgcccacctcggcctcccaaagtgccaggattacaggcgtgagccacagcaccccgccagcggaatctacttttttaaggctgaataatatcccattatgtatgtatgtatgtatgtgtgtgtgtgtgtatatatatatatcaataaagtgtgatatatatatatcacactttcattattgatacgtctatcaacagacacttccaatgttttaatatcacaattcaatagtgaatactggtgcaatggacatgcaagtgcagatatctttatgaggtggagaattaatttcctttggatatgtacacagaagagggattgttggatgacatataaatcttctcttaatttctttttttgtttttttgagatggagtctcgctctgtcgcccaggctggagtgcagtgacgcgatctcggctcactacaacctccacctcccaggttcacaccattctcctgcctcagcctcccaagtagctgggactacaggtgccctccaccacgcccggctaattttttatatttttagtagagacggcgtttcactgtgttagccaggatggtctcaatctcctgaccttgtgatccacccgcctcggactcccaaagtgctgggattacaggcatgagccaccacacccggctaatttatttaagaatatccttacttgttccacactggttacatcaatctacattcccaccaaaagtgtacaaggattcccttttcgtcacatcctcgtcaacacctgtaatgactcgtctttttgatattagccatcctgacaggtatgaagtgataaattatggtggttttgatttgcatttctctctttactgatattgaataccttttcatatatgtatgagtcatttttatgtctttggaaagatgtctgttaaggttctttgcccatttttaaattgggttattcattttttttcttgctattgagctgtgttatatattttgaatattgacctttatcagttacatagtccaaatatataatcctttaatccatatgctgccttttcattttgttgattatttcctttgctgtgttgaaagtttttagtttgatacaacctcacttatttttgcttctgttgcctgcgccatatgacactatccaaaaaatcactgccaaggttaatgtcaaagagtttttccccttatgttttcttctaggaattgcatgatttgggtcttaggtatagatctttaatccatttggagttgatttttgtgtacggtgtgatataaggctctaattttattctttggtatgtatcatttggaaatgtacaaaacacctcaacttacatctcactgtgtaaaactcaaacacacctggctgcaagggaaatgtgtaaccctgagctggccagttggttatatgtgcatctagaacttgagattgtatcactaaaagagaatggtaaaaatcgtaaagagaagagagaaactaagggtatgtgaaacatcatacaaatgtttttatattggaaattaatcttgattatatttcagacttcgaagaagcccagagtcaaagttcatgtgcttctttctatgattcttttagctagtaatgactggactccatatcctgtaggattcctcaacctagtcataatactgaaattttatctaaaaaaaaagtaaaatactgatccttttacctgtaaataaagtataggaaagctcaaagaagatatttcttaataaccctttggtcacactttgtataaacatactattaataggaggtaatacaaaattcttatgacctgtagaaaaatgtcatttaatcaattgtatttaaaatcaaagcacatatatataaagtggtacttcctaaaaaaatactggtcaagtgaaaatatttcttcataaactttcacatgggtagtgctttacagtaaaaacagaaaataggtaattgtattatctttttatttagcaattattatgcttaccaaatttttgcatttgaaataaagatatatcccaaggtagtaaagaatactgctgtatttaatgttaatagtggtcagctggacaactaccatcaaatattcttatctaacctgaattttcttctttgtaacacataattttcatattgctacacgctttttattttttataactagatctctagtgttttctcatgtataatttggaaaagcaatatcccattaagatactgaaagtctttgttatctcccagaattattttataaaacttacccatacaataactctgaatacattgcatatgatatttgagtttttattcaagagttctatccaagaatatgcttattattagctattttacctgattctacattacttttcttctcagccttcatcttcattaattagataagaatgaaattgttgtcattgaagtagtttctcaatattatatttatgctatttcagaatatattattaagctattgttagacataaacttctgtaacaaaaacaatggaaagttttcatggccacgtttacatttagaatacaattttcatttgcaaaattaaattattatggagaccagcctgaaataatgtaatagaacatgaaataatcagtgcagtatttcttgagactatactttatacattatatgtttatgattggtgtacatgtccgtgtatattcaaaggtatgattaaatctttttaaagttgccacagttacatatatgctgacaaagcttttctaaatatacaaattatggttatattggcagaatgggatacttttcccaaagatgtgtctatgaaagactgtatcttataggctgtcaaaatcttttttctatattattattcttaaatcaagttttcttttttgacaaagtaatggattcatatgatgtgaaatttaaaatcataagctacactacagaaacatccattttactcctgccatgtatatgtctaccttttccactacatggaataattttgttatttgtgatatatttttttcatttttagcagaggcaagcacaaatcatcatctccctctttcctataaaaaatgcagcatgctattttttttacaatgtttgaccattgtttttcatgtaacagttgaatgagtgagagaatatataataatgctatctgagtatgtatgtaactgtggcaacattaaaatggtttaatcatacctttcaatatacacggacatatacacccatcataaacatataatatgtgaagtataatctcaagaaatacagcactgattatttcatgttctattaaatgatttcaggctgctctctacaataatttaattttgcacattaaaattgtattctaaatgtaaatgtggccatgaaaactttccactgttctttgttacacaagtttatgtctaacaatagctgagtatattctgaaatagcataaagataatattgagaaacaacttcagtgacaacaaacttatctaacttgtctgaatgtctagcttgtcacccttgtccagtccaacatgtatttgttttgtatttgcataaaattattctgatatgttgtaaacgcttttggtttaataaagaaactcctaccttgaacatgttttaggagtcattttgattaatatataatattaattttgattaatatactatgttaattaaattttcacctgacaatgaaactggagggatagctacataacataactagaatttcaaattatcttgacaagtcagcatgatgggacaatagttttttttaaatatatattgaaacaaataacatatatttctcatggaaataaagaaacattctgtgaaaaactactcaacaatataatacgtaagagatttatccacatttataaataatttttgtttgttagacaactatgttagatgcctttaaaaggtaaatattatcttagactgtatagatagaaatgcaatagtggtaagcaagaaaatgattatgctgaactctggattgatcaaaacatgaatgtttggaatactgtagtttattctgggtattttttgatgtctgattgaaaacgagaccagagtaagtcaccccagctagtgaagagatataaacttcagttaatactgtgatattactaatacaagtctaatgtaatcttagtttaattaataagagtactatataaagaacagaggctgagagagaacttctctcattgtggtcatactttgcttgagtattcatttatgtttgggactctgaggttaaagaaggatgttggcaaggctaggaataataaaatagtaaaccaggaataataacataataataaaaataataaatacatttttctgcttctggccaatatagagttatgggatccaagttactttctcatctgaaacaggaacaaaatacaaaatatataattctggttttcaagacattgaacatcagtaaatgcagcacaataatacaaaagaggcagaaacaaattatataagccatgtgattactgcagattaccattttaagagagctgtgaatagtgcctactagatttgaacaaagcaaaagctcataggccatggggcactggtattgtaactcttgaatcataattcataatgaggaatgattagctttacacctagcaatgctatgatctgccaaagaaacctcacgtgcagaattcagagggttaatctgttcaactaacttaattgcaaccagaaataagtttaagaatatttatagaaaccctaatatacctagcaccaaaaagtaaaatgtacatcaaatattgaaagattactaggcattaacaggagcagaaaaacattaaccataacgaggattttagccaattaaaagtgacccagaattgacagtatttacacaagtgttcaaacatgcataaatggacattaaaaacatgtattataactgtctgctgtctggagaaaagtcagggacatgtattaaaaagacccaaatcaagctgcagtaggatgaaaaactacattgagacggagaatacgctgaaaagggttgacagcagattagacattacagctgaaaatataagtgaactcagtccataacaataaagaaaaaattagaataaaaaaatgagaattcagtgatttttgaaacaacttcagctgagttcacgtacttagaatttggagtctctgaggaagaacaaaaggggatcagaagacagaaaaaaataattggagaaatgatgggataaagttttctaagtttgatgaaaatcacaaaaccacatctcaacaaatcctcagcacaaaaatacaaagaggactatgccaaataaaaacacaatcaaaatgctgaaaatcagtgatggagtcaaaattttaacagcagtcataaataaaagacacttttgtacatagagtaacaaagataaggaaggcagctgattaatactggaaaaaatgcaagtgatgacataggagagcaatatctttaaaatgccaaaacaataacaaaaacaatggatgactcccaattctacacataataaaaatatccatcaaagtaagtgaaaaagacaattatagatgtagaattactgaataaatcatctctagcaacctgcactatcgggaatgttaaaggaagtttttcagggagaatgcaaatgacatcagatggaaatatgaatctatacagagaaataaagggtagtgaccacctgagtaaacacaattttcttattatttaatctatttaaaaatgacagtttaaacaaaaataataatgttttgtggctactgtatctctacagtatccaaaattcaggagaggagaaatggatgtacaccagtctagggttctattgaaatggtataatatcacttgaagatggacatagataagctatagatttatattatgaacattaaagcaatcagtaaaataatgaagcaactaaatcaataagaagataaaataaaatactaaattaattagagtaatttttttttttttttaaagacggagtttcgctcttgttgcccaggctggagtgcaatggtgtgatctcctgtcacagcaacttccgcctcctgggttcaagttattctcctgcctcattaattgaaagacagaaagagagacaataacaagtggtggaaaatttgtggagttacttgaaatgcaaaatttttcagccactgtgaaaaagaaattggttatgttttaaataaacacaaattgactacatgaaacagcgatttcactgctagctatcaatgcaagagaaataaaaacctacgtatatacactaatttgtacattggtgtttaatggcattattcttaataactgcaatctgaaaatgatctatatgttcatcgactggtaaatgaataaacaacaggtagtaaatgtatgcaatggaatatattcagaagtaaaagtaatagactaatggcatatgctgcaacattgatgcaccttagaagcatgctacgtgaaagaaaccagccgccaaaactatacaagttaaaaattaaaagaatggaaaaatatttgccatgctagcaagtaaaatgaaaacaaaattgaatacttcaatatcaaataaattctaatttaaagcaaatatccagaaatgccatatttatatatagagaaaataaattcatggatgacggaaaggcatataggacaggaaaatgactgcaaatggacaataagtacatttcaaaggtaacagaaatgattcaaaattggattgtggtaatggttgcacaactgtaaatttgctaaaaatcattaaaatgtacatttaaaatgaacatgtttaatatcatgtaaattaaatagcaatacagttgttataaaataaagtttcctaaggaaagtgaaggtccggatggctttctttggcataataatggcataataactaattctactaaatatttaagcaaaaaataatactaattctcaactaaatgttcctgaatatagaaatgaagggaacacttcacaacttattgtgacacgaatgttactctgataccaaaattacacagctacaacaagaaggtagaacaatatccttcatgaaagaagaacatcccaagtcttcaatgtattggataatcataattatgaacaaatcaaataaagcaatattaataaaaatgataatacatcatagataatgttgtttatcacaagaatgcaaggctggtatgttcagcctttgaaaaatctaccaatatagttcattaaattatgccagatcaaattaaaaaaaaacaaataattatcttagtacctagagaaaaagcttctgtcaaaattcaaattacatttattataaaatcttcttaataaattgggaatgaaaagaaatttcctctaccttataaagggcatttacagaaatcctaaatctaacatcatatttaatattcaaaacctaagtgcttttcccctaagtttcagtttaaaaagcaaaaatgtcattcaccactttattttgcatcacactagaggtcttagccagaataatacaaccaagaaaaataaatgaataacacagagtctggaaaaaacttaaacaatttctattctcagatgacctgattctctaaatataaaattaaaaaatatatataaagttactaaaagaatgttattttagcaagtttgcaggaaacaagctcaatataccaaaaattaattgtgtatctttacactggaaagggattattaggaattaaacttaatatttttatagcacaataatacattatagcagtcctcacttaactgtggttattaaatggaaaattccagaaagaaacaattcataagttttaaactgcatgctgttctgagtagcatgatgaaatcatatgccatctcattctgtcccacctgggacatgaatcagtcagccgtttgtctagcatctccatgctgtctctgctatcactctgtagtcatttgcaagtttttcagttattagattaactgtcatggtattatagtgattgtgtccaagtaacccttattatactccatgatagacccaaagcacaagattagcaaagctggcagtttggttctgccaaagagaggtgttaaagtgcttattttaagtcaaaaaaggaacaatggacattagggaatataagagggaagaaaggagagagccaagggttgtaaaactacctattgaatagtatgcaaacttctttaatgatccattcagttgtagtacaaaccccagtatcatgtaatatacctcagaaacaaattgcacatgtacaccagaatctaaaataaaagttgaaaaaaaagaggaaaaaaagaactgatctttttaaatcttagtgaacctagttgttataaaattgtgctgctaatattctgttgcgtgaagtcagggaccacaaacggagggaccagctgaagccatggcagaagaacataaattgtgatgattttatggatgtttattagttccccaaattaatacttttaaaatttcttatgcctgtctttactgcaatctctgaacatacattgtgaagatttaatggacacttatcacttccccaatcaatactcttgtgatttcctatggctgtctttactttaatctcttaatcctgtcatcttcgtaagctgaggatgtatgtcgcctcaggaccctgtgatgattgtgttaactgcacaaattgtttgtagagcatgtgtgtttgaacaatatcaaatctgggcaccttaagaaaaggataacagcaatgttcagggaacaagggagataaccttaaactctggctgcctgtgggccaggcggaacagagccatatttctcttctttcaaaagcaaatgggagaaatactgctgaattctttttctcagcaaggaacatccctgagaaagagaatgtgtccctaaggggaggactctgaaatggctgctttggcgatggctgtcatagcggacagatgaaataagcccctgtctcccatagcactcccaagcttattaggacaaggaaattcctgcctaataaattttggtcagactggttgtctgctctcaaattctgtctcctgataagatgttatcaatgacaatgcatgcccgaaacttcattagtaattttaatttcgccctggtcctttggtcctgtgatctcgccctgcctccatttgccttgtgatattttattaccttgtgaagcatgtgatctctgtgacccacaccctatttgtacactccctcccctttttaaaatcactaataaaaacttgctggttttacggctcggggggcatcacggaacctgctgacgtgtgatgtctcccccggacacgcagctttaaaatttcactcttttgtactctgtccctttatttctcagactggccaaagcttagggaaaatagaaaagaacctacgtgaaatatcaggagtgaatttcccccgatatattctaacaatgttaagtgaatgaagaaataaacgcatttcctttttaaagaaaaaatgtgaaagttcacgactgacaatgaaaaaaatggattttgaagatctaagatcttaagaacaaatcttctatccatacaattctaaagaaggaaaaataaaatttgatactagttttgctgttgtaactcaaactacaaaagttacagccatagtgtgtgataagtgctcaattaagatgaaaaagacattaaattttggggttgacgacgtaaacagaaacgtattcttattgatagcaattgggtccggtagtatccatggtttctgacatctcctggcagtgttggaatatatcccctgtggataatgggcactaccataattacttcagtttaaatgaaactaaatacatacaaattctgtatgctgaaagcttcaaattactaaagaacacaaccaaagaagatctaaataaatggtgggatagactgtgttcatggattaaaagactcaatattgttaagataatcgattttccctaaacaggtatagtccatgcattctcaataaaaatcccaacataaatttttgtagagattgaaagatgaatctaaatttgttagtggaaaattgaataatctaaaatagccaaaattatttttataaagaagaacattggacaactcactctaaccaatttcatggctcactataaagaatcatgtacagtgcagtatttttaaaaggactgaccaatcgaccaataggataaggtagagagcccagtatgagacctgaacatataaaataaatgattttctgatcacagattctgacgcaatttaaaagaggtgtttttttgtttgtttgttttgttttgtttttccaacaaaacatgctggaatatatagaaaaaataagtcaaaatagattataaactagaagcctcagagtagagcatagaataaagtctttgtgaccttgagtgagtcaatgatcttattaactatggcacccaaagtatgatgcattctaaaatgaatgaattaaagttcctcaaatttaaaagctgctctttaaaacagactgttaaaggaatgaagatacgtcacagagcaggagaaaatatttgcagaattacatatctgataaacttggcctcaaagcatatacagagctttcaaaattgaataattataaaacaacccacaaataaaatccataaaacatgcaaacagatattgcattaaaagaaggtatgcagatggaaaacaaaaacacaaaaagatgctcaatatagctagtaattaggaaaatgacaattaaaactattaaatacacattggacaaaaatgtttaaatggtgaaatagcaagttttgctttggatatagaatgaagcgaaatgctcatacaggcaggtagaaatacaaaattatattagcactctgaataacattttgaaatgttctaatatgaataaacctacacttatcatacaacgttgctatccctccccaggtatttatgtcatcaaatgaaaactaatgttcacaaaaaaagcctgtatgcataagcttctagtggctttatatcaagaatcaccaaaaaagactgaaaaatatctaaatgtcctttaactttcaaatggatagagaaactgtggtacatccatgcaacagaatactccttagtaataaaaaggaacaaaattgttgattcctgcaacaatatgaataaattcaaatccattgtgctgagtgaaagaaaccacactcaaaggctacatattgtgtgattgtatttatgtatttcagaacagatttacgtatttcagaacagataaaaccgtagatctagaaattgatgagaagtgtcaggggagtggatgctaggtttgactaccaaggggcataatgtatttgtttgatacctcttgattgtggttgtagttatttgactatatgcacctgtcaaagctcacaaagctctatactgaagtaggaaaatttaactacacaaattataccttcacagactcttgtaaaaatgtgtttatagaaatgacaatttcaagattatcagaagtatcactagtgagatctttaaaaaacaacaacaataacaacaaaactgttaggtctatcttttgcaaaaggtgtactatctttgtaactttttaaaatatgaaaatatatgtaagacttaaattttaatgaaccaaaccataatatgcagaataatgaaacccctcagaacgccccacctcctaatcttcagcatttgggattatgttctgctacaatggttgcagatagaattaaggttgctcaccgcctgaccttaaaatagggagaatatgctggataatcccaatgtcattacagagtccttaggatttgaagagggaggctaaagaagagtcagtgttagagtgatgaaatgcaaaacgactcatccagccattgctgactttgaagatgaaagacagtcacgggccaaggggtaaagataacctctataaactggaaagggcaaaaaagtttgtcctccacaattcttagagtggaacacagtcctgctgacatcttgattttagcccagtgagacccatttagattctgactctcagaattgcataataattttgtggtggtgtaagacactaagtttgtggtaatttgttgcagcagccatagataacgaatgtaccaactcttgtctatttcatattgggtttcacaagggaaaaaaaaatgagaaaactattcatacttggataattttttttaataccctacattgacaaaaggcagatcaatgcagtaagttttattctaaagctaggttggtatgagaataaatgcaaatatttgattaagatgtttccattgatctcctttcaagatattttatgaaatttaaagatcccttggtaatttttaacattaatatagaagttaaattgaattcttttttgtgggtgtttacaaagtcatcttcttccttcctaaacagatctctcctgacacattttaaaatagcagaaaagtgcatttacctaaagtcttaatatttgtagatgatatggatatggtttggctgtgtctccacccaaatctcatcttaaattataactccgacaattcccacatcttgtgggaggaatcaggcgggaggtgatggaattatgggggcgggtctttcctgtggtgttctcgtgatagtaaatgaatctcagaagatacgatggttttaaaaatgggagtttccctgtacaagctctctttggctgctgccatccatgtaagatgtgacttgcttctcctcgccttccaccatgattgtgaggcctccccagccatgtggaactgtaagcccaataaacctctttcttttgtaaattgcccagtcccagatatgtttttatcagcagtgcgaaagcagactaatacagatatatttaggtgtgtttgaattttaactttcaatctataaagacacattaaatagatgctatttgaatattaaacaaattggtaagtgctgttaagacgagaagagtgtaggagatcttttcttatctacgttcataaatgagaaattttatcggagctaaagataagctaattatttaccttggctaacatagaatgtttttatgtttttaatacctaatacaattcttttccttttgatttttgtgccaataatatataagatttataatctctcccactcatatgtatttaaatttttatttcactggattcaatttaatgtgctcctaaatttcatcttttatataattttcttgccagagtttgagtattttctgtcatcacaaggctgagtcattacaatggaagtgtttgaatgaagatgaatagaggtgaaggtcactggaggtgagcaccacaatccattgctaaattaaacatggcctttatagtcaaggaccttattaactaatgagggctatggagaaagaatcagataattaaagcagaatgcacttagtattgatggggagaattagagggcactattgaaacatacagtaggggcatgtaaatcagacaggagttacatggaatgaaagtgtaagagacctgtaagaattatctaggaaaggaattgggggaaagagtgctccaaaaagaaagaataatattcataaatatatggagaggggagacctgtaagaattatctaggaaaggagttgggggaaagagcgctccaagaagaaagaataatattcataaatatatggagaggggagacagcctggtgcatgttggaaatgccaggcatttccatactgatggaggataaataactcagtctctgaatctgggattggtttcggaccgtcttcggcaaatttttggacctttgccccagcaacagtgtggtttgggaaaatggggcataaaacgaaagaaatagatgggggtaatttgtttgtgtcatatctgttgcttagagatggatcttgctatttgggttcttctcacttcactctgaatgtttttttttttttcttgcttttggctaacacccatgtctcccctttataccaaataccagcattacccagaacatggaatgcgacattctgtcttttccctgatttgagaggcaaattatttgagcagctcaggtctactatgggtgaatgtgagtccttcctaagtcttccaaaaccattgttgacctgccttgaagcacgtaaggtaaaaatctggtctgtgatggttaattttaggtgtcaacttgattagatgaaggaacaccttgagagctggtaaagcattatttctgggtgtgtctgttagggtgtttcagaggagattgtgtatgagtctttgaattgactagagaaaacctcccctcaatatgggtgaacaccatccaatcatcagcggcgctgggtagaacaaaaagttagaggaaaaccagatcctttatttttatgctgaagctgggacacacttattttcctacccttggacctcagaacttcagggtccctggcctttcaactgtgagacctacaccagttcacgctatcttcaccaggttctcaggcattcagcctccatctgatagttacgtcattggctttcctggttctgaggccttcagacttggactgagccttgttactggaattccaggtctccagcttgcagagatcccataatgggacttctcagcctccatattaataggaacctatatcctctcacccatacgcctgtttgtctgtctatctatttattatctatctatgcatcaagtctatctatactattggttttctctctggagaaccctttaattaagataaatccacttctcaaaatacatgcatcagcctttaatcgactacacacaaaagtggtatcctagactttattttttttttttcacttcttaaagagaatcactctataagcagagtacaaaatgacagttgtcaaagattctctggagacatcaattgaaatagactccccctcaacatgctaactagtcattaggcaatgttctctagggtttttgtgtattgtcaaatcttcagaaagcaatgtacctggaccattttccaagcaatctgctaaaatgtttttcagaaagttaaaatttaatgttattctgctttttaatgcagaggttatgtaagaaatgtccaattgatacatgtttcagtttttttatttttgcaaaaccacagtctaaacattgccgatgatgtcatccactgtttgttatttaaggattaacccactacagttcagggctgaaagagaaacttttctccctaaatgatctattatattttcttcaatctgacaaagcaaactatataatccaatatgcaaacctttgtttggggttttgttttgtttttcatctaagtttccaggcagctctgaaccaattttaagtcttagttgtagacaccagcttaatgtggttgaatggcataataattttatgttattttaacttggactttaatgttagtttctttttaaaaataattattctatttgatgcactgagatttatagtctatatcaaatattatttgaaatttaggaagatattttcataaaaaacaaattacccaagttttctcataagaatcatagggcatttttctctattttacatagaaataattcgagttcatataggctaagaaagttgaccagatttaactaaagaagttacataattgatatttaaactcggttctctgctatgaaatttaatgctgtttccattatatgattatctaattaaacatttctctaccatttaacaaagcaaaaaaatatattttgatgtacaaataatttttatgtttctaagtatgtgtataaggtcaagttattaatattagaaaacatcatatccttatagtatgatctaaaaacaacttttactcctttgccatatactatcattacctagtctgtaatgtttaaattatagtgtaagaaaactcagaaattacaagccttatgttgtaaagataacatacgttttaagtgaaggctatgtgttatacatccagtcaattatttggtactttcacctgttgctgaataaaataaatgtaaacataaatcataataaataagcacacacaatggagtacacacaaaactattcacttcaaacattaaataaatcacagaatctccacatttatacaaagaaaaatctaagctgccaacaaggagagttataaaacatttgaaatcctgctttgctgctttattagagataatttcatccagtgagatttgaaagcaatgccctggaaatttatgatgtgacttttactaagatgtatgtaagtttatagaacgatgttcactagaaacagatttattctgtttatataacaagcagttacctctggcctgctctccctactgtatcctgctataactggtaagggtattaccccctaaattacctgctgttaggaatggccatgccagtttattcctataaataaggcaatctctctagccctatctctgtcattttaggcagttgcattcagtatgccccttccctaagtttgttttgtgtctcagattcttatacacatgagaacacctgggaatagacctggtggccttcaacccacaccaaggcaagcacaatgtctagaatgacttatgtcacttagccatggacccctgaggttccgtcactgacatcttattttctgacgtttttgtggagaactatttaaattttgtgaatagctgcttaattggctaatttagtgctctattttcaaatatcaacaataagacccctttcgatgtaaagaatcatttttcaagaaagggtagagggtgatggtggctattcttttttgcttaaactagcttgacctttgtagtctgattcttataaacagaacaagaaattagccaattaagcaacttgtatttaactagttttttcaatttaaatgtaacaatttgataaactttgctgagaatgtctattaactgataagataaattagaagtaaatggtcagttctttagttctacttaacattatcatattctgccatgacagagtagcattaagattcattgtttttagcctcatccatcttattgcaaacatattgtaaaatacttagttcagaaaagaaatatttatactcaacctttctgcactactatgtttatggtttacatttttctaaatgctagtctagtcaacattgatctagttttctatatttaaagcttaaatatcttttttgtagtgtgttttttttcagtttactatgttaagttataatgaacacatttaaaatactgtttcttctgtttatgtagtagtgctctattgttaaatgaaaactagaggacaaagtatgtgtagattgccaaataaagaattagttaccctatgtttgaacacctcaagaaggaatatttacatttcattctacccttctactacaactacctactttagattataaactcatgaagggcagggatcttttgagcaaagctcatatcattttgcataagaaaaatatacttgatatgcgatttggggtagatctgatcatatggctactggaagtgcaaactggctggtggttgtgatgagcatggtactacttatcctagaagattttcattcctctaaataaggcagaaaatgctgaactgtctttatacacactatgatggactattaatgtttcttccctacaaacagaaaatgaagttattaaatccaatcaactttcatttactacaaaggtttaaatgcctatactcaatgtacttcctactaaccatgtttagcttaacataataaaaaccctttattgaaccccattaaaatgaaagtctgccactcaaccaatcagctctgttgaaagttttggatgctaaagttccatgctgacttcaatggatgacagataatttaaaggcaatgcatataattaacaggattaacatctgaaactgtgtttatcagttagttgaaacattaattgcattgatttgaagtaaaaatctgacaccgtaagacattcacaaggtagtaattttggattctgtgtcaaggtaatattattctaaacatcccaaatggaaggttgtctctctagagcaagtatggaggaaccaaaaaggaaaaaagaaaaatatatagagctgatatcaaaaataattttgtcaaccacattaacaattgaaacatgaaaatacacaaagatatgttcctatcaaattgtcaaagtggtgtttatgaaacaaactcaatattagcaattataatagaatcagacatttttctttttttttggtgtgaagatggttattaccattatgaaaacaactagaaacacttaattatacagttacttatactgctatttgtttttatcataaaattatttttaaaacttgacttaataattaagtggtaatttatctgaaggaaataatcttatattcacaacatgtattatgtataaagatgctaatcatagcattattacttatgctacaggagttaagaagaaattaggcagatagcgagggtgggagagtactcagtaaggttttccttttactgaaaggtagcccccaaattatttccatttctaacaaaaagcagcctgtaaaatcaagctgcagacatggacaaacaagctggaagctctcttgggtgaatgctggtagctgtgccaataggaaaaggttacctgggacttggcatgttcaaaatgacgcctccatgttcccatctctttgccagccatgtatatagtaagaagcagaaaacacggcgccagccacgtggaaagcccatttgcatattagtgcggggtggacagccttcccagaacgttatgtaaacgtcacatgttgtccaaccaatctgtggactccatgtaaatcagacacacagcctcttcaaacctgcctataaaatctggtgtattccatggtgggccagaattcttattcagaagcccctctctctcaccagggagagagctgttctgctttctctttctttcgcctgttaaactctgttcctaaactcactccttgtgtgtgttttcctgaccttaattttcttggtgtgagacaggaaccctgggtatataccccagacaacaatgctgcttcgcttatgataattacagatcaggagtgtggaaagagtacatttcctattacataagaagtgcttaataatttacagaataaccaaataatggaatatatgggaatatttaaattatgttttcgaagaatatttaatataggacatgttcatattatattaagtgaaaagttgtgtcagcaaatgtacattcaatataatatcctttttattagctatgcctattttacatttaaatttatgtgacatatttatagaaaaaactggatatgtatatatcaaatttatcagcagtaagtaaacgagagctgggatcaaagttacgttggtatttaaatatttctgaattccatattttcataaaaatataacctgtatgattaagtaaaatataacctgtatgattaagtaaaatataattagctcattttatcttatgaattagttaaaataattcattttgagctgaataaatacatttctcatttatttacttctatgtgaaatgagtgctgtgtcttcaaactaactgtaaagccttcagattcttatgtttgatacaacttgttatctacactattaagttttgtttgtttgtttgtttctctttctttgagacagggtctcactctgtcgcccagactggaacgcagttgtgtgatcctggctcacagcaacctccgcctaccaggctcaagcaattctcctgcctcagcctcccaagtagctgggaatacaggtgcacactactaccgtctagctaatttttgcatttttagtagggaaagggttttacaatgttggccaggctggtctcgaactcctgacctgaagtgatccacctgcctcggcctcccaaagtgctgggattacaagggtgagccaccatgcctggccattattaacactgttttaaaaacatcattaccattttcccaaacccttggaattacccttaattgttccctttctagtacacttaaaatagtattatgcaacttgaacttttttttttttttaaacagagtttcactcttgttgcccagactggagtgcaatggtgcgatctcggctcaccacaacccctgtctcccaggttcaagagattctcatgcctcagcctcctgagtagctgggatgacaggcatgcgtcaccactctctgctaaattttttgtatttttttagtagagacggggtttcatcatgttggccaagctgttcttgatatcctgacctcaggtgatccgcttgcctcggcctcccaaagtgctaggattacaggcgtgagccactgcacccagcccaattatttctaatttatttaaaaaaatatttatttgtggtcactatttgccaaagatt

SEQ ID NO: 33 - DNA, 10552 bp, Homo sapiens
tggaaacgctgataacggtagataattcatagcaagttctctcagaatgtaaaaaatcctatttattatcattattatttaagttaacatgtactatttccttaaaactgaccataaagctttatttcttaattaaactctgatttggcgtagatgtgaaacccattatgttatgtaacataagtgttataacagatgataagttgccaaggaattgactttgcctgaggaatttggtagaaatttcaaggttctgacagtggttttgataatatagtagagaaaacataaaaagagaatagtatgaagagaatttggttaaggtgtacaaaatacagttcgatagaagggatgagttctagcatttcagcagaacagtagggaaattatagttaacaataatttattgcacatttcaaaagagctaggagagaagacttgtaatgttcccaacacagataaaagataaatgtttgaggttatgaataacctaattgtcctgatttgatcatccaactttgtatacagatatcaaaatactacatctaccccaaaatatatacaacatatatatatatgtataaatttttaaaaagcagaattttaaaaatgaagattaaaggagctctggggatgatcacatttaatgggaagaacaaggaggagcggagaaggggaagaatgtggatgtaggaggagcataggagaaagctgaagactgaatgttcctcactggcaagtaggagaccttccccttgtagagttggtctctgaaaattccaagttaagtgctatgactcttcagatcatcgaatcccctttatctcatattaaagcaaacttattttctagaatgttctatttctacaaattatatttcaatatgaaggtgaaattactgtgcattagaaatgaaaacttactaaatctatgaaataaaacatacacaactacaaagaaaattgtctttcagcaataagattgaaattttttttggtaaagcaacagagatttggtaactatatcaaatgcctctaacaattttgacaagcaaatgagataacaagaggctaaaagaaaagttgtgaaaaaaacaaaacacaaaaaaaagttatgaaattaaagctatgtttatctcctcaagaaattcaatattattttctttaataaagcttagtttaacattattattttataaattgtcttcatcacaaaatactttagagcatctacgctgcagtaagaaaaggttagacttttcttttaaaagttcctttttttgttgttaaatctgagtgtttttcaagatcacaaaagctttcagtggctgttttagtgcaatagtagtattagcagaagaataaaaacatataattctaagtgattatgcaaactatcctccatttgaaactttacaactttagctttaaatgtttaatattgccatttttaagcattaactatattctgaaatacattgttttctttggcattatgaaacttctataaataaaagtattttttactaactgcctattgtcattctaatggaatctaccaaacaatgctgcaattgcagaggtactgattttctcagaacagttaagtggatttcagagagttgatcacaattttctgagagacaatatcatagtaccaagatgtttctctggcttcataatattgctgtacctcccttttgatgttaattcaatgccctcaaaatctgtttgttacaattatcttggttttcttggctacttacagtaactaggaccctttttattttagttttgccattctgtttcatatcacattttatgtttaaaaagcattcattagaatcaaatgacttctaaaatctaatgtttcttagctaatactaaggaagttttcagcattcttgggtcaaaatgagtatccgcattgcttatattactttaaatgcatttacttggatcctcctgcaattcagggaagagctggtttaaatttgcactttgaaatttctctacaaaggaatacactttccaacgcagtattttatctaataatgtaaataacatttctggcaagatgttataaggttcaatgaaagatgcctgatcaaatagaattacatgtcaatttttggacatttttctcccaaggtgtggaaaatctggttttcagacagggttagtttgctggtaaatttaaaaacacagcatgtagacaacagaagggaatgaattaatttggaatcacctaaacatggttcatcactaataatcgagccctagagaattctggtgacttctactgatctggatggtatgggagaaaaaataactagggtagcagagaccattttttaccttagtcccttgcctcacgtaaggggaaaatagttcaaaatattagtgcccaggaaatttactaataattccaaactagctggaatcattacttcagtatttttatataagtattcaggactgggaatagtagttgagcctccgagcagaagattgttttcatttaataaaatatttacgagtgaaaactattggaaggtagaggtcaagattgatgcattatgaatctcacgtttgacgaaaacacaatatgtgcatagaaaaataaataacaacattatcaagtagtaacatgatctgaagatgataaatacaataaaaaagaaatacattatataagcaatataatgttaattagtgatagatattacaaatataatggacatggtaatataatcggggactacttttaaaatggtagaaagagaatatctttcagagcaagtgacacctgagatgagactaaaatgaagaagagacataaaagaagtttttatttgaaggcctaattggagtgggataaacagaaaattttaaaaattaagaagtagagacagcaaatgtagacaatttttgagagataaagaaaatccaataaatagaattgtagatgagtgtctgggggtcttgtattgcagtattaaacccacgaccaataccaacgtatacaaaagataatagaaaactgaaaacaaatgaggaaaatgaatgtgagatcaataattgaagtgacgaagctgggatcgagagagaagtcacgtgatcttagagatgtggtagcagaggaactagagacaatgtcagcaaatcacccagtcaactgggctacccaaaggaggagtagtatagacaggtaataattattataatccaaagagaatattccttgaccttatacactattatgctgacatggaggactcacatcagcttatgaaaaactgaagatagctgtgctatggctgaagtttgcaggagtctggctccgggacaagtggtactgagtgtcgcctcctccacagtgtgcttcctcagagcctcattaccccaagcttgctctgtgtggatttcagtgtctgagatttaggatacctgcaagtaaaagtacagtcttcaccttttctactccaagagtctttccattccttcagtgaggttttatttttattttctaaaatggaagtggaagaaggagggcataagagaatattatgagatatggcttctttctggatagacggcaaaggctaaaataaatgactcctgttaataggtgtgagtggacagaaagaaaaaagtcgttaaggaaatgtacaatgcctaagacaattcgtttaagttgttgttggctatattaagggtctaaatacaaactatcaatagaatgccttgttttattttctgtaaggcagaaatattgtctgaaaggatgaataaattatcccacctaaatgtgtgccacaggtttgcttctttataaccctgtaagtgtagggatctgaaaaatttaaaactggcaataagaactaagtttagaggtgagatctggtacatagcttttaaaaatccaagtttcatcaagaagacaaaaagaactctcgagctttgtacaaaagcttgaggaagtaataaagttaatttaagtccagctgttgagaacctattatctctagtccaaattttatcactaagtagtcaaaagataaagtcaaaaacagaatgcaattgtatattgaaaaatataattgatataattttttaaaaatattacatttaacaatttataatattactcacgtaaaccctgaatataatgaggagagacatgcacaaatgttggaggtaaacagtaaattatttgctcttctcactcactaatttgattccttaaaattaaaatataaattgagcctctaatttctgtttagacctgtgttccctgttatgggaaatatgaatataaaagagaagcatgtgagtcctggatagcaagatagataatttgagaaattgcttttaatttctgatgatgaagctagcatttggcgtgctgaaatagcaacatgcaacatccttgtgaccatgcaaatttaatctggattccaaaacctcttcagttccttactgggagtgttgatattccaggagaagtggtaaatcatgttgctgtcactgttcattaggtgttgatcatatttagatttaacgctacaatatcagtcatctgttgtttattcaggcaaggaatgcgacacaatagtttaaaatgcagtcctagacttactgagttcagatcccagcttgtccattgccttctgtgcgtcttagggaaagtcacttagcctctctctgtcccagtttcctcaaagctcaaatgcatattacattgacatatataaaggcaatctgggagtagaaaaggaggatgttaaagtactcttttcattttaactagtaaaagtactcatttttaaaatgtatcgtctaccccttagctagtgatcccctacttaagtactgtagaagtatttttattggaattaacttttaaagacatggttgaaatagaatttttaaaacataatgcttgaagggtccaaattatgtggtgtgaactttccataccagaaaggcattttgttttctgctccaacaaaatgagtctctaaacagctactaatgttgagagagattgaaacaatacagtaaagcctacttaccacggcaatttaaacttctccctatctatgatacttaatgctcaaagggacatttcagcataatgatagtcaaaatttgctgtataagaaaaacggccatttggagtggattttttttttctacttggtttatggaaaatgctgtagtcaggttttgcagcacggaaaagaagcaacctagcaactgaatttcaagaatgatgaaagatatctgagtcaaatgtgctgcctcttgagacaggaaatagatgattctagccaagcctgacagaaaagagaaaactgaataggcactaaaagggaaacattcccagatgaaaacaacttttatttaaaatgtggacatttaaaaaataatttttttcagtcattcttagttttctttacatacctcatacatcctaaaattagacagttttatgtgggaaatagttatccagtatttcattggatgaaaatgcaatgactttttttttttgacatttatttaggcacaggtttacatttgggcttttaactttgaaatcatttcattctcagagcttttctgctaataagaatagaaatacttagccattaatgcaattttgaaggagcccaaggtagtctttttcctgctcagaggttatcaacatggagagataaaacaacaaagacagtccacgggcaccatttacactaaaattgcaagcatgagacactcattggtgagtcctgctgcatgttcacagcaggggaagaaggaaaaatctttaaggaaaaacaaattggccagaaacgcagcaggagagcttaactgggcaagcagaaagcccacactacttcaaacagtaaggattaacaagaaaacatatttgaaaaacaatggtaagaaaacatatccagaaagaggaggggatattgtcttgtattctaacaccaagcagaacaaggtaatgagaaaaaagataatagaggatggcttccataacactgataataaagagaaagacaccaatggttatgaaaaatcttgcaaacaattttcaaaataccttattggaacgtcatttttttttccactctgacaaacttctttacattttaccagattcatgtaaattatttatagtgtagtcaaatttattttgatgtaaaattttcaaatggataataaatctatgggaaattcgttctgctttgggttatctcacttatggagatgaaaggacaaattcacaatgaatatgttttaatttaaaatgaactgctttaaacaaatgaaacagaagatcttgcagagaccaacaaagtctaactaaaataagtgtttaatcagaatattattatatgctgactatttagataaagagaaagcagttggactaataattttatttttattctcttgaattatttacattttaaaagagaaaaaagataagcccgaatattgatataacaaggtagaggcagacaggaaatgggaaggagtacagcattcaatggcacaaacaaggaagtaaaaagtggccgaatggccatcataagatggggccagtgtgggtagatctctccatccctgctgggtcgattccctactgaggccagaccctgattctctgctctccactggcggatctcagtagagaccatacaagagacaatggacccaagaaaggtgaaagctttactcatcattacttacaactgaggtacacctatatcatgagtacaatttgcctttccaccaaagatgaaaaaggaaaagagaaaatgactgatgctaccttcttcttttgttttacatgatagtgagaggtgacagcatgctggcagccctcacagccctcgctcgctctcggcacctcctcggccttggcgcccactctggccgtacttgaggagcccttcagcccgccgctgcactgtgggagcccctttctgggctggccaaggccggagctggctccctcagcttgcggggaggtgtggagggagaggcacaggcaggaaccggggctgcacacggtgcttgcgggccagtgcgagttccaggtgggcggctgtgggctcggcaggccccacactcagagcggccggctggccccgccagctggccccaccggccccgggcagtgaagggcttagcacccgggccagcagctgcggagggtgcaccaggtcccccagcagtgccggctccccggggctgtgctcaatttctccctgggtcttagctgcctcccagtggggcagggctcgggacctgcagcccgccatgcctgagcctccctcttccccatgggctctggtggcgtcggagcccccccagggagtcgccccctgctccacagcgccgggtcccatggatcgcccaagggctgaggagtgcaggcgcacggcttgggacttgcaggcaactccatctgccacaccagtgcgggatccactgggtgaagccagctgagctcctgagtctagtggggacttggagaatctttatgtctagctaagggattgtgaatgcaccaatcggcactctgtatctagctcaaggtttgtaaatacaccagtggacactctttatctagctaatctagtggggacatggagaacttttgtgtctggctcagggattgtaaacgcaccaatcagcaccctgtcaaaatggaccaatcagcaccttgtcaaaacaaaccaatcggctctctgtaacatggaccaatcagcaggatgtgggtggggctagataagagaataaaagcaggctgcctaagccagcagtggcaaccagctggggtccccttccacagtgtggagggtttgttctttcgctctttgcaataagtcttgatactgctcactctttgggtgcacactgtctttatgagctgtaacactcaccgtgaaggtctgcagcttcactcctgaaaccagggagaccacgaacccactgggaggaatgaacacctccagacgcaccaccttaagagctgtaacactcactgcgaaggtctgcagcttcactcctgagccagagagaccacgaatccaccagaaggaagaaactccgaacacatccaaacatcagaaggaaaaaactctggacatgccgcttttaagaactataacgctcaccgcgagggtccgcggctccattattgaagtcagtgagaccaagaacccaccaattctggacacaatatgatcaacctcctttcagtgttggtattaagaaactaaagaacctttgcaggcacatggatgaagctggaaaccatcatcctcagcaaactatcacaggaacagaaaaccaaacaccgcatattctcactcaaaagtgggattcaacaatgaaagcacatggatccagggaggggaacatcacacactggggcctgtccgggggtggggagaaagaggagggagagcatcaggacaatacctaatgcatgtagggcttgaaacctagatcatgggttgataggtgcagcaaaccaccatggcacatgtatacgtatgtaacaaacctgcacattcagcacatgtatcccagaacttaaatttaaagaaagaaagaattgatcgttttgaaaaaaaaaaaatacattatcagaaaaaaaaaaaaaaaactaaagaagatgcttagttgttcttgactgagacttttggaggatttatatgtcatactcttttctgttgctttatgattttttttgtgttagctcaccataggattataaactcctttgcttgcaattctttcagagtcttcctaccagcaaacacagagctaggcactctgtaaatgacaaaagatatgaaaaatcacttttgttgattgcctgcttcttcctgtcaggcattttcctagaggttttattgttgaattcagttaaagttaaattgattttcattataactcagaaaagggagcaagcactttgagaatcaccgtagtgccatttactccatcattacatccatgggcttcattaaataattcaatatatatttgttgactgtatggatggatgaatatgtgcagaaagagtataattcaagcaattggaaacatattcaggggcatggtgggaggaagtgaaattgtatttgagtcaaaatattccacagttatagacatttttttatttggaaattggaaaagctgtacctgtttcttatcatgtattgtgccagatgacataacaagactggtaaaggaagctttcgagtcaatattatttgaaaacatctttcattctaactttaaatataacccccatgtctgaatcaatactactgtaaattaggaggcttctgaatcacattaaatataatatataaaattgagctatttagtcattatggtttcactgattctgttgacagtgcacagtattttaattcattgcagctgaaaatcaaataattttactgatgcttagatcttatattcttcttcagagttaaatagctccattattttttatttctcatacttttcacatagatctctttgtgtgggtccttactgtttcaggatttctgttataccaaaataattttacagttttacagcttctgctttatttcttgtttctttccttagcttcaagaaatatattttcaaaacacaaatatcatgtttatttatgtattaaacaaaaattaacttagcattttcactcaggaagcactcttctagaagctatggatagaatagtgacatgagcaaacaaaaatccctgtcatcatggggtctacattctcttgatggacacagacagtgaagaaaacataaatgtaacatatggtaagtgagatgttaagaggagctcaagaatgccaaggaaggaggaaaataaaaataagtgttataatttagatagggcagcctgtcgaggcctctttgaaaactgaagttttgagtaaagtccaggaggtcgtgaaggagggagctttgcagccattgaggtaagaacatttcaggtgggtgggggctgaaatacttgttcagggtggagtggggaggcagatgcagccggaccagagaggtcaaatgccaaagtgaggccaaagaagtgaggaggaccagaatctcatggggcactggaatcttttttttttttttcagccagccctaccatgacaacttcatacaaaataacatagcaaccctccattcctcattaccttcatctccctgatttgtttctttttggaagtatttatctctgcctagcatcaaatgaaatatttatctgttgattttctgtcacgtccattagaatataagccatatgaagaccgggactttggggttgtttacacatgtaactccttcaagcagagcaggtaggtgctcaataatacttactgaataaacaaatgactttgtagctaccatttgtcccatcatgtggttatgcattcagcaggtattcagtaagttctgattgaataaaatttgtcatttctcctgaatctttg

SEQ ID NO: 34 - DNA, 102959 bp, Homo sapiens
cacatagatttaaatagcaaaagggggaataactactaggtgttagacttgagaggcagatgaattagatacggcattgaaagacaagtaaaatttaaatcatgaaaagagaggacatgatttacaaggcgcagaaagcacaggtaacccgagaaagtcatgaaagctggaatttgcaaattatggttgtgtggtaagtaggttgagagtatgtcttgatttttatgatgtggatttgggttagagatcttggagggcttacattctaggctaagattttttaaatgtatgataaataatgcatgtttaacagagaatacaggaggaatttgagctagtgactacatatatgccattaatgtattgtgagcattgacataaggaacacagggagacagatgagaaacgtgacatgaggaaacaaggtaattacaaatgattaggttacaaagtaatcttattttgagcaaagatgtcaaaagttaaaataaaagagttgtgcggtcttcagggccaaaagcacgctaaatttaatttttttattcatagtatctagagtagtacctagaatatagtagaattccataattacacataaagaagggaaaagggaaggtagaaaacagttattaaacacattttccgtgataggaattaggctaggaaatagcacatacagtattcactgtatgatcacaatgacagagataagtactattattcccaattttgtagaaagaaacagaatatgtaaggttaggaaatttacttacagtcatttgttaaataaatcttaagacttataaagcaactagttttgcataaatcttgagcccaggtactttagccaggtacaacattgggctacaagaaatagaaaaaatctaactcattcaacttacaggatgaggatgcttcaaggtcacagaataaatgtgaagtattctgaaaaggtcaatacttaactgatccctgcatttagataatctctactaataaacattagctttttgttatgataacaaggaaactctcagtaaaatttagcttcggcgttaaatgtacttttcaagaagcattcttctggttctctagttattttccccacttaaatataaaaacttcagactgtttttgtttcatatatttgtactattcatcttgaatcatcagctgtagctctgtgacattttagcaaagtttttggatgaagaaaatttcatactgtatttattttacctttgtagttctgaaaataataaattataatgtttatacttctttctattttttctattttcattgtagggctacacaactatttcaatacattatgactcccatattatgaatatggtatttctccaaaggttgcaatattcctaattgttaagagacttgaaatggaaccaaggcaaaaataaacctattaatgtattttagtgtcttttaaagttttactctcagcctacaaaggttattattttatgaaaaatatatcagactcattctctgaaagaaaatttaattacaattgaaattaatgttacagagttcaaacattaacaaaaaatatataatgtttcttaatacatttaatactcaacgattaattgtttattgccacaaaagaggtaagatgattcaatgaaaacaaagcaaaaagttcatgtgattgtcaattctgtttcgtagcaaaccatgaacactcaagaagtagatttattaataaatcaccttcagtaaatcatgcagtggtgaagttggccacacagttgcttttatttcaattttttaagacaaagaacaatatcaaagaaagtcacctggtggcattatatctccaaaagcaaataaaaaagaatgggggcaatcatgtacagataattttatttaaaacaaaacgtccagcaatactaagttaaaaggataacggactagttaatcctattaactatacacgcagctgagaataattctacttcataatcatcgttgtcttagatttcatgctataatcattaaattaattgaaaacgtatgctgcatatataaaatactttttgggtttttgtttgttttgtttttgtttttccctcagagtctcactctgtcacccaggctggagtgtagtggcccgatctctgttgactgcaaactctacctcctgggctcaagtgattcttgtgtctcagactcccaagtagctaggactacaggcgtgtgtcatcacaacaggctaatttttgtgtttttaatagagacagggtttttccatgttggccaggctggtcttgactcttgggctcaagcaatctgcccgcctaggctttccaaagtgttgggattgcaggcattagccaccacgcccagcgcaaaatatgctttcatttattaattttaaatattatcattttaagcatttttaattaaaaaacaaatgaaactactaagaaaaataatagtcatcataaatgcaaagtgatgcaaagttaggcaaagaacagctttccatggaaggacctcaggatgtctcattactgtggtcaaaactgcatgtttaagtggatgacaatactggtactaaaaatgtattgtatatcactttcttttatgaaatatctacgttttaagcattatgcataatattattcataaattagttctttgttttcttcccaattttcttagccaatttcctcaaatgctactgacatagaatataattaaaacgaggaaattttgacagattaataaagttcgtagtggtgattacctagttaaattgcaaattatacaaggtcatgtcatcatatagaacaaattcactaaaatatactctttggaaagtcatattatttacagaatatccttatgtgtttcttacattaaaaaaaaaacaaaataaacttggattttattattcatttattttacaaccaagagaacaatttctaaagttaggcataagcattaaagacttaatatataccgtctctaatacatattttatgtatgtgtcatataaaatttcctcattacataatgagagggttttacacaattgctaaatgataataaagtttcaaccaaacttctactatatcttagtagaagatatagccagatttttaaaaaactgaaaaaaatgtttaattaaaaaaacaaaagaaaatattgtaaaatgcgttccacgaatgtgttaatatgaaattatctacacttgcatttggagctaaaaaaaaaaaaaaagtttgggtgttgtggctcacagatgtaattccagtactttgggagacgaaggcaggaatatggcttaagcctaggagtttgagacaagctgggcaacacagggagacctgcctctaccaaaaattaattttaagatatgcttacaacttgtttatatattgttagtaactcttttaacagcacatgctgttttgcttagccacacagtgacagtcttattgcagtgaactttaaaccttgcagccatggatagaatatatgcagccaatctaataggaagcagatgtaatacttcacctctcttttattaatttagttatgtcttaggtcactgatttttaaatgatgttcaatactaagtgtaattcataaatcaggaagatgagacttacaaaaagtcttctttttaacaggctcaaaataacaaatatgaaaatatttcagcaaatagttttgctatttgggtttaccaaatgcattgtattataaactgagtttttgggcaagcttgtaagagactcaaaattgcatccactgtttccttgtcaattttatagaatacttcatgggtaacatctttctcaatggctttcagtggcatctttacaaaaagatgtttaaaaagttgagcgataatattagaaatttttatacagaattaatttatacacatatatatttcaaacatttttgctagagatcattaattcagactgtttcaggtatattagtaagaattttgtgtctatgttattagaccaaattagaatatgataaaatttttcaggaatagccattgattacccagaagaaaaaaaaaaaaactgcctcatccatctgctaaaagtcccagtctgtctttaaaggagtggatttgcataaaatcaagatttcaggaaatggtatacttgatttaatgttgccaagaaagtaatgaccagcacaatcaataagtaagtttcttgaattaacaccaccaagagatttcaaaatttatgatataggtaaacacatcatttgaaagtaaatacaggaaaactttgatttatttattcagtgaatacattaataatcagaataaacaataacgataatttagttcactaattaaaaattttgccctagaacattttatgtgattcaaatattacaacaaagctacattactttcatgagcaaatagaatgtttaaactacttgggcaaataaaataaagtaaaaatgagaaaagaaaagagaaaatggcaaaaaagcaagaaataaaaacgttaggaagggaggaggaacagaatggaagaaatgtcatctctctgaattttaactgccttgtaaaataattctcaacaagaaatgtagtctgtgtagtctaatagattgataacaaagaatttttttaataacatgaaaatgtaaattatttttagaatgttatcaattaaatttaccctctgggatttggtacactcatcctcagtcttagtctctaattaaagggaaaataattataatcgatactacctctgactatgacatggaaaatttgtcaaatataattcagatcgttacatttgctatggtgtatgatgagtacaatgaattttttctctttttgcctaccactaaaatatgcattcttctttcacccttccatcaattgtgtgacctttgttcaatgtagcacactgatgggcttgggtgatgtttattaaaaatgcagcacaccaacatggcacatgtatacatatgtaacaaacctgcacgttgtgcacatgtaccctcaaacttaaaataaatataataaaaaaaacgagctgggtgtgctggtgcatgcctataatccccgctatttgggaggctgaggcaggagaattgtttgaatctgggaggtgagtgttgcagtgagctgagattgcaccactgcactccagcctggatgacagagtgagactccatctcaaaaaaaaaaaaaaaaatagaaattttaatatataacctactgagttagaactcatttcctaataataccaaccaaacttaatgacattcaccagaaatgtctgaagaaaaaaacatgtattagatttagataatatagctttggaatcagacataactgaattttagacaatactggttcaggcagtctttcaaaaatgaatcttgagcaaattacttgatctctttaaactttagatgtcttatttttaaaattgagggagaagtatgactaatctaaactttattattattacgcataatattcatagttgcatttaatttggaggaacatagatatttccttcagtggactacaaccctgtaaatattcttaagaaattacagtaaaagaaaaacacacagcacaaactattctactagggagatgtatatggataaatcttgaaatatgttatccatcactttcgttttatgtatgtggaaattaaggccaagaagaaatcttccgtattttgcccaactagatatggcactgacagaatttgaaacaaacttcttagtccaggtttctttattgactcctgtaattcctttcacccagttttaagagcaatttgatgattatgaagccaactctttgccctacggagtgattcaactgacctggctgaatagtaggttttccttctttctttgctactttatgtgtgtacagtagtaagaattgacttcccaaattgatgaggattgttctttggtaaaaaaaagaacagtaataatcaagtatttttatatttttacatcattcaaaaatatgctatggacaatttgaatccaagaaaaaatagatttaaatatcttatgtctactaggacagaggatatgaataaaaaagcaaaaataatatggtgtggtaagtcataaattccttagcacataaacaggagttaaagaaaaaattataaagaagctcatgacagagcaattgttaatattttggaaatatctggaaggatttttctaaaagatgtaaggtatacattttaattggtcaagaaatattgttgtctgtgtttcattatatgtacagcacagtagtatgcactatgaagaattaataaaatcaagttcttttactcagatacgtgatattaattctttaaaattatgttttttattatttaatctattatttcttctttctatattattgcttataattcaaatagtggactagagtttgttttaaagtgtattttataacaatgaaacaacaaatggcaaaaccattaaaatcttcaatcgagttgtatattctctttgtagatatatttcctagtacatatatatgtataaacagtatatactatatgtactatatatatgacattatactatatactgtcatagtatatactatatataatatagtatctgtactttataatatatatgaatatatgatatataatatatcatgaatatgtattcatattatgaataatatgtcatatattataaagtacttatactatatatgtcatatattataaagtacatacactatatatgtcatatatgtgctatataatgtatataatgtcataaatatatgcaaacacatatttttctttatgtaacacttttcacaaatattatgccatcatttttttttcaggcaaaaatgagattccaagagacttgctcaatgttgtgaaataataaatgagaaacaggacaagagaccagagtcatctaataaatcttattcactattcaatgtcttttattttctctcttcataaatatgattataaatagttgaaaggattacaatcatttaacaatatcaaataaactacctataaatttgatccttctttttaaagatttggatatttctctgattcctctggaaattgcaaactaagtctacttagaaattaaatattatgttttactgaaattcctaactttaataatccaggccccttttaaacaaatgaattgatatgttattaatcttatatttcacatcataatgctcatttctagagctcgtgcatttcctagatttgctaatagttgagttataaaggcttaattgaaaaggtacaaaaaatattttaaaaccctgatcaaaacctagaaaagatgttttatcctcgaaatataaaatatacacaaaatagtttgtgatgtaagcacaatattttattcttcaaatttattttaagaatcataagatgtttgcaccttatgcaaacgttattgataacattaacatttttataaatcacttcactatgaatgaatgccagtaaaaattaaagtgcaaagttttaactcaaaatataaagcttcctgcataattttaatgcttgaaagttaaataagctagagaaaataaacttcagccattatgaaaagcacttttgacattcatgtcaacgagacttaagtcagcatgtctcttctgatagtgcaatttgctttcctctatattgtcgattataattccactttcctgctaagtccatacaattagattactacagggacttcattacagccacagggaggacagcagctgaggtacacaattttcttcctatgatgccagcaatagtaaacagttattggaacaattgtctacaaaggagcaataaaagctgctgcattaaatattgttgtgtcattatatcatctcccaaaatatagcaaagacttgaaaaatgtcaatgccaggaaaattttgcttttcccacttgtctgttttgctaagtttcctataaatcagttgtttttcatttgttcatttaaacataattcagactacacattatctccaggccttagattcctagttttaaaatgaggggagtgaagaatttataaatatttgatgtctctccaaataaatcttcaacaatgaagaataatgatacattcttctgtattagattgctgcttgctcataacaatataaatttcagagctaaagtttacatcttattgtcatatagtccaatgtattttctactgtcattgctttaaagtatacatgctatatttcatattcaggattctattttcaattggcattctaatgtaattctttcttaattttacaaagtttatctcttccaagtttttatgctcaattttttttcatcagccttggtatatctcatgcatattattgagtcttaaaacacctagcatattttattactttccttattcaaaaaaaaaatctgtaaaaccaaacaaaaaaacaaacttttaagcaaaacaaatcagattaatagtaataaaatttcttttaccaatattccatgacacttttagtggaaaaatttcattttatgtgacattaacatctaactaaattttactgagtggttattagtggttgggcattgagatcagagattgcaaaactactgaaggaaatcagagtggctcttagcagtgttcagagtttaatcagacagactagaagacaaacaattacagtacagggcaaaaagcatcacataatgtttcttagctcactggtatgaatccatttgtctttagatatttcagacatcagtttctctactgtgtgaaactaccgcaattgttggtttctgttgtctctgacttagtgcctttacattggtactgaattatcattgtcaaataatatcaaccacacctgccctggtgtggtcaggtgaataatgcacctcctcacccccaaagatgtccagattccaatgcctagaacctatgaacatgttactttacatggtaacagggactctgtagatgtgaataaattagatatcttgatagagtttatcctggatcatcacaaagctccgttgtaaaaggaagcaagagaatccgttggtagcagcagatagacaatgatgagagaagcaagtggttggagggatttgaggaaaaggctactaaccaagaaatgtaggctgactttagaagctgaaaaaggacatggattctccccttgaccctccagcagacacagaacttctggcgtcttgattttagatgtctgatctccagaacggtaacagaatagatctgttttaagtcactaagtttgtagtaatttgttttagcggcaatgggaaacaaacacacctgctttccaagaaaattttaattaaaatattttctttgattctcatgtcacaggtattaattttcagtttggaaaggatggcgacagtggtgaaggtgtaagtgtttccaaaatattaggaagccttgtatgtgaaagaaagaaaatctacacaatgtaaatgaaaaataattattaaacaaaatcaaaaaataacaaaaccaactatacattagaacatattacatattgaaacattttacattggattgaattttatccctagactgcttccctaagggaatagactgaatttggttgaaagggtacttatttgagaagtcagcagttttcagacttgggtgtgtatcagaatcacctagggaactttttaatatacaaatggctagggcaggtgccgtggctcatgcctataatccccgcactttgggaggccgagattggtggatcacttgaggtcaggagttcgagagcagtctggcccacatggtgaaaccctgcttcttctaaaaatacaaaaattagccaggcgtggtggcacacgcctgtggaccccactactcaggaggctgacgtgggagaattgcttcagcccgggaggtggaggttacagtgagtcgagattaggctattgcactccagcctgggcaacagagcaagactccatctcaaaaaataaataaataaataaataaataaataaataaataaataaataaataaaataaaacaaaatacaaatggctgaaccccgcctcccaagtttgacttgacagccaaggatttgcatctttatcaagtttggggatgatgttgatgctactggtccaggtacctaaccttaggaaacactgatgtagcattaaaaaaaaacatgaaaactggaagatctgggttcatataatatttctgtcactttctaactatgtaataccttaacttcagtgattttcagttttctttctgcccaatctcacaattccactgggaggatcaaacaagaaaatataattcccgtggactataaagccatataaaagcatggtgatgatgcataattaatagaagcaagcagtttatgtctatggtcatgttatttgatactctggatagttttctcctaattgatgtatttatttgcgacttttcaggcactctaaaagggcatgggttacttttcaaattaaaaataaaatatgaataactgtctgtgcgttgggggtgtcttgcatatgtgtgtgcttgtgtgtgtaaatactattacgtgaattctagtaattcagtgtttcctgattaaagagactatgcaatgttatgacgtaagacgttttccttaaaaatttttttaccaacaattacatattattttctgtgtctctattacagagacactgttatattgctgtaagtcacttttgataactcaatagagacttggcaaggagaaaaggagaaatttccatatcctaattagtaaagcctttgttatatattttatatttttttctgtagtaaaatacttcgtctaatactttttgaattatagaaatggctttacttatttctatactgtttcctaatttgttatcacctcaaaattgtattaacatcaataatgatgacaaatgaaactggaattagttctaccctttcaagtgtccccctagactatttttctcctggagaaccactgtcatccactactctttatgtaaagcccttcaggcaagattaaatacaagtcatttcaaaataacagtatttttttggaaaacatattaaatatttcctcaatgtcaagatgcacccacatctggtaagttaccaaaacaagtgcatatgtatctgtgtctttgtgtttgtactcacatatatataaatgcctaacatgcacaaacacacacacacacacacacacacacacacacacacacacaccatgtactgatgggtggctggaaagagaaaaggaacggattcataggcagaactataacaacacaacatgtcaggcagatagaacagtggactgaagttccgtggctgctgtcagattcctcagaactcctactagcagctggctaaccttgaactaattcccagtttgttttgcatcctcatctcccttccctccttttatgagggcatcaaaatgcttcacgtctaaaactcttccacctttaacatcctctgccctgtccttggtagaatgccttcagggaaaaaaataaattaaacaacaaattctttccataatagcttacagggaaaacacgggtgctgccttattgagtggaaaatttaattgttctgacaattgtcgcatttttaagaatgcagctgtgtcatgtgaacacagacaatttcctggactctatgtcagtttaactgaagaaaaaaaaatgttaggttgtccaatgtgttggaaaaataacagacctatttaaaatggatggaaaatgcatgtttaagaagacactacagaaacaggcagctgttggtcctctaactcatcagtttacacggttaaataatgagaggaataaaacctgccaccgtcagatagatggactttgaatcctccagacaggttgtggtctttatctcacttagtatctgtcacaatgatgagtgagaatatactctgcagtatttgtaggcctttcattttgaatgaattgatagccccagatgcaaccctttatgactgtcttcaggcaaaatattttacaaagcttctccaattaggttatggcaaaactagaaggttgtgcactaactgaattttgcctagtatataggataataataccatagatgatgtctcagagcaaatatgaaggaagacatgaatgacttgaatcttaaaatatttgatgaacgacaatttatcactcggcaataaaaatcatttaaacatttaatgaggataattagcattttgacataccagatctgtatttaaattttcataaacaatttcatatggtttaaataataataaaaggttatagaaatgtcttaataataaaatatttattttttctttttttgctctgtgaattgaaccaagatttccttggactacagtaattgcagcaatttcaaaaacactgaatgattagtttagaatatcgtccatgtgggagacacaccagggtctctcacggggtgggggaaggggagggagagcattaggacaaatacctaaatcatgtggggcttaaaacctagatgatgcgttgacaggtgcagcaaaccaccatggcacatgtatacctatgtaacaaacctgcacattttgcacatgtatcctggaaattagagtaaaataaaaaataataaagaaacagaatttttttaagaaaagaatatattccatgtgtttctgttaaaaataaataactgaaaacaaacaaacaaacaaacagcaacaaaaaaacaacctgtcatcaacctttggggaaccctgaaatctaagtaatggtataagactagaaaattgtgaacaactcataacttcctcaaaacgcctgaggtagtttagtaggcagcattttcaaaagttaaactagaagcaactatgaactgccattcttagacattcttagatagtttcaactattgttagaatacgttaaaatattttaaatcaaaaaagctgcaattgccttctcctaacaaaacctggctttattgaagcagctgctagtttatttcttcaaccaatatattcagtaagcagtcttaaaggaaactttggtgtgtggcactatgtgaagtcctatatggagggcatacaaaagtcaaggacttttaagttagaatgggagagaaaaagtacttaggtagcattcagtgctttcaatagtaataaaacataagataatttataaatagattattatagacacaagtctcttttcaggaaaaccgtccaggaaaatgcaatattcattcctttttttgtttgtttgttttgaaatggagtttcactctttttggccaggctggagtgcagtggcaggatcttggctcactgcaacctccgccttctgggttcaagtgatactccctttctccctgcctcagcctctagagtagctgggattacaggcatgtgccaccatgcccggctaattttgtatttttagtagtaatggggttttaccatgttggccaggctggtctcgaactcctgacttcaggtgatccacctgccttggcctcccaaagtgctgggattacaggtgtgagccactgcacctggcctcacttctttttatttctctttctctcccacaagttgactcaaccatgagcaccacaatgtataacagtagaactgtacagtcatgttttctgttctctagctttgtccctaaagagtaaatatacaaaacctattccttttgctacaaccatctcaatatttatattattttcacgtattcttcattgcaaataatgttttgaaaaatacatatgaacaaaaatctttgaaccactgatgttttaggagaaattattggagttagagcaaaaattatgagtatacttattttttctatatatgactacattggtttttaaaaatgtgcaatggccacctcagataaaatgattatttctttacacttggaagaaggttgagaattatcatttttaatgttttggtaattttataatttttatttcatttcaagtggggcattttttttcatttatttattaacaatgtacatggcctctttgagtatctcaatcaatctaattatatttgaatttaatgttttcttgcgagtttgcatatgtcgttgtatacattctttatatattgtttaccaacatttagtcatatttgttacaaatatcttcctaattgccggttcccttctaattttatgtctttatgttttcaggaaaaattttgtttgtgtgtatatatacatgtagtagagatggggttttatcatctctctctctctatatatatacacaaacacatagttttatatatatacatagcttttttttttcctagacaggggtccactctgtagccaggctggagtgcagtggtgcaatcgtcagctcactgcagactcgacccccccgggctcaagtgatttcccacttgagtctcccaaataacttggactataggtgggccatcacacccggctaatttttttttgtaatttttgtagagatatgtttttgccaagtagcccaggcttatctcaaatttctgggcttaagcaatcgcctgacttggcctcccaacatgctgagattacaggtatgaggcagtgtaccagccaaaaagatatttaaaaatattagacactcctatctttccattgcaatcatttagggaactccaggcaatactccctcccatgatttagattttagtattaaccttgttttgtctttttatttttcttcatcagatgctcaattaatttttgatcatttcaatatccacataatgtttaaaatacccggacatctcagattctaaacctcctctcctccaatgatattgtggtcttccctaccttattcattcaacagcatgatcatatgcaaaactgtttcatcaacaacatcttcatctccgtacatcaatttcagacattcttcctttgacctctgtctcttatctcttaaactactactcagaaaattttctaaggttctattccaaggattcaaccagcactcccactatttcctcaaatccctccttacctatttttgatgcaatgtctatcattataatcagtaccttgtatacattttaaagtccttcgtcctacccttgctttttttgtattcacttgtcaaaaccacctctacactgaaatcaaattctctcacctactcagcacatacattctcaggtaaatgtggaaagtcacacagccactctgactggtctcccattaatttcacaagtgtaaatgtcactgtggcttttaatctctttatctttctctagtcaatttacccttctactcagctactcatgctggtttctctcttctctaatatctagccccttcttgttctcctgggagaaaactgaataaggctggaaaatggcttctcatctttcccttcactaaatctgaagacgcatattcatctatacccataaattctgcctttcttttcctaataaatgaacacgtgtccctctctaaaacaaactcctctactctttctttttactaaagctctgacattagtcctcatttctgaatcataagttgttccctctcttcagagaatctcctagcattttataaacatgcaatatatttttccatcatacaaacaaaagacccttgactccacactctttacattatcttcagtggctgccttatttcttcacatcacttcataggaaataaaaataaaataaaataaaaatggaaaaaaatctcttcaaataattatttttgtagccttcacattttctttcaaacttcattcctatgaggtctttatcctcagcaaggaagcaaagctattcaaaagtcatcaataattaattacaaaacctcattttatcccatctagtagtagcatttaacccagctgattataaattccttcttccatggtttctttacttggacttctgggcaccacactctcttggatcttattctgcctccctgccttgtcttcttcatatctgttatgcattttctgcattcacccaggctctactcccttgagtgcccttggactcaattcctgtgcatttctccatctatttcctttaacggcatctatatactgatgactcagaagggtaaatctccagatattcctctgaaatctgggatctatcatctctacttggatgagttgtgtactccacatcctcactggaatctcctcctgcagagattattctacacagaggggagaggactggaatctttaccctgacattacttagtcattagttaagggctctctcagtgcgggagagtcaaacctcccaggcagttacgaaaatatggattcctattagccaagcacaattctccacaggaggatgcaggtataatccattagcagacaacaggtgctgcacccaggaataaatgcatttgctgataaaggttatcacagcacataccgcactctgattcagcctgtgatggctgtgtcatgatttcaactaaaaaaaatatacacatgcatcattttaaattaaaggtatccttgtactattttagtatttaagtataaagttttaaaaaagaataaaattaactccattgttgtacttaatacaaattaaatcaatagtagaacccaccactttacttagaaaacattaaaatagacctcaagccttctgatatttttttttttgatcaacttaacctcaaagtaatcttgattctgaatcggagatgactttttccatacatttccttatacttttaatgcatatgtctctataatccctaaaatatatgttttatgcattttataatatattttatacattttatataagtataaaattatataaatattctatacattatataaaattgatcatactgtatatatccctttacaacttgattatttttctgctaatattatttggtaggttcaataacattttacatgcagctataatttattcatttcactgctaattctattggtgattaaatcataatgtatacattcaatatttttgacggacaggtagcttgtttttatttctttcctagtataaaaagtgattgattagacattccagtccacagtttcttctgtacataaataagctgttctctaaggtttatatcaagagagtacagttttaggtgaaagggtaggtttaaatgttattaaaatacaataaatggaagaatacagttagtttcttgaagttggttccttttttttcaaaaatcatgaaaataaatattcaaaagaatgactgtaaagttgatcttttggacaatttatgtgttttatatgttcggagacaggagctgattttcttccctgaacctgttctaatacgtagagcatacaagttggtagttggtatttgattgtttacaaaatctgtacacaatcctcactgggattatctttccttattggtagcagaaagtttttcttttcctcaatgtggcagatgtgagaacatctataaggatacatttcagtgctgcattagtgaaaactggaaaactggcatttcttttttgttccaagttgtattctagaatatttatgtacatccctttaattaatccttaaaaccttatgatgtggtgccgggcgcggtggctcacgcctgtaatcccagcactttgggtggccgaggcgggcggatcacgaggtcaggagatcgagaccatccgggctaacacggtgaaaccccgtctctactgaaaacacaaaaaattagccgggcctggtggcgggcgcctgtagtcccagctactcgggaggctgaggcaggagaatggcatgaacccgggaggcggagcttgcagtgagccgagattgcgccactgcactccagcctgggcgacagagcgagtctccgtctgaaaaaaataaaataaaataataaaataaaataaaaaagtatgatgtggatatatggtaatttttctgcttcagagcttcagagaaaatattatccctaggtcatacagctggggttttaaaaaaattctcaattttaaccaacatttacctcaaaacaccgtaggaatttgagttgtatttatgacagtgaggtaaacttggtttaatgaataatgcacatgtcacccaggcatggtggctcgcacctgtaattccaggaggtaggaattactggggaggtaattgggaggccgaggtgggaagaattacctgggaggtaattgggaggctgaggtgggaggattgcttgaacccaggagttcaaggccagcctgggcaacatagtgagatcctctctctagtgaaaaaactaattaattaattaaattaattttaaaaattaatgcacatatcaatgaatagcctaaataattcacataggttttgtgtattaaaatatcatctgtctttcaattcttctttgaagccaatctctataccttagctgatattttcctttctctatgcttctctggcagcattttatatcctgttattctatactgtcgttgtctgttataactgagtataatatccctcactggaatttaagcatttgagagtaataaccttaaactatgcatatatggcatcttctaatcaccacctctcagctgaaaggactgtgcttcataggcagagacttagggaatcagagtgtaaaggaagtaacactatcaactaaggaaatggagatttgataagcaagccatgattgtcacagggtattgggaaatcatacactaggcatgccgaagtagaatcagcagggaaaaaaagccatgcttaatctaggaaaacattcaggcatggcttcagagacactaggaggattctagtaggggacttgacatacgccgggggcaacccattgtgaaggagctaggtggcctgggagtgcattctcaggctatgagatactgccacatataggtcaacctaaaccttcgttcttgaagaccactagctttggaaataaacggcttttttgatctagaaaaaggccttgaaaattaaagtcactcagcaacgttagacattgaaaattaaaagtaactcaattcaaacttttcattttataatcaggaaaactgaactgaaaacaatatatcagttaagtcatttgagcatgtctcacagcaaatgattgttgaaaaaaggctattcaaaatgctaggatatggttgttatctatataaagattttctatgcctttcatctaaaaaacaacttttaactttattaagataccaccaagaagcttaggtaccgaaagatgtaaaagaaagaaacttcaagtatcttcaaactaacagcattttataaatagtgatattttaaacaagatcatgataaaggttttagggtttttttaaaataaaaatttaaactttcatataagtttatatggtgagatagaaagacccacaaatgcaatttagatatgattgattaatttttcttgacactttcactgatagcagttatctgttgttgttaatttttcacaggctttcaagtaaaataaagttgctgctttctcccaaaaaattataccctgttacatgatttagtttcctgagatcgggacccttgtcctgtctttgttttgcactcctcagaaaagcatgcaatagttgactacattgctaagtattcaaaaacaatatgatgaaattatttagttatgcttgacccgctgatcttgttttcaaactaagattccatagcgacatatctcacactgttactatgtgaaaaaaatagcaaactgccctaaaagtaattcaacatccttaacaattcatcccaactaaagctcaacaatcatattttttgttccccgagaaattatctattgtgactgtttatataaaatatactactctcatttgttactctattttaacatgaaaaaacacttatcaaaaatgctactgtaatgtacggatgccacttcctgtataagcaaggtacaaatagacttatagaagaggcttcttcttatagaagaagaagaatgaaaaatcacttgcatttcaccaccaacttcaattgatcgtcagtaactgcctggagagttctttctttgagagaaattgtgaggcctagtgtaagctcaccaggaaagtatgccaagatcaattattgatgtctgccatgggcatataggagaatggggtgacaatctataagccatgattttttttttatctgtgcactagagcttgaaatatgtattcattttaattattgagacataggcatactcttggtagatgagtgtcatatcaggtacaataaactctaacaatgtacactgacttttagaaggcttgtttactacatgttgcaatgaggtgataattgccctataaaaggattatcattcctccaagatatgactgtcaaagtaatagaatgccacagctcatagtattgtttccagtattaacccattataaacgcagactgctctaagtctttcagaaaattttaaaaaatagccagagagaattgttacttttacttaaatatattttgatgtgactgctgatatcaaagaagaaatagtccatggaaattcaagtcactgttagacaccacagcgttatactgcctccttatattggaataagaagacttacttttgatctccaaatagacctttcagtaacagttactacagagattaaattaatgaatgacaaatttcaaagtgctctatttgcaacatggaaatattaattgatgttatatgaccatttactgtctgcttttacattcagtcttgctctgtggtattgaacctaatctcagtaatttgagtccattatttgtttctaactaatctcttaatttggggctacatcctggctcccgttaatttgttaaaagggttcagcagaagaatattcagctacttgcctcgaaaaatgactccttgaaacgtaaaattcaaaagtaacaagcaaacagtgactccattaaaaattacgtctagtacattctttttttacttttaaaaatctttttaaagtttttttttaagttttgtgggtgcatagtgagtgtatatatttatggggtacgtgagatattatgattcaggcatacaaagtgtagcaatcatattagggcaaattgggtatctatcatctcaagcatttatcctttgtgttaccaacaatcgaattacactcttttagttactttaaaaatgtgcatttaaattagtattgactatagccaccctgttatgctatcaaatactagatcttttaatctttttctatttttttgtacccattaaccacccactccccaagcccctccatgcccactaccctgcccagcgtctagcaaccaacattctagtctctatctccctaagttcaattaatttttaggttccacaaattggtacattctagaatttcactcatcatgtttactatgaaagggaaaccatcacagagagtgttgacttcacttcttatttgcagatatagttactgtttcattagaaactgtgtaatgtgatcattttgagaaaaaacagtcaagatttaggtgaacagaaaacatactggaatcttatgtagcaaataaaaaggaataactgaacagatgagggaatgagatggctctttgtgctggaatgaaaagatgaagtatctgttgcctcctagttctatgatattttattccctttatatataattaaataatggcagtttctataaactctctaataatatgccaaaaactgataatcattctgtatacctttctctatgtaagcaccatatctaatttatctataagtcttgccgattacacctttaaaatataacactaatatatccatatttctccaacttttctattaccaccgaggaacaatgtatagccatgacttcactaatgctaaaatagtctttttattagccatctcctccctcttgtacatattgccccatgacctccaatccattccttatcttacagataatttgatttgcctttaacatacatgtatatatgattatgccactttcttgcttcatattcactaatagctttctgttacactccttatttggttcctaaacctcctcaactcaataccacaagttctagccacaatggctttgtaattagttcctcaacaacacaaaacttgatcttggtgcaagatcaaaactcttagtgcaattctcactatgtattaagttgttgttgagaacttctcagcattctggcttcttctcattactctccgtcttctggtatccacctaaatggcaggaatcatatgactatatcaaccaaatcagtccctttgtcccttccccccatcatagtagcctgtttcatttgtcatatcattctttgagaaactgcaattaaataggtttactgttttcccttactagactaacattctgaaatgaaaagtccacaggtattttgttcaccacagtacatgaagtatacagcaaaatccctggcacatggttagtgttaaatgtctttttatggaggaatgaataagaagaaatgctatgatgtggtttattttttgttgctgttattgctatctttagtgataatagtggctttttgtttgattctttatgtcaagtttttacagttaagactattaagtattagagatatgaggtaaattgatcaataagtggaaaatccaggatatagttcactgtgtgaggctaatgttactgcttctactagtacatgatactgttttcatattcatcatataatcaggcagcatactgaaatgagaaaatcactgatccgacagctctggatttaaacaatggctcatctattcattgactgtgcctggtcctcagttttttcatctgtaaaatggggataataacttttatcttgtgaacttactctgaagattgaacaaaaccataaatttatacatacatacaaaacaacagacatatactgaaaattaaataaaatgtagtcttttgtttcccaatggtcatccccatatatttggccttctttctttgccaaattgttaattatccttcagattgtacatttccaatattaatatttttatcactgaattacgatcatcactgcttaaatataacttttatgaatctcttttctaaagtgtctgatggatttcatgccctatactattaatccaattaattaggtaattcaatactagttcatatcctgagttaaaataatctattttcaaacagacatcatttcccttccaatatgttacattgattcttcataacatttatgcaggaaaatttggcagcagctataaaccacatgcactcttgaatgctgcccaaattgacaacaatttcaattaactgtctagactgtgagtgcgagcaaaatgtgcagggtagtgacaattataaaatagagatagaaagtagtattgatctcaactcgtgggatctacacaatcaagaaaagataaatataaagttaaaagtatccagaggaacaaggttttcagctcctctggataattatgttaacactgacagatggaagcacatatatgatctacacctatgtgcccagtgtaatctcattaatatatttgcacagtgttagaagaaggtgttagagtactactcaaaaacaatttttaaaattacagtaaaaatatgttcaggccacttggagtaattgttactgctgtaaaagacaaaaaccagctatttgaaagtttctaatgaataatagaaagattacatgattttcagaatgagaagtaagattacaatgtcactgttaactgtcagcaggaaaagcatatccttactcctatgtcccttgatgacttccagcacaacaatacaaccagaacaaaaagataattacaataaaaaggcactaatggactgctttttaaaaatgaagcgccaaaactctccataaggtggaatgaaaataacatgtgaatacagctttccacaaattcattcaacttacagtgctttatttgaggcttttttttttgtaagtgtggtaaatacaagtgtatttgtttgttttgaattacttgaggctgggtaatttataaagaaaagaggtttctttggctcaccgttctgcaggctgcacaagcatggtaccagcatatgctcagcttctggagaggccacaggatattttactcatggcaaaggggcggggaggcggggggcagatgtgtcatatggcaagagagagagtgagagagagaggaggagatgccaagctcctttaaacaaccagctgtcttgtcaactgagggagtaagaactcactcattaccgtggggaaggcaagaactactaagaattaaataaaactatatttagtctgttgtctttctcaatggtcatcgacatacatttggtgggctggtggaagctgtttgggtcatgggggtggattcctcataaatggcttggtatgggggatccacccccacggcccatacacattctaccaggccccacgtccaacactggagatcacatttcaacgtgagatttggaggggacaaatattcgaaccatatcggcaagtgtatcattttaagcttttgaaaaaaaatgacaaaaaaaaggtccaactttttctaagatcattaatattcttatgtaataataggcttcttaggacaatttagataaaatttgactctggtgatagaagaatacgaaaaaaaccagaataattaattctacctttaaaatttattattatgttgcagagtgtcttcactgctctttcatgtgttttgcagaaaaaagcaatcaaatatttgtttttatgatgaactatttttaaaccttttagttaattatgcatctttttttagggaagataatgtcaagatctcaatggttgtctttagctaaacatagattccctttgagattgtaataacataacaaaattgtattattacttacaaataaatgaaatttttgcctggggttatgtttggtttatttatttccttattaattctttgattcgttattatataacgtcaatgctggtattacaatgaaataaattagtttctctgtggaaaattaccttggaacagaaccaaacaaaagtttccaagtaatctatctgtcaccagatgtctataagtcactttgagattcttgaaaggaagatgttaggcaagtaatataatttcttgaaaaaaagtcttaattaaattagaccttctggcatgatgaaaagtactgcatgaaaaatttaactgaagatagaggtaaattttatcctcaatttatcaacactatatgaggttcagacacatgataaaaatgctgtcatgatattcaacactttgaaaatcaacatttttgacacatcattctaaaagctggaggggaccaagggagagggaaggagatgccaggctccagtcctctgggtacccagaactgaagccagagctaaatttggtacctgagctgataaaggtgctttctaaaagagcagtggtttgtatacatgtctcatttctctttaagtagcacaatagagaaactattcagaaggagaaaaaaaaacagcaggctaatgtgaagcagagttatctatgaccttcttattcttttacaagtgagtatgacagctttgagcaccctaatttgtttaatgagtcagtaaataagctcaaattaaacaaaaataaataaattgaatacattcatatttttgttacaagtctgttcacgagggagatttcaactgctacgatcttatttaaatcaattgatattaattgggggtttaaaaaatttaagtcaatgacctgggccctgctggaaatctttggggaggcaaatttctagctactttgcagagaccagtcttttaagtggggagtaaatttgcaggatggcagaataagtggccccaacctatattacattgttacaagaatcaccttgacctaaagacacttgagaaacagtagatgtaagaagggcatttgagtctcccccttttctccctgaaaacaggagataaactcccatgtgaaagatgccctccctctacaagacaaatgaatcattctttgatggagagtcagaactgagaggattctgcacagactttcttagaataattcttcttctttaagcttccacatataacttacatttcctcaattgcctcctttagtttaacctaactcaaaagcatgtagattctgtcatttatttgggtctcaagaaccctctttatgagggctcttgtgtcacataaaactcatcttaaatgtatgtgcttttctcctattaatctatctgatgtcatcttaattctcagagtcagcttgcacactaagaggacagagataaaattttgcttcccctacagggtgcatagaagtgatgatgatataaggcagaaaatatgtttcataaaatgaaaaaaataagttgcatctgttgtaagacataacacacagacactgcctcaaggagagggaaggctcaaacgtgaaggaattaataggatagttgagtgttcacacagatacttcatcttcagaattgaattgtaaagctaaagaatggaatggaagatacggaaagtcaaatattcagataatatttatggaattgtaacccaatagtttttaccacatgcttccaaaccttcatattaattcttccttttaaaaattacatttcctgttttctttgataggctcagctacttgacttaaatttattttttcataattaaaaaagcaagaatcaagaaagaaatcttttattggaagatagtaaaataataataatcagctggatagagattcatgaattagaattatctaaaatgtctattttcttttctttatgaatatatttctcattttacaatctgtgactcaaaagtgatacttactttgctcttcctcaacactgagtctttcctctatccttttcaaatatctttatatttaatccattaatatgcctatcatttttattccctttgagaaataatcttcactatctcaaatggagagagtaaatgaatatgtgggtctatgtgtgtgtgtgtgaatgtatgaaatagattgtggaattgtttctaggggaaaatgacacttttagagattatggctttctaaaaattgtttctgggaataaagatgtatcagagtggctttaaattccattttatcggtctcagtgctgaaagttatacaaatcaataatcagtaatacataaataaaattaacatgaattaatgaagagtcctccagtaatttagagtgatttattttgtcctttgctggaaaacattttcagtgtaacattccttcaaatgcaaatggaacattattttcttgacagaagccataagcctccaatatagaaaaaattgcagcaaaatttgtgcaagatttttcataaagaaatatttccatatgtagttgaaatcctaatgtgacctatgccacaaaagactggaaacaatacaaatttatattaccgagactgactaataaaatacagtatgtaaacacaatagattgctatgtagtcattaaatgggcagaaaaaaatggttttgatgcaaaagcttgtcactcatgagccattgcagtacatatgctatttgcactgtgtaaaatacaggtaaatatgatatgtaaatattatgtcttaaaaattcttagtaattcttattgctctaggacaaggcatctatttctttaagggaggcattaataagccattaaaaaattatttagcatttgtccttcaaatttggattttgaaaaacattagctatgaaaacgtatgtctttctatgcaaaagtgaggcttttcttttttattttttcctattatgggaaaaggtgttgatatggtttggctctgtgtccccacccaaatctcatctctaattgtaatccccatgtgttgagggagggaactgttgccaggtgattggatcatggggtcagtctcctccatgctgttctcatgatagtgagtgagttctcatgagatctgatgctttacaagtgtttggcatttccctctgtcctctcattctccggctcccttatgaaaaaggtgtttgcttccccttcaccttctgccgtgattgtaagtttcctgtggtttcctcagccataaggaagtgtgagtcaattaagtttcttccctttataacttacccagactcagggaagttctttatagcactgtgagaatggactaatacagaggtttatggaattatagccacaaagcttggattagtcagaacctagattattttcccccaaaggccatagaattgaaagaattcagatatttttatgaggacaggtttctgcttcaaagataacaggaaggagttgtgtttttttgtttttttgttttgttttgttttgttttgtttttttaaaagactctcactctgtagcccaagctggaaggcagtggcaggatctctgctcattgcaacctccacctcccaagctcaaatgattctcctgcctcactgctcaagttgctgggattacaagaacctgccatcacacccagctaattttttgtattttagtagatacggggtttcaccatgttgcccagggtagcctcgaactcctgagctcaggctatccacttgcctcggcctcccaaagtgctgggattacaggcgtgagccaccatgcccaggaaaaagcagattttttaaagaggacaaaaaagcctcctggtctggggaaagaacttaatcatagggataggagagcacaagagggaggctgcaccctgtgccctgcaccccacatgcaccctgcctggcactcagggagagtgaacctgctgggagggtgcatgctgagtgggggccctccatagagccttggaggacctaaatgagaggtcacaacataatttttataatgttttaaatagtatgaaagtttatgatgtaatgtactttgctattccaacctgaaaatatatttcataacataatgtcacctattattttgattttattgaactgaaggaaactagtaagtttatgaacgtacgattggaaccatttttaggtggataattaacaaaagaaatagcaaaataccctagtataatattgtctcttagataaaatctataaatcatgctcttttgggaccatgaaattcaggtaacttgaactgaaatgtattgtataacaacatctaggtgatatactcttgcaaatagtattttgtttcctacttgtataacaagagctgataaattctttcttcctatgctcaatcattaaaaacaaatccttctaaatttcagagcatgcagaatttgcaggggtatacgccattaaatcatgtaaatgatatgcaaactactgttaaaataattgcatcatttttaatatactggaatcatctgcaaattccaaagatttagacataagaattatggagagggttacaggaaagatgtgaggattaaacaggggtttaatgaagttggccactcttttcaaggaatgaaattgagactgaaatggcaaccaattcacattatctacatgctgtcaattgaggttatcaaaaccagtaaaaagtacaaaaaaaaatcaaaatctagcagacgttatcttgccatgaaacaattgagtgatttatagatgacatgacagattgatttttttagaaattaaattcattgacagtttaaactatgtcagtttaggcactgccttcagtgagtacaggccgctcacactcatttgaaagcatactgtgagttaagtaacaaacactagatttaatccttcagattacattacactaaattatgtcatccagaacaatttccctaatgtccgttgctaaattaaatgtgttgtcaagaaactaatgagataaacttgaacctttagaaccgaaaatgaattaaatctccaaaccaacttgaaacactactggatttttaaacagcacagcaaaatataagaaataaaaattgaagaacatatttttccatataattacagtaatgaatataattcccatatcaaccgcctataaatttacacatctcaccctcccaatacagaataaaaaaatgtaaactaaaatttctagcatgaacaaagttctgtatatgcattaacagggtacacatgattgtatttttctatttatctctatatcattttattcagaaaaatatttgtagccttttatctttcaagatatatctattaaagactatttaatactctccttttgtgaatagtagcttgaaccatcaaaattcaaactgcaaatttgtctcaccacctttgattctacttcatttttgagttggtactaccaacagttcatagttggagttagaaaattttttaaaagaagatgactacagagggaaaatgtgtagataaaagagaacaagagactaataagtagtttttgataagtgaagagagttaacataagtggtgggggatacatttgaagcccagagcatctaataaactaagaaaaatgaataataaaatatttgaataaaaaccaaattatatgtaatgttgatgactaaaatgtaaaatgacccaagcatgacatgttttatcactttatatgtatattttatcactttatatatagtgataaatacatatcattttatatatacacatgtacacacatatgtgtgtgtatatatgtgtgtgtgtgtgtatatatatatatgaaagcttgttacaaaaagattaaaagtgaattttgtgaaagtttaacacaatgtaaaaaacatttatagtagacataattatgacagtaaaggagaaacattatgactgtactacatttggacactttctcccataaactgttacattaaataagcaggaggcccttaacctgttgactctgtactttgaattcctacataacaaactgcaatctaacatagtttagttcaaactaagaatatagcaaacagccagatttcagccagttgcaagcaatgcactcatcacaccagccccaaataagggagatgcccagctgtagccactcaggtgatttctcttctgtgctcctgtatctggcccataaaagctcactgctctcactgctgggtggagctctctgaaccccttctgcttctgagtactgcctgattcataaatagttctttgctcaaataaactgtgctaaatttaatttgtctaaagtttttcttttaacaagtatcaagaatatagtaagaaaaaatacactgaaaactttgtacatttctttcacagatgatggatcctaaaagattttaaacatcaccccggaagaacccagtaagaggtatgctacctgggtctttgtcagacaaaattgtaagtattaagttttggggaaatgtccttaaataaagcaatagttataacaagcttgagtactgtttcaaatatgttttatcacaacctagagtaagaaatactctgtacctcgcaacacagaacatttacatatatgtataaatattgaactattacatgtgcaagtgtcaattctgtttcatttcatcccattcaattctatcctgggcctattctctcctatctcattccactttactctattacacttagaataagttctggccacagtccagctcatggattaagtaactcactaatgggtcatgattgtagtatggaaaaccctgggctgggcgcagtggctcaggcctgtaatcccagcactttgggaggctgaggcgggcagatcacgaggtcaagagatcaagaccatcctggctaacacagtgaaacctcatctctactaaaaaatacaaaatttagccgggcgtgggagcgggcgcctctagtcccagctactcgggaggctgaggcaggagaatggcgtgaacccaggaggcggaacttgcagtgagtggagatcgcatcactgcactccaacctgggccacagagcgagactctgtctcaaaaaaaaaaaagaaaaaaagaaaaaccctgaactagactgatgatgcacagatgatcaccattacaatacactaaatataaaaatgatgtaaaattttctctactttggttctctaaagcttaagcttcccgaaagcctataattactctatttttgtatttttactagtaggtttacacagtaaaaaaatgttattttttaacctaaaaaactatataaattagtgttagccatgacagaaaatcatcaaatgtaaattttatatgattcataaaaactacctaaaacatccctgtccaggtgttctccagtttctctttataaataaacttggtgagggagaattcaggcactgagcttatttaaaaagagagaccggaaaattgagtatgttagtcaactgattgtttttcaggacacgtttaatttagactagatataaccagatcccaatttaaaaccttgaaaataacaaataaatgccactgtaaaacacccaaaatagtaaaattcaaattttattgttagcaatttaagatctccataagccttatctttgtctatttttacatgtcctcagcattgtccttaaggaacttaaaaatttagttggaaagttacagcaaaattacctttaggttgttctctgctatttcccagctatataaaatagccatttcttttctgagttttcacattcctttaatataatttgatgtatttgtagtaagaaaaaaggggtaattcagatattaggaagagaaaaaaatcttaatataaaacacaatactatgaaatataggataattgttattactactaaattttgagagaaagaaagaatcagtttaagcttcccttgatggtcttcaattttgttccctaaagcatttctgaaggcaaagaaagtaaaagtaagtattaattattgtcaacatatgtgtttatacttagcatattcatatttattttttcaaatcaaatgtatgatacaacaaaattgaacttacatgtgtgatttgataatatgtgcaacattagggtccctgggaacataaatatgtacactgcctttatgccattttataatgtttagaggattattttactgttcaaaattatcacgtttcatttatctgtacttttattatgtctcattagtcatagctatgatttatttaagctatgtccttggtcagaaaattttatctgccttaaaatgttgagatttataatgccgtcttcagaaatgtattttggcaaaaacccagggcttcttgtttctaagctttgcacagtcctaaccataaatacacttgaaattcagagaacagagaactaaatgtggagtggtaatccagggaaaatgtccagttagggcaatggctttagctgagacgtcaagaaagagtagtatttagctagactgaaatgcaaagagataggaaaacaatagacatggaaataaagtagggtgggaatattataaatccctctgtggttgggaaagatagtgcatgttgaagaagatggaaaagtaagtttttataattttttgtgtgtttatgtgtgtgtgtgtgtgtgtgtgtgtgcctttaaaatggaaaaattacagtcacagatgtggatttatttcactatcacaatacgttaagaggcagataaaatagatattatttccctgttacaactaaaagtcatgaagtccagagacctctttgagtttccatttttctgagaaaaatggaaatagtctattaaatgagagatgaaaagctaacttcatgccttttcatatatccaacagatatttatggagcaaaactatgtgccatgcactattctagatacttagaaaaacttgacaataaaataaccaaaaatatctactttggtgaagcttatattttataacgaaagacataacaaccataattaaaaggtaaatgatatggtatgttatacaaggtctttggaggaaagaaatagagcagaattaatttgggagataggggttgaatagagcccattgcattttaaaacagtttactcaaggcaagccctgtagaaagaacggaattagaactgggactcaaaggagtccatgaagatatttgaagcaaaaacattccagtagccagaaagtccagtatagaggtcctaaggcagaaacaatcctggcatattccaagggcagcaaagatgaccagattgattgtgatgaaaacagggaggcaatactagagaaatacagaaaagtaacaagagtggaaataggtcaggcagcctatgcagtgttttgtactcattcaaaagactttatcttttattcagtaaaaagtagagtcaatgaaggattttaaagagcgggataactctttatgtaggaagttttgtgtaggaagaataaataagagtctgttaaagtaattcaggaaacaaatgatgggtgctcatgaagggtaatagccaccgaggtcatgtgaaatgaacagagtatatgtaataattttaagatggactgaaagcattccttaacaattccgatggggagtaagcagaaaaagagaaaaagataacaccaatatttggcctaagcaaattaacaagaaagtaaggagaggtggaaaagcagttgagctgcagaaaataggaagagaacatgttttatggaaaatcgaagaaatctagttttctcttttagatgtccaagtgaacacatgaacctggagatcaacagggcaatatgttggtatactctatatattagtccattttcacaccgttataaagaactacctgacactgagtaatttataaagaaatccctgggatgcaaggctggttcaacatatgcaaatcaataaacgtaatccagcatataaacagaatcaaagacaaaaagcacatgattatctcaatagatgcagaaaaggcctttgacaaaattcaacaaccttcatgctaaaaactctcaataaattaggtattgatgggatgtatctcaaaataataagagctatctatgacaaacccacagccaatatcatactgaatgggcaaaaactggaagcattccctttgaaaactggcacaagacacggatgccctctctcaccactcctattcaacataatgttggaagttctggccagggcaatcaggcaggaggaaaaaaataaagggtattcaattaggaaaagaagaagtcaaactgtccctgtctgcagatgacatgactgtatatctagaaaaccccactgtctcagcccaaaatctccttaagctgataagcaacttcagcaaagtctcaggatacaaaatcaatgagcaaaaatgacaggcattcttatacaccaagagcagacaaacagagaaccaaatcatgagtgaactcccattcacaattgcttcaaagagaataaaatacctaggaatccaacttacaagggatttgaaggaccttttcaaggagaactacaaaccacgctcaacgaaataaaagaggacacaaacaaatggaaacacattccatgctcatgtacaggaagaatcaatatcgtgaaaatggccatactgcccaaggtaatttatagattcaatgccatcccatcaagctaccaatgcctttcttcacagaattggaaaaaactactttaaagttcatatggaaccaaaaaagggcccgcattgccaagacaatcctaagccaaaagaacaaagtgggaggcatcacactacctgacttcaaactatactacaaggcttcagtaaccaaaacagcatggtactggtaccaaaacagagatatagaccaatggaacagaacagagccctccaaataataccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggtcataggcatggagaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctacttatctgacaaagggctaatatccagaatctacgaagaactcaaaaaaatttatgagaaaaaacaaacaaccccatcaacaagtgggcaaaggatacgaacagacacttctcaaaagaagacatttctgcagccaacagacacatgaaaaaatgctcatcatcacttgccatcagagaaatgcaaatcaaaaccacaatgagataccatctcacaccagttagaacggcgatcattaaaaagtcaggaaacaacaggtgctggaaaggatgtggagaaataggaacacttttacactgttggtgggactgtaaactagttgaaccattgtggaagacagtgtggtggttcctcaaggatctagaattagaaataccatttgacccagccatcccattactgggtatatacccaaaggattataaatcatgctgctgtaaagacacatgcatgcatatgtttattgcagcgctattgacaatagcaaagacttggaaccaaccccaatgtccatcaatgatagattggattaagaaaatgtggcacatatacaccatggaatactatgcagccataaaaatgatgagctcatgtcctttgtagggacatggatgaagctggaaaccatcattctcagcaaactatcacaaggacaaaaaaccaaaaccgcatgttctcactcataggtgggaattgaacaatgagaacacttggacacaggaaggggaacatcacacactggggcctgttgtggggtggggggaggggggagggatagcattaggagatatacctaatgtaaatgacaagttaacgggtgcagcacaccaacatggcacatgtatacatatgtaacaaacctgcacgttgtgcacatgtaccatagaacttaaagtataataaaaaaataaataaaaaataaagattccttgggaagcacaaaaaaaataaaaataaaataaaataaaatacaaactcaaaacaaaaaaagaaaataggtttaattgactcccagttctgcatgcttaacaagaagcatgaccggaacgcctcaagaaaattacaatcatggcagaaggtgaaggggaggcttatacatcttcacaatggagagcaagagactgagagagagtgaagtggggaagtgctacacttttacaccagcagatctcttaaacactcagtcagtatcaggaagacagcatgggggaaacccactcccatgatcccatcacctcccaccagttctctcccctgacaagttgggattacaatttgacctgagatttggttggggacgcagagccaaatcatatagacttctgtctatagactaagtggagtctctcctctgtcatacacttatatctatagaataagtaggatctctccccaaaccatacagacttatggtttggctctgtgtccccgccaagtctatatatctatggcctatttgtgctctacagatacaaattttaagatctaaactattgtataaatgatgtttagagacctaagactagatgaggtcatcagataagtttgtataggtagaaaaaagaagaggtaccaagattcagccctccaatgagaagaggttcatgggagaagctaggaaaggtaacttacattgattaattgatgaatttgcacggaaaccttgagtatgtgttgtcctgacagccaaataaacagaatgtatcaaggaggaggtagtgagtaactgttaaatgtggctgacaagacacctactgagaactgatcattagatgccacaacatgggagccttctatgagtttcttggggtcaggactatgttcttatttgtttctttttcctgtaatctggcccagagtttgaaaaatgtgaggtctgattccaagtgtgatattcttcaattctctagctgagagtgttaccagcatccagagaagcccaattaattagactacacaaaatttaaataacaaaaaacaagaactagatgtcacctgaaagagtgttgctgtttatgatttttcatcttcttttattcttgtttgttttgaaaataaaatgtttactcattcaagatgttttagaagccagcttaaaaagtgattagaaaataatttaggttactgctcaaagctagcaagtgccttgggtgacacattaaggatgacacaatgacattaagtgagaatggtgtaaaaattgtatatgaggaaaccagaagactaagggtgccaataataaatcaaaataaatttcactgatgttattagtggcttccagttatttttgaaattcaaaatatagttagttcaataaaatgacaattcattttttaatatcagtaacctgggtggagaactgaataaaagcaggtaatgccctaaagctcctcctttgttcaagcaaaactccatgtatctattgatattttcagtagcagagatgaaagaacatgtctgtagtgaaaaggtcctggcttttctgataccttggagggcagaattctctccaggaacataccaaaacaagcaccaccctcatgggtctaattagaaaacaattcagtcgctttgaacttatcagtgtattaccatgaagtattttttaagatttaaaagcacatatacatcggaaggcataataacgaaataaccaatcaagatgaatataacaccaatgcaaagaaaagttagaaattcaaatcaagcttgcaaaacaaattaagtagcaggaaagcaacattcataacacattagtttgcaccaaaacaaaattaataaagagaaagtgcataaatagtacttgaatatttttgtaattaaaaggaacatctctttgcgtgaagcaaaaagcatccagagaagcaggcaagcatcccgctgttgaacacataacaagagaagaggcagacatctctgacctctgttgtttttctggataataggaaaaattaatatatcccgtgaaaaggacaggaggggaaaaaattacttcatgtgtttgtaggcagagacttcaaatttttattcaaaatctattattaatctttccttttattaggatcttagctagaggttacattttccaggtttctttgtagcttcaagtggccaatgagttatgaacaaaagtaagtaatgtttataatttttaaccccttttccttgaggaagctgcttgtctttcatgcattttccgcctccctgcagttgagatgtcaccggggtgctgggagacagatttctcatgtagaaagtcaataatttagaccatagctgtgcaacaagatgaaaagaacctgcttctaactagccttctggaacagaacttcttgcccacctggactgtactcaatacccacttctggacttttctgtgagggagaaataaactattttgttaggacactgaaattttgtgttgctttgtgactgtagcttagcgtaaaccctaactgattcaggtataaagtcctaacgtagtttctagcagataaaacacacttttatttgcattttattcaacatctatttaataaacatttactatgtgccgcaatactatttgcctctgtcgtccttaaaagattcaacaagtttaatatatgcatatttaatttctgcagggtcaatgcagacacatgtacagcaatattttcattaatagcttatcatataagatttaacaaagccaaaataaactactgaaggtccctctctgttgaaagccttaggaatcccccaataacaatgtttataatgccaagaaagtgatgtctttatggttctaatgtttcctcggccaacttagttatcatcaaatcaaattttttggcagtttagaaagtaaaattcatcgactttcaaatacatttaccaatagaagagctgaataaagattattaatagggttcattgcagtatataccaagaagcgcaataattttttctatgcatgtccataagagcaaaggaattgtaaagaaacataaatatcactccccaattttattattattatttttttttttttttttttttttttttttttttgagacggagtctcgctctgtcgcccaggctggagtgcagttgtgtgatctcggctcactgaaacctccgcctcccggggtcaagtaattctcctacctcagcctcccaagtaactggcactacagatgtgcgccaccacacccagctaatttttgtatttttagtagagacggggtttcaccatgttggccaggctgctcttgaactcctgacctcaggagatccacccgccatagcctcccaaagtgctgggattacaggcatgagccaccacaccgggctatcactccccaaatttctgacctcaatctttctaaaagtgagggtacacaaaaggtatagatcgtccttgatatttagaattattcttccttagatatggtcattcaccacacatgaatttcttaggtataatcttctgttagtcattttttttaatatttaaaggtagttgttttaatatgtgtcttaataaacatacatgtttcccctgttgtcatcttatttgacagttaaactgataatactgtggttgcaatataatacattgctattgaaatttgctcactgtgttcagtgttccataacttaaagataagttattcttattttagtagcattacaacattttttaacatactacaataaatcttcattaaattgcatattttgaaatctttataactgattactgttttctttccatggatcatctagtgacatttttcagaagcagcttctgttgtgtggccacttggttcaaacgacagtccttttagaaggaaaacagacaaattgtattctcacgtaacttatgatcaagactgcagaatatatattttatgatacattgttttaccatatatatagtgtccttactctcctatgagcattacatggctagactatatggaagggaaaatacagctgagatttcatacctagaggacatttatcaatatctgaacattatttcaaaagtagtgttttgttgttgttgttgtttttgttttgtttattttgtagaagacagggtctcactaggtttcccaggctggtcttgaactcctggaattaagtaattctcccaccttggcctcccaaagtgctgggattaaaggcatgagccagcacacctggctagaagtgaacagtgtaagaattctcccccaagtttgaattctggagtttactatatattccgaccccattagtgacacagatatattacaacttggttcagtaagtttcagatgacattaaaagcagcagaattaccatcaccttaaaaggtcaaatgagaattcatgataatctggactacttggaaaatggattacattaattaatttactaattaatttagacagcaaagtttcatccaaggccaaactccatttgcaaagaaaaaggggcagtcgcatactgtcgctagggcagacatatgaggaatagtggcttttatcctaaaatgctgaatgggagtccacaaaatgtcaaatgattaacataacacagagttatatcttctttgctatctctcagtctttttgttttatatcatttttattttattttatgttctaagatacttgtgcacaatgggcaggtttgttacataggtaaacgtgtgtcatggtggtttgcagcagctaccaacccaccacctaggtattaagccccgcatacatcagctatttgtcctgacgctatccctcccccaaccccctcaacaggctcctgtgtgtgttgttcccctccctgtatccatgtgttcttactgtttagttcccactttctctctcctcctacttttagaaaacactggccttaggtttaatatttgttctttgaacaaatatttgaactttgtctcttctaaattcatctggtgaagttctaaaccctagttcttcagattgtgaacttacttgaaaatggggtcattgcaagtgtaaatatttaagtaaaaattaggtcacactggagtagggtgggcccccactccaacatgactgactggtgtcctcataaaaagatgaaatttgaacatgaagatgaagacacagggaaaatatcatgaaaagattggagcttatgctaccacaagccaaaaaatcagaaaaattgctagcaaattctaaggcagaagcataaaagagatccttcctcacagccctcagaaggaaccaaggctgctgatatcttgaatttacatttctagtcaccagaactgagagaccatcaattctattgcttaatccacttagtttgtggtactttgtgatggtagcaaactaataaactggctcatatttatctgtaggttgagatagcacgatttactgcttcaggatcttataaagatgaaatgaaataatgttcacctcacatggtaaaaaaagcacatgatagttgccttccaaataataggtctcattctcttagctaatctctttaatcttgaacctaacatttggacaataatcttgtaatgccatttagaaaataactgatttacattatgatacaaattgttaatacatttactagtaaaatatgtattctttgaaaattatttatttggaagtgtgcaagttgcacataaactttctactttgatcttggttgtacacgaagacaccacacagaacctttagtttacgtagtacatcttctgtgggtaaaataacaatatatctttgggatatattaacacacaaatatgaaatttgccttcaatttggagggacggatcatcagctcctcaaatccatatatagaatccaggttgagaacatctaatacctaattttcaatgctggatcatttttgatccattgtgtttcttcttccaacgtttttatttacttcagtggattttccactgtcctatcctcacaaagtcttatatttaaagtcctctagcatcataagatagaaagatcctgaaaacattatttaccattttcctactatgtggtaataattcaagaaataatttttagcaatatatggttattcctaattttagatttcagcactttttttcctatgaaatattctcattttaatttctgaatgattgtccttggattaggcgcatcatacacccagctgatctgtataggaaaaacatattcagtctcaatgaattacttcatttttttttgactgcaatcatgaatacgtctgctgacctcaaagtcccattttaggaagctgaaaaggaaaggctctgacgttaacctggatgtctattgacttatttcaggagtattaacatgtttaaatggaaaagccaatgtctagaaactaatataaattaattcctttattgtataattttaagcttcagctacatgtttggaggatgtgaagaatctttgatattagacccacacatcactatgtcccagtttatccctattatattcccagttaagcataggcaggcctcatagacagttcatcttgctggttagaatagtcctaaatgttatgctagaacatgaaattaagattgcaggtttaatgctacattggccatttaatttcacaaaaaaccttttaaaaaatccattaacaaggtgggggttgctgtttgtaccaaattccagcaagtcatctaaaaaagatcccatcttgatcatgaaaaagcttgaacaaaaaataaatattgtatacatctcttaaaatttgtcttgagttttaaaattttaatttacctataaggaaagaaaatattacagctgataacctccctctaatcggattagagcactgtgttctcctgtttcacctagatgtcaggaaactcacaacaaaactcacagctagagaaagcttcttagaaatagaagctagatccaaaaactgtttaaaaaatttgcaaaagtaatcatctcaagacaaacctgctacacccaggcctaccctcaagtcctcaaatatgaaactaaggaagcaataggttccatggattgaaattattgtgttttcaaatgcaagagaggagctcttgtcaaatagctgattaggcaaaatttctattagcaaatgacaagagacaaaacaagacaatgtaaaacaatatttactcgtctaatatcaaactgcttttcattttggttatctcctcataacctaaaaattgaaaatgtctgctttcacatcaaggtcatttatctttcctgtaaatatgcaaacttctgacttaaaataagaaagtatatttaaatctttccttggctacacagcctggaccttttggtgtggttctcataattcctagccacactaaactgaaaatataggtggtgaataaaaaccatctgtacttttgctgttgtgattcaccccatttctgagtcgtaatcaattccaaacttattttcacttaacacaggatgtttgcaaaagaaccagctgtgtttaatttcccttaattgccctacgaaggaaaaagaatttgaccagatttggggaaaaatttaatctatcagtaagattttatttcttatttttgcagaaaattgaagcccctatatccaggtagtcatacctgaagtccatcttcagttgtgcatgttccagatatatggcagccttccaatactttgattacttcactgtagaatggagttactaaaagtttacttcgtgtgatttgcatatcaataaatcacttagcttaatgcccacaaaaagttataggtgatctttttaaaaattgtttttagtgactagtaggtaagattaatgtaaaatacattatctaaataatgtaaaaataaagaataatgaatacaattactgaaataattatttttgcatttataatgtacaaacagatccatcaaaaataactttatttatggagctcctttatacagtcagtagtggtctagattctgtgagggatataaaaagtgcataagatatcgggaagtaaatagtcagcaagaggcttgccatccactgtcctcttagccactggaaagtgacttgttggaatctctatgtatgcatgcaaatgaaagacctctggcaaacacatccatggtatttgtccaaaggtgaatccttgtctatggaatgctttcaatgggatgtgtctggtctatttaggacttttttagggtaaacaaaactgaaatctatgggtttatgagcgtaacaatctggaaaatcatgttaactattaatatgtaaaattgagatgcttcatgactcaaagagctccttttcatataaataatgcagccacatatatctagaatgtccaatctgagttaaagagcatgcttcaagcaaaggcctaaagagtggtgtttgcagttacttgtgatgacttgcattttgaaactgtttctaagtcttgatgctaggtaaaatatctgattattgtgtgctaggtcaaatactttgtattatctcagatatattagggaaaaaaatgtcttttccccattccttgatttccatgaggaaggttttccttaagcattgttagtttcttgcctcatcccttatttacttctccctatgaaagcaaaatgaatctttgcatttgtggggtaacagtatagtatgctcctcatgtgggcatacaaattcatcaaagttatttttcacatgtgttttgattttttttttttggtttctctagtgggaataaatctgcttatgtctgctctgtggaaaaatgcttgcctctagtgggctgttctaagagagaggcttggaggagagagatggcaaaacacttggctctcaggattggctgcgatggagaggatgtggagaaataggaagatttttacactgttggtgagactgtaaactagttcaaccactgtggaagacagtgtggcgattcctcaaggatctagaactagaaataccatttgacccagccatcccattactgggtatacacccaaaggattataaatcatgctgctataaagacacatgcacacgtatgtttattgcggcactattcacaatagcaaagacttggaaccaacccaaatgtccaaaaatgatagactggattaagaaaatgtgacacgtatatgccatggaatactatgcagccataaaaaagatgagttcatgtcctttgtagggacatggatgaagctggaaaccatcattctgagcaaactgtcacaaggacggaaaaccaaacaccacgtgttctcactcataggtgggaattgaacaatgagaacacttggacacaggatggggaacatcagacactggggcctgttgtggggtggggggaggggagagggatagcattaggagatatacctaatgtaaatgacgagttaacggatgcagcacaccaatatggcacatgtatacatatgtaacaaacctgcacgttgtgcacatgtagcctagaacttaaagtataataaaaaaataaaaataaaaataaatttatatgtaataaaaaagaaaggtgatttccatgccccattggcttgctttcctattttcgtaattagttcccaactcaatatgtaagaagagtactattcattgcgccactcgaatctccaacacgttatttaccactgggatcctcctcaggggtgaggagtctgaaccgatcaaacatgaaatggttaagtgatcggctaatgtaaaggtagtgataatacagaacacataggaattctttttttattattattatactttaatgagagcattctctatcaaatagagtaattagtgacgtgctagagttgacttgtacttactcacgagagcctattttgatttctcttccatgttgagtggtgccatgtcgtagcttgaaactggccatagtggaggtatctacaccacagaaattagcaactacttcaagtcatggcttccccttgcccagagataattggtttgaaacatttactacacccatgaatttgacctggcataaatggatatgaataaagtctcagattgaggaaagcagaaagacacttctgatatctaataagtatgtctcccacccacctccttgctggagatactattacagaatactgaaagataaaaacgtaacactgacattgactctcatggtgaggataggctttatctaccattagtattatctcatataaacaataatgtagcagaaggattatagaactgagagttaggaaagatttccacatgtctctaccaccaaacacttgagaggcctttaatacatatgctttattttaaaaagaaacaacttcttagtctcaattaatacactatttgtataatactaagattggaacaaacgttaactgaaacatatcttagtagtaatatttgttgggtaccacataatgtttgttacattattacaatagaaacattttacttttcttgttagtgcttaaattattttattttatttatttatttggagatagggtcttgttctgttgcaggttgaaagagtgcagtggcacaatcacagctcattgctgccttgacctgctgggcttaaatgatcctcccacctcagccacctgaatagctgggactacaggcatgcgccaccatgcctggctaatttttaagatttttttttatagagacaaggtctccctatgttgcccacgcttgtcttgaactcctgagctcatgtgattctcccacatcagcctcccaaagcattaggattacaggcctgagccaccatgcccagacagtgcttacattataatctagtgcattatctaccattattaaaatatgtggatgaatcagaaaatgtatagagagataagctaaataaaaaattatttaaggtagctactatgaggggtttatcatttattaaactgaagcaattcactgctgttattcaacgtatggcttcaacaaaatacactattttgaagaagttgtgaaatgtgtatccctacattgatagatagcactaagaaaaaataaattgaaagaattcatctaaaaacaattcttagttgaatatttactgaatacttttcagatctgtgattaacactttaaatataacaacagactgccatctctttgatgtcttaacacacaattcatctgaaatcaggagattagtccaagtgaaacttgatttgcttttaaaatccaatattctatttctatattgatttaaagtcaaagtaaacgggtcatcctataagataaaggggagaaagttaatacagcattctgcatagaggaaatagaaataaatgaatggataaaggtaaataaaatacatcaataaagttatttaaactatgtaaaaatgatcactatgtaagcaaacagtgattcaataataaatatgaaaactttttgcttgttaataagtgaattatatatatatattattttaaaacaaattttaataatttaatcccaaaataggtagagaagtgattgaattacatgaaatctctatttatacctgtcttgtaactgtcacagcaatggtatttgcaaagtgtttacaacatcatgaatgtttgctgagttaaaatgcattagcatgtcatgaataaatacatattttaacatttgctacctgcataattcatctggcattattctatatgtcttgctgtccttttattctgtatatagacagcacagtttattgggtaagaaattaatttctggagagggacataatgaggtttgaattttagcattctcattattagcactgtgacttcagggaagtcacttgctgccctgatgaaatttagtttcctttctctaaaatagacatagtaatgcataaaatgttcttttgaataagtaacctattacttaacatataacaagcatgaaataagttatttcagcaaaataaatacattcttaagcaaaatcatttattatttattagcaagcattcctttctttctaactagaataaaaagttggcaaataattacaggaactatattttacacaactttctgggtgtagggaaatccactgactacaacaaacagctgtttttatctaattagggaagtcataacagatcttcttacttatttgtatacctctaattttagattagctttattttattttgatctcttaattcaacaagtttagcctccaggcaggtagagcttacagaaatacacaaaatttccattaataataaaagacctgatgctaaaagttaaatctgaaggatgaattaagtagtccagtgttctgaacatttatttaacctcataaacatgctgtgttttgtgctgattttaacattaaacaaacaaaagtttcttaatttttagttataaaggtcaattttcgcagttcagaaatgaatactaacagtccttctgcacttggttgagatccaagactaccagtataaatgattctaatacattttccagaaatcttgacaaagaagacagaatttaagtcaagataatatgtaatttcacattttatataattttcagtttaaagaaaccagctagctattctactgtgatattctatttcagaaaaaaattttttaaagctttgaataagattttattctccacttccaatttttatcaatttgacacagtcagattttcatgagtaataattaatagatttgtgtccatagtatcaaactaaattttgaattggggggaaaacagcattctttgttatttgtttaaaaatgcaaaatttttatccattttaaagggatactggtttcattttctttgtttattttgtattttttttgttctgtgttttttgtgtattttttaaaccacccacactcaacgccacacattttgagtatttggccacttaatatgaattaaaaattttcctaaaaccacagtgtaccaagttattgcagaaaaatactaaaataaaaatcttcttttatgatattagtggaagccttttaaataaatcagattgaacccttacttgagcaaaaccaggtaacttatctacaaaatgactgtacgagaaagatgccttgaaggagtaaaaccactgaggtctccaatttcactggaataccctatggatattaagaggaacctgacaagaatgaaggactctcagacacatacggaaatcacaaaattccataaacttttcctgacttttctaagaacaagaaagaaatatcaaagcctaaaggaataaagaattactttccagataattcagaaaggaattaaatgctgaaaactgacatctgtgaatatcacattttttgagagttatgtatagagaccatccaagtatcataattttattaaaaatatatacatagtaactattgataatattgtttattggtataattgatgcattatgatatttaaatgattctttggaggggtaattaacttttatacataggctttttttagtagtatgtattattatgttgatttatattgaaatagtattataatttaaaaacatatagaaattttatctttaaggctcaagttttgcatatattttaacatcaaacttttcattcaagctattcattcgcagctgtcagtaaattttatgaaagaaaatagatattcgtcataaaccaactcaagtcattctttttctgctttagaaaataaaaaatgtatctccatttccatttacttgctcaatctgttgtctttcttatgaaaagggtcacctttttagccatgagaaatatatccaactgtactggaaatatatccaactatattctcattttagcaatgatctcacttaatctattattcttcaacttataaaataaaaaatctccctaatttatttaatatatttgtgtataaagccaagtgttatgtgacaactacaggggtcctcccttatcagtgctttacttttcatgatttgttacccatggagaaatacactctgaaaatattcagtggaaaattccagaaataattcgtaagttttaaactgagtgctgctctgagtagcaggtaaaatttcacatattctctcttcatcccaacaggacattaatcctcagtttgtccaacatattcatacttagtaaagatggaaaagtgattaaatttctgggtggaagccgtgttccaactgacagcaatgggttcagtactatctgtggtttcaggcatgcacagagggtcttagaacatatccctggatgttaagtgcagactgctatactgtaattgatgctggagatagaatgagagaaaagtagacatatttcctgcttacagaatttacattttacttggggcgttatttaagaaaactgatcattataatgctgccgatatgctgtgagttaatatagtaggtgctgtgttggcacaattaagttctacccaagaaggtttggttaatcaaaagaggcttgcaaaagaagagctgtccaaattaggcctaattattttgacgaaactaacctagtaaaggggcaattgaaatggcatataaaaaaatctagagatgaataaaagcttgaaatgtctgaggacctgcagtaagttcagtgtgggtgcataatagaggatgagaggaaatatactggtagatgaagcggcagacataagctgaattttgttatagagaagctggtagtgatcttaagaattaattatttcacaaaagcaattaggagatgttgaagggttttaaggaggaagataaaatgattccacttcactttagaaagatcacgttaaccacaatatatggaatagattacacaggttcaaaacaagaaaaaacagacaaccagctagtcttactaagctatgaaggcaagagatttacatgaactgactaggaactaaatgtgacgatgaagagaaatgagcaaatttgagacagtgttattaaaagtaagtaaatgaagaggcaatagaaaaatctatcttgtcagaatttttgcttagatgaataggctgtcaataggtttgtgggttgtggataaaagctcaatttagggcattttggtttcaggtgtcattgagacaaccaagcaggaatgtctacttgacggctgatgcaagtatcagaagctcaggaaggaaggcatatatagaaaggtaatatgagtatcacaagtatatgggaagtaacttaaaccttatgactaaatgagattgcatgaatgaatgactataaatgctaaacataaattccagttgagaccatttaaataaatagccttaaaacaaaaacaaaagcgaaagtcattatggaaactcagaagaataaaatactgatggaaatgttttattactaaatctatcaaaccttttaaaatgtttacgttccctgacaatggcagcatttaacattctaggtcattccatttttctgttttccaaaacacgactctcattttagttttctttctacttctggccttcattgcaatctcctattttttttctttttcatacattctggattcgtgtttcactctctccacctatcattttttgctcctttccttaaagaatttctcatacctctgaatttacctacccatatatgtgaaggagtccaaatcttacatcactactctaggactctgctgagttagatttattcagtctgttttctagaccctgtcaaccaaacactctaccagcacttcaattcattatgttctctaaaactgtcctctccttttctattctctattttcatttttttttttaatttcaacttttattttagactcggagtacacgtgcaggtttgttacacgagtaaattgcgtgatgctgcggtttggagcatggatcccatcactcagataatgaacatagtacagaataggcgatttttcaacccacatatctctccctcctacctgcctctagcagtcaccagtatctattgttcccatctttacatccatacgtgctcagtgtttagctcccacttataagtgagaacatgcagtatttgttttttttgttcctgcattaatttgcttaggataatggcatccagctgcgtccatggtgctgcaaaggacatgattccgttcttttttatggctgcataacattccatggtgtacatataccacattttctttatctaacccactgtcaatgagcaccacagttgattttatgtttttgctattgtgaacagtgctgcaaaaaatatgcatgcatgtatctttttggtggaacaatttatgtttctttgagtatatatccagtaatgaaattgcttcactggctggtagctttgttttaagtcctttgagaagtctgcaaactgcttttcacaggggctaatttacattcctaccatcagtgtgtaagtgttctgttttctccacagctttgccagtatctgttatcctttgacattttagtaatagtcatttttgactagtctgaggttatatttcattgtagtttgatttgtatttctctgacgatcagtgacgttgagcattttttcatatgtatgtgggatgtttggatgtcttcattaatatgatctctacttaactagtcaagttgaacaagtcagaatcctgagacatagccaaagattcttacattctgttcccaacttttttcagtttgtcaggatgtcctgctgattttgctacatcaagtttcttagagtctactccgttgcttcatcagtcattacaactgcagagcaggggttcaataaatgctttttgaatgaatgaactaattcctcttctctctgcccctacctgagtttatgctcctcattactccttgctcacaaattggaatacattctcaatgtctcccagtataaataacatttccttaaaattaaagccagtataatttctttaagtctgaatttaatttgttcaatcactttcttaaagtccatcaatatctccttacctcctgcaagacacattataaactccttagcatattgttatctttacccacttttgacagcctggttaaaggctgacccagtaaatcctcttaaaggtttcctagaatgagaatctccttttctcaggactatgaactcctgtagctcctgaggctctgctcagttgttttctcccctgacagatatctcagctcctccacccattgtagagaagtgagcaatcctttattgtgctcctagagattgtaatggttagctaacatttcagtctccctcaggtgcactacattttatgaggataaggattttttggaaacattattttcttttatttcacatttaaaataggcataaaatcatgtgtggcattcatcaaatgctggttcagtaaaagaatgaatacgtcatatgtaaacatttcaaaattcacctgcactaacaataatatccgaaaagtaagataatcatactagaatacgggagatgtatctttagaaataatacactaagaaactggaatcttttttttttttttttgtctttttttgagagggaattttgctctgtcacccaggctggagtgcagtggtgcactcttggctcactgtaaccttgcctcccaggttcaagtgattctcctgtctcagaaaaagtggaatcaactttaatgagagactggaaaagtgctaatcagaaggattctgctgaaagttaggagaggcagcaatccactcttacttaccttaccactaatatattattagtgccttaccactaatatattattcctgagagccatttgagtgctgtcattaaaaatgacttttcctgaagttccctccgttagtaatgagctcataatgtcaaagagcaaaagcttttaagggccatattctttaacaagagggatagattacttcataaagatattaggaattaccaaggggataaatcaaatcactcttaccgcattttctttcttcggaaaatcagtagatttcaaaatataacacagaaagctaatgactcaatagtattcatagttaatatagtcttgggtaatcttgaaggcctcctgatcatgtatctattcatgtatagctaattttcacattttaaaattacttattatccaaaatttaatttaaaagtatgaaagcaatcatgaatactagtctttaaacataaatgtccagagctttatcagaataaaaccgataaggactttgtactggaaaagaagatgattctcatgtgagagacttttttttttcttgatacaggataatttcaaagaaattatgagttaatgtgattccagccagtccaggttggcataatttgttattaaagtcaatcaatatctccctacctcctgcaagatactctctactccttggacacttgatactgtattagaaatgacagacagtagttacttagagcagaaagataaatcccgagatatacttgtcatcaatcacattaagaataaactatacgtatttatgcattagctttaagtttttcttaataaaagtcttctattacaatgataacatatactttaagtgcttttcccctatatttactactttacattaagggaggtttaaatttaaggcaagatattaagaaacagaaaattgggaagaatagtaaaagcaattaaaattgctttatcttccttctggattcatttttcttcttcctgtaaagtgtccttcagaagttccttttctaaaatctgttgctatcgtatctttgcctttgttcttacaaagtttgggtacataattctacattatcagtcaatcacttttagcactttgaagatatcgttatcctgtcttctagttcccattcccattattgctactgtgaagtctactctcagtctaaagattattgttttgtaagcaatcggtccttttctgctgcatttgctctttgaagcctggaattaagattttcctcttcttttttcatcagtttcacaataatgtatcttcgtgaatattcctctgtttttaactttttaattgatatataacatgcaaataaaaagttgataaaccaaaacaccacacatatatatatacacacatatatgtgcaaacatatatataggggtgtgtgtgtgtgtgtgtgtgtgtatatatttgctttgtacttgagttttaacttttacttgaagaatttcctaaagctaaaagataggctgcatcttccaatcctcttagccctcagatagctcatcctctgtccagagacagtcaaagcacatctcatcttttctgatagctggagcccctgcaagttctgaatactctgggtatgagacactaaacagcttcagccatctgcagcatacatcttatttagaatatctggaaatgtggttatgaataactgcaagttgctcttctccctgaaggctataaagttaatgttggtatgaaatcttcctctatcaattcagaaagatggtatgaatttgagaattccattagaaaattataaacaggaaggtatactctgttcccatcttgtccagtggtaataatcaaactaacacttccaaaaagattagagggggtagggatacaaagatccttccaaagactctttccccaaatcatatcaaaattgcttctactgctgtaacaactagtctgtcactacgttttcgctccaggcttagtctattacagctttacttcaaatcagcaaaagcaacaaaacacatacacatatatgtacacatataatatgcacacataaaaattcttgataaagtttcaagatggatgcattattcaagctgcttctcatacagtttatgttttaaagtattttaataaatgtttgtagaaaaaatcgtaacatttgaaataccaggatgtagcaaatagtttgaaataagtcacaattatttcctcaaaaacaattctaggacgctacaagtctcctaatgtcaatcccttgtttaaaacgtttttagagtttccaagccaggagtcttttgctccactttgttcagaggcacagagaaaaacaacatattatatttaaagtaatagccaaatattactcaagtattatttattcacagtctccaaaacacaatctttctcattttaaaatacatgattttctgttgttccctgaaggacatagagtttattgctacaataatcttttctatgagattcagatgacataaattataaacccactttctagcgtatgggctagtaaaactgtagagtttctttcccattcttataatccttgcaattatgggaataaaaactccaagtgagccagctttactgtaattctattctttgcagtggtaggtaatgaaaattagcaaaatagcttagagtgactaagatgatgctgatagtattactttgaaacaaaagctacttacttcctgaacacgtatctctgcagggatgcaaggccttggaaaatgacctacatagtgtcttatcttactgctttacaaaaagtccatgtaccaatggatcattagtttgtacaattcacctggaagtattttactaatggaaaagcaccaggagtctcagagcacagccatacaggccagttaaacatttaagtcatggctaatgagacaactaacgtgaatatttccttgtcctcttttaggatgggaagaaattgggaagagaatcagatgggacaaaatcatttacaaagtaggtgaaataattgtaacaatatcattattatttctattagttctgtttctatagctgttataaaattatataagaactataccatctccttgttaagtcagaaaaagtctaagagatggtcacacccatttttaatatctatagacaaatctctttccttattgatgatttgaaagattctcttcaagtcaagtgttatagagagttactatatgtaaggtaacttactatatgtaagttacaatatgtaaggtatcgaccttacatattggcttcttctaacagcttagtttaacactctcagtgagatgaaaatattttatgtataactctacagggcaaatatttttcttccaaatgctatgttaattttcaatggtagcttcctttcttattgtcaatgctacttttatttaaaaatcaacatatacacaagataactggtcttttttgtaatgtaaatacttaatttgttggtcagatttatagatttttcagttataaagaaataaataatatatatatctaagcaaagtaatacaaaatggcactgactttttgtactgaaacacagcatgatttctcaatttaaaaaagtattggaaagcatagggcaatatgttgcttgaactttataatatttagtacagacggaaatgtaagcttaaaagggtagagatttctgtttcacacctcgatatattgcaaacccctagaaaaatgacctgtgcatagaaggtgctgaatagtattttttaaatgaatatattttgactttgattttcttttctataaagcaaatgtgctatactattgctttcaatgaaatattttcttctccttctacctatacacttcttccaaaagaataaattttaaaacatgaatagcaaaatagatgaaggggaaaaagagtggaaagcaagaaagtatttcctgattggcatcactgaacataggaagtcaactccacctttgaacgctgttgggcttctgtggtggcaatatacacatatatgcatatataatacatgcagacagtgaaatatatatatttcactttctctgtctacctgaaatgtcatctattagagatatatttggattcatgaatattattgttgtaaatgcaagtagctctgaataagaaataatttaaaaatttgcttaattagattattttgttcctaaaattgagacaattagaaggggtagagttttataaacataaattatgtggaatgagcagatgcgaagaaagaaaggtcagggagataagtgaatatttttcaaaaaaaaaaagagaagcttaatccatggcaagacaataaatggatgataatgactccacctccaacctattccctcataactatattgatagataaattatattcaacaggagcatcactaaaagtgttgatgatagaagcattccaaggcactgaaaaatcaaagcttggaaatatctgaaagataaaccaggcctgtcttgcataatatagtatgctttcatttgcttctccttcaaacaagtcacatcctaaattgaaggttgcctctatcatgagtcacagaaaccctcttttcacagcttaacgtgctgaataaattaagataaagttataagtaaccaacagctaagaatagaactgcaatgtataaattaaaaataaatacattataagtcagtgtgaatgaagaaagaccaatacttgtacaattctgtacaattcttaaaaatatattttgtacctggtagtattttacatgtaaggtctatcaaggataacttgaaataagaatgaaaataacttttaagtattatgatctagcatacctatcaatattttcttacctattgtgatggttaatgttatttctccacttggctaggctatggtgcccagttgtttagtcaagcacccatctagatattgctataaaggtatttttttagatgaggtaaacatttaaatctacactttgagtaaagtagattgccctccataaagtgagtagagcttgtacaatcagttgaaggccttaggggcagatgctgaggtttcccaggaaagaagaaattctggatcaaggctgaaatctagaaatcctgctgaccttccagcaagctgccctgcagaattcacactacacactgcaacatcaactcttacccaagtttccagttaccaagcctgcctcatagattttagacttcccagtctttacagttgtgccagccaatttttaaaaaatttatctttgtctctctttatctctccttcaaagtccattaatggttttgtatctctggagatcctgattcgaaaatcaatgagttttgggtcaaggtgtctgtggctcttgaactcttttatttgggggaatgtgttctttttctgtcatgcctctattatggcatgcttcaaaattttaagagaccagccaaaaattaatgaaaatttgcaaaaatatcagaataatctagaaatgcaaatgtacttcttacgtagctaacaaatctagttctacctgttgaatgagattaccaactaattctaagaattagttgatttaagttatggggaaattagtcaaacattttgatgacgaagaccagatttctttctcactgattcagatgccaacctcttgacagaaatataaaatataaagcctttgtgtagttgcataaataaaaaaaaaaagtctccaacgttactcgttagactgtggcctacagtctatctgcaggtggtctcaggtctcatctgagccttaataaatcaaatatttgagaaaaggcttaggaatttttatatttggcaagcatcccagggcataaaagtttgaaaaccattgatctatcatttagttcctaaaaatgtacctgaaatttcaacttaaactataaaatgaggaatggatctctgaatgatttttaaattactctacaaaatttttggctataaaagggttcacaatgacaacttcttcaattttttgatgaaatatttctttcttattgcgaattataccttatgttctaaaaataatcatgattttttaaatttttaccattattataaaattgaagggaaagttttcctttatttttgtaacacatgctggcgtcctctaaaactttttacacagccaattaaaatatttgcaggtttctttatgaccaattagaaaagtatcattgattatatatatatatttatatgtatatatatatatatatggcacatatatgcaataattatgtttattttaaaaatgctgtatattaggaacaaatagacaaaaataaattcctggtatcctcgaagcttggataaacagcatcagattgaaaatgatcttttcctatcttggaacacttataacactattataccccatacgcaccttttcatatttcctaatgaccttatagtccatttacacatacatacacacacacattctgttttaatattgtaaatttttacgtagtaagttaccaaataatatctgttgattgatacactcattaacaatgtaagcaaatgcagacattcacagcaaattttattttctttgcattatgaaagcattgttttactcaattaaactaaattgaagtgttccataatgtacctcatgatattttaattaccttgctttcttcaacctgttctcttactatgcacaactttattctataaaaacgagaaaaattggaaattcagaatctcagaatcttgaacaaattaaagtagcttgtagagatagtttccttttttatttttatttttgaattttaacttttattttagatacagggaatacatatacaggtcagtcacatggttataccgcatgatgctgaggttcagggtacaactgcacccagatactgagcacagtacccacaagtagtttttcagcttactgctcctgactcccccttctctagtagttgccagtatctactgttgccatctttatgtccatgagcacacaatgtttagttcccacttatgagcaagaacatgtggtatttggttttctgttcatgcattaattcacttaggataatggactccagctgcatccatgttgctgcaatgggtgtgatttttttctttttcatggctgcatagtattccatggtgtatatgtactacattttcattatccaacccactgttgatgggcacttaggcacttaggttgagtccgtgttttccttctcatgaatagcgctgtgatgaacatacaagaacatgtctcctttggtaggacaatttattttcttttggatatacatccggtaatagttttgctggattggatggtagttgtgttttaagctctgtgagaaatttctgaacttctttccacagataatagtttcctaacagcataaaatacaagtattttgtctaaaagttggtctttggaaaatactagtagaaatattaaaaaaatgacattacttattaaaaattattttgttcaattgtccatttttttgttcatatattcattcaaaacacttttttttggcaccaataatacaccaggaactgggaagctaaggcaagtaagacagagacccttttctaaggatttttcatttgttatgagagtatttcaaaaataaagaagactttatacttcttttaagactctagctccagctgtctctgggctcacatttcagaaatgaagcctggaaaatttaggtcgtagagcttcctcatggtccataactttaggtggtcttgtggaatatggaaatgaggagacaaaaagaaaggggaagcccattttgtgttaggacttgtactgctgcatactccaatccccccaacatctcccttgcgcagaaacatctagactattttttaagagaaaatgttttagtacagatacaactaatgataaactatatagctctctggactgataaacagaaaaatgagaccacactccttcagcatttaccttctgttataggatatgcataactattcactagcattaaccatgacatcattgctttactgatatatcaaaatattgagaagaaaataggctttattgtacaatataaaaggacatacattagtaaaagttataaataggaagaaaagactaaaagtttatttcactgatctatttagagacctagattaattgcattcatatttctagctgtctaacaaatcgctgtgaatatataaaataaaacatatctatgtaaagtcaccttctccctttctctttctctctccgcaatggtacgagccttcttcatgtgttttagacatggttgtggcataaagatttttaagacatgtaaattattaaattaatattaaaacatagaataaattagtttgttcattctaaatgtgtcattcaaatataaataatctacattttaaatatatatgtaggtatactaaataagtaaatatgtatgttaatatgtttaaagcagggtgagaaacctggacacttcctgtgtgggcaatgacatcaagatgatgctagagaaaccacttcactattttcttcagtgttctcatctgtaagttgaagttattgacagccttacagttctgtgacccttacgacaacatttcattatttaattcttgtttgggtattcctccactatctggggagacagttctatttaaccaaacacccaggcaccagaagcacacctggagtggattctgcaaagaggagccctcatttcccagagggaggtaccctgaacttgactttgaaaatggcttggcagaaggatttgacagggagtgacctaagcaggcaaaaactccaattccacagagcaccacctccttaaaagttaaaagtatattggatgctaaggctaacaatttcaggtacatatttaaaaaatcataataattcaaaataatcaaaaaatattacaaactttaaaacagatagggttagtactatcggtaaccaaggtatctctgtctggctagatgatggatatatttatctttacctcaaatgtttcattctgtagctttgtataagaaacatgctttcttcaaatcaagaaaattcgtactcacacagaaagtggcaagaagtgtttgatgtgtttgagtcatttctctttatttggatcaaacaaacaaaccaaatataatggagcaatatttcactgaatagtatgtttagtacattgtgacatgttaagatgaatatatagttaaaagctataagattaaaggttccaaactggaatacagcaaaaaatgaattccttatgcagcactgggaaatgtttgtcaaagaaaaggttttttgtttttcattttccattatatttaatttctttaaatttctctgataatttattattgttttatttttccataagtgaagaaaattatcaaggtgtgcaagagactcatattatagacggccgagtgtctaggctatttgcatcatagttcagactacataaaaaccaataataaacaaaaaccaataatatctgaatctcaatatttcgagtgattatatttctgccttgtagtgacactttcatcagggtcaagtttggtgttttactgctggcatatattctcagattaagccatctgaaagaataaattgtgtcttatctgggattattggagtttgtagaaatatcttctatctcctccctcatttcaaaacatttatactttttcccccaacagtcataccaactatagtctagctgctgtttgatcatttaaaatcacgtgttacataaatccttttagcaactgactgcgtgttttcaaaagcgtcttctctaagtcttaaggaacatcactggatatttccaaagaggatattagaaaattgctttccaagaactgagaaggaaaagcatcatgtcagacagggctaggtacttatcaaacagtaattgcctcttcttcctttctattgtttcctagattttatttgtgaggtagaaatacgctcactgtgtgcagactcttgagcaactaagtatatccatgacatgcatactttgccaatgagaaataagctgggtgttttccagataatattgcttccctaatatgaagggacaacccatctggcttctggttccctaattcttcctgtttgaaatacagacttaatgcgtggcactgcagcagccaccctgggatcctgaaactaaaagagacagatggcaaagatggaagaacaggtcaacggaaggagcctgtatctgagatagtgtttttgagcaacagcatcaagtttggactgtctaccttcagatttattggatatgagaaacataaacctaactgtcgaaagctcagctcgttaagttttcagttactggaaaataaacacaagcctaattgctaaacacgtagatttccaattctaattttaatgacaatcagtaacctgtctaccacctgaaacaaacgcctgtgaggctggctagtgcttcttttccagaaggaaagatgaccagcacaggaataaattgtacttccacccaaggcagggcaaaggcacacacctacagctggatggatctgagtcctcatggaaccagtcagcctagaaatagcttgatgagaagattgtgagttcaccacaagagaaagtttgtatggtttagggctattggaagcagcaggtgaagggtgatctgtcagagatcagaaggagtgacatccttgccaggaaactatagttggaaattactgggggaggaaaagtttctctaagaaacctccaaaaggtacaataattctcaggggtttgactgagcacccagacatagacgcaatttaaaaccaaaccagccatgtgactgtttttgtttgttttgttctgttttgctgaaatccctcaaaactactggagttaacactggataacagacactacagccagcaaatggatcaggagtaggagaaaggaagtgagaagcacctgactccccactcttcatctttacaggcttctcatcctaagctaggctggaggtaggacggaagtttagctttaaagtggatgatgttttttaaaaaacttgtattttagcttcagggttacatgtgcaggtttgtcatataggtcaattcatgtcatgggggtttgttgtacagattgtttcatcacacaggtactaagcctactgcccaacggttatttttttttctgatcttctccctcctcccacccctgaccctaaggtaggccccagtgtctgctgtttccctctttgtgtccacgtgtcctcatcatttagctcccacttataagtgacaggttatctttaatattaagctggactgaagtatttatgacatgaaaaagaagcttcaattcttagctgagagtgattagtaaaactatgggatcagcctgaaatattgccaggtgaaagagatttgttaggacaaggaggaaagcaatgcaaagaaagctgtttgtggtttgacccctacctactccggctcgttcattatcacagtaatattacattataacaaatgtttatgtggtaaaatagaggggagtgatatgttatacctatatgaatgataaaattttactatatacaggcatgcttaagatgagaaatatttataaggcagagaatctagaacaaatgactaaatgcagaatgtcttatacattttcttaaaatataaactataaaaccaagtctatttgataaatgcagacttatctagtagttgtaatcatctttatccctagacagtttcatgaagctgaataattagcagctatgtatcagttcttcctagccaatggtaaccacatatacaattaagaatgttactataattgatatcatcttgccaatgtttacatttaaatatacactatgagataaacaaaatatcaatcagatatgaaaaagtagattgctcctaaaaatttaatcctccttatgcaagaacagactgcatttatgaaacattaagagggcattttatgaaaatatttttaacatattatttccttattatttagaagcatttcaaatcatattttactgttggcagagcaggaattgaatatgaacatgtctgaaatgatagaagatacaacggaattttaaatcatgctgttcttaaaatgttttctgatcaaaacttccccaaacaatagacagtggtattattatatcaccattatacaatgttaaaggcttttaagcgtggatgaattggcccattacctctcttttgtgttttcttaatctttttttcttcactacgcacactcactcagaatctagctcattttcaataaattaacacaactttttgaactgcacatggacaatttttatgcacaaattttgtattaattttcttattctcttcttgagacttaaaattacataaatgtctttagcctctcatcttgcccatccttgctgtagaacttcaaatattgtgtttctaccccataaaagatgcccacttttctactctgtaatagatgtctagccattgctcctcaaaatatttcaaggacagtatctttgaatgtttctgacatatattttcagaaaattgagagtcagcatattgttctgggggaaaaaaagtatatctttgtgctaagaatgggaaagtttacatttaaaaaaaaagcaaacaaaaaaaacgggtctcctactaccagctgtgtttcctgtgactttggggaagtcaccgaaattctctgtggctcactttttccatctttatcacggaaagaataacaaaacatgcttttctgatctctcaatgagacggatagatgaataaatgcatgataaattatggtagtgagaaatacatgagttcaagatggagaaaaccctgtctctactgaaaatacaaaattagctgggcgtggtggcgaatgcatgtaatcccagctactcaggaggctgaggcaggagaattgcttgaacccgggaggtggaggttgcggtgagccaagatcatgtcattgcatgccactctgggtgacacagcaagactcaaaaaaaaaaaaggggggggtgtgggggggagaaaacactgaaataatgcatatatattcataataataatatttgaacaattcctatgaagacaatgatatctataagcaattaagtatttcccagttaagtaggtatatattttttgtaatatctagagctgtgggagcaatgagtaaattctatgtatgcagagctgcaatttgttcagtgaattccgacagcaagaatttagcccagtaagcatatgaaggctctgctaaaatctgtttcccacataggaactaacctattaaaagttcaaaactatgtgccattttgtctttgttgcaaattagttaggtataatattaacactaaaattgaataggaaaggaaagtttgttaagatttgtatatttattatcttcaaaatatcaacaaattcacagtgactacatgcatagaagttccctgtttaaatatagatgaggtgtctagaatagaaatagacaagtctacaatgaatttgggtggccattgggtatcattaactcgatcccttactaagctatgcctaatttcccattattgtaaattggaaaatatcttaattatcatacaaaaattttgtgaatatggatcatgtacatgaagacactttcaaatgacttcagatacatgcaattgttaatatcataaattatgaaagactagtttattgccagcaaaaaaagcactagaaaacataaaatcctctatgtctattatctagaattggaattttaaaatattactctctcaatccatgaggtacagacagtcagtaactggtatctcagatctgtttttttaatctcctttgcactatgtttgggtccacataactagttccgaccaaagcaatgtgacgtgacatgacctgtgtcaattctggtttgaggcagtaacaagccaatctgtttcatcagcaacgtgtcttcctaccattgagaaacacagtggtcttgtgttccagatatctagttactaaatgaatgaaagaaacatttgaactgcatagagtttcaatgagtataaattaatcctatatagtgcttagcccatatattttgtagtttatttcttactacaagatagcttagcctatctttatcaatacacaccaagtctcactattattcagtagcgctgcattacaattgtttaaaaaacaaacaacaaaaatcttttaatccctgggtaccaaatgtttcaaccaatgtttacctttctctggcaccattctttgacataaactctattgaaatccatgtctataagcgaccatgctatcttgattcttagcagcttcgctttctcattcctgtccctgaagtgatgtcccacccatcttcacagacataatccaaacagttttcaaacgcaatgccattggcaatacatgctagaaaatctctatccaaagttagcaaaatgaaaatccattcatattaaaaaaaccctcagttgtctcaaaaatgttagattttcagagaatgaaacttctcatagaatcataatcctttttttgaaagctctattactctgtgataattgaacaagcatttcaccaattaaaagacagatttgtttttgtccaaaatgcagatgactataaactttcatttgcttgctcaattgaatttcttcaatgaagccatttaggacaatgcatgatggagcatattatattcgcaaaagttcctgccaaaataataagagtcatagaagttaacattcaataacttttgcatatatatatatacacacacacacagagtagtagaatagaaacctactaaaatccatagcatttattctaaaataaataattcagtaaaataatgggtaacatatgacaaattatacagagaaattaaaaaaaaaaaaggatatccattgcatggaatgtttaggagccagcccacctcgggaggaatcccagttctgtcacttatttctgatgctaccttgagcaatttcatccaggctgctcactgtgcctcattttacctatctgtagagtggggaagatgatggtcatgaaaataataacaaaaataataataatgcctatttatagtagttgctatgagaattaagcatgtaaaaatatttaaatctcttagaaaattgccaatatgtagcaagcactcaataaatatgagctttactactactgctaccactgcttctgctaccatcattacttcttttgttgttgttttgttttgagacagagtctcgctctgtcgcccaggctggaatgcaatggcgtgatctcggctcactgaaactactgcttcccgagttcaagcgattctcctgcctcagcctcccaagtagctgggattataggcacgcaccgccatgcccagctaattttttttttttttgtattttgaaataactttaggtgttttatttccacacatgtaaaggtctcataattttgtcataaatcatgcacaaagaacaatttctatttttagtagagatgtggtttcactatattggtcaggctggtttcgaactcctgaccttgtgatctatttttctcagcctcccaaagtgctgggactacaggcaggaagccactgcactggccccatcattacttttaatgccacagccatgttagacattaggtgtatatttcaggaaatattacataataccttacatttttttccccagagcaattttgggttctttcaaaaatgtgtaaatattgtacattatgagtaaagaatctaagcttattttatgagcaaatgaatacctactatatattccagagaaagaaaactacatgatttacatgggtatgaactgtaagttattcttactgtttgccagtaacttcttagtttttccactgtcgtctttaccaaatcttgaatgctaatctgctctaaagactttactatgtaactgcttgtagaaggtgttcatatgttcaatataaagtatcaaaatatttaattgaaataaaaatgcagccactgatttttgttcctgtaatcatttatttgtataacaattcttgtaatttcctgcatgcgtaacttgagggacaaataaccaattgttttatgggaatgacatttccaatgtggtttatattaaaagatgttatgaaaaattcaactttggttagaaagttaattttgagtgtgtagatgaagggtttttaaactttttattttgagataattggaaattcaccagtagttgtaagaaataatatagagacacctttaattctttacccaatttcacccaatgggagtatcttgtaaaactattatgcaataaaacaaccaagatactgacagtaatagactcaagataaagaatatttccatcacaataagaatctctcatgttacccttttatagcctcatccaatcccttcctatccttaacactaagcaaccaataatctgtcctccctttctagaatgttgtcatttaggagtgttacataattggaaccacatactatgcaaccttttgtggttgccttttttactcagcataattttatggagagtcatccagagtatttcaagtattgctcctttttattgctgaagacccatccatcgtctggatgtagcacaggctgttgaactactcaccccttgaagcacatcagggttgcttccagtttgagctcttacagataaagcttctgtaggcatttgtgtacaggttttatatgaacgttgtttttatttccccaggaaaattcccaggagtgcaattaattttttaagtaagtatcaaactgtttatccaaagtgactatgccattttacaaactaaccagcaaagcagagataaagtgtctttatccagagataaagtgtttccacatcctcaccagaattatatatgttgattgttttagccattctgataaatgtgaaacagcaagatttgttacagccctccttcctcctcctctatccctcccttccttctctccttccttcttccttttcttttcgttttttcttctttttctccctttctctttcctcctctcctctccttccttccttcctcccccctctatccctcccttccttcttttcttttcgttttttcttctctttctccctctctttcctcctctcctctccttccttccttttcttttctttcttttttctttctttccctttctttttctttcttttccttccctgcttcttttcttctcttctctcctctcctctccctctcctctctctctctctctcctcccctctcctttcctctcctttcatttcccttttctcccttcttttctccctttctctctttcactctttctttctccactggaatctctagtttgctaacagcttcaactgaaagtttgggatttatgaggaatatagaaaacaacattttttctaaaatggaaattgtgtatactaagcctttaaatggtaccaaaatcagcaaagaaatatgacttacatgtatgttttgataaagtgaccctacagataagtattaaatactatataaatactttaaaaattaaaatactagaaacaacataaaaatgaactaaatcaatcgaagaagacatataaactctattatatgtctatatataaaatttgttttaaatgttcaaaacttaaaaaaaatatgcagtggggatattatttaggaaactattgtgcgtcactcatttattttcaataactttttaaattaatgaggtttgtaaatgtttacatatctttaaaatttagagggattttgatcttccttttgtgttcagtcttcctcagcagtctaattttcttagttgagtgaagagacgtatggatttttccctgtaaccccagaaatctgtattctcccgggttccctcatgaacaggaaggcaagatggtggccttaccatgtacactgacagtgagaaaagggggaggtcatgattaagtttcccatagtaaacattaaatattacaactttagcataactatatatgcatcaatacgcatatttgacagctaatattaaaatggggatatattttgactttttaaagtattttgtaaaataaagttgacattataatgaatacttactaatcattgaccatgaagctataattaaaagcaaagaaaaaaatcatttaattattcaaatatgctcaggaaaagtatacatttattctttttcttgggaactttctgaatttggattcttaacagctgccaattaatattgcattacttctaactctttaatcagatagtgaaaacaaaaccagaaagagaaagattggttccaaaacgtgtctctctgttgtcaacacatattgtgttcctgaatatcacaatccatcaatgtatcttacaaatgcaaatattcagactatagtttgttttatgtatacttgcatgttactgaaatattgaaaacctaagtcaaaattacttttaaaaaacttagccacaaaatcctaaaataatatgtaaaatattcttatcctaataagaatcaggctttggatttcaaatgtagaattatttactccttaccttctaaggaatttgaatcacaggtgaaaacacaaagccaatgtccctgaagaatgtataatctaatttaaaaaaaggaaactactgaggatacatttggcaattgaaaaatgcagttataaatgatggacacaacattatgccatgtccatcttcatgcgtgcaaaaggagccactcagaggtgctcttgccccacgctcctcctctcagatgatgacaacttcattctttcaattcctcaagcccaaaccctggagtcatccttgctcctctttgttatacctcacacacaattcactaatgtattttcagctctatcattcagattattcagaaagtgtctacttcttaccttactgggatattgcttcacctggataattgcagtgttgtcctaactagtctgctgcaattgaactcatgccctttcatagttttttcagcaaacagagtggtcctgtaaattcagatctgatcactttgctccgtgctttcctatttttctcatcattctaagcttcaggcacctgctattcctaccagatgataagatgcgcagcctccaagcctttgcagtagctaatcctttgacctgttatgcttttccctacacatccttacactttggttcgcccactccttaattcttacttagattataccagatctcttgagtcctgctctctgtcctatttaatttgttatccttttgcctgaagtctttccataccactctccttctttacttttcttctcagcaggtattattaatgtattaatatactaataatttcacctgtttgtgtatttgttattcgtttagctcagtagaatgcagtttccacaagagcaaggatttctgtccccagaatctagaagagtatctagcagagagcagatgcttaataaacatgaattgaaggagggaaggaaaaaaagagaaaagaagaaagaaagaaaaaaatgaggaaaggaaggagggaagggagacaggaaggaaaaagagacgaaaaaagtctctacagctctctaggggtgtcaaagaagttttactaacttaaagttactgttaagtacccaatgtgaaaaaaactatgagctcaatctttattttattatgataaaatggtatattttattaaatactcacagagttacttttctgttagtatttaaatcaagtttaaagtttagttacatttattttccaaacctctggaaatactagttttggtattctgttacacactagggtgactatagctagtaacaacgtagtatatacttcaagacagaagattttgagtgtcatcaccgccagagatgataaatgcttaaagtgctgaatatggtgattaacccgatttgatcatcacacaatgaatatacgcattgcaacatcacattataccccataagcatgtacaattattttgtatcaattataatgtaaaaattaattgataaaaatattgatttcttttataattctatccttttctcaaattttttacagggtatgatacaacaacacgatctgtaaagtatttgttaataataaaacaaggaccagaacaattacatattatactattcataataattttggtagccaaatacacgtaatggcaaaggctaccttgagagcccattccaaaatattctattttcacttaaaatagctcaacattttaaacggtggtcttggaaacccccttttatctatggcttttggtgaaatcaaccaattgctctctgctcctgctataggtcacaggaaattcatgaagcaatagtgctgatattgattaaattgtctcccagcaatgtacatgttgaagtccttaaatccagtacctcacagtgagatttggaaataggatacctgcatgtgtactatttcaagtcaggatgagatcatacaggagtacctattacaggtcacactttagccctaatccagtatgactgatgtaattctaaaaaggggaaatttgcacccagtgagaatggcatgtgaacatgaaggcagagattagggagaatgccatgtacaaggcaaggaacacctgaggctaccaggagctaagagagaagtttgaaacagctttttcttgcagccttcaacaggaaccaaccttgctggtgccttgaaatcagacctctaacctccagaaccacgagacaacaaggaaaacgaaacatgcagtgtattgccagaatacaatattgcatgtccttatattctggcagcagagacctaacatttttgaaagccattttagacactgttcggtgtatgaagaaaataaaagggttgaagggttactgtcatagaaaaatagctgcagtaaggctgggcacagtggctcatgcccataatcctagcactttgggaggccgaggtgggtggatcgcctgaggtcaagagtttgagaccagcctaggcaacatggtgaaacctcatctctactaaaaatactcaaattagccaggcgtggtggtgggcacctgtaatcccaactacctgggagggtgaggcaggagaattgcttgaaaccagaggcggaggtttcagtgagccaacattcagccactgcactccagcctgggcaacagagcaaaaactccatctcaaaaaaaaaaaaaaaaaaagagagaaaagaaaaatagctgcagtaaggtcatttaatagaggcttcaggaaaggtctctgaggaaagaaccacttgagtttagctctcagagaagagagaccagtgaaataatattataggcagaacaaagagtaagtagaaaggtcttactgggaaagcttggcattctcaaaataaagaagaaactggagaggccatacagtaaacatgaagaggagagtagtccatatttaagagagagtagttttgtttatattgctttgttctaactggaaactgaacttttatatagaggtcttacctgatttacttttcaaaattttgtttaggctcaaatctgaagaatttactcaggatagcaagtatgcacatgaaaacaatgtagaaaattcattattattaataaatactattgtgacagcagctatatttagagggttcttcccagaatccctctgcccaaaattattttttgctagattgcctgttcctttagcctcagattctctttctagaaatgcatttatggaaacatcatacataagctaaaaaaatagaaggtgcgttttatcatttaggtagtttgtgccccccgatggacaataatatactcattaaaatggtgtataaaattgctgtgtgacaacaactagagtaacttaaaatagaatattaagcgataagcaagaatgcatgtttccatctgtcataatttcaactataaatatatgaatgcatttggacaaccattgaatggcctagaaaatatgaaaaaaatgttgttaaggttacagagttgtgtatttttattatgattttcctcttacaattaaaatgtaacttaaggtaaatatatttctttggattgagtcagtgcaatatctacaatttagaaatcctcttttcaaatacagcaccaatcaaacattgaggcatgaacatatgttttaggttagggtgtcaacaattggtcatccctgacttcttgggaggttaacaaaccatgactcaacataaatcagtagcatttggggatttctggctaaggacagtgggaattcagagctctgaaatcacaacccaggtatttcacatcttggagtctctcttgggttcttggatcaaaaaggagagtagagtaacacatgaacaatgaatgggagaagaaaatttaaattcctaattcacaaaatgtttaacccatcatgaaaactgttattaagtctatgaaatgtgatctcaaattgttaaaaaaaaaagatagcaggaaagataatttatctttggcttgtccccagagacaatggggtatcttgataattgttttaacaatgttaaattttaaatacacaagcattttcaaatgatgagcttattattcatttactgaaatcactagacttatattattataccaaaagatttgctaaaattaaccagctaagtaaataagtagaagaagaaaaatcctttcatatatcttagaaagcagcttaagtagcctcaaagttgtactgaagaaattcaaaatccagtcactgtaatactactctctccccttctcactttttctgtttccattttctccatgcgttattgatctattacagtctctttgcttatctatattctacctatacttcaagactcagtttaaattctgaggttgacagactttggattcaaacagatgttatttccaatttttgatttgtctgtttctgtgatttcaagaaagttaaattacctgaatttgtttcctcatgtgaaatgggcaatattatgttttccacataaatgctatcaggaaaaagggagataaagcacccttgtgaggctcctaatgaatattaatctcttccccatttgtgttactcagtgcagtctcatccagttggaaataatgcaatgtaaagaatatgagcttagtagtagagtttcaacagagttttaccactcatacatgtgataccttcactaggttgtttaacctgactgggtccctgtgttaggctaaataatggtcctccaaagaagtctatgaactaatccctggaagctttgaatttattacattagaggacaaaagaaaattaaggttgataatgaaatcatggttgccaattagatgaatttaagatggggagattatcctgcattatccacaagcatgggcccaaggtaatcacaagggtccttggaagtggaagaagaggtagaagagtgggtctgagagatgcaacaggagaagaatttgacttgcttttccagagtttgaaggtggaggaaagagtcatgagccaagggatgtgacagtctctagaagatagaaatgggtttcagctgacagccagcaagaaaaccggaatctcagtcttacagtctcaaggaactaaattctgccaaaaacacaaataaacaaggaaacagatcctcccctaggatgtccagaaagaaatgcagttctgccaacaacttgatcttagcctcggaattatgacctataaaactataacattggtgtcttttaagccaaaaatctaaaacaaattcttgaaggaacaatagaaaaactaatggaatttccttcataagaattcttaaatagggacaattgtacctaccccttggtatgattttgaaaatttaatttattagtttcacaaaaaaacctagcacattattagcatcccataataaatgctctttttacgtatttttcttcttttcttatttcaccctggattcctgtaaatgtatgccatctgtaggtgttatgtggaaactatgtattgctatatttcacctatagatgtatgcaactaattatgtccaggtgatatctcttccagtatcaatttctattataatttaagctccacaatttactggctgtgattttcaggtgagttgtctaacctctctgtgcatgcctcctatctgtaaatgaaaataataagggtaataactcttttatctagttgtggtaataattcaatggaatgctacttaaatagcatttagaccagcacctggaacattgtatttgctcattaaaatgagctacttttatttttttcacaggcttatagccttcaactgattaaacgatatgtcccttgatgttcaaatagtatcttggagtaattcttatcccacttagaacctggaaaaatgtctaaatgaaagtagatacttgataaatattcatggactcaattttatgttctcctttaatctagtcacatatcattagcacttagacccattctatccccatccctagcttgaaggataaaaggaactttcagtgagaggagggaaggatggaacaagttagagaaccagcggcttagacacttagctgcagaaatactgtcttccctattctactgtgtcagacagagcaagaaaattttaacataatcaaaattcactccaactatgttaaagctctctgatagagctaagtgctgtattttcatgcttagatgtacaatgagaaatgaggactaaatggttccaagttagtttcccaaattctgaaaatctgaagtcattattctttatagcataagacactcatcttttaaataggatttgaacttagaattaaacatttttccattgcattgagcacacaaaaggctgactcaatgactgaagatgggaatgtacaaaacaagcctgctgaactgagccaatcacaaacacagtttgctgaagcaggtggaatgggaatctctaactagaattatgttagattacttgaaacgagggaccatattttactcatcttgtgcttagaagtgtgtctttaaaatgaaagaaataccaatatttgtttaattcgattgcatgaatttaactgctgtttagcagagtatataggaatagaaaaagatatgtgatatttcaactagggaatcaagatttgagcagagaacaaaacacaacatcatactttaaggaggacaagagctcaaatcatcaacacctattcttcttattaaaagcaggatgtaaccaactagtgggactaattacttaaaatgacttatttcagtacattttattatttcatgtgtgtcacttagtgtatgctatatgattatcttatgaaaacactgattttaaaaatctaatatcagctgttgacattactctcataatttgaattctgtgaacattactacagtgaatggtttttctctgagaaacatgttcaaagaaaatagcatctgcttccaaatatctcatgttgttccaaagctctctgacatatggattgtggttagtagaggtggctttgagaccaggtcacctcattttagatactatctctagcactaggtgatcctggtcaagctatttgtgaaataccatttgaatttttaggtgggggaataaatggcattaaaactcttttttaaaattatactctaagttttagggtacatatgcacaacgtgcaggtttgttacatatgtatacatgccatgttggtgtgctgcacccattaactcatcatttaacattaggtatatctcctaatgctatccctcccccctctccccaccccacaacaggccccggtgtgtgatgttccacttcctgtgtccatgtgttctcattgttcaattcccacctatgagtgagaaaatgtggtgtatggttttttgtccttgtgatagtttgctgagaatgatggtttccagcttcatccatgtccctacaaaggacatgaactcatcattttttatggctgcatagtattccatggtgtatacgtgccacatcgtcttaatccagtctatcattgttggacatttggcttggttccaagtctttgctattgtgaatagtgctgcagtaaacatacgtgtgcgtgtctttatagcagcatgttttataatcctttgggtatatacccagtaatgggatggctgggtcaaatggtatttctaaactcttatcactatatctgcaacagaacaagtgttcaatagacattagatatttgcattactatattttaaaaagtaatcctttccttgtggctttgctcaaagcatcttggagcttttcataccccattcatcatgtttatagaatttaatacaaccaaccaagaaaaaagaagatgcatctatattttcttcttctattcttctaatgtctgtgtagaaatctttactagctgtaaataaagggtgacaaaagtcatatggtcattctgaaattaaatacgagaaattcaaaaatgactattaagtgtcgatcgtctgaattgcaaaagttatgttttcactttcatttttagtaaatttaaacttcaaaaatgcaagtaattctaatgaagggatttgaggaaaaattgaacgtcatcccacatcctgggcagcatgtaagccttgcagcattaggctctgtgacctaagcttgcacaagaacctgattctggcaactgagcaaacatttgcccttctcagattttaagtcttttctctgaatatcttttaaccacgctgtttctgatgtttttgccaagcatccacctgcctttcaaatgtcctaacaaatactagggttgcatccaagtctcatgaagcatcctattactgaaatgtttgtagggcataaaaggaatgctggcagtgtgtacagtaataaatgccttttctgttgttggtaattttcacattgctattttcatcaattactcacaatcagagacttgcaggatggcaaaactcacatgcaaggtctttaaaaatctgtcctgcaagtgaattaatattcctcattttatgatggtaattggtgaccagatgcagtgaatcacaaaaacgttagtgtcctttcaacctaagaatcttttgtctgcttaacaaacagcaggttgaagcctgtaaaagcaaatcacaaataatatctcaattacatcttatcagcacaactatttgcctggcttttttctgtagataaaccaaaacatatttatcagtctttggaactgagaaggagagcacaagttattttctcagtaccctaatagagagacaaggacatatcttgttggtagaatttgcaaaaaaaaaaaaaaaaagaattgaattacagtgtaagtttctgaaaaacatgacaacaaaactaggccacatttaattattattttacgctgcttgagagaaataaattctggaatcactgttgatatctacatgtttgggggagtgaggtagtaactctccagccttatttcataaaaagaactattttaacgtccattaggtactaaaatattctataagaataaaccctagaaatatgtttgtatataaacacacacatatatatgcacacaaatatatatatttatatagtactaagaatcgctaatgagcatagcaatgatcagtttatatatagcaatgataatagagacatatagagagagacatatatatatgtcaatgttatagtattatcttcaatattcaaagtgcttgaagcaggtatgatataaatacaaacttgaaagtttccaataaatattctgaaaccattctttggaaaggaggaagggctgagagtaatgtaaaagttttggagagggcatcaattcctaaactaatttctcaggattattctggcatgtataactgatgaagaaacctattacactaacttaggaaagttatttggctcctagagaagcggatgaataaattgaactcatacagggtttttcataacacacttttcaaagcttcatctcatgatgcagaactggaaaaatccagtgcacaaaatgtgggatatcacagcaatcatcgaaccctggactcatgttgtcataaaagcttgtcgtaccacaccaaattaacttccagagaaatgcatttcaactgttgctctttaaaaatacagtcataaaatactcttattctactttatgaagtaccaaactataaaaaaatataacactctctttctgaagccaaatgttgtggatttatgtgctgtttataccacaaagatacttaaaaatctaatgattccagaatagtataatcacaatattttgaattaccatcactattgaactcttgttgattttcatgatgcttagggcattgtgttgccattttagaatgaataaaacatggtctccgtaatcaaagggatagttgttgagacaggttataaacataaaaaagagatgataatgaaaaacaattagaatattattgctaaaataaatactatccctatacatgaggacctcagctctcttagatacctagagtttacaaatacttcaatgaaaatttcaaccatgatccaccaagcaacctgggttatttatttatttatttgagatggagtctcactctgtcgcccaggctgtagtgcagtggcacaatcccggctcactgcaacctccgcctcccaggttcaagggattctcctgcctcagcctcccgagtggctgggattacaggcacccccgccaccacacccagctaattgttgtatttttagtagagacgggggattcaccatgttggccaggctagtctcaaactcctgacctcaggttatccacccatctcagcctcccaaagtgctgggattacaggcgtgagccaccgcccccagcccagatttatttttaaatgaattcagtccaagctcataggcggaaatctctgtggtgattatatcccacacttgaatatatggttttttcagtcaaatcctacacctgactttatactccacttcatttgattacttaaaaaaataagacctcaggttgtttctaacctctgaggttagcaaaagaaacaatggcatgataaagtggtctgatgcctttctaaatgaaatttaaaacctgaaactccaccaagatttataatcaggaattcactctttgctctgttttgaacttcataacttactttaaaatataagttttaactactctttcctctatgtgtcttataaataattacctttgtccaaaagcaataaattttgatatgactctaggctgaagttatgaggaaatatgaaggtactatactgtcacagaacagcagaaaggctaacctagaagaatttatatgagggggtgagtgaaaatgccaacatcatgcaggattattactattgcattatgtctttattttatttttaaaaaatttgacaaacatatatttaaggtatgcaggttgaggatttgatatccttatacatggtgaaataaatcactacaataaagctaattaacaaatctaccactcagttattttcttgtgtgtgtgtgtgtgtatgtgtgtgtgtgtttgtggtgagaacatgtaagttctactctcatagaaaatttcaagtatacaataaaatattgttaactagagttacaatattgtgcactagaggtccacaactggccaggtgcagtggctcaggcctgtaatcccagcattttgggaggcttaggcaggtgaatcacttgagctcaggagtccaacaccagcctgagcaacatggtaaaacctcgtctctacaaacacacacacacacactacaaatatatatatatatatagctgggcatagtagcttgcacctgtaatcccagctactcaggaggtgagaggcaggaggatcgcttgagtccaggaggcctagatctcagtgagccaagacatgccactgcactctagcctggacaacagagcaagaccctgtctctaagtaagtaagtaagtaagtaagtaagtaaataaataaataaataaataaatagggttccattacttactaatcttgaataactaaaagtttgtatcctttgaccagtatctacccattttccttgcccctccatccataggtaaccacccttctactctctatttctatgagtataacaacatagattccatatataagtaagatcatgcagtatttgtcttcttgtatctgaattatttcacttagcagaatggcctccaggtccatacatgttatcacaaatggcagcacttgcttctgtcttatggctgaataatattccattttgtgtatacacacacacacacacacacacacacacacacacacacaatattttgttcattcattcaacagacttttagtatgtttccatatcttgtctattgtgaactatgttgaaatgggagtgcagatatctcatcgagatcctcactttacttcctttagatatatacccagaaatggggttgctggatttcattttcatagttccattttagtccacataggaattaaactaacactaaatacaatgtccatgtcttgttacagattcttcctctaattacttattaaacagcatatacaagtacagcatgatattttggaagcaataactaagtttatatctttttcagctgtaatgatttgtcaaaaaatcaaatctatccttaaattcaactccagcaggaattttaaaaattgtttttgacagttttattaatcacagtgtgttcctgtatctttaagatttgttccagcctgcattccaggttttaaaattagggaaatgtaagattatgtttccaaatatgctgatgatatgaagttttatattgtagcgatagtggatccactatggttggtgatatgaacacattaatttgtagcataaacaactatttactattcccccccaaatcagagtaaaattacctatctgtacttcaatttatatctaatactgtctcttctgaattgcatattattgctatcagtttatcattagtctcccaaattggtatgtttcaaggtgcctggaaaagttaataattgtgtttgcaagaacaaagttaaagtattttcgtctgttatttagtctgttattatactaagacttcctaatgataatagcaatgattagattaatttgaggctaatgggatatgagcagatctaatctacaaaatgttcttacacctgaggaaaataatacacttagtacatttaaattggaacacaatgtataatattaagaacaccaacaacagaaatagcactctcaatggtccaagtcctaagctgtttgcatattttgactcatttattttcagtacaacccatgaggtaggtgtgatccttgttcctcattttaaagatgatgaaactgggacctaaaggtgtttaattccttgtcttagtttgcatagatagcaaatgtcaaagctcacattcatttcaaactcaagctatctggctgcacagccatggtcttaatttactaccctatagaactagtgagtacacaggttgaagccaagaacagctatcactcaaagaaagaataggtcagcctggatgtgtttatatacccatgtttctagctctcaagcttccttggtgtgctgaagctttggttgggaaaggagtccactgcgcattcattttcctcttcttcagtgtctctggatttatatatgtaatagttcctctggacttcagcttcagaatcatgtaggactgagtcatccatttatagaacccatttcttttgtaacttctcaaaatatttaaaattgtgcagatgagggagtctgatggttctcgcagtggtgtcatgtgacagtggtatctttttatgacctctactggctgtctctgctctggcatttcataattgggcttcaactttggagacctaagttatttaaaggagtttcttatcaggtgttaaaacccttttattaatagatggaatggaatcacttgattttaatttttatccaagaaaagaaaaagccaagtttgaaaagtattacatattcaatgctgcctattttaataaactaccataaaattatttgaaaagatctaactgtaggctagcacaaacacaattaaatttcaagaaggacttattttgcaactctgtactgcaaactttacttcagggtgcccaggtgagaaaagggcaagaattagaaagaatatgattaagaaagtagaaaagaaaacccagaaactaagcctgagacatttatattcttaacattcaaaccatgcattttcacttttaagccaaattacttataataaatatttggatataacattaggaataataacataaataatttcaaaaacaaataacaaacaaaacaattttttccaaagatatattttaattccgtattgaatatatataggcattggtgtcttctctcttccgtatatcctaattctggaatatgtcttcccaacataaacatactaatgtaattaattattaattactctaacatattttgccattttgccttattaatatcataaaacatcattttcgaaactgaagagacagctacattgaaaacagactatcttccaatttgggaataaaaatcacaaatcttagctaccgacccagaagttattaggactcatttcatttaggaaatagaggaagagtactgaaaataaataatgcgggaatttaaaaagaactgtgaggttctctttgccttctaaatgccatgaataggttacgtacaaactataccactcatctggcagttaactatgaccacattttgaaagctattttatctagttatttaaaatatataattattaaaatgttcaataaaatagtaatctgccatttgctaagctgttaatgcccaatgtctcatattccatagcggaaaaccagctgtaaatatttgctgattggtcagatgtgcgattttaagaatattcttgcaagaaacatgattgggcttttaaactacaggaatcaagctggtggttgttttttaaattcatgtatgtatgtatttaatattcagccctgaagtgctattattagaatatatgttttaaagatgattcaaagatgaaaaaggatggttcttgctcttaaatcatgtagccacctacagtaggtgctgtaataacataaatataatggttggagcaggaagtaactaactctggctgggaaactacaagaaaagctttttggaggaaacagtgtttgaatgaagacactggttgtgctcaggacaaccctccatcacagaaaattctaaattttttagtcacctcaggcctccagaacttctttaacactacctttacttcattctgctgtctctcctagtactagtaagacctctttgcttttactcatagagtatgaataaatggtctacataaaggatcagtaatctttttcttataaaggggtcagaaaaatattttagcctttctgggtcacatggtctatgctgcaactactcatctctgctgttgtacagagagagaaaccagacaaactggaaagaaagcagtgttgctgtgtttcaagcaaaagtaatttataaaaacacacagcaggcaagatttggcctgaggctgttgtttgccagcttttggtctagattacccacctcaaatgtcctggtgtacttcttttatgtttccattgtatcacatcccattatcccatctatacaacatagtgagtgttatgatgtttaccctgtattgtaaccactatactgtcttgtaaacattaatttatgacctattagatggttgatatggtttggctctgtatccccacccaaatctcatctcaaactgtaattcccacatgtcaagggacggacctggtgggaggtgattgtatcatgggggtggtttcccccatgctattctcatgataatgagggagttctcatgagatctggtggttttataagtggcagtttcacctgctctctctcgcgctcgcgctgtctctctctcgcgctcgcgctgtctctctctctctctctcactctctctctctctcctgccatcttctgaagtaggtgcctgcttcccctttgccttcgccatgattgtaagtttcctgaggcctcccaatccatgtggaactgtgagtcaattaaacctctcttatttataaattacccagtctctggcaatatttttatagcagtgtgaaaatggactaatacaatggtaaatatatagaggtcaggaatcagatttataaatgcttaatatgacttgaataaatgaacgaataaatgaacaaattaatgtacagatgaacaaattaaaaatggaagaaaagaaaaccaaggacaatctgatgcccgatgtagatgctactcaattattctaggccctaaaattaatgcaaaagaaaactaaaagtaaacacaaagtttataaaaatgtatgatctgtgatatacacaatatattcatttttattttagtttcattgataagaagacgttcaaaacaagaaaggtaattggcagtaaatatctttgttattgaatgtgtcacacacttttaaatgctttaaagtgatccacaagataaatactaatttggagatgaagttcgatgaataaatttatatatttttatttttttagaaattagtataaactgttaaaaccttcaataaagtataactcagaataaaacataaataggtagttatctgttttcatgttagcttagctaatttttaaaagaaaagtaagaatccctttttcttgtttttttttctaaacgtgaaatcatcctgatttcggtgtttcctacaccaaaaacaccaacgtaaaaccttaattcaagtttgtttaaggaaactatttcttttcttttagttaaaagataagagtaaaaatgtgtgggaaactactattgttcaaagtaattaaaacagctcatttttaagattaaatttacaagaaaaaagataaactaattgtacagaagtagctaaatggagcatattatgttgaactgatctttagttcctgatagtatagctataaatatgcaaaattggtttgaaaataaaatgtgtagtttacaataaacctatatggtgctattctattcattccacaaatttcagttttgatacggtttgggttactttcccacccaaatttcatgtttaattgtaatccacaatgtttgacgtgggacctggtgggaggtgattgtggatcatgggggtggatttctcataaacggtttagctccatcccctttgtattgtccttgaaatagtgagtgagttctcaagagatctgatcatttaaaagtgtgtagcccctcccctgccctctcctcctcctgcttttgccatgtaaactgcctgctcccactttgccttccaccatgaataaaatctcgttgaggcctccccagaagcagatgccatcatgcttcctgtacagtgagccaatttaacctcttttcttttctgttttttttttttttttttttttttttttgagatggagtctccctctgtcgtccaggctgaagtacagtggcgtgaacccagctcactgcaagctctgcctcccgggttcacgccattctcctgcttcagcctcaggagttgctgggactataggcacccgccaccacgcctggctaattttttttgtatttttagtagagacaggctttcaccgtgttagtcaggatggtctcgatctcctgatctcgtgatctgcccacctcggcctcccaaagtgctgggattacaggtgtgagccaccgcacccggccaaacctcttttcttataaattacccagtctcaggtatttatttttagcaatgcaagaacagaacaatacagtagtccataaataatgcataataccgaaacaaacatttctctctttagaatgtacaacatatatttattgtttcagaaaggtccattttagaggtatgtaattcacatattaaatacagaggaaaatattatataatagaagctctatacattaaaatcacattttaaatggcttatttattgaccactgtatacactttacagagtgtatacactttaccattgtatatatagattcctcaatttatatgagaaaatatgttaaattaccaaaaaatatacactgagctcctactgtttggcagctgcttgcccaggtgctggaaaaaatgtgatgagcaaaaacaatggacagaaagagagggacagaaacacaactctgatttcccgtcttgccttaaacacctggaactcccaacaaaatatgtaaaatatcatcttttcagggaaaatggaaacaaataacactgatatcaaagataaaaacaagcaagatgagctcattgcatggaatgaatttccaaactgctgtgcagatttgggggacccaaacaaagctcattattcttgctgagtttggagacaggtttcagaggtcagggaggctaaggtggtgagaattttgaccagaatagcagatagatggaaggtaaacagaaacacctgcagagtggttccttaaatattttctgtactgttaggtgcacgtatttgagaaaactactgagaccagggaagaaaactagcagaggaatgaagtgggaggaataattctcagggatcaacccaactcaggaatagtttgtgttcctaccagaaagaataaagacctcctaacacatgatataatgttgaacctagactacaggctattctgtctctgcactcaaaagtatcatccctgcaatgccagaacttttggaggccaatgcagaaggatctcttaaggccaatgcagaaagatctcttaaggccaggagtttgagaccagcctgaacagcatagagagatcccacctctacaaaaatgaaatagatgtgtgtgtgtgtgtgtgtgtgtatctccagccctgatggcatatgcctgtagttctagctacttgggaggctgagacaggaggatcacttgagtccaggacttcgaggctgtgatgaggtatgattgtgctatggcacttcagcctggagacagagtgagactccatctctatcagagtaaacctcaaaattaatcacaatgatttaactgcctcacaggaaaatagtccaacattatttaaagaaattccccaaaacctactgcacaataatataaaccacgatgtgtggcattagaaaaatacaagatatgcaaagaagtggaaaagcatgaaccttaagaaggataaaaatcaactaataaaaacacatgatcatatcaacagatgcagaaaagaatctgataaaatccaacacctgttagtgaaatgaaaaagctcttagaaaacaagaaataaagcgtattttctaagcttaataatatctgtaaaaaacgtacagctaacaccatacttaacggctagaaactaccagatttactgcaaagataaggaataaggtaaggatgcctcttctcgtcactctttttcaacatcatactgtaaattctagttaatgcaataagaaagaaaaaaataaacaaggatataaagataaggaaggaagaaataaaacaatatttgttaacagatgacataattgtctatgtagaaaattaaaaagaactgaccaaaaaaaaacctctcctggagcaaataagtgataatagcaaggtgatgcaacattaatatacaaaagtcaaaaacttatatgccagcaatgagaaagtgggaactgaaattaaaacacagcatcatttacattagcatccaaaaataaaatacttagaagtaaatctagaaaaatataaaagatatatataaagaaaattataagactctgatcaaagaaatcaaataactagaaaatgaagaaatatttcatgttcatggataggaacactcaatattgtcaatatattagttcttcccaacttgattcatagatataatgcaacccaatcaaaatctcagcttattttatgaataacaacaaattgattctacatattgttatgaataacaacaaactgattctatatgggccgggcggggtggctcacacctgtaatccagctttttgagaggctgaggtgagcagatcacttgaggccaggagttagaggccagcctggcaaatacagtgaaacccagtctctactaaaaatacaaaaataagccaggaggggtggcctgtgcctgtaatacaagctactcaggaggctgaggcaagagaatcgcttgaacctgggaggcagaggttgcagtgagccaagatcgcacaagtaaactccagtatgggcaacagaatgagactccgtctaaataaataaatacataaataaataaataaataagtaaactttatatggagaggcaaaaggcctagaacagctaaaataacattgaaggaggagaacgaagttggaggactgatatttatctgaccctagtatttactataaagctatggaaatcaagataatatggtactggtgaaataatagacaaacagagcaatataacagcaaagtgcccagaaacagacaaaacaattaatttagacacagactttgaatccttcacaaaaattaatacaaaatggatcacaaacttaaatggaaaacacagaactgtaaaatttcaagtaacataggagaaaatctagatgagcttttgtttggcaatgttgacgtagatacaacaacaaagacataatccatggaacaaagaattaataaattggatttcattaaaataaaatgaaaacttctgcttattgaaagacactgtcaaaagtatgaaaagataagctacaggctaagagaaaatattgtagaaaacatatttgaaaaaggacaataaccaaaaatatacagagaactcttaaaataagaaatcaaaccaatctactaaaaaatgggccagacaccttaatagacacttcaccaaagaagatgtaccaatggtaaataaccatatgacaagatgctccacattatatatcatcagggaaatgcaaagtaaaacaacaatgatatgccactaagaacttattaaaattgccaaaaccataatattgacaacaccaaatgctagtaaggatgtggcgcaaaagcaattctcatccattgctggtaagaatgcaaaatggtacagccactctggaaaaggctttgacagtttcctacaaaactatataaatgcttatcctatgatccagcaatcgtgctccacggtcttcctcaaaaggaattgaaaacctatgttcatagaaaaacctgcacttgaaagttgatatttattcataattgaaaaaacttggaagcaaccaagatgttcttcagtaggtgaacagataaatacactggtacacccagatgatggaatattatttagcattaaagataaataaaatatcaagctatgaaaagatatagagaaaacttaagtgcatattactaaatgacagaagctaatctgaaaagcctacatactgtaagattccaaatacagcataccaacatttcagtcaaggacagacagcacgtatgatagttgcctgtcctatcataagattataatgaagctcaaaaattcctatcgtctagtgatgtcatactgtcgtaaactcatagtgcatggcacatgtgtttgaggtagtgcaggtataaaccgacctactgcactgccagtcatataataatatatcacatacaattacttacaatacataatacttgataatgataaaatgacttactggttcatatatttactataccataaattgtattattattttagagtgtgcttcttttgcatacatattttttttaaagttaactgtaagcctcaggaagatctttcaggaggtatttcttttatcataggagatgacaactctatgcctgttattggccctgaagacatgttagtggtacaagatgtacagggggaagacagtgacattgatgatcctgaccccgcataggcccaaactaatatgtgtgttcgtgtattagtttttatcaaaaaagtaatatatatacatatatattatatatatacacacatatatgtgcttataaaatcattacataaaatactttgtgcatctatacaatggttttgtgctttaagtgttattacagaaaaagtaaaaatttgaagaaatataaagatttataaataaaacagttacagtaagctaaagttaatttattattgaagaaaaatattctcataaatttagtgtagcctaaggtacagtgtttataaagtccccaatagtgcatagtaatgtcttatccctttatattcactagccacctactcacccagaataacttctagacctgcaagctcctttcatggtaagtttcctatacagatgttttctttgatacccattttttctctttgatactatatattttttatttttttaactttaaataattttgatacacacttaccattgtgttacaaatgcctacagtactcagaacagtaaaatggtttacaggtttgtaactcaggctacaccatgcagtcgatgtgtgtagtaggctataccagctaggtttaagtattttccataatatttgcacaatgatgaaattgtctaagtatgtgtttctcagaatgtatctccactgtgaagtcatgcatgactatatgtgatattctggaaagtgcaacgttatggagacactaaaaagtacagtggttgcaagaggtgaagtggagggggtagagataaacaggcaaaacatggtggaattttagggcagtgaaactgctctgtatgatgctataatggtgtatacgtgtcattataaacttaacaaaacccatagaacatacaacaccaaaagggaaccctaatgtaaactttccgtattagtgataatgatatgtcagtataggttaaccagctgtaaaaactgtggcactttgggagatgtttacaatggggaaactatgtatgcatggtggcaatatatgatatttctgttccttttgttcaattttactatgaactaaatactgttctaaaaattatctattaaaaatgaaataaaaatcactcatataaacggagcaagaaatctcacagatataattagtgaaaaaatacattaaaaagctcttataaatacactgcatatattccaaagtagaagaaggcatgagactggtgaggagagacatagattgtacggagcaagaaatctcacagatataattagtgaaaaaatacattaaaatgctcttataaatatactacatatattccaaagcagaaaaaggcatgagcctggtgaggagagatacagactgtatttaaaaagacacaaattaaactcccaaagatgaaaatacagtgtcttagatgaaatatatactggacaggattaacagcacattggacactcagaagaaaacattagtgaacttgaaaatatggcaacttgaagaatccaaatgaaacatacagaggaaaaagagtgggaaaaaaaaaaaaaaaaacagaaaatcggtgaaccctggcacaataccaggagatctaacatacttttaattgaaatccatagatgaaattgccctagttcagagtaatgagctagacaaatacatttaatgaaataatggcaaaaacaggcccacaacaactgtaaattaaagaaaaaatagtccaaagaaacacgcagcacagcacactaaaatatatcacaatttctgaaaatccatgattatgagtcttgcaatcagcctgagggaggaaaaaagacattatgtacagatgaacacaattaggaattactgtagatgtataatcaggaacaatgcaagccacaagacaatgaagtgccatatctaatgtattaaagggggaaaaatgacagcctaggcttctatacccaacaaaaactattttactaaaaaatagaaataggacttttagaaatataatgtaaaccatcacattatcatgtataggttaatttcacctgtggttttagtcatttcatggctacagaaagatagataccacctatgtatatgttaccttgcctggatcatgttgctcggacttcgaatgatataaagagaagctaaagttatgatggtcttcgaaatacctcattcatatatgtaacaaagtacatacgcataatcctaaaatgagattagatgtaaaattcagcagtgatcagatattactcagatctaaaataattatgtccctgattattaattctataatttagcagctatttcatcaacccttcttcttggtgaatgaatatcttagagagaggtctctgcatgttttttaatgttctcctcttgcatggcaggaagcccatgggcttttagatgacacaagtgaattcaacaggcatcttagggagaagtagtttaaatgataaatggcacatttatagctaatgtttggtaagtattttaatgttccatatattttaatattaataataaataatccataataataatgactttaatattcatagtaacagagaacgaatttgaagcacagagaaaaataacatatctgcccagaggtagcaaagggttcaatccaacctttagtccaggtagtcagatttcacagccctggggcataatctattatgtagtgatgcttcaagcatggatggcaaaggctggaaaggttcagagaatagccgatcaatttgttcgactaaagaaatgatggaaaatacaatgggaaatacaggaaactttaacaggaatataaaagaggctagggttgtactatagaaaatatttcatttttgaatataagattatactttgagtatgaaaagcaatgaaaggcctcccatccaccagatggtgataataggaacaatacatatgtacagattatgtaccactttgtataagtaaaacttaattaaaaatgcacatacatatataatgcaccctgcaatgcaattttttttttttttttgagacagagtcttgctctgtcgcccaggctggagtgcagtggtgcaatcacggctcactgcaatctccgcctcccgggttcacgccatcctcctgcctcagcctcctgagtagctgggactacaggcgcccaccaccacgcccggctaattttttgtatttttagtagagacgggatttcactgtgttagccaggatggtctcgatctcctgaccttgtgatcggcccgcctcggcctcccaaagtgctgggattacaggcgtgagccaccataaaccatgcacataacttaacaaacagagatgtcttttaccatgcagaatactttaccttaaacactcagttttgaaatctaaatagccatttgaatttcagtgatcaaatccaaactgattgatttaaaggtaaattgggctagattcagtattgtttaaccttttgtaaataactgcatagatgacatttgccggcagatggtgaaagtcaacacctctgaatctgtgttcagaatttgtaattattggggtggccatagaagatgaccagataacgccatttaatttaatagaaccaggtgtcaaatatttctataaggtacaaaataagcaacttgtgaaaacccatgatgataaatgactgtatatttgggattctgacaagaacacttcaagtatgtcacaaaatcagaaatctcaatgattcaacaaggtactcaggtgtaaaatatgcctaaatactaatagggaaatcttcaggcaatagactaatttataataacaataaatgcttacgattacaatccattttatacccaacatttaccaggagttaacaccaagaaagtatgacagatgtttaaggtggcatcaaccgttgaaataacacttgtataaatttagaaatttcagaactacaaaaacattcagaagcaatatataaaaaaagaatttaagaattggaaaaaactaaaaattagaatatttatcctttaatggcagatatttaccctaagaaatagaaaaaatacatatgaactctttgtcatgattaacttgaaacacacaatgtaaataacttcttcccaaattcatcaagtaaattatattaatcattagaaaacagtttaaattagatctgatcaagattcttattttcccagataataagaggaactttgatttcttcaacttggaaattaattttacatcaaatataccataacaaaataacatagtacaagtgtataattcttcacttaatttttggtttgttttattcttccttcagtgagctttttcaaaaaatattgccatcattcttgtacagaaccatagcattttagggctcgagaaaattaagtgattttctcatttggagattaattagcttatctggaactagaagttatatcctctgatacacacttaaacgtaccatcaactatagaatttcatcaatcttaagatgcatgatttttcacattttaaaatatctaaaatctgaatgtgtttcatctcacaatccatgggatgccataggtttatcacttgtgcttttcctttctcagtgatatataaaagtggtttatggtatacagtcctagagattatgaaacccaacatgccatttttaaatatataaattatgtacttttccagtgattacatcaattaaattgtttcagagctttttaaaaatgattgttcatttctaactaaatgaacgtctacatgtactcactcccttcataatgcaatttttacttggcatctgatggcttcttaaatgatgttttggcccagtttaataatttttctataaacaacagcttgttttttgagtattaaataagacaatcaagttctttagggaaagtggaaccaaatcatgtattgaaaagtcatggcaacgtatttatgtacagacacattttggttcgttacatcacatttcatacaacttacaggaatttcactaatatttttggcttctctgttactgactctggctaaaagagctttgggacattgtagtgagttggctcgtgctcttaaagctgctggagttttgctaactaattttctcagagtattcatactgtaaacatgttgtagcagattaaaaatacctataaaacacacaagcaaataagtgtaaaaattaaaatagctttaaaaagttcatctaaatgatgcatctcaaatctgaggctgaaatagtttcgacacctttgtttttcctttttttgtttttttttggtttttggtaaaacagtttaacaggaatcacatcatatataaaattgctgcaaagaagtctttcctttcaaaaaaaaatctacaatgcttcataaccctattggtagcaggcccttgtcatttcaagaaacaatgcagccttcactgaaacacatgtgtggaggagggaggtctgttatctgtgcaggtcgtaattcctggtcctctgtttaaacatgcagtggcatttcctatgtaattaaatttctaaatgtacaagcaaactttgtctacatattggcatgtataataaattattaattagaattgtcaaaaaccattaatttgaaatctgtagagcaagtcttcagcctcttgactgtaccatgagattcatttagaaattatttaaacacattaattaaaactaagtttaaatattctaaaattaatactgataaagaaggaaaattaaatcttcaagttatgttctgcttgtatttcatgatggagcagttatttgcacctggaataatttaaatagtaaaggtatatgaataaaacaaactttataattattatgtggtattttggggtggacatttccaattacagagtaaaaaagattaaaaaattctctcattactattagaattagacaaagatagaagtctagcttgagctattaaggcacgtttaaaatatatctaaaaaatgaaaatggttaatttttctaaattaacaacattcaaacttttcaatcccatagtttatgaaattggaggagcccttttatatgacaatctcaatttacaacatactttggttaattcatgtatgtaactactaatattgctattcattgaaatactccagtaaggcaatacccagttttaatggctaactttgtagggctgtggtattattctaattaatcactacatatgagttattaaatatttacagtattattcatttccatatctacattaacaccaatattggtatctattacatataaagctagtttttatgcaaagtaaaatgtatgatttaatttacaggaaagtctatttaaatattacagatgaacacacagctgttaggaaaaaaacctcgacaagttaacaattctgtcaataaatgttcattaaacaatgaataaacctttcactgaactaaagagcattcatctagtttaccaccccaaaccagtgtactagaattcatgacagcaagacttgggtttagctgttacactaataaacctacagatactcaaccacaatatggtggtctaaaaggaaaattaaggaagcccatacttctactaatgaacaggtaactaattacttctaacaaactatatgtttcgtctcgggaagactttgctctcaagacttaactcacctcctatccaggtagtgcatataaaaactcatctgagcaatttatatagaaaattattcttgccctccaatcactttattgagtatcatttacagtatatgtttagaagtaatttggaatcttggcttcaccctgatcaggttatagaaaggatatccaaatgaataattgctgtaatatgttgtaagcactaaatttgagtaatttgaaatatacaatatagtaacaaataaaagaaaaaaatctggtgcactaaataaaatgtttccaagggagaaacaggagtgatgggactcgaaacatagcaagaacaattaggagattgtttcaataattcaactgagatataagagatctgaaaataaactaggagtaatagagttggacagaaggtagttggaattgataaattggtcactaaggcatatagatttaaaagcatattatgggaggaggatagagatgggaaacaggaagacggccaggttttcagcttctggagatcatggctattattaagtagaagcaggggtactggggtgcaatagagatttcaggtttagacatgttgcaggggctgaaattgtggacacaaggatctagactacatcagggaagaaggttggaatagtgacctatattttaatgcatggttttgaatatgataaatatgtaatgattgcaaaaagaatatcaaattctgattgtccaggaagggagaaagatcagctaaagagagtaagatgatactgccacatggcttcatcagcagcacaagggataaacgaacaaaccatcattaacattttcaaactgggtccctgaattgtacttgagcctttgcaactcacctcacaaaatattcagtaataatattaaatataggactatttacaggatcacaccaaaaccaagccaagccaaataaacaaaaaaattctctactttgggcccaaaatggtattttgaagatttgtacattttacattatttcagt

SEQ ID NO: 35 - DNA, 3371 bp, Homo sapiens
aaaacacccactagagagtaggagtcaggaaactaagcaaaccatttaaccattctaagtctcagaatatttataaaaaattaaaatctaaagtttttccttcaatttacatggtcaacttcatttgtattaacgaaataccaaagaaactcttgtcaaatatcaaaaggagtgacttcctaaccaatacacttggtcttggagtctattaaaaaatcttcctgggatagaattttacctttatcaacatgcgtagaaacattttcataatgcgctttactgcttcagacatttggcaaaagtagatactttaaaaaattatgcaataccacaaacaagattttacctgaattcttcatagcaatatataaatgggttgttctattgatgtataaagatgtatatacaaagaggaaaataaaaacttaatatggaaaacgtattaatactagttaaatccaaagaagtcattacgagatttcattttaaattgactattctgaacttttttggataacaatgttgtgataattcactaattataacattcaaacatataagtcctcgacttttaaattctcactgtagtctaaggggttgtgtgcagacttaagaaaaaggcagtaaatccagtattgaaaagcccaggcttgccactgtaagcctgacttactatttgtgtgacctttagcaattttttaaaatgtattgtaataaaaaacatataacatggaatttaccatcttagccattttaaagtgtacagtagagtaattttaaaaatattcacattattgtgaaacagatctccaggaatttttcatcgtgcaattttgaaacactgtacccactggagcaacgtttaacttatttaagtctcagttttctcatctataaaaatggatgatgatagcaccatttatgactaaatgagacagtttctataaagcctataacataatacctggcacatatctagggctcactgaatgtagagaattattacatgagtgtctttaattgcatattaaatggaggagtgccttgtatattataatatgtagtatgatttcacaaaatatgtgtaaattaaagcttttaagatgcatttttaaaagctcattttatgtggtattcttgaagattcattttaaaatgattcttggtaagacacagaacattccctaatgtctatgtcttgtaaagttggaatggtcatcaggcagtttttaattggcattttctcagactcaagttcttcgttagcagattcattcatttatttagagacaccacccaggctgaaatgcagtggtgtgatcatggctcactgcagctttgacctctagggctcaagtgatcctcctgcctcagttgggagcataggcatgcaccaccacacctggctaatttttttatttttaatagaggcaaagtctcactacattactggtcgcaaactcctgggctcaagcaatccttccacttcagcctcccaacgtactgggattacaggtgtgagccactgcacccgttatactttatttaaacattctttttagtgtgcacttcagttaagggccgtcattgatcatgctgcatattataccaacagatctattttaatggatgttaatagttcaaaacatcatgggaatgccttcacagtcacaagtgagtaaaacattgtcctaatcctcaaggatttaaataggactagcgaaactcaccagcaactaaactgttacatcatgtagggtaggtgatgtaaaagatcaaatagttttttcattgtgtaaatatattacagcttatgtaccaattattctgtcaattgacttcagtgtttgggttgtttccatgtttttgctgttgcaaacagagctgctaaaaacattgtatataaccccagaggcaaaacaaagataaaacagaaccccagaacttgcttcattattgatcttttattgacagagagcaaaaaaactaagcagctgtggtaagcttgacgaaaatacaaaagtatactttatgtaatataaatatacctataaaaacaaagacacataagaatttctctcagaatttttgagttgaagtcaatgtttaactttacaagatggtatcaaattattttcccaagcgattgtaccattttacaacccttccctaacattaatagtgtataaacgatccaatttatccacatgccttccaacactcggttcagacagaattcttaattgttgccagtgtaatagtatggaactgtatctcatcacaatctccatgtgcatttccttgactagcgacttattacttttttaaacattaaaattattggctattactaaaaacataacacatgctggtaaggttgtggagtcaaagtaatgcttacacactgttgggaggagtgtaaattaattcaactgtcatggaaaacagtgtggcgattcctcaaatacctaaaatcagggaagggagagcattaggacaaacacctaatgcacgtggggcttaaaacctagatgacaacttgacaggtgcagcaaaccaccataccacatgtataccaatgtaacaaacctgcacattctgcacgtgtatcccagaacttaaagtaaactaaaaattaaaaataaatttaaaaaggaagaaagaaattccacttgaccgagcaatcctattactgggcataaacacaaaggaatgtaaatcattctattgtaaagacacatgcatgcttgtgttcactgcagcactattcacaatagcaaaaacatggaatcaacccaaaagcccatcaatgacagactggataaagaaaatgtgatacctgtacgccatagattactatgcagccataaaaaaaaaagaataagatcatgtcctttgcagggacatggatggagctggaggccattatccgtaccaagctaacacaggaatagaaaatcagatactggatgatctcacttataagtgggagctaaatgatgagaacacatagacacatagagtggagctacacacactggggcctgttggaggatggagggtaggaggaaggagagcatcaggaacagcaactaatgaatacaaggcttaatacctggatgttgaaataatctgtataacaaacccccgtgacacacatttactcatgtaacaaacctgcacatcctgcacatgtacccctaaacctaaacataaacataaaataaaaattgaaattctggaacttctaaaaaaaatttagatgcaacttcaagatatagatagtcaattaaataaaggttgaaacacaggcagaatttaggtaaatggggaaagaaaatgacttctaggagaggaagattgcaaaacca

SEQ ID NO: 36 - DNA, 41176 bp, Homo sapiens
  misc_feature (39114)..(39114): n is a, c, g, or t
  misc_feature (39134)..(39134): n is a, c, g, or t
  misc_feature (39136)..(39138): n is a, c, g, or t
  misc_feature (39140)..(39141): n is a, c, g, or t
  misc_feature (39143)..(39143): n is a, c, g, or t
  misc_feature (39238)..(39238): n is a, c, g, or t
  misc_feature (39242)..(39242): n is a, c, g, or t
  misc_feature (39248)..(39248): n is a, c, g, or t
  misc_feature (39258)..(39258): n is a, c, g, or t
  misc_feature (39285)..(39285): n is a, c, g, or t
  misc_feature (39289)..(39289): n is a, c, g, or t
  misc_feature (40493)..(40493): n is a, c, g, or t
tatcagtgaaagtgctgtggacatcactgtgaccgaacctgctgatttaatttctgtcacaagagctcccacataggtttcccaggggtagtctggaggctcagtgatgagctgccacctccatgagtggctctgtcaacccctcctccacccacctcttggtggtagaatggctgccacagccccacacttttcatctcctcccatggccctttggatggccatggatccctcctccctcagcagacctccctcacagaactgcatctggaccatcctccaaaatcagagtgctgctatgatgggggaggcagggtcattggtcaggagagccagcccaacatttgctgagccctcttcctcctagccctggccattccttcatcctttcccattctcaccctcaatacctattccagccttggagctccagacaccatctttgtgacagtgactcacaagtgcacctccagcctggcctctctctctgctccacgctcttgtttctggagcctgctccacatctccatctccactaccaataaagttctcccagtcaccatgccagaaaggaactcaaggtcttctcaaaatccctttcttaccctatgttctccacttttacaaatgggccactgcccacctgtccatctctagtgctcattctcttctacctatttgcctctgcgtgtgccctgcctctttaccagtccaccttggtaaatggcccactgtggcactttttcaaaaagtttattttctattttgcattattttttgagacagggtcttgctctgtcacccaggctggagtgcagtggtgtgatcatggctcactgcagccttggcatcctgagctcaagtgatcctcctgcctcagcctcccaagtagctgggactacaggtgcaccaccatgctcagctaatgtttctgttttgggggggttttgccacgttgcctaggctggtctcaaactgccgagctcaagcaatccgcctgccttagcctcccaaagtgttgggattacaggcatgagccaccgtgcctgcctggcctgcccccctcccttttttttttttttttttttttttgagacggagtctcgctctgtcgtccaggctggagtgcagtggcatgatctcagctcactgcaagctccacctcccgggttcacgccattctcctgcctcagcctcccgagtagctgggactacaggcgcctgccaccatgcccagctattttttttttttgtatttttattagagacggggtttcaccatgttagccaggatggtctcgatctcctgaccttgtgatctgcccgcctcggcctcccaaagtgctgggattacacgcccggccttttttgtttgtttttttacttttgagacagggtctcgctctttcacccaggctggagtgcagtgggtgaccatagctcactgcagcctctgaacacctgggcttaagaggttctcccacctcggcctcccaagtagttgggagcacaggcacacgccaccatgcctggctaatttaaaaaaaattatagatagggtctcactatgttgcccaggctggtctagaacttctgacctcaagcaatccacctgcctcagcctcccaaagctctgaggttacaggtgtgagccaccgtgcctggccactctggcgcctctgaaacatgctggcaggttctctgatgctgctccctttgggagtttaattgggtttcttcctgaaacatgggctggccttcacgacttgcttgtaatccatagaatgcagcagaactgacatcgtgtggtttctgaggccaagtcacacacagagtcacacagatcagatcagcaacccaactccttctctctctctcacacatcttgggatgcttgatctttacacccagccaccatgctgtgaggggcacaggcagcctcgggagaggataggcgtgttcctgccagcagcaccagctgaaggacccatccaccccctgcacgggtcacctacaagtgagtgaggaagccttccagatggctctggccccggccaccattggactgcaaccacaggagacaccaaaactgagaatcccctccctgagcccagtcaagccccatgactatgaaatataataaaatagatgatgctgggtgtttttactgcaccaagtttgatgtggtttgttatataactatagataagcagaacgggatctggtactggaagtggggtgggtgctgctgatacaaaacctaaatcatgtgacattggctttgggatggggcagtgtccaggagctgggaggaccttgcagaggctgacagtggggacttagaggaaagtgaagaaattgttactggaagatggaggaaagaagaccattgttatgcagtggcaggaagtttagcaacattgtcacctgtagccaaataggaaatagaagctagatagtattcccaagaataaaatgatctaaggacatacccagagagaaagttcaaggtgctacttggcttcttctagctaccaataataaaaagaaagaagatatgattcaaaaagcaagatttagggccgggcatggaggcttactcctgttatcccaatgctttgggaagctgaggtgggagaatcacttgaggccaggagttcaagaccagcctgggcaacatagcaagaccctcatctctataaagaaaagttttttctttaagatggagtcttgctctgttgcccaggctggagtgcagtggtgtaatctctgctcactgcaacctccgcctcctgggttcaagcaattttcgtgcctcagcctcccgagtagctgggattacaggtgtgtgccaccatgcccaactaatttttttgtatttttagtagagacggagtttctccctgttggccaggctggtcttgaactcgtgacctcaggtgatccgaccgcctcagcctcccaaagtgctgggattacaggcgtgagccaccttgactcatcaccctggagcttcaggtacttctcttgatgtcctcatctcctaacatccttcctcttcctccccctcccctcccccttcccctccccctcccctccccctcacctccccctcaccctccccctccccttcccctccccctcctcctccttcttcttctccttcttcttttcttttcttttcttttctttttttttttattttccaagacagagtctcactctgtcacccaggctggagtgcagcagtgtgatcttggctcactgcagcctgcctctgccttccaggttcaagcaattcttgtgcctcagccacctgagtagctggattccaggcatgcactgacatacccggctaattttttgtatttttaatagagatggggtttcaccatgttgcccagcctggtctcgaactcctgacctcaggtgatctgcccatctcagcctcccaaagtgctgggattacaggagtgagctactgcaccaggccctcatctcttaacttctaatcttgctctgtccaggtccctgaaccaaccagctcaactatttgctacagctggtgggtcttgcaggttctgcctttgcagagtggatggcacagtgctcacagaaactctgccgtttgggagtctttgccctcatgctccactgccgttcagggctgcctgagtgagctgtggggcagatgtcataagtgaggccacatgggatggcagtcacctgctttcacagcttacgtgtgtcctctggacttgctgagagctgatcctcgtaatgccacttctgttgtgtggatggttggtaccttgagacctggtggcttggccaagcacagtggctcacgcctgtaatcccagcactttgggaggccgaggcaggaggattgcttgagctcaggagttggagaccagcctgggcaacatagcaagaccttgtctctacaataaataaaaaaattagctgggcgtggtggcatgtgcttggggtcccagctactcagaaggctaaagcgagaggatcgcctgaaagatcgcctgaacgagttcgaggctgcagtgagccgagatcaaaccactgcacttcagcctgagtaacagaacaagaccctgtctcaaaaaataaaataaataaagcctggcatggtggctcatgcctgtaatcccagcactctgggaggacaaggtgggtggattacctgaggtcaggagtaccagaccagcctggccaacatggtgaaaccccgtctctactaaaaatacaaaaattagctgggcgtggtggcaggcatctataatccgagctactcgggaggctgaggctggagaatcgctttaacccaggaggctaagttgcagtgagccaagatcacaccagtgcactccagcctaggtaacagagcgagactgtgtctcaaaataaaataaaataataaaataaaataaataaaagacccagtgggtgtctctgacaatacccagctctaatgagccttctggtcactcagtagcccatcgtcagatgcccagttcctgccagggcccagaaacgtggaaggagctgttttgttttgttttgttttttgagatggagtctcgctctgtctcccaggctggagtgcagtggcgcaatctcagctcactgcaacctccgcgtcccaggttcaagtgattctcctgcctcagcttcccgagtagctgggactacagacacctgccaccacgcccggctattttgtgaatggtatgtggcatggccttgctccagaaccctaggagtgggcactgccacccttccactgcagcctgctgaaggcgccacatgaaacctttctctgccaagcgttggccatggctctgtcaggtcacagggtcaggctcagggctgctggtaccacagcctggacctgcagcaaatcccatactgccctaggctctactaaaagctggcatcctccatatcacccacaaatttcttgggcagtattcccaagttttttccgcctccaaatcgcaaagaagcctcaccctgttgtgttctttcatagtggtgagaggagctgggcgctcgcccttcgccttggaggagttgctctggcatcccaggccgctgggctcccagaggctgcttttttttttgtctcttcttcattaccggtttgtgagagttctttgtatatttaagatactagtcccttatcagatatatgatttgcaaatattttctctcattctgtgggcagtttttactttttccttttctttcttttttttttttccagagacagagtctcgctctgtcgcccaggctggagtgcagtggcgcgatctcggctcactgcaagctccgcctcccaggttcacgccatactcctgcctcagcctccccagttgctgggactacaggtgcccgccaccatgcccggctaacttttgtgtttttagtagggatgaggttttgccatgttggccaggctggtctgaccttaggtgatccgcccacctcggcctcccaaagtgctgggattataggagtgagccactgcacccagcctttacctttttttttttgaaacaaggtctcactctgtcgcccaggctggagtgcagtggcatgatcatagctcactgcagccttgacctccttggctcaagccatctttccatctcagcctcttgagtagctgggaatacagccaaatgccaccatgcctggctaattgtaaaaaatatatatatacgtatacacacacacacacacacacacatatatatatttgtagagacaaggtcttgctggcctggcacagtggctcatgcctgtaatcccagcactttgtgaagctgagatgggcggatcacctgaggtcaggagttcgagagcagccaagccaacatggtgaaaccccgtttctactaaaaatacaaaaattagctgggcgtggtggcgtaggcctgtgtcccagctactagggagtcaaaaaaaaaattgagacaaggtctggctatgttgcccaggctggtctcgaactcctggggtcaagcagtccttccacttcagccacccacagtgctgagattacaggtgtgagccattgcgcctgcccgttttttgcctttttatttttagagacaaggtctcactatattgcccagactggtctcaatctcctgggctcaagtgatcctccagccacaggctcccgaatagctggaagtccagacgctcaccagcatgcctggcttcagctggcattttaataggagttatattgaatctgtagattagttttcggagcaatgccatctcaacaatatttaactcttccaagccatgaacattagatgtcttccatttatttagtgctttgatctctttcaacaatgttttgtagttttcagagtttaagttttcattttgtttacatttgttccctaatattttgttcttttttttttttttttttttttttgacagagtctcactctgttaccaggctggagtgcagtggtgtgatcttggcccactgcaatctccgcctcctgggtttgattcccctgcctcagcctcccgaatagctggcactgtaggcgtgcaccaccacacccagctaatttttttttttttttttgtattttagtagagatggggtttcaccatgttggccaagatggtcttgatctcctgacctcgtgatccgccctccttggcctcccaaagtgctgggcttacaggcgtgagccaccgtgcccggccaatactgatgcattttatttctttttcctacctaattgtagagctttcttttcttttttctttttctttttcttttttttttgagacagagtctcactctgttgcccagctggagtgcagtggcatgatcttggcctactgcaacctctgcctcctaggttcaagtgattctcctgcctcagcctcctgggtagctgggattacaggcacgcaccaccacgcctggctaatttttgtatatttttagtagagacggggtttcgctatgttggccaagcttgtcttgaactcgtgatctcaggtgatccacctgcctcgttctcccaaaatgctaggatcataggcgtgagccactgtgcccagcttagagctttcaatacaatgttgaattgaagtggcgagagtgtacatccttgtgttgttcctgatcttagaggaaaatgattcggtcttcaccattgagtgtgatggtagctgaggatttttcataggtgccctttatcaagttgtggaagtgtccttctttttttttttgagacaaagtctcactctgtcgcccaggctggagtgtagtgacgcaatctcctctcactgcaaccttgcaatctccgcctcccgggttcaagcagttctcctgcctcagcatcccgagtagctgggattgcaggtgcgtgccatcaagcccggctaatttttgtattttcagtagagatgggttttcaccatgttagtcaggctggtcttgaactcctgacctcatgatcttcccgcctcggcttcccaaagtgctaggattataggcgtgagccaccgcgcccagcgtgtccttctagttttgggattaaacaacatgatccactggtttttgcaggagccagataatgtattaaactgggatttgctaaagaccacattgcaacctcctttcaatctttatttatttattttttgagacagggtcttgatctgtcactcaggctggagtgcagtggtgtgatcaacactcactgcaacctcaccatcctgggccctggtgattctcttgcctcagcctcctgggtagctggcactgcaggcatgcaccatcgtgccgggctaaattttgtgtttttttatagagacagggtctcactatgttgcctaggctggtctcaaactactaggctcaagcgagccccctgcctcagcctcccaaagtgctgggattacaaggcatgaccagccactcccggccatcctttcaattttcaactgagacctctaagctctgctatccttcctgggacgcagcactgtatttttttcttttgagacggagtcttgctctgtcgcccaggctggagtgcagtggcgcaatctcggctcactgcaagctccgcctcctgggttcacgccattctcctgcctcagcctcctgagtagctgggactacaggcgcccgccaccacacccagctgatttttttgtatttttaatagagacgaggtttcaccatgttagccaggatggtctcgatctcctgacctcgtgatctgcccgcctcagcctcccaaagtgctaggattacaggcatgagccaccgcgcccggccagcactgttttttttatcttggtaggggcagttcaggaactttcatgtagcctttattgcaaaacaggtctcacttttgagaactgaaagtaaaatcctaagcactcccaccaactgaaaagatcccccttgaccaaaggaccccagagaaaccttaaaaactgagttaacagccatgacaggacagaaggtcagacatgcctcgctgtaccctgtcccttttgtggtttaggcacaactgaccaacattaatgttaaaatagagatcataagactgacagaagagactctggcaaaacgataccaaattataaacaggaccaaaggccatgctaggcaaggattaagtcatgcacccctatacttaaagaagaaactatattctgtcacaggtggtttttttttcctctaacagttaaacaagcactagcctcaagataaacaatattaaaacaattacaactcaaccactgccagacactcactgaccctcctgttgtacaagccacaactacagctttgataggacatgagactggatttagtaactttcttctgataaaaagaccatccaccctagactggttctggctggttacagaggctgcacacttgcgtgccttcacgtccgtccctacttcaccttctgacgtgtagggcctaattgtaatgcatttaaatgtgaagtctccgccccaaagtaaacatggctgcatgggacatgcgtatttgcttctcacatatgcacatgttcccccttcatgaatattcacagctcctcctagatcctgttaaatatgtatacttggctggcctggtgcggtggctcacgcctgtaatcccagcactttgggaggctgaggcaggtggatcatgaggtcaggagatcaagaccatcctggctaacacggtgaaaccctatctctactaaaaatacaaaaaaattagctgggcgtggtggcgggcacctgtagtcccagctactcaggagaccgaggcaggagaatggtgtgaatctgggaggtggagcttgcattgagccaagatcgtgccactggactgcagcctgggagacaaagtgagactccatctcaaaaaatatatatatacacacacacacacacacacacacacatatatatacatatatatatacgtacacatatatatacacatatatatacgtacacatatatatacacacatatatatatacacatatatacacacatatatacacatatatatacacatatatatacacatatatatacacatatatacacatatatatacacatatatacacatatatatacacatatatatatatgtatacttggctctcctattcagcataaattcctgtttcaccgctctcatcctaaacatgcctgtcttttgatctctgcgagaggctacacttcccagcctggccgccttgcaggctataaccctttataagaaataaagttggcagagcacagggctcatgcctgtaaccccatagtcccagcactttggaaggctgaggtgggaggatcacttgaggccaggagttggagaccagtctgggcaacatagtgagaccccatctctacaaaaaataaaaaaattagcaggtatggtagcgtgcacctgtggcctcagctacttgggaagctgagaggggaggatctcttgagccccagaatttgagactgcagtgagctatgattgtgccactgctctgcagcctgggtgacagagtgagactgtctctagagaaaagaaaataaataaagtctcctttctaaatttataaattgtgtgatttttcagttggcactctacaggttagaaatcactgtgaaagttctgccaaatactaaatatgtctattccaattatgcattcagaaactgcagaaataacctgtgagtagctcatgaattgctgggcccactgtgggatggaattgggccaggactttgcgtactgcccggctgtctgtgctcctgctctagcagggaggccatgagggcactttgggtcccaggaatcagtgctgacttggagccagtatccaacagcactaaaaagatctgggttttccctttccccagcgcacagctacctgagtaagcggaaacaggccccttcgtgaaaggatgaggggaatcactactagaagtacctttcatggtgttcctggctccttcctcatgggaaggagacttcagcagaggaggtctgggcctgagaactggctggacactgggcgacactgagacatttcagtgggcaggtgacctgacctcagccttttgcccttctattatttttacttatgtttttaaatgtaaaataaagacagcatagcatttaccattttaacctttttgtttgtttgtttgtttttggtagaggggatcttgctctgtcacccaggctggagtacagtggtgcagtcatggctcactgcagcctcgatctcctgggctcaagcgattctcccacctcagcctctggttgctggaaccataggcatccaccatgtgtacctaatttttgtatatttgtagagactgggtctcacttatttgcccagattcattttaaccttttctacgtgtgcaatacaagtgtgcattaaggatatccacaaggctgtgtaaccctctccgcgaccattcccagagctttcctaatcagaaaactgtaaccattgcacagtaattgcccttccctgaactcccagcccccggcgagcggggctcatggctgaataacactgcactgcatgtgcagactacattttgtttatccacttatccctccagggtccttgggttgtttccaccctctggctgctgtgaatagcgctgctgtgaacatgggtgtaatgcgcttgcttcagttcctgcattcagcccttctgggtatatactgaggagaggaattgctggggcgcatggtaattctatgtttagggttttgaggatccactgaacttttccacagctgcatcttacattcccaccaggttcccataaaagttctactttatccacgtcctcaacaacatttgttattttctggttttaaaatgtatagacatcctagtggggatgaagtatttttctcattctgacttttttttttttttttttttttgagatggagtcttgctctgtcacccaggctggagtgaaagtggtgcgatcttggctcatcgcaacctccatctcctggttcaagtgattctcgtgcctcagcctcctgagtagctgggattacaggcgcccgccactacactcagcaaatttttgtatttttaatagagatgggtttcgctaggttggccaggctggtctcgaactcctggcctcaagtgattggccagccttggcctcccaaagtactgggatcacaggtgtgagctattgtgcccagcctctttgcttatttatttatttatttatttatttttatttatttttttgagactgagtttcgctcttggcccccaggctagagtgcagtggcacaatctcagctcactgcaacctccgcctcctgggttcaagcaattctcctgcctcagcctcccgagtagctgggattacaggtggctgccaccacacccagctaattttgtatttttagtggagacagggtttcactacgttggccaggctgatcgtgaactcctgacctcaggtgatctgcccaccttggcctcccaaagtgctgggattacagatatgagccaccgtgctcgtcctctttgctcatttttaatgtttttttcttttttcttcttcttcttttttttttttgagagagtctcgctctgtggcctaggctggagtgcagtggctattcacggctcactgcagccttgaaatcctaggctcaggtgattgcgtgagccaccatgcccagccagttgtttgttgttgttgttgtgttgacttacattattttttccaatatttcatcatgaaaattttgatgaaattttcatcaaaatattcagataatttgaagggatattcactgtctagattattcaattattagtattttgctatagttgatttatcactatgtatgcattcgtcttttatttttacaaatggggtcttggtatgttgcccaggcttgtcttgaactcctggactcaagtgatcttcccgcctcagcctcccaaattgctgagattataggcgggagccacagcagcaggccaggattgttttttattaattttccagtggcctgccaatggtatatataaatccagtccatgtttgtgtagtcatctggtaactgttttagcatcccagcacacagtcaagaaaaataaactttaaaaataactaaaataactaaataactaaatggcccaggcacggtggcttacgcttgtaatcccagaactttgggaggccaaggcgggtggattgcctgaggtcaggagttggagaccatcctggccaacatagtgaaaccctgtctctactaaaaatacaaaaaattaaccaggcatggtggcgggtgcctgtaatcccagctacttgggaggctgaggcaggagagtcacttgaacccgggaggaggaggttgcaatgagccgagattgcgccattgcactccagcttgggtaacaagagtgaaactctgtctcaaataaataaataaaataactaaatggaaattctagaactgaaaaatgcaacatgagaaataaaaaattccctaaataggcttaacagcagaagaaagataacagtataacagaagagtcagtttgagactagccggataatagaaattatccaatctggggtgggatggtggctcgcacttgtaatctcagcactttgggaagccaaggcaagcaggtcacttgagctcaggagttagagaccagcctgggcaacatggcaaaaccccacttgaatttctacgaaaaatacaaaagttagccgggcatggtggcacatgcctgtagtgccagatactcggaggtggaggcgggaggattgcttgagcccaggaggttgaggatacagtgagccaagatcacaccactgcactccaacctgggtgacagagcgagactccatcttaaaaaaaaaaaaaatcctggcactttgggaggctgaggagggcagatcgcttgagcccaggagttcaagaccagcctgggcaacatagagagacccccatctctataaaaaatacaaaaaattagccaggggtggtggtgcacacctggagtcccagctactcaggaagctgaggtgggaggatcacctgagcctggggaggtcaagactgcattgagccatgatcctgccactgcactccagcctgggtgacagagcaagactccatctcaaaaaaaacaaaagcaagtaaaagaagattttttttgtatagagtcaataatatataaaagggcaaaaataggccgggtgcggtggctcacgctgtaatcccagcactttgggaggccaaggtgggcaaatcacgaggtcaggagatcgagaccatcctggctaacacggtgaaaccccgtctctactaaaaaatacaaaaaattagctgggcctggtggcggccacctgtagtcccagctacttgggaggctgaggcaggagaatggcgtgaacctgggaggcggagctggcagtaagccgagatcacgccactgcactccagcctgggcgacagagcaagactccatctcagaaaaaaaaaaaaaaaaaaaaaaggcaaaaatagagaaaataatgaagccaaagataaacaaaattaataaactaaactgaatcagaaaaaaggaacactaattactaatatcaggactgagggaagggatgtaactatagattctgcagaatttaaaagaataataagggaatataatgaacaactttattaataatctatagttaacctgcagttaatatcatactttctggcaaaacgttggttattttctccctaaaattaagagtaaagtaaggatatccatgacacttctattcaacgttgtcctggaggttttagtcagtgcaataaagcaagaaaaatatagaaaaggtataaagggcttggcatggtggctcatgcctataatcccagcattttgggaggccgaggctggaggatcacttgaggccaggagtttgaaaacagcctaggcaacatagtgagaccttgtctctaaaaaatattttttaaaaattagcagggcatggtggtgcacacctgtagtcccaactacttgggaggctgaggtgggacgatcacttgagcctgggagttggaggctgcagtaagctatgatcatgccactgcactcctgcctgggcaccagagcaagactccatgtcaaataaacccctcaaggccgggcgcggtggctcacgcctgtaatcccagcactttgggagaccaaggcgggtggatcacgaggtcagcagttcgagaccagcctgaccagcatggtgaaaccccatctctactaaaaatacaaaaaaaattagctgggcatggcggtgggcacctgtaatcccagctacttgggaggctgaggcagaattgcttgaaaccagaaggcagaggttgcagtgagcctagattgcaacactgcagtgtagcctgggcaatgagagcaaaactctgtctcaaaaaaaaaaaaaaactctcaaaataaaaaacctaagtgcgcaaggccatccactcagatacaccgccccacacatcagcgtcccaccccttcactatcaggctgtcactttgctgtgagagccttgtttaggttgagatcccctgcttctcctggagttcggctgtgctccactaacccccggggcctcatcttcatttctgtccacccgccggccagtctctgcatgtgccagctgggctctgatgcggggcactctgcttcatgctgttgatcggtgtgtctggatctgtcatgttctctcctcaaggaatcaacagtgcttagcaacagcctctcagtcccatggctcttggagttcctccccacctctcaggtgcccagggcactgcaccagtgacactgcctccaaatgtctcccatcccagttccccctggtgacagttcttactgtcacactgtgacccaggccgggggctgtcagttctccacctgacaccttggcatctacgaggatggaacaccacaaaatgctggaaacacgagaagagtgacagctcctcgttgccaccctgccggcgcaggagccaatttcagagtgctgtccttcaggtgggcttcccagggccacccaccagacacccactgttgaggtcgagttccctagaagcaaagcctgaagcaaggattcttgttctcgggctgttgctgagcgtgtgcccaggagagtgaggaagtctgtgctgccttccggtggtgctgagccctgaacggtttccaacaggagcttacttgttcatacttccagaggtcaggaacccagatcagggtgtcagcagtgtcgtgctctcggaaggctccaggggacagtctacccggtgcccttctcccagcatctggccttgctggacccactgggcattccttggctcacaaatgccccctcccatctccaccttggtcaccacatggtcttctcctgtatgtggctcttctcttctgaggacttcatcagtcttactgggttaaggacataccctactccggtatgacttcatcttcatttgcatggttcttgttgttgtctggtttacaggcagggtcttgctctcttggccaggctgaagtgcagtgatgtggtcacagctcagtgcagcctcaaccttctgggctcaagcaatcttctcacctcagcctccaaagtagctggtaccacagatgtgtaccaacatgcccagctagttaatttaagtgtaattacatctgcaaagatcttatttctaaataagttcacattcacagataggatgagcgaggactttggcatctctttgggagacacaacagaaacctagagggactccccatcctgatttgcctgtgactttcccaggttttggtgctgacagccctgctttccgggaaattccttagtcttgggaaaactgagatgcctggtcaccgtggaagtaggacagggctgggtggtagagtgcagactgctgagcagaaagctgtctctgttacaggtcagttttcatcattccacatggaaccgctgtggcagacactgagaacttcacagatctgaaccacctttcggcaaagcagggatgcccaggtatcagccattgtcagggttctgcctctgggtctggagggctgctgtgtgggtggctctcattccccaggacaattctccaagaccaaggtggccatgagccaccaggaggcaacagtcagcagctggggaccagtaggctgacccctaaaggggatctgaatagagccatctatgcacacccatccccttgtcttcccagtaaatggcccgcggccccacctactcacctgggtaaacacacacctcgactcctgtgcaccttggtaaacacacacctgtccgtccaggtaaatgccccactcactcacctgtgcaccttggtaaacacacacctgtccgtccaggtagatgccccactcactcacctgtgcagcgctcacctgactctagagctgctcaaggctcagctggtgggcaatgcttagcactccctactcccacctcggatctcatcgtccacctccagctccatctggtattgcccacgcctgtccctctgcactgcctccaccttggcgccagtcgtagatgtctgccaccggcacccccacagtggctggcttttgaacccactcccagcaacttttctctcctgtcctcctccccaaagtgagcctccccgagaggcgtcaatgcttgccacaaacagaagtcccatcatggcaccctcacttcagatgcccggagtgagtggtcctcagtccctggaagccctggactctgccacctctcccatctgtcccctccctcctcactctcagctgcccaggtccctggtcagctccttcaatgcatccaccctggctccttgacgccctatcctggggctcctggcacctctgcaagggggccttccctactgtccccacctgcacctctctagacaatcccagtgctcccggctgccaccatttctttccccgactaaagaacagacctgactgtttccaggactggatgaaactgaggcagatgaagagggcagggatctggaggggctgggggagaattagaggccacagaggaatggagctttgggtgggcacggacagaccactggatttggacagtcagggccgggacgcaggagcagctagggcccagggagccgggggttaggtccctcagatcccgcacatgcaaaagtgaggctgaggtaggggggtggtccctcggcatgtgagcccagggggttcccgagccaagtggcagccggaacagtggggagggacagccaaggaggtggggaggggtcgctggccccgctcagggctggttggggtggaggaagcccgggcccaggccgccccccgctgggtcgaggccaccccgcctcgagggcgcggccgtccggatctcctgattgctttctttcatctctgttcctttctcagccacaaacgcccgctaatgcctcttttatcacggaattaggggatttagggccggtcgcacaaaggggccctcgatagcggccataatcaaaccccaatcggccgaccttggacgggccggggaagaaaggagcgccggggattagcgcggtaccgcggccgggcaggcagagatagcatcggcgccgctgcggggctgaagccgcggagggctcggccgcgctcggagaaaggacggcttagctcctggagccggggattctgaagccattaggtggggattaacacccaagttaatctgctttggtcgctcaattgtcagcagcgaacgcgcgggactgaggaagcctggctcccagcgaccacagggccttgccacccagcagtccagagctacgagctggtatcagtttccccagctgtcacccggccaaggcgggccttggagccaaaagggagatgcacaccttggtgggctggccaacgggtctggatgagtggaccccctgccccgccagccttcctgggtaatcagggaactcagagaaggatgttcctgccccatcctgacccagaccacttgtggaccctgacagccagtgcagccctgggtgccacccacacactgagcttgggttgcacggcaacatgcatgacacacctgtccccatcaagcagggtcagggggcagcctgcagactgggtggacgctgacagcagctagcagcccccttgcagaccctccatcttccctttggggtccctgtccaggtatagccccctaaagacctctgttgaccaactcactgacagggcagatgtgacaccacctgctctcaattcatcctcactcttcatcttcagtcctctctcactaggcggcagagggagggactggacctatacaggtcccaggtaggtcctttgtctctgtctgggttttcctatctgaggaatggagccggctaaggaaaggcccaaccagaatgtgccagtgtcgtgtgtggcctgtgctcactgctatcttctgtggggacgcaaccccaaccctgactccttctcctgttcctgccagcaggcccccagagtaggtggctcagaggggtgtgcttacacctgcctcctcctccatggagatgtggcaaggtcactgtgccttacatgagcctacaggcagcaacaagtggctggactggagctgaccaggcaggcaggatggggtgggcagtagcagaggagaggccagtggagcgctctgggtccccatcttctttcccatggctgagactagggacattggaacaaaaagtcccaagtggaggaaaagacgcagtcataagtacatttgtctttccttccctctcatctcccttcctccctttcttccttcagcagtgaccaacgattctcccatccaggccctgtggaggggacacaggcgtgagccacagacccaggctctgccctctgggagcttgggtccgaggacacagttagacaaccggatgggagggcgcccttcgggaaggggaaacaggcaccccacatgcacagggccaggcagggcctgaagggcagtgtgaattacagggaaaatgcggagggagaggaagagtgctccagggcgaggaagccgcgcccgcagcgatctggagtgcggtggggagcaggtgaggcgggagaagcccagttctgggacacgcaggccagctctaggcaggggaaaggaggggcgggaggccagggaatgttccctcaggctggtgcgtcagaatggcccaggcagcctccagcgtgggcccccgctggtcccgggaggcgccgccagaggctcggggagggtggacgatgtggctgggccggcgagaatccaggggctgcaggcaaggacggggactcgcgatgaaacccgaagatcaggggctggtggcagtgaccgcgaggggcctccaagcagcccaatcaatctcggacgaggggtcgagtcagtggcggtgcaggcggcaaaggcagccagggtctgagcagcgcggctccagccccagcagcaacgggagagcgcgtgcgccgccccagacgactggacgcgccctcgtgacgccatcagcgcgcgccgccccaacttccgagcgcaagcgtggtcgcccccacagcctgtgggctacgggaacgcgatccgactcggcggccctccctgcctggatggccggtccccgaggctgaggaagtccattcctctttcggaaatggtccccaggaagcttctccgtgtccccctatggccgggtactgagcggggcccgggtggtctgcggccgtggcccccgcccctcagcgcaggcgaccctcctggccctggcgggcacagcgcctctcccgtgacctgggccggcccgcaggatgagcccccggatcacgatcgctggcattttatttaccttcttccattacaaccccaggcgagtctcccgggccccgagaggagggggtgactggtcagggtcatcggtagcggcggcaggggcctgcatagggctgcctcggggcgactagcagaatggccgccagcctcggctgccccagcccccagcgcatggaatgtgccccgggccccaggagctccaggaaccgcgcttgtgagacggagcttcggctgcttggagctagtgagccaccggccacggcagggatttgagcagaacttgggggcagagggatgagatggtgcatcccttgaggtcacttcaggagatgacactcctgtggctaagtgtagcttcccaggtcatggctcccaggtcaggcctggtcaatggagaattaagtgggcgttgggtggtggatggatgtgatttggcagaggggacaaatgtgacaacagtgtaataagggccatgttggggagggtcaggggtcagggtccggcccaacctgagcagaagggaggctgctctcagggatatttgtcaggtaggaatgggtggagtggaactacagggccaccatgtttcccatgggtcacccatggtggccttgtcatgtttatccgtgatcctcagtgttctctgtggtcctcccgtcacccctttcagactgtcctttcagttctccactgtccctgcatcacctctgcccctgtcccgtttgtctgtgttcagtccatgttcccaggtcttgaggtggcccctggttctatgccccttacctaagaccctgtgcagggaatctgtgaaaacacagaggaaataaaaagtgaggaaaatagtactcttgcatcctcgaccaagatagtgtttgttgtgagtgctgagacggaccagcattctctttgttggtgaagaggagacagacccatccacaggagtcattggcttttttgaatactaagctctgactgccattcatcatctacacagggacagaaaacccggtctgggggacgtggcacgcagcagtgtgtgaggggaatgccaaggaatctggggagcgtcaaggaatctggggagcgggaagatggagcggggtagctgcctggaggcctcagtcccacagcagtgaggacaaggctggaggttagccaagccctgccctaggtgtggtcacgacctcaccagctcccttttccttttctctgaggccattgtctctcctgggcacagtccgtaaggttcagattccagactgtgactttaactggtcaccgtggctctggctggagcaggacatggtgacctggagtctccatccactcctccgatgtgcacttagccacctcctggggctctccccagcactggccgagcatcctggttagtggggaaacgtggagcaccaggctagaaatcaagacccttctgcctgcagactagcttggagacccatccacgtgtctctgctcctctgccccttaagggcaggtgcgccccagtgttcttagtctgtgctactccctgctgcgggcctcctctctgcagtctggttaaatgcaacttggctccctccaggcccctgcctgcctctccagcctccagctctttcctgcacagacacctttccccttgggtctcagctccaagactggaggctgcttgcttcttgagggaatgtgtgaagcagcctacagtgtgggttctatctaccagagtacgtggctcctccatgctcgtggccccaagggactcagacccagctcaatcaacatttctggctgggctatctgatgtctgccgtgtgattcaaaggtgattcgaggtgaccctgaggatggcaggggtccagggagggtggagacccatgccatcctacaccctgctctcacctagtgcagcctcggccccttcctgtggagagggacagggacaggactcggtgcaggtgtgcagtgagtggctggcatctctggaggtcagtatgtgagggtgggggtcccctccaggcagctgcgagggcttggctgctcccagaactgcctggaacctggggagactgtaaacaacctcttgcaaccccaagaataaagctgccatgtgtgagggcttgctctgagctaagcatgattctgagcaccggcagggagtacagcaagtggatgctgaggcctggagggcaggccccagagagctgagtgcccctccaggtttcatggctggcactgtggaccagtgtggcccactgcctgcttgccaccccacaacaaagcttcagaggtgcagaaccagtggcctgagctccagggacaggaagcatcttggcgtggggttctcatggtggcacttgcatgccctagtgcacaggggcggaaggggaagctctgttgcctgggccctttctctgtggcaacagatggggaagtctgccgtgaggatagagagtgcatggccatcccatcacagcacaggttgagtgctgagccaccccgagccctccccagcccagcggctctccccaaggaggcttcaaaaccccgtgctccctttgtacccccaagcccatgcttggctctcagatccacctcgggccctttgcaccccagactcctccccagctgcacattcccgggattccaggcatctggtgctgtgtgaggtcactaggacagggcagtctccccagggacgggacctgttcacatggagtttctggctggcaaaagcttgttctccagtctgagccaaacgcttgcatgactcttcccccacggaggcacttggacaggaagctggcttctctgcacagccaggggcactaagtgatcccatcctgcctgagcgtcctccacgtggctcataggctgtggaaagaggggcttggccccatggggacatgccagttcagagctctggcctccagccagagggacacctttctctgaggctcatggctgtggcatgaggtgcccagagagccctggtcaggcagccccacctcctgctgccccagggcagctgcctcccagcccaggtgaaggaacaagggagggcccctgcccagagcctttgggtagcagatgccagacacccacccccacctggagttcagaggcctcaacgtgcccccatctcctcctccccacgagcagcccatttcactcactgaggagctgggcataccccagaggggccctgggcaacccaacccttccctaagcttccctgtgggtgaggggcaggcagtcgtcctgggggctccatctcctgggcccagccccctgctctgaacactctgccaggccacccctaggccttgtcaacacacccttttacccatgccacgggatcttgcccagaggccacagggaaggccagggtgcacccagatccttcttggcctggcgctgggcttctcagggagccaacactgtggccacagctgctctgccctgggtggacactaggctttccctgtccccctactgcagtgtcctcagatgggggtggcctggtcccctgcagaggcacagccaccaatgcccatgcatagatgggtccatacagggacgaacacaggacaggaggctgcaacaggatccggtttattctgccttggcagggtggtcctgagagtggtgggtgccaccctgtccggggcggagagagggcccgagggccagttaaggccaatggcgggagaagcagggggctgcagcccctggaatgcggtgaagccaggccgaggcccggaggcagctgtggtaggccagggcagggtggaaggcaccggactgggaccgggccagggctacagggccgaggacccaggccacacgggcaccccgggaggcggggcacagggtcacgtgacacagaacatgaaacacaggcacagggtcataggccagatgcacatccagccatggctgggccagacactgggacacagtggtggtgtcacacacagaccacaggggggacacatggatttgacagccacaatgcacagaccaggctacagagctcgagggacgtgggaaggggccttttggcactactgcactggaatcgtgagacaaaggtagcaggacactctggcggtgcctggggcggtccccttgcggcctctctaggcttagtccgtcttccacactttgttgagcagcttcaccacttcatcatagatgacaaacactatggccacatccaggcagacccggcccaggcgggggacagtgcccttgtagaatctgggtgggaggaggggcggggagaggaaggcaggtcagcacagtgtccctgcacagggcaatccccagatactgaagtgagaggcacagaggcctgaaggggacagagtgggcaggccaggtaggccgggaaaggtttgaggtggggacaatagccctgcccctcccccactcacgccttgagcccctccttcttcaggatctgcaagccgcagtcccacgtgttccggtatttgtgcgcctccaggccctatgggggacatcagcaggcaggggctcagcagctagctctggcctggtccccccttcccctccccttcccggccccaccacctgcatccgggtcttaatcacatccagaggagtgtttccaaagacactggctgcgcctgcaatagctccgaagaccccagtgatcagagggttcatgggcttgttggggttgtcccctggatataggaggggtgaggtgggtcagagggtgccgggaggggcctggatcagcacttcaaaaggtgggtgcccgccacccaggggtggccccaaggagaggagaggagctggccatgtgcagagatggggccctgtgatgcagacacacctcggtaccagttgcgcagggaggtcatgacgaagaagcggatggcctggttcgagccctgcttcaggacagtggctgtgaggccctggtacgtccccttcagccctgcgggaaggcaggcacggggttaccctgcagcctctcaggccccggttgggaattggtgtgtgtggggggtgggtgttgcacaaagcccaaggcaggatgggaggtgcaggcccttcccaccctggcccaggtccctgagccctatcaggaaggtcgagtggctcaccttgttcccgcacaatctccctaaccccgtggaagaatcctctgtacttggggtttggggaggtctggtcgtggatgaacttcacctgagagagagaagcaaaggcgcaggttctcggctgccacctgggtgggtcctggctagctggcaggcccagggcccatccagggtggagggaactgggaactcttccccaggaagcagtgcagccaaggccgccctgggctgcccacacggaccatgccccgggacacagggcagcccacacggaccatgctctgggacacagggcagccctgtgagcagcctctccctttatgtttgctgctcttttccagttttggcagtgaaggtgtcattttgttttctgctttataaaagtattttttaaagactttaaggctgcctttagcatagactcagcctccacgggtggcccttcgtggcaggcgtcctgccccagggccccgcggtcaccccgccggccttccctggcgtccaggagaccctccccagcttgccggttgccccgggagcaccgggccagcggggccgcccgtctccgtactccctgcgtgtccggggtcctcgccaggaccttccccaccttgatggtctccatggggcacacgaccaccacggcctcggccacgccagcgcccaggccgcacagcagcccacgcgtgctgtccagccgtccctgggcatcccgcatgtggttgctgaggaactcgaacattccaaacctggaggcgggaggcgggtgagaggggctgccgcggccgagcccccctcccgcagcagccaccggccgggcctcacctgacggccgccttggggatggaaccgtagagcagggagctaaggccgcggtacaggcccaggacgccatggctgcgaaccgtctgccgcacgcagtcccctgggggagggggcggtcaggaccccacggccctcggtgccgccgccctgggtacccgccccccgcggcgccgcggcctccccctcctcaccgatgccccggtaccgcggcgggtgcgagcgctcgtccagctgcagctgcgtcttcacgtactcggtggggaaggtgatgcagatctcgatgccacccgccaggccgcctgcagggaccgggaacccgctcctgagactcccgcccggccgctggcgctcgggcccctcccccgtcccggacttcggtcggcgcggccgccgcgccagtgccgcggggaacataggctggggccccacgcccccatgccctcaccccgttgtcccggcgaggcgcagggggtgacagacgggaggcgggcgagtcccagcgcgccgggtggggaccaggaccgcgcctccacgactccccagcccacggcccaacccggaagtggggcggggcctcagcgtcccgggcccacccagaagcgcggcgggagaggggtccgcgtcccggaggggcccacctgccaggatcgccttccccgggtgcgtcagcttggccttcccggacgcgggcgcggcggccgccagagcgcgcggggcgcggggcgcgggcatggcgggcgggaggcggggcgccctgtggcggcttcgggtccgagactccagaactccgcgctcggtccgcggtggcggcggcggccggttatggtcccaggggcggggcggccgcgtcagctccaggtcccgccccgcgtggtccgagccaggccccgcccccagcccgccccgtgcgggccgggaaactgaggcctgggcggggcgcgccgaggcaggcgtaggggcggggccaaagcgcagccaatggccgaggccgagtccctgggcgaccgcgagcggcgggacgggggcggggctgcgggaggcggagccgtggcccagctccgagcagtgggtcaaggtgcactgtgtgccgcgccgcgggatagcgggcctcgggtctgcgcgactgtcgagagcggcgggatccccagggatcccggaggccaggggcacaccctccccgaaaacacgtggggctagcccagtcccagaggaactctaacgtttcaaacctggaggcgggaggcgggaggccggtgagaaggggctacgccgccgggcccccctcccgcagcagccacgggccgggcctcacctgccggttcccacccacacctttcccggttgtagtttctgcgctcagcgaacaaggtcaggaaagaccacaaatgcaagcggctgtattctcctaggcagcttgtctgggcaacggaggtcccacaccccaaagaggacccagcaaatctttaatggactgcggggcctaggaaactggcccgtccctcctacccataccagcaccaagcagagcacctttgcctggataaaccgactttaatatttatgattgccaagaggctgagagtccttttatgaggtccggtacctccaaacaagacgtgttcatgtagtcttcaaactggcctggagggggcagctccagccagtcggaggcgcccaggaggaaggcctggctccagcaggagggcccacagtccagtctctgttgtcggctaaagctggtcttgcgccgtcagcctctaccctggcctccccaggctctgggatggctcagaggttgccgtcattgggtttcagcaaaaataaatattgtccaggtgtccctgcctcccattgcgtcccctgtgctgctggagtgacatgctccttggagaagttagtaactctgcaggtagggtgggtggtgacaacgcccactacacgcggaagttgtacattggaggctggcgaagttgggagcagaggcatatccataggggaagctggcaggggctgggcccacggcagggcctgcagagggggaagcccacaatgagcagagctcttcctgcccatgggggtcctctcctggctgcccctgagtagcccggggcccagggagcagggtctataggaccagcccttaccacccagacgctgaggccccaagagagcaggcatccagaggcaaggagcgtggggtcagccagagaacctggcctggctagaggataagctagtctccaaatgggacacttacttagtgcaatcagctgggtctcattcatgcccatcaaaatctaaaaaaaccagaatgacattaatggtggaaggacacactcagccggacgctggagacccgccggcgtgctgcacactcacaccacaccctcaggcctgtgtttgccccacagtgtccaagcaccccacagcctctccagtctgctcgacagccaggctgccctgggcaggttctcaggtgcaaagcccctcccagcacacaccagcagcagccttgctgtccaggggccaggcccagcaggacacagcagtagttcacagctaggcaggcacccctatcagaaggcaggcatccttacagcagggaggacagcggccgtgccaacattcctgggcgtacacttctccacacccagtagccactgggatccttccagcccccacccatctattcccatccccatccaaagcccagccaggtaagggcagtgggactttgactccctccctgctccctccccagggggttgggggctacaggtgccacctaccaaacacgagaggggcaggctctgtcacatgctcctcttgcttgcgcagactctccaaggcatccagtttgtccacctgcaaggaggcaaaagcacgtgagcacccgcttgacagagtgcagtccggcctctaggtgaaagtggagtggaaggtcaggacacagggcctccaggagaatgacagtggaggaggtgcacatgggcagatgtggagtggctcagcccacaccccatgcacttttagaatgcagcaaggcatggagaggtgaagcctcggtagctgggctgagatggaacgccaggtggggcccccagagcttcccagtgggcactggggcagtcagttgttacaggctgtgcatgtggcctgcttatggggggccaagtcctcctctggatacagggacactgccacttaccgacctgcagggctggggccatgtgcagggaacactgtctgcttctggctctggccagtctagtttgcccgcccctccaaaccagcagagagatcatgtggctctcagagacaagtcacctggcacctagacacttcacctgagaagcactgaggacaaactgcctcctcactcttccctgaggcttcaccaggcactgaccccacccactgccagagagcgaggcggcagcactgcactagaggggcggcagcaactgtgcagctaggatcccctcacaaacacactgagtaagaaagagaaataagaatgtgccccccatgagctggggtctggggggggctgagaaatgaggaggaagcagggggcacacttgctgacacctagggtgagggctgagctaggcctgtaccctccctacaatgggagagcgctgggggcgtctcagagggatggccctcaagcttcccagatgagccacgaggccccaggcccagctgtccaccaggaaaggactgtgcttcttgtccgcgccctcattctcccagcactgctgtgtggtgtcagctgagcaccagctcaagctgacaatcagctcacacccccatgccactgactgggaaaccccttgccagccccctcctctccttgaactctccccatgacaggcgtctcatctgccccagcaggaataggtgggtggcagcagagaaggtgctccagcagccaccacctcccagggccagtggagtctgggaaccctgggccaaggctgtgcagccacagtgtggaccaacgtgatagtggctgctaactccatcatccgcaacagaaagggaatgtgcgcctcaaagtcctgggggatccccacaagcactttgacccccacagcaatgacactccctagggcctggtgagcctgagttcctctgacactaacccacgggcctctactgccaggaagagattcaagcactttctttccttgtgctggttctcagaacacagactactttcaggaaagacacccgagggatgggaaaacctgctcatcatggtgacagcagcttccacaggcacgcaccagacaccgcacaccacacactgcataccacaaaccacataccacacgtgccgcctgtagggagttgccatccactgtggtgggggaaccagggcccttgtcaatccaaccagtccatgtcccctggcagcccacgaatctcaggccacgtagccagggctgtcccttcctccccaacccttgagagtcatcagggagtctcactcaggcatgctatgcagatgggatggggtcacactgtcctacaggagggcaacggccttgaatggactctgggatggcctttatcaggggctgggcagccccctggaggctctgcaggcggcaggcagccctccaggctaaagctggcagcatgagcccgccttcctgtttccttcctacctcccactcacctgggaggcccctcccttccctcgctccactgagtgatgcttcagcatgagtgccttccgaggctctccatctggcttgaaggaggttagataggcaagtagatgctactggaagtagcttttccagtgttagaaacaacaaactgtaccagatgacactgctgacacaggtctctggacagtggctaaagctagatcccagcagggactcctaggacttcaacacccagggagagttttacaatcaagtactgtcacttcgatgaggcagagagtcatcctccctatagctgttagaaggattcagtggatctgtgaatactcctactatgtgttcagcaaaaggcagctaccaccaaccgtatgctaacagctgcacccccagacgccactgggagctcctcagggagctgggattgccagccacctcactgtcaccttgttgaagtccagggctggggatgagcacgcctgttgtgctcctagcagtgtgcacattgggacagctgcccagccagagtctacaggagggctgctgccagtgggcactccccatgatgattttctggaggggcttaacgttgggcagaaaaccacttcagcatgaaggaaagcagccactcctgaaggcagccagggctggctggggaatctgggttggcctcaaaggggcccacccttaagacctgcggccagagtcactgccagggttgggtcatgccacacaggggccggggagctgcagccggcccggcacctaccttgctcaggtactccctcatcacctggatgaagtagggcatggccaagtccacgaggttgtgcctccaggccagctcaagcaccatgtctgggcgaagcaggtcatagcaggtgaagagacaagctgcgaagcactccctcttgccttcctccaggaaccactgcagcaacttctgggccagctcagcatcccgcgactctgcagcatgctgcatggcatcctgcagccaaggcaaatgcttgcttgggcatcctgcaggcagaggctttgtgcctgcagcagctgggccggagggcagggagtggcactagactccaccaaggacttcctgcgctgtggagcaagcctggacccatggctgggccattccctatgccctgctgcccactggtgaaacggagatgccacctccggaggctctggaggggacaggtggctcacggaggcgcaggtgccctgggagacaggaactctagccccgagggcagagggcgtgcacaggctgctctgaggaaggcactgatgggagtttgggggttgtggggctgctgcagaggtgctgcactcaggtccatggagcgtgtgacaccaggggagcagttaggaggggtacggctactgctctagaaacagcaatgtgtttttctttcaagtggctcaaaaacccctaactgctattttcatccttgcaaatgtatttgtctaagacaatatcattgacaaaataacacctgcacctgaccagtcctgaagaagcctgcactttctgtggccattctctattttctagctccacagcaggcactggatcacctgattccttctatggcaggggctattagtaccccattcagagaccaggaacctgagacccagatgtagtcacttgcccagggccactccacctggagttggccatgatccactgactgtgacctgtgctctccagggataccctgtggcggtcccagctctgcatgcctgccatcgcctgcagcacacacctctgagttccgtttgggagacccctgaggacgcccagtgcccacatctgcatggacccgatgtgctgagctggctccggaaagaagtctcccccgctggcatgctgctcatcgatcgctgcctcctgacccacactgttcctacaaaggcaccaggattctgaccctcaggtgagagctccaggtgcctttgggtctccgctttgaggacctgtgacgcccgctcatctgtctccctgccgtgccctccaccggcccagcctacccttgctgacttgtcttccacatgtgcctaaagtgggccctgctctgttcctcctctgtgggccttggggactgtctcactgccttcccagaggacttccagtagaagcagcccccaggaagctcccagtcagtgtcccgctcctgcggcctggagcccagctcgagtcaggctctcccacaccctcctctctcatcacctccccggcccatgccactctcagggaggcttcatcctggtccccatccctgtgtccagctctccagtctacacctgtacttccgcagcccctgctcttcactggtgggtgtgggagggccccactgaccgaactttcatttaaatgctacttctgtcatctggaaatacagttttctgttgctagctggctttgccctgactggacacgctgtgacctggccactcctccaggaagactccaggaggcttcagctctggcctcagggcaggctcctccagtggcagtgctgaccttgggaggtctggggagccgcctgtgcactggggcttgtgggccccatccctgcctctacggcctatacacagcaccacgccctaagctgtgacaaccaaacattccctggggtcacagtcattcctggctgacagccactgttctgggggaagcgcgctcggccactttctttttttttttttttcttgagacggagtctcgctctgtcacccaggctggagtgcagtggcgtgatctctgctcactgcaagctctgcctcctgggttcacgccattctcctgcctcagcctcctgagtggctgggactacaggctcctgccaccacgcccagctacttttttgtatttttagtagagatggggtttcaccatgttagccaggatggtctcgatctcctgatcctgtgatccgcccgcctcggcctcccaaagtgctgggattacaggcatgagccaacgcgcccggccctgtgctcggccactttctatctgtggctttgtcctctggactctcttctgggcccacgtggctcggagtgggtggctggcaaggccagtaggcctctggcagcactgatggccctgctcactcatcactgcctgagtgttgaggaggctgtgtgtttaagcccctgacagggaccacatgggtaggacagaatggctgtgatcagccagccgagggcagccttccctcaggtgcgtctgagcccagctgtctcctcccagcagccaggtccagagacctccaggtgcggtctcagagcctcagcagcttttcctctccattccctctgcaggggccctgtgggcacctcaggaaggatcacaagcactgtcaccaagggctaggatatgtcacagaacagtccagaacactggaggtgacaacttagggtgaaactcaatgcaacactgatgcaggcatcagaggcctccacggagtctgagccaacagccgcagaccaggagccatgagaatgaggcccctgtgcgggacaggaagtggcaagtatccatgtgtcctgtgaagatactcaggaatgcctaaggccaactccgtaagtaacaccctcaggtcaagtccagagtctttgggcacaaggagcccttgggaattggctcagctgcatcacacagcacccacaagggccctcttgtacaactccacctcacccccgcggggagatgttcaggccaagcagaggatgttaatgccttcagggtcttgggggtccctccaggcagcccaacctgtctagctgatgcccagatcccggtctgagaatgatactaagaaacctctcaccagcagaaaaaacacagtttctttttcctctcaagtgatcctcccacttcagcctctaaagtagctgggactacaggtgcacacaaccgtacccagctttgaaacaaatgttttgaatgtgatttatttatttttttcctttttttttttccgagacagagtctcactctgtcacccgggatggaatggagtggcgtgatctccgctcactgcaacctccgcctcctgggttcaagcgattctcctgcctcagcctcccaagtagctgggattgcaggagtgcaccactacacccggctaacttttgtattttcagtagagatagggtttcaccatattggccaggctggtcttgaactcctgacctcaaatgatctgcccacctcagcctcccaaagtgctgggattacaggtgtgagccaccacgtccagcctttgaatgtgattttaatttaggtttttaaattcctcaaatctttttttttttttggagacagggtctcactctgttgcctagagcagtggtgtgatcatagctcactgcagcctctgactcctgagctcaagtgatcctcccttctcagcctcccgagtggctggtaccacagatgtccatcactacacttggctaattttttgtaaagatggggtcttgccatgtcgcctaggctggtctcaaactcctgggctcaagcactccacccacctcaacctcccaaagtgctgagattacagggaagttcccaaatcttgataggaagtaaagtaggtgccaagaagtgaatcttgccacactgtgttttggtagagtgaaactcacacaaaactgctgcgaaaagaatcaactccgtaaaactctacaagtctttcaatccaaacagtttttaaggggtgctagctcactcccaattcttactctatgttctaaatatggtctcccattaatactaatccccccacccaccacgaggatcccctggtgaagctcagagccaggtctcaggaacaagagggaagggatgtgacccccaaagccatcaggaaacacaccaaggcaggaaggtgggaggaaacgggcccaggccaccaaccttgtagagatgatccttcttgcagagctccacgctctgggcccaccagttattgcccttgtacagataggccgcaatgcacctgaactccatcagctgatgcttctccagctgctgagccaggctgatgttgtcaaagttgtcataggcatcgatagatgcccttaagccctaggaagacagcctttctgtgagggatgggacactgacatgggctgcctacacatggagcaggcaccttgtgttacttgatggctgttgctatcagcacagccttagaaaggcccctgcccatatatccactggtgtcctgtggggcctgcacaccctcctgtgcaaaggcagcctgctttgagaacagaatggcagttgcaggggaggagcccagcccacccaggacagggctccttcctgcacacccacctgatagtcctcctcctctgtcagcaggtggttgagtgcctcattcacactcttgttgttgtggctctggactgaccgcaggtaaggcttcaccaggggcagctgacctgcctgacaagttgagggaaccgtcaaggcacttggccaagcttgttatggggacactaggcaggggcacaggtgggcacgtgcgtgccatccacttgaatggtccagctctggagccaagggcaccttctggacacctagaaccaaaagacctacactcacacaaagaggactgtctgggcgattcagtggatgccaatgtcaccacagacattcacaccttagagagacacatgggtttgggtccagaccaccacaataaagtgaacattgcaataaagtgagtcatattaattcatgtttacactatgttgtagcctaagtgtgtaacagcattatgtctacaaaaacacagtacacaccttaattaaaaatattttagtgctaaagaatgctaacaatcatctgagccttcagtgactcgtaatctttttgctggggagggtcttgcctcaatgttgatggctgctgattcatacaagtggtggctgttgaaggctggagaggctgtggcaatttctttttcttttttttttttttttgagatggagtcttgctcgtcgcccacactggagtgcagtgccgtgatctcggctcactgcatcctctgcctcccaggttcaagcaatcaattctcctgcctcagcctcctgaatagctgggaccaggcgcttgccaccacgcctggctaatttttgtatttttagtagagacagggtttcaccatattggtcaggctaagtctcgaactcctgaactcaggtgatctgcccacctctgcctgccaaagtgctaggattacaggcatgagccactgcgcccagccggcaatttctttccttcttttttttggggcgggagacggagtgcagtggcgcgatcttggctcactgcaatctctgcctcctgggttcaagcgattctcctgcctcagcctcctgagtatctgggattacaggtgcgcgcccaccacacctggctaatttttgtatttttagtagagacagagtttcaccacgttggtcaggctggtctcgacctcctgacctcatgatccacacgccttggcctcccaaagtgctgggattacaggcgtgagccaccgcgctcggctggcaatttcttaaaataagacatcaatgaggtttgcctcactgactgactcttccctttatgtaagaccactctggacttgtgttgcataaaacaaaataaactaaacaaacaaaaagactctgtgcagcatgcaatgctctttgatagcactgtactcacagtagaacatttttcaaaattggtctcagtcctctccaaccttgctgccactttatcaaccaggtttatgcactattctaaatcccctgtagtcatttcaacaatgttcacagcatctgccccagcagtagattctatcttaagaaaccactttctttgctcatccctaagaagcagctcctcatctgttcaagttggatcctaagattgcagcaattcagccccttcttcaggctccacttctaattctagttctcctgctgtttcccccacatctgcagtgactttctccactgaagtcctgaacccccaaagttatccatgagggttggaatccacttcttccaaattcctgttaatatatggatattttccttatatactggtgtctttacttgtttccaacttcttattgatacatgatagttgtgcatattaattgggcatatgtaatattttgatacatatacacatgtgggatgatcaaatcagggtaattacgatatccgtcacctcaagcatttatcatttctttgtgttgggaacatttcaaatcttctcctttagctattttgaaatgcacaataatttattgttttttttgagatggagtctctctgttgcccaggctggagtgctgtggtgcaatctcggctcactgcaacctcccgggttcaagcgattctcctgcctcagcctcccaagtagctgggactacaggtgcctgtcaccacgtctggctaatttttgtatttttagtagagacggggtttcaccatgttggccaggctagtctcgaactcctgacctcgggtgatccgcctgccttggtcatccacccaccttggcctcccaaagtgttgggattacaggcataagccaccattcccggccattaattagcctaattccaatgctgttgtgtctcagggaatagggaggcccaaggaaaggaagagggaccagggcacggccagtcagcggagcagtcagaacacatacaacatttatccattaagtttcccttcttataggggcatggtttgtggcatcccaaaacaattacaatagtaacatcaaagattgctggttgtgtgcactggctcaagcctataatcccagcactggaggaggccaaggcgggaagattgcttgaggccaggagttcaaggttgcagtgaggtatgaccatgccactgcactcccacctgggcaacagagcaagactgtctcaaaaaaaaaaaaaaaaaaaaaaagatcactgntcacagatcaccataccatntnnngnncnaaaatttgaaatattgtgagaaatcctaaaatgtgccacagggacatgaggtgggcacatgctgttggaaaaatggtgctaatcgactttctcantgcngggttncaaacctccnatctttttttttttttttcttttgagncagngtctcacactgtcacccaggctggagtgcagtggcacgatcttggctcactgctagctgtgcctcccgggttcacgccattctcctgcctcagcctcccaagcagctgggactacaggtgcccaccaccacgcccagctaatttttgtatttttagtagagacggggtttcaccgtggtagccagggtggtctcgatctcctgacctcgtgatccgcccgcctcggcctcccaaagtgctgggattacaggcgtgagccaccgcacccggccacaaacggctaatctttaaaaaaacacagaatttgagaagcacaataaaatgaagcatgatacgggaggtattcctgtatctgaaacctaaaacactttgatacactggtgaatcttcaagtcagctgggggtcatttcaaaaactctttataaaggtgctatcattcagatgactttgttagagctagcccaatacactcttctacctggggttttggttgactcacctttgaaaagaaactgactgtccaggtgtggtccagccggggtgaaagcaccagcagcaggtcattgatgagcagtggtttgtaatccaaatagaactgcagggctctgtaacagagctcgacgttggcaacctgtggtgagcaaagctgagggtcagtccctgccgctgtctccagataccccagggctccttccagtttttgctcaaatgacactttactactgaggcctgccatgactaccccctataagactcaatggcctgtgaaggtgcctcctctcatccctgaggtattttgtcccccagcactgacacactgagcatttttcttaagaggccagcctcagggtttcctgcctcaacccagcacctagaccagtatctgatgcagggtccacgatcactcagtatcggctgaatgaatgaagtgtaatcagtcagaatgaagccccacagcaaaaccaaacaacagagtatgtttccatccaagcaagattactccagctttccttggaggcctcagcctgagccataaccaagtggacagcatgtcctgtgacatcaccagagcttttgagctgaaacactgtggtgctcagaccctgggtgagacctgaaggccagcccatgcagagagtggaccactctgggtggaccctgtgcctgtgctcctgggtctcgagatttggccaggctgctgtntctcttagcactttccccactggtctgccaccattctcttgctgggcgatgtcatcttttttttttttttttttttgagacggagtctcactctgtcgcccaggctggagtgcagtggtgcgatctctgctcactgcaagctctgcctcctgggttcatgccattctcctgcctcagcctcctgagtagctgggactacaggcagctgccaccatgcccggctaattttttgtatttttagtagagccggggtttcaccgtgttagccaggatggtctcgatctcctgacctcgtgatctccccacctcagcctcccaaagtgctgggattacaggcgtgagccaccgcgcccagccctggcgatgtcatttggtggcttgctgactgtggcatcgatgtccagggcctggacacagctctgttcagggagcatgcaagccagatgggcatgaaccaagacagtggtgatgaatgtgtctgcgtgagtgtgggggtcccgggatgtgcacagggcacagctggagctaaagtcatgctgggatcccagggtgatcaccactggagcctccagcactgctgggtttgggtgacctggcaaaaatgtggggcccgatggggtcttctgactaaaaggggtctaatggtcccactatggcttactggccacttcagggtgtcttct

SEQ ID NO: 37 - DNA, 26679 bp, Homo sapiens
gaactaattaaacaaaacaacaaaagaaaacctggcatcagtcctggtcactgtgctcacgccagcctctccatcccggctcctcttccaactctgcttcctgcttcagtgactcggatgtcgcccttcgccccatgcccaggaaaccggaggtggcagtgggggaagggagggaggcgtggagaagataccctgtcaccatctccatgcccctccccgggaccacacaggtcgcctgggccctgaccaaatggttcgttgtccgccaagccagacagcagggcaggcgcgctctgtgcaaaaccgagtcgtgtgcgggcccagggtggcgctcggggcgcttccagcgcacgtcacctcatctgcgtcgtcaccactgtcgcctccgaaagcgcattccgtcgtcaaaatacaccacgaggtcccgggtgccctcaccgccctccccttcctcgccctctcgtcgttgctgttgggacgggctctcgtcgcccgcgctggggcgcagtgactcagtgtgactcaggcctcgcccgcgctcgggctcacggagcagctgggacgacgggcgtgagcgcagaagccgcagagcccctcgcgcgcctcgcgggggtgtggtggggggtggccgcctccggggacgggcgggctgcggggctccgaccccgcggcagcgtctcgcggcgcctgaggccccggtgggcgtgggttccaggctgcacggctggtttgccgtctgggggtggtttgtgctgggacccccgcctcgccgcaaggaccgacgctttccgtatcccgggttcctgcttcggtgtaccggcagaatctgatcacgcgtggcctggagaatgcgcccagggtcgtattgcctggaaggagctctcagccgctgggggagccggaagggagacggttctgccctggacgcgggctgctcggcggccccggctctcctccaaccggccaaaccccgcctggtcccgccgccggtggctgctgctccctcgccgtcttcctgccgagcagccgctggcgtcttcttccactgatctgctcctctccacgtccggctgccttgtcggcctgctagggtcttgggtttttatagtaccaggatgggggcatggcgggccagggtggtcttggaaaatgcaacatttgggcaggagagcaggagagcctgtcctcaccgaggccggggaccctcctttctctacccagcacttccctgcccccctctcgtatcaccaccacgccccggctattttttgtattttctgtagagactgggtcttgctgtgttgcccaggctggtctcgaactcctggactcaagtgatcctcctgcctcggccccccagactgctgggatcacaggcgtgagccaacgtgcccgcctccctcgtgatctctttcttgactgattggttatttaagagtgtggtacttaattttcatgtttttgatttttccaaattctctcctgttactgattcctaacttcattctgctgtggttggagagcacgctttgtattattgccgtccgttttaattctccaacgtgtgatctgtggcctaacatagagtctttttggagaagaatcctgtgcactgggaggaaagtctgtttttctgtcaccaggtggagtggtctggaggcatctcaggagcagttagtgctattcaggtcttctgtttcccggtgtgttttcttcctgttgttagatccacgatggaaagtgaaggcactgaagtctccagccattattgttgaactgtccagttatcctctttatttttatttttttattgagtctgggttttccggaatggttatccttttataatccattctgccgatctctgccttttaattggaaggtgtaatccatttgcggttaattgctgttaaggagttctgctattttgctgtctattttttttttttttttttttgagatggagtctcgctctgtcgcccaggctggagtgcagtggcgggatctcggctcactgcaagctccgcctcccgggttcacgccattctcctgcctcagcctcccgagtagctgggactacaggcgcccgccaccacgcccggctaattttttgtatttttagtagagacggggtttcgccgtgttagccaggatggtcttgatctcctgaccttgtgatccgcccacctcggcctcccaaagtgccgggattacaggcgtgagccaccgcgcccggctgttgtatcacttctttctcgcctcttcttacttactgccttctcgtgttaaacaaatattttctagtattccatttacattcccttgtttcttttacgacatttctgagttaaaaaaaaaaaaaaaaggattgctgttgggattataatgaactaaaatctagtttcaattgatagtaggtgaatttttttttttttttttttgagacggagtctggctgtgttgcccaggccggagtgcagtggcgcattctcggctccctgcaacctccgtctcccgggttcaagtgattctcctgccgcagcttcccaagtagctgggactacaggcgcccgctaccgcaaccagctaatttttgtattttcagtagagatggggttttaccatgttggccaggctggtcttgaactcctgaccttgtgatccacctgcctcagcctcccaaagtgctgggattacaggtgtgagccaccgcacccggccagatagtaggtaaatttcaacaggatacaaaccatgagctccaacactgtcttctcctcctgtgtgctgcaaagtatatgtaaattataccctcatacattaaaaacccatcaatagttttttttttttaattgagacagggtggtctcactctgtcgcccagactggagcagtggtgcagtcacagctcactgcagcctcgaactcctggtctcaaatgaacctcccgctttagccttgcaaatggctgagactataggtgcatgccaccacacctggctaattgtttttgtagagatggggttttgccctgttgcccaggctggtctcaaatccctgggctcaagcgatctgcccgcctcagcctagcacaacgttggggttacaggcatgagccacggcgcctggccacatttcattatgtcaattgacctatcttcaagtttgctgatacttgcttctaccaactcaaattcaattactttacaactacagaatttccatttaattctttttgaataatttatctctgtattgtattttctatttggtgagacaatgacaattttcatactaccattttagttctttaaacataatttcttttagtgctttgaacattattcgtaacagctgactttgtctttatttaagctgagtggtggatcacgcctgtaatcccagctctttgggaggcgcaggtgggcggatcacttgagcccaggagttcaagaccagcctgggcaacatagtgaggcctcatctctacaaaaaataaaaaagttggctgggcacggtggctcacgcctgtaatcccaacagtggcaggccgaggcgggcggatcacggaggtcaggagatcgagaccatctgggctaacacggtgaaaccctgtctctactaaaaaaagaaattagctgggcatggtggcgggcacctatagtcccagctccttgggaggctgaggcaggagaatggcgtgaacccgggaggcggagcttgcagtgagccgagattgcgccactgcactccagcctgggccacagagagagattccgtctcaaaaaaaaaaaaaaagccaggtgtggtgatgcgtgcctgtcatcccagctactcaggagattgaggttgggaggactgcttgagaccaggaggtcgtggccacaatgagctgtgttcatgccactgcactccagcctgggtgacagagcaagaccttattaaaaggaaaaaaagggccaggcacggtggctcatgcctgtaatcccagcactctgggaggctgaggccggtggatcacctgaggtcaagagtttgagaccagcctggccaacatggtgaaaccccatctctactaaaaacacaaacaaaattagtcaggcctgatggtgggcacttgtaatcccagctactcgggaggctgaggcagaacaattgctcgaacctgggaggcagaggttgcagtgagctgagatagcgccactgcactccagcctgggcggcagagtgagactccgtctcaaaaaaaaaaaaaaaaaagcaaaaaaggccaggcacagtggttcacacctgtaatcccagcactttgggaggctgaggtgggtggatcacgaggtcaggagttcaagaccagtctggccaacatagtgaaaccctgtctctactaaaaatacaaaaattagctgggcatggtggtggtgtgtgtctgtaggctgaggcaggagaatcgcctgaatctgggaggtggaggttgcagtgagccgagattgtgccattgcactccagcctgggcaacagagcgacactctctctcaaaaaaaagaaaagtcggccgggtgcggtggctcatgcctgtaattccagcactttgggaggctgaggcgggcggattacgaggtcaggaattctagaccatcctggccaatgtagtgaaaccctgtctctactaaaaatacaaaattagccgggcgtggtggcacgcgcctgtagtccagctactcaggcggctgaggcaggagaatcgcttgaacctggggagtggaggttgcagtgagctgagactgcaccattgcactccagcctgggtaacagagtgagactccatctcaaaaaaagaaaaaaagtctttagtaagttcagcatctgggcttccccaaggatggtatctattgatggcttttccccccatttatgggtgatattttgtttctctgcttttttttgctgaaaagtagacatttaaagcaacatgatgagaccagttgttcttatcccccaggttttgttactttgtggtttggttgctgcttctgtgtgtttagtgacttttctggactaattctctactccctttgctgtgtgaccagtgaacgctctgtactgtacagtttccttaaatgcctcgattcagtgagtcttttttccctggctgggaggcttttccagcagtttccagctctgctgtagctttcgctttctgtttgcacaaggcctcaatcagccaaggggagatcagagaatgttctgtcccttcctggccgtgcgtacagacccacacgtgcccagggctttccgtgtccccaggaaaatgtcagtgctgcccgggtccccacaggcgcctcgttcctcacctcgtcctttctgggcaggtgccggctgccccagtgggtagtgccttggacagctgtgtggttaaacggtgccactgattgtttctgaccaatgctgtggaaagggggcttttctcactgagcgaactgcagggcaggccagatatcacaggcctatgaatgctttccagggagctgccagaggtgagattgaagcaggctgtttcaccggagtcgtaatggggtgcctggtttactcagcctgccgccctcaacccctcgcggagggagtgtgtgggccaatgaggcaggactggagtgcaggatcgctggaactggccggctgtttaggcaccggtgggttcaaactccactcacttggaccctctgtgctccaccccttgcaggagggtgagcaggtgcaggagctggagcaggtgcttttgggtgccggcagcagtgaactctgtgcaggccccgtgcagcatccagggccggggtacctgtgccccccaaagccccagagggcgtgttacggggctcctttagctctgccgtccacagacagctgaagtgttaacagctcagtggaccctctgccttttcgcgtgaggctgccggtgagaggcaaagggccggtgtgaccgccttttgtatccacctgtggctctagagctcgtctggcatccaggaaaaatgaggttacgcaaacgaattgaaggatggtaaatgtgggggattttattgctgatgaaagtggctgtcagcaggaaggggagctggaaaggggatggggcgggaaggtaatcttcccctgaagtctggccacatctgtgtctgcagatggattcttctctgaagtgacaccgtcaagctgtcccttaacatccagctgcttctcctctctgctggctgagtctggggcctttatagacacaggatggcggggggcagggtgggaccatggtggtttaggaacaggcaacatgagggcaggaaagcagggatggcagttctcaaggtgggccatggtctcaggcatttcagcttgagggtggggcttcaccaggaacctgcccctgtctgcctagaatttctctacctcctgtccccatcaagatggcaacagctctctctggggtgggacttttgggggctcatactgagcctgcctctctgggctgctagttttcaaagcaccagagagttggagtaaggagaatgaaacacggcaagttaaaatgacaaagctctctgtaccaatattcagctgtttttctttttactttttctttttggagacggagtcttgctctgtcagccaggctggagtgtactggtgcaatcttggctcactgcaacctccgcctcccaggttcaagcaattctcctgcctcaacctcccaagtagttgggattacaggcatgtgccatcatgcccagctactgtttgtatttgtagtagagacgaggttttaccatgttggccaggctggtcttgaactcctgacctcaggtgatccacccacctcggcctcccaaagtgctgggattacaggcatgagccaccatgccaagcctcggctgtttttctttaataaacattcattaaattattacaagccttagttaataatttccagagttctgaaaaagttaattttgacaattttttccctagtggtgtcattgcttttctcgaggagggattttcagagggacttgctaccctggaagtcctgcgtcctttctgtcatatcagctcaccccctcagaggttctgacctgggacataatcagtctctatgtagctgctttgaattgtcatttatttccccttttcttaattgtgggggtcttgactgcagggtaaatggctctggctgctgcgattttaacttggtatctttcctttttctttctttttggagacggagtttcgctcttctggcccagcctggagtccagtggcacgaactcggctcactgcaacctccctccccgcctcccgggttcaagcgattctcctgcctcagcctcctgagtagctggcattacagacttgtgccaccacacccagctaattttatatttttagtacagacagggtttctccatgttggccaggctggtcttgaactcctgacctcgtgatccacctgcctcagcctcccaaagtgctgggattacaggcgtgagccaccacacccggctggtatcttttttttttttttttttttgaagacagagtcttgctctgtcccccaggctggagcaaccatcacagctcaccgcagcctcagcctcctgggctcaggcgatcctcccgcctcagcctcccgagtacctgggaccgcagacgcgctccaccatgcctgttctttgttgttgttgttgagacagggtctcattatgttgtccaggctggacatgaactcctgggctcaagcatcctcctgccttggcttcctgttgtgattataggtgtgaaatactacacccagcctgatttttggttttagagacaggatcttgctgagctgcccaggtgggaaggcaatggctgttcgcaggctcactcacggtgcactaccgccgtgagctcctggactcaagtgatcctcctgctgcagcctcccaagcagctgggaccacaggtgtgagccatgtttccagtttatcacaggtaatttcagatgtgagtgacgttctgtgcccagtaatggggcttttggggtttataccactgcactcccccagctgtggtgtacaacttgcacctcgtccctgagctcttgctgatgccacagctgagctcttgctgatgccacggctgccttctcactgcctgtgggtccctctctctagcttcagtatttcattctgctttccaacagagccaagctgggcccagttccttctactctcctgtgagactgtcttcgctgtcccccagcgggaaggaggaaagcagctccctggtgtggggggaggtgggtggaggttgtgtgcggctccacgtgctggggcccttcccctcctgccaggctcaggcccaggcccagctgccgcttggaaatggcgacccctgaatggagacctgtcttgccagatgctgcacggtctcctgggcagagcaggcgctctctgtgcggggagctgacggctcacgggctttccacaaaaacctctcacctccttccaggttttacaaaagccaccagcttctcttctacagcagcaaaagccgccatatttctttcctttttctgttgaagcctggggccttacgccttggcaaggtgtcagcttccctgagagggggaccctgtgccagaaaggggtgccagcttccctaagagggggaccctcggctggggaggggcaccggcttccctgagggggaaccctgtgtcggggaggggcgccagcttccctgagagggggaccctgtgccagggaggggtgctggcttccctgaagtgcctagggtccgagcactcacctgctctgtgctttgggtttgtttgttttttgtttttttttttgctaatggcagtcctcagagcctccggaagggaaggcatcaggaaggcttgagttacaggtggtggaccctcagagccagcctgctccagagcccgggctcccaggcaggagctgggtagcgctggggtccatggatgtagttgagcgagtggggttacgccatcttcctccagctccagccagagactcccgagagcggtctgaagcccacatgggtggccccgggcagcagggtctccaggctggcacgcaggctcctgcggttctgggtactctgacgtttctcagtgtttattcacaagtctctctgaggggcggcaggctgtctctcgtcccctatggcaggaggctgtttgggagtcgcatgtgcggcatctctggcaggtgcacgggagccgagactccagcagaccagggtgggggccggaagggagctgctctcgcctgacacccctcgtgggcacccgagacagggaggcacagcatggtggccgggacgtcgtcaccactgtgggctggaactgcagcgtgctctgtgtgacacaggctgactcaggtttttcttttaaggcagggcttaaaggaagttttactgtgaccaaagttctgtgattgagggggtgtggagaaaacaaaaagcctggccaagatggtgaaaccccgtctctactaaaaatacaaaaactagccgggtgtggtggcaggcgcctgtagtcccagctactcgggaggctgaggcaggagaattgaacccaggaggtggaggctgcagtgagctgagattgcgccactgtgctccatccagcctgggggtcagagcaagactccatctcaaaagcaagcaaaaaacccccaaaaacccacgaagcccccaaaacaaaccacagctaatccgaacccagaaaaatagactggaaccttctggcttctccacacccccaccccaagcccgtaaatgaggtggacaaccctgcctttgctcaggctcagccctgaagggaacaggagggaatccacaaaagttctgttcacagatcgaagacaggagagggggcatggccccacgcctacccccaaccccacgcaggggcccagctggcgagggagctcacagcagcctttgggggaatgaagccactgcccccgccactggctcagcctggcagggctcagggaccctcccaggtcgggctcctccgcaggggacccagtgaccaggaccctgttgattctgatgcacgggcagtgtctgctcttctgtgggggttgtttctgtagctgccactccctccccagcacccaggtacaggggacagacagctcagaaggaaaagggtgaggcgcctccatcagctcaccctcctgtcacgccgggggccaacagtctcctggagccacactggctggagggtcctggcaggcatcctctgtgccaagatcctctgagcagaggcctcgcatctccatgcttgcctgagctgccttccagccaggacagggctctcaaagcgcggaccctcaccagctgcagctgccagggaactgtgggcaggggcacaagccagccagccacaagctgaagctcaggggcgtgcacagctggccacggggtctggccacggctgcagtgctcagatccgtggggagtgatgctcctgtttctctccagctcctacaagaggcagtaattccacagcattcccggtctgtgcaaaggcagaggacgaggggaacagataatttgtttcaaaattaaaagctaacaacttggtaggaaaaaggttttcttttttttcagacagagtctgctgtggagtagggtggcgtgatctcagctcacagcagcctccacctcctgggttcaaacgattctcctgcctcagcctccggagtagctgggactacaggcgcgcgccaccacacccagctaatttttggtatttttagtagagaggggattttgccatgttgggcaggctggtctcagactcccgcctcggcctcccacagtgctgggattacaggcgtgagccaccacgtctgtcctgggagtaagaaggtcgtcgagaggggcgacactgtgtcagtcccacacacagcccctctcctggagggacgcactgtacaaagagcattttaattaatttatttatttctttacacataactgaaagtgatgttacagtacataagttatttacaactgtgcagtaatgtgttgcaaaataaattatctagaaggcagcaaaagtacattgtgaaggtatataaaactgtacagcgtttacggatacactttttatatgattattggctctgtagtgtttcaagttacgttctcagaaagagaaacaaaatgcccaagattaaaggaaagaagatacaaaccacgcggatttgactccatttcaatacggctgggagtcctggctctgtgtccctccgcctggctccgcaccaggtctgaagcccagtctgaggccgtcgcagctcggcggcaacagaaccacggctgggatggggctcctgcccctccgacctgcaggtcactgtttgtgagaggtggacaccttaattttctttagttgatcagaatggaacaaaaaattttaaaaatgtactccgttctccaactcctgaaatgcctctgcagttgctggagaaaagggcccgaaggtcgccgttttcaaacagaagctgccgtgtgtgcgcgcccggcatggtctcctcatcccgccggggccagtgaggctctgggggctttgcccccgccgcggcagctggtagagaagagacgtgtttcacctccccgacgtctggaccagtctggaagggatggaggcgctgtggccaagtgcagtctctctcggggtctctccccgcccgggtggacagggcgctccctcctccgcccctggggctcagcagcagtcctgggcagccgtgcggccctcgcctgcgtcctgcggccgtcccgcggtgtcatgccggcaacaatacaaagtcgtcgttgacgtcgaccatgggcacgtagaaggagggcacctcgttcacgcacagggacttgtgcccggcggggtccagttcctgcaccttcagctgccactccatcctctgcacggcgttcagggccgcggcctcgtgctgctgccgcatgaggaggcaagtctgcgggacacacagcggggagaggagggaggaggagtgaagggagagccccagactctgccgacctcagctgccagcagggccaagggcgtgatacggccgtgaacctaccctggtatgggccaggcccagctgtacccgctcctggcatctagttactacacgtggcggtagcgccagctgtgctacatgtctgtccccataaccgctgtctatgccacctctaccctggcctggggctcaccctggcccgggggccctgccctgctctgggtgggcctgggactcacctccagcagccactgcagcttattagaatcgaacagctttgcttttgtcattttacaattacttacggccagtgatagtttcacttgtatttctagtagaaactatgccatttaaaagtgcacataaggggactggactggggtagcacatattttggaaactaatggagaaatggaagcgtggccagggagtactggtatgtcacaagcaaccgtgtagagaatcttttttagataccgtctcaaggctggagtgcagtggtgcaatcatgactcactgcagccttgacctctggggctcaagggatcctccctcctcaacctcccgagtagctgggactacaagtgctaccacgcctagctgatttttgtagagatggggttttgcgatgttggcgagctgcagtgtgatcatgtctgtctctaaatttttctcaacatatatatatgtatgaaatcgttttcgaagctcaggatggattcacaatcctcctcaatgggcctcatagcttttactcggcagctcagacatcaccagtgtaaattgttacatggaatcatataataccctttggatgttccaaactccggtgagtcactgaattactgatgggcctctgagtgagtttccagttttgttccagtgaatatttttatacatatccctaaggtttttttttaaattttgtccccaggctggagtgcagtggtgcaatcttggcttactgcaacctctgtctcccgggttcaaatgattctcatgcctcagtctcccggaattacaggcacgcaccaccatgcccagctaatttttgtatttttactagagacgaggtttcaccatgttggccaggctggtctcgaactcctgacctcaggtgaaccacccacctcagcctcccgaagtgctgggattacaggtgtgagcaaccgcaccccgcccaaagtcccattttaatgtagtcaaacatttatcttcttacaggaaagtcttccatgtgtctttatgaagctttcagttttttctcacggctctggttaggaagggcctagtggcctggggagggtgtggtgtgagtgacttcctgcaccatcatcttagggctggccagaaatgcacactcagctacgcctcagacctgagttcctcagcacaagcccccaggggccacgctccccaaatacccacagctcccaccgggtagggctggtggttctcatctgtgcccacatcagcacctttctgagagctgcagtatgacacacgggtgcttggttcagggacctgggtggtgctgagcctgatactgcaggtagccggggccgcctgctcccaggcctggctggtgactgtacagggtgacgctgactgtaaagttctgtaacttttggcaagtttccgccttccgttgcctcctggtggatcctccagggtgtcccggtgagcagccctcgcgaccgggataagggtgtgctgcccttcccggcacctcccccgcccctgcccaccgccctggccagcacttccagagcagtggagggtgaatgctgggaccttagagggggctcacagggcagtcccaggagttctgaccatcaagcctagggtcctgttgagctggcgacaggagccgctccctgcacaccgggacagaagggaagactgaggaggccacacgcagggacaggacctcacctccccgaaagcatcggccagattaagagaatctgaaattgtcaccgcccatcacagaactgggcagcggcctccccccaggcagcgcaaagggggttgtcaccacccatcacagaactgggcagcagcctcccccaggcagaactgaggggacgcgcaacaccgaccttcatgcggtcatacttgtcatccacgtcctggagccaggagatgaactggcgggcgttgaaacggtcgcgcactgacttgttctcgtcaccctgtggaaaccaaacacgggagtttcatcaggagccccagagaccgctacgggaaggcatgccagcctgggcgatgctgcagtgaccgttctcaagggacaaccacagggggagcctcattccaccgcgcacacactgaatcatgttcaaggcatggcaggcgcaccctgcccatctccctaaacagcctccctaaaatgcgcgtggaggcagctgggcctttgtctcctgggcaccgggtgcccgcaggccccacctgtgagccggtccccagccctgcccccaggggacagtcagagctcagcccactgccaactcctgggagagacttttttttttttttttaagagacagagtttcgcttgttgcccaggctggagtgcaatggcgcgatcctggctcaccgcagcctccacctccagggttcaagcgattctcctgcttcagccttcctgagtagctgggattacaggcagccaccacgcccagctaattttgtatttttagtagagacggggtttctcctgggcgagactttctagatatgtcaccgtcctgtgtcctgaagggtggacacggataagatgtccaggctcctcccctttttcacgggttcatggtgaagctgacaatgccgtctgtttctcagaacatgtggagcaccgacagaaacccacacacctgcagggaactcactttccacaaaggtgccaagaacagaataacgatcacagggaaaggacagtctcttccgtaaacggtgctgggaaaactggctacgcatcgcagaagagtgaaacgagaccctagctctcgccacatacaaacatcaaaccaaaatggatcaaagtctggaatccaagaccttaaacgatgaaaccactacaagaaaacactggggaaaatctccaggacattggcctgggcaaacatttctcaagcaataccccgaagcacaggcaaccaaagcaaaaatggacaaatgggatcacatcaagttcaaaagcttctgtccagcaaaggacacagtcaacagggtgaaaagacacgcacagaatgggaggaaacgcctgcaaaccgctcctgtcacacagattctcaagcagaacatagaaggcatgcaattaactcgatatgaaaaaatctaataatcccatcaaaaaaacgggcaaaagatctgaatagacgtttctcaaaggagacacacaaatggccaacaggcatctgaagaggagctcaacatcattgatcgtcagagaaatgcaattcaaaactaccgtgagacatcacttcaccccggttaaaatagcctttatccaaaagacagacaatcacaattgctcgcgaggatgtggggaaaagggaaccctcgtaccccgttggtgggaatgtaaattaaaacagccgccgtggagaacagtttggcgtttcctcaaaaaactaaaaattgagctaccataggatccagcaatcccactgccgggtatagacccaaaagaaagaaactgggggccaggcacggtggctcacgcctgtaatcccagcactttgggaggctgaggcgggcagatcacctgaggtcaagagtttcagactagccttgccaacatggtgaaaccccatctctactaaaaatacaaaaattagccaggtgtggtggtgcgcgcctgtgatcccagctacccgggaggcagtggctgcagtgagctgagatcgtgccactgctctccagcctgggtgacagaggaagactcagaatcacaaaaaggaaaaggaatcagtatattgaaacggtgtccacactcccatatttaacgcaaccccatttactatagctaaggcttgtgtccatcaacagatgaatggataaagaatatgtgctacatacacaacggagtactattcagccacaaaaaagaatgagatcctgtcatttgcaaacacgtggatggaactggggtcatgatgttaagtgaaataagcatacaaagacaaacatcacatgttctctctcacttgtgggatctaaaaatcagaacaattgagctcatggacacagagtagaacgacggttaccagaggctgggaagggttgtggggggctggcagggaggtagaagtggttaatgggtaccaaaaaaaaaaaaaaaaaaaagaatggataagacctactatctatctgacagcacaatagggtaactgtagtcaatagtaactgcattgtgtattttaaaataacatataagagcgttaactggattgtttgtaactcaagggctaaatgcttgaggggatggacacccattggagaaataaagagggaagtaatgcttccttggaaggtgttagaggcacgagctggtcctcctcatttttgctctgtacagagctgtcctgactgcctgtccatcacagcctctcacctgcggtacaagaatgcaaacttatcagcatccagcccccaaagcaccatttggtccaactcatgttttctttaaagaaaatctgtcggctgggtgcggtggctcacgcctgtaactcccgcactttgggaggctgaggcgggtggatcataaggtcaagagatcgagaccatcctggacatggtgacaccccgtctccactaaaaatacaaaaatcagccgggcatggtagcgcatgcctgtgatcccagctactcgggaggctgaggcaggagaatcgcttgaacccggaagccagaggttgcagtgagccaagatcacaccaccacactccagcctggcaacagagcgagactccgtcacaaaaaaaaaaaggaaaataaaatttgtcattgtgtatatgagagacattgataaaatacatccccaaagaaaggaagatctttaatgcacaaagagatgttttcaactaaacatctgggagcccctggctgtcaccacacagcaaagcctagtgcactgctcagagtgcccagggctggggtggcgtcaaggggggcacatattacgagggctctcggtgcgagatctggacaccaaggcaggaatgtgttccaggcacgtcccactgcacaggatgtggggcctggggtccagggagcccacaacctgagcgcagtgggctccgaggaggagggaggggctgatgcaggcgaggcaacgggagagccaggggtcccacatggacaggtcagtggtggctggaggatgatttctgaggcaggagtccctggcacatgggctgcttgaaggcagacaggaagagctgccccagggagagccacggggccctggccgcccacatcctatgtcccagtggacagagcaggtcaaaggcacgggagctgcaggggtgggcgggagccccacagcagatgggcaggacagtgactgtagttctggaaccctgagtccggcccgccctggcccagatgagcggcacacctgggtgcccgtgttcccttagccacccagtgtccctgctgtccccgtatgacagcccctggggcctgtgctgtgaaagccctcgatgtggcagccctggggtgcctgagagcagcaggtggagcccagcagtttaaacagaaaataatgccagcgctgacacccgtgagaggtaggtaggggcaggtgctccaactgcatggacaagtgttacggagggactgagctgctgaggcccagcccagtggcctgagggccttgcccgtgcggggagctgtctgctgtctgctgcagccttcttggctcctttctgaggctcgcccaaggctagaggcatgcaaaggactctgtagcccctgcaaggtgctgagcacccgggaagctcctggtcaaagtgcagaatctatcaaggggaggggaggcgggcagggtgcaggcacttggactcatgggcctggcatgcagacgggccctacctggctctccaggggcatgttgtagacctcggagtccagcagcatcgtgcaggcgctgaatggcactgcctggttggcgatggtcctggccgcccggcagtgaacccgcagaatctcctgctcacaggatacgatcagcttctcctgaaggaggagaggagtagagtgagctgggacacagccacgctccaggccccactgtcaacacgacagcccctggggcctgcgccgtgaaaagccctggccgtggcgcccccctgcctgtgccagcccacttacccgctcgatgctgtgctgtagacgcagctttccccggacggcctcctgctgcctgaacagctccttcaggggctccgccagggagggagggggtgcgatctacaggcaaaaggtgagtgtggggggtcagctggggctgtggaactgcacgaaggatatagtctggagttcacgggggtcccgactcagcctccccactcctaggagcctgccctggaggcctcctccagtcccagcaacagacacaccaggaagcttctagaaaccactatgtgctggacgcgggagagcggacacctccacggtgccccgtacagcaccacgcagtgaggagatagtgcagggagaggcgcgggacagtatctgtgggccatcgtgtgccaaggagggcctgaaacaccggcatgagcacccaactgtgcagaggagatacagcgagacagcaggagggggctgggggtaggctgagcttcctgtgttcacagggagggcccatgcaccccaaatcagcctttcaaccaggctgtaacgtgcacagtggaatatgaaagctgacaaccgagccggtggtcttgcagtggctcgggggagggaagcacgcactggcccaggtccccgtgggggctgggggactgtgggccggaagcgcaggcactgcactcccaccagcagaagggttctcacagaggtgggtcggccattctgaaactacatgcatgctggaagtgaatgaggaagtaaagacagccgagaccatcaggatgaggcctcacactcttggagaaacaaggcccacacaggagcggggagccaggctgagccccgcagtgcagcagagacctcaggcccacagggagtcaggtttccaaagcagacccagaaagcatggccgtgtgctcggggccacagcagtcgtaccagggccaccactccccacaggtggacccacacggtaatggcaaggcggagccgggtggccaagaccagctggaacatcgaggggccagtcagcaacaggagcgcacggggcagatgggcaggtggacgcacaagagggagaccaggaagagctcctgacagccaaggctggggcgactcatggcatgagaccaacgctggcgatgccgggcacctgcaggcggaaggggtggctcctgacagcacagctccagttagcggacacaggagagggagacaggcccagcgcacaggagtgactgctgcagacgagagccgtggacagcgatgcgcatggacaatgggctgagagaaacagcctcacgcagtctccacgtctcttccaagacacacacacacaccacagagggagagacttcaactcatggtggacgggcctgaccaggcctccaggtcacgtcacctatgacaccaggagcagaaggccccgcctcacgcctataggctcctgcctaagaagcatcatcgcaggccaggcctggggcctctgaccacactgctgaccgacactgcccagaagctcccagccaggagacagggcacgggagggcctgccacagcgtggacgcacggcagggtctcgtcacctccacggctcctaaggcacattcaggggaggctgggcgtgcagcaggtgcataaacctatctctgctgtttctgaacttttctgcccatctaaaatcagttcaaaattaatgatttaggccgagcgcagtggctcacacctgtaatcccagcactttgggaggctgaggcaggcggatcacaaggtcaggagtttgagaccagcctgaccaacatggtgaaaccctgtctctacagaaaatgcaaaaattagccggacgtggtggtgggcgcctgtaatcccagctactcaggaggctgaggcaggagaattgcttgaaccggggaggtggagcttgcagtgagccgacatcacgccactgcactccagcctgggtgacagagtgagactctgtcttaaaaaaaaaaaaaaatggattaaaaaatgtagcaaagtccctctagtccacagacctcactctgttcagcaccacatccaccctgcctcgacgagcccagccccccagtgagggttctgctgagatggggcccgtcggtggcagggattctgtgggccacctccaaggtgggactgatgcgagctcaagcgaatgcacagcccaggacccggcaccaccccttcctctggctcagccccagggccggcagctacagcaggagctgtgccttgggcctcaggcagcacctggcacctgggcctgcctgggtctaggtctggggggtactcaaaagaccaggcgggaggtgcacagaacattcccaggactactcagattggcaggattctagtgacttttttcccctgtattttccaaattttctacagcagtcagactagtgttatgatccattaaacgagaaaacaaaacaacaaaaagcacagaaggtcagaagatcagaaggtcttactgaggagagatcctggggcaggtttttctgaatgtcatgacccaactgccgtctctgtcttctgtggatgagcctccccggggacggctggggtcaggctcgcggggaagggaaagaccgcagaggtcaccgtgggtgcagtgcccctcgtgctccctgggagcagagctcagagcttggcagggtggggcccgagggcgcccgctcctggatcctgcacaacgtccctgacatgtcggccagcagcacagacccagcctcaccctcagggcaagctcagcagaccccgtcatcctcaccaggggggtgctgggtagctgagccaggtcagggccagcacggcgaggggcctcaggcggcctgggcccacagagccaacgcgtgtggagggcccctggctgtacctcacgccacctgcgagtttcagtgcccaggaatccccagaaggaaatggccattggtgacggcaagcctgttctgggcataacacaacacactcaagcgagacggctgcatcaaccacacagtccgctaggcacagtgtgagtggagtcgcgtggtctgggaggagactccagggaagagccagaacgccacacgctggggctggatggaccctggggggcctgagaacaggagggcaggggaggccgtgcacagctcaggccgtcaccgaggacagacgggtgggctctgcctcccccatgaggaatccctgtgcctgctgggaaagaccccagtgggtaggaggaggtgggaacccagtcaggccccgcggcccagggcagagagtgcacagggcaggcagccctcatgggaatgtgctcagagcagggccccatttggagggatctattttgggcccagacgtagcgcaaggagctgggggagtgggggtgattccgagatgtttcacctgagcctgcagaggtagggatgatgcctggggaactgggctgacagggtcaggtggaacaaggtgaggctgggggccgaggaccaagctgccccaagggagctgcagctctgctgtcccagaagcccaagggaggaggtgggggaagggactcatcgtgcaggtatggaggctcagggaacccacgcgggtccaagggagaagggggcggggcaggggcaggagacacagggggtggctctcgtgaggccgtcctggtggacggggagtggagaggggagagtgagcggcgtgaagggggagccccacacgagtgggaccggggtgcacccagggtgagggggaggtcaggagaccgaggcctggcacggaccagctggaggaaggacctcgggtctgcagaacagctgggcagcttccggcttttgcctccacagcagaagtggggctgtgtctcctcaggtggcagaaggtcgagagaggtcaagggccatgagtgggacaagacgggctggaggaagccgtgactaggggccccagacgcatcccagagagagaaggcagtggctctcccgggccccgcactcaccacggggatgtggagcttgctgagcggcttgccgtccaggaggtaggagcccgtgtaggtgacgtactcggcgtagcactggggcgcctgcggcgtgatacagcacaggatcttgcgcttctcctcgatcttcttcctgatctgcaggtattcgaagtaggggttggccctgtcgctgtggtagggctcgatggcatccagcttgatggcgtccacgatggcggccagcgtctgctggatcacctcccgcgtctgctgcgtggacgtgttcagctgctgctgcagctgctgggtggagcgctgaaagcggcgtttgcgcggatgctgggcctgggcgtcgtcgtcctcggagccgcgggccttggccctggtgaccggggcaggggtgggggcgcactccttctcggaggggggcgggccctgcttgctctggttcgcgagcatctgcgcccggttcctggtcatgcgctgagggatctcctccactcggggggccttcggggcttcggccgtgggttttggttctgcggcttccggctggatgccgccaggagggccttcggctggggcggcggcacgggaggcctcagtgtcgtcctcggggccggcaccgtctgcggcctgagcttgtgccacagtgttcggggcggggccgtcaggggcacagagggacgcggcgggggggccttcagcctcagccccctggtctccgctccccagtgggcgctgttctgggggaacgggcgcgggctccacgctggagtccggatccccacgggccctctcttccggcaccgtctccgcctccaccgcagcttctagagccacgtccagctttggctcccctgagggctcaggctcgagctctgcagggagccgggtggaggcctggtcaggaggcagtgccggcggctcctcagccactacggtggaaacatccccaccgtttatgaccccgggggcccctggaggcatctcttctggaggagcaagactttcttccacgggttccgcttcaccatctgcggcatctttagtctgcaggggaagctccggcagggagaagggccccaggtccaggtcgtcctcggggccggcgaaggcgtccgcccagggcaccggctccacctggccgaggtgagacaggccgcggctgccgtccaggaagctattttccaggggccccagagcctccacctgagccacagcggctacacaggcgggctcgggggccacgtccagcggggcttccggaagtgacttgcagttgctgaagaaggactccagcccggagggaggggcgtagggagccgcctctgaggtggagatggcggcggggacggcgtccactccgtccttgacgtcctccagccccggctcagcgacgggcagagcgtacggggcaggagaggcgggaggggcggggtacggcgcctccgaggcgctgaagggccctggggcggcagagtggagggggtccgcggggcagaaacgctttggggactcggggaatctctgtggagacttcagcaggaggtccgagcccacaggccagctcacagggttttcagaggtgcccccgatcaggctagaggcaagcgcctgctcggaggggtgggcccactcaacgggctcctcggtgatgacggcgctgaagggaccctcgtccagcggctccaggtagctgggctccggggggatgatggcggccgtcgcctgctggtcctcggaggtgtccaggtccgggggaagggccccttcgagggaaggaaccagcagctcggctctgggggaaggggaaggttttgcttgtaaacttgagaagacgccctctggagacggggtgacagtgacaacggcagccggtgggcagtgcaaagcgtcgactttgggcgacgggaggccatagtctggggagtagtaccctggcgacaagcaggcaaacttctccgcgggaaccgggggcaggggcgccctgtcttccatcgagggtggcatgggagagtcgtagctggaggcagcaggaacgctctgctgcctgaagagcttgtctccgacgctgaattcttcctcgggggtcctcctaatgtcgacagagaccgagcggtaaaggtttgtggagagaggcctggcaggagcctggctggcgttttccgaaagcccacttgaagccacggagaacctgtcgaaaaaggagggggagcaggcgctggtgggagcggtgggcacgggcgtggagtgctgcgagtcggcgcagtcgaacacgaggtccgcgtagtcatcggcgctgcaggacggggtcctgggcgtgtgcatcacctcctcgtagctggggcaggatagcaccgacgtaggggtgggcacgccagtgggccggctctggtcaggcctgggggacgcaggcaggacctctttcatgtgagggcctgccagccagtctttggagtctgcacctgatgctgggtgtagcttattttccgcggcaggtggaataggagtcgactctttgagctttttgtctttaaatggagggtccagccccggcggtttcttagcaggaatgtccagacccttcttccgcccgtcgtctgccggcttcgccttctccttgagcttggggtctccggaccggtgcctcagcttctccatttgcttcatcctctccttgtgccgcttgtggcgctcctcgatctccaggtccttctgggacagcatcctctcgaagctggtcatcatcaggtcgccgtcccccaggagcttctccctgggcctggcgtctttcttgcctgggtctttggatggcgctaccttatcattcccgttgctcatcttcactgggtcgcccttttctttctctgcaccgtccttgaatttctccttcagtttggcatcgccgagcctcgggccctcgtccctggacttgtctttgagcacgcggggcgggctgtccttgtccctggtggcgggcttctgctcgtccctgtgatgccgcaggagctcgtccctgtgatgccgcagcagcccatccgcatgcctgtcccggtgcctctccttctcgtctctccatttctccctgtgtttctctctcttcttcttctcttttaggatgttgatggcactagatccataaggctttagttccttttctattttcttggaaggttctctctcggaatcatttttatctttcttttcggtagaaaacaattcaatggttttatctagctcatcttctatgtcagctttcatgttgtaagaaactccgtaagcatccgcctccaggaagtccttttcgtactggccggagtccttcctgctaccgccctccttgtaatcttcgcccttctctttcttctcggccttctctttcttggctcgctctcggtcgtggctcttcttggatgaagatgaggagtgtctgtgcctctccttctctttcagcttctcagggaggcaggcgctctccctcggcttgtcgtctccaggtggctccgtgaaagagacctccaggaaggcagtcagccccggctcctgccctcggtccgtgaagctgtcagaggagacctcgctgattttatcgttggagtcttctctgtactcatggagagcctcttcttccaacttttcaagcaggcttttttccgcgtcggcacttctcgaggacttcctctccttggaatgttctttgtccgacttctctttgtgtttgcttttagccttgtcttcggcagcgtgcttcttttcagccttctcggggagcttctgtttatttttcttatcttgcgtggagtccactgaggctctgtccttcctgtccttgtacttttctgtggactctttatccttcttctccttgtgcttttcaaagactttctcttttttgtctctccccgcgtcggcagcccctcggtcctttctcctgtctctgggctccttgtccttctgcctctcagggtgctgcttgtcagaagacttcctgtgtctgtcggaggcataggcctcccgtccttcctccttctcctggaggccgtccgtcctcggcaagtcgctggcctctcccatcttgaacccgctccccatgcagctgtctctgtcgtcctcactctcatctgtgaagatgtctgcgatgtaccagcttttctctttgcctttcttgtcatcttttttttcagagaagtcttctgagatgatcccagggaaagccttctccttcttctctttccc

SEQ ID NO: 38 - DNA, 2500 bp, Homo sapiens
tggatccacacttagaaccaccatctttaaaaaaaaaaaactgtttaaaaaggacttccaattgcatttcatgaaggcagtgggtagaaaatccttgatcagtccctaattgggtgtgttttccatgaatgagctattgggatacagagtgtcgagaacaagaaaacagcttctaatatgaaaacagatgaggttctcctaaagcttctgtgacagctgcatctaaacagtttaacactgaggtggacgggcgcagtggctcacgcccctaatcccagcactttgggaggcccagacaggcagatcgcttgagccctggagttcgagaccagcctggtcaacatagcaaaaccccatctctacaaaaaacacaaaacttatccgggtgtggtggcaagcatctgtactcccagctgacagggaggctaagaaggaaaggtcacttaagctcaacaggcagaggtggcagtgagctgtgatcatgccactgcactccagcctgggtgacagagcgagcccccgtctcaaacaaaaacaaaaaccaaaaaaaacccacagactcaattctggctgccaggccatcaagggctgtgaagtgaagccctgagatccttgtggcaggaccctggacacacaatgacagtgccaccagccacagccatgcccagcaagcagcttcctgtccagtgagcaccaaggggcccttctcacacacagcctcccactcaaacctcgagcatccgcttctctcctcctccactctggggcacagaggctctcgccagcccccacagctgcttctccgcttgtcaccctgccacacaccctctgtccctgcagttccagggacagccgaggtgttctcactctgcaccaagtgcctcacgggccaggtcctgcttaaagcctgaatgaagcaaagcttggaaaggacccaacacaacctgccaccaactgaatgcctgccatccctccccaccctacgaagacactgcatgaaagccaccgagcacgtgactgcatgacccccacacaaagggcacgtccatcgttccaactacaaagctccacgtccaacaccagtggcctcctcacccccaatgcatatttgcaacccattagtaccaaaagtttaatcactattgctgccctgtctcctactaccccattccttgccctcattaaactcctaaagacagtggtccctagatgcctccctctcttccctatccagcgacttatcacaaacaccccaacaccctttcctctccatcagatatcactgaacctcaacaagggggcctgaggtgccaaagaaacatcacatagcacgatctagagtgtagcaaccacacagctaacacccaaatcagagggtcctcatgatcccatccatgcacccacatcccggctgtcgtccacaatcctacgaatcagagggtcctcgtgatccccatccgtgcactcacactccctgctgtggtccacaatcctacaacaatgctccactcttggcctcgtaccctaagtgtccacattccacctgttctcactcctcctacacagccacctttggccctaagaacactgcatccggacacgcaggccctcggcctcccaaagtgctgggattacaggcgtgagccaccgcgcctggcccaacatcatgtatttattacatgtaccagcatttatctaatattttcctaaaatacaataactttttctttttttttttttttttggagacaaagtctcactctgtcacccaagctggagtgcactggcacaatctcagctcactgcaacctccacttcccaggttcaagcaattgtcctgtctcagcctcccaggtagctgggactacaggcgcccaccaccacgcctggctcatttttgtatttttagtagagacagggtttcaccatattggtcaggctggtctccaactcctgacctcaggtgatccgcccaccttggcctcccaaagtgctgggattacaggcatggagagttgggccatctattctctcactgaagcagggatgactttgtcacatgcacccttgcagacactgggcaccttgcagacagtgggcaccctgcagacagtgggcaccttgcagacactgggcacaggaattcagtaagactgataggtgatgtttttagttagggagaatatatgtgcaaattatttccatgtaatataaaaagaaaaagtctcaactgtaaaatgagcataaacagtccaatggtgaaaccttttctcaaaaatctgaattgaaaggacaagttatattagtgctcaagaaaaacttctccctgatctgtcagaattcacaccatgagttccaaatcacacgaaagtactcaaagtcttggccaaagcaaacctactacagcacctaaacacaaatctccattttcttttttcttaaattagccttactactatattattaaaactctcaaaccaaaagttgaaactaaaaattg

SEQ ID NO: 39 - DNA, 218884 bp, Homo sapiens
gtctccctagagtatttcaaaataattatgaaatacctacttcctgtcgaaaggtgtccctcctatttactctgagttttcataaataatttacaatacaaaagtatttgatggtgtgacattttaaagacaaggaacagaatgattcctaaaggctcctccatatctataacattttaaaaaatcaaccgattgctgtttgtaatctctccctgattttgctgcaaatgactaatcttagtattttccttcttgttgcagttctcaccttgatgattttataaatacctgtgcaatcatttaaggatgctgttataacttgctatcacaggattcaggtttgtctcttgctctttttagttattcctctccccgtcttttctccttttaactccccttccctactcttttcttctttgtttctgattacctgctttgcacgtgtgaggtaccttgtgtaagtagcagctttttcctaaaaattcctcttcatgatttcccaaatctctaaatcttggaggatttgcaccaatgagttccaaaatgtcacaggctataatttatttatattttgtctcattgagtgaagagtatttgacctgtggttttaaaatacatgactagccccagccaagtgtagctaacgaaagagttgcatgggacaatgtcagtcatagaaggaaggtgataatatttcggtattattagaaatgaaatgaagaaaaaactaaatcatctgatactgaagatgacaagtttggtgttttgttcgatgaaacaagactacctatcatttactgttctcttgatgccaaggtaattaatgttcttaaaaagttatctaacttaaaaaaattagagatagaaaagaaagttcatttccattccatcctctttttttttatccctctgcatccccatttcatgtggttattgcaggagagaatacattgcttttataaaactagtatagttacacaacatcagcaaagcatttttgggggatgaaaaataagaatattatgttattaattacattttgaatttcaaaaaatttaaccacgcatcatcaacactgtattgcaactaaaggaaatagtggaaaatttagaatactgtatatattttgcatttcactagtagggttggctttcctaagctacttggcctttatgtcctgttcatcttattttaatataagattagagagaataccatatatcctacgttatcagatacaaaaaaatctagatatacgtatatttttgtaaataggttgatttacctggcatttggtatcttagccctctcacatatgttaaatggaatacttttcaaactaacatgtaaagatcatgccaaataactcttccaaaaataagaaacatttgtatgattaaagacatttttcaaagagaatggggggaaagtttaacacaatgactttgtacattctcgatggtatgttctattacaattttttgtttgggctattaacatgaattttgtgcaatactatgaggggaagattggttacttttcaaagaaaccacttattttctctcaaaactgagtgtctaatcaaaggcaattttttagaacaggttatcattggtcaaatgtagtaaaaagttgatattcctcttcaatattcacaagatgactctcttactcttctgtgtctttcgacatagttatttttagcaattacagctctgcctttgtctcatttactatgcagtctgtataaccattattagacattacaggaaagaaagccacatggcttaaaaagtactcattctgtcttatccaccagccatggctgtctctttacagtagcctagggagagtaaccccagacacattaacactttacaaaatataatgaatgtgtaaaacccccaaagagagatgtataacgtacctgaaaatactgtggtgaaatgacctaataatttttcactgcccgtgggaaagtattctcacatctccagaggggctttaatacaatcaaattcaatattcagaagatgctatttattataaagagtaattcacttaaccagacacttcagtgaggacttattttgtgccactgaaagaggatagggctacacagataagaagaaaattacataattcttttattaataaatctacatttttgaatatttactatttgtcaagcactgagttaggtcctgtggatacaaggcacaagaccttaaatttgtttttattctagagtacttataatgcaaggtagttttcttctaccatctaaggtgccatatgcttacaaatgatgccctctgtaaacattccaaacatacattttctaccaccattatttttgttgtcttgctcttattaattgatcccacctgcagcttgatagaatatggcaaggtgttatatagaaatatcttcttacgtctttcttgctcttcttcaataacataataacaataaaaagacaaactgtaatgtgttatgtacttgttgtacccagcattggtctaagtgccttataggtattgtccctaaaatcctctaaaaattgatcaaataaaaaccattatcattttaatgtaatgagaagaaattctggttcaaagtgactcactaaatcccttgagttaaccaggctaataggaggctcagctcaaactcaaactcaaactcaaactcaggtatattaaatacaatggtgatatagaaggaagatcttactgtacccaccctatcttccttcacaaagtcttcctaaattgggtaagtttgaactggttttaaaagagttagatcaggagattgatgttttcttttcctttttaatcactgtcttcatagatagataaaaaacaaggaaggaaggaaggtgtcagaggcattcaaaccagaacaactccatcttgaataggagctgggtaaaataaggctgagacctactggactgcattcccaggaggttaggcattttaataacagatgaaataggaggtcagcacaagatacaggtcacaaagaccttgctgataaaacagattgtggtaaagaagctggcccaaacccaccaaaaccaagatggtgatgaaagtgacctctggttgtcctcattgctcattatacattaattataatgtattaggatgctaagggacactcccaccgtgccatgatagttcacaaatgtcatggaaacatcaagaagtcaccctatatggtccaaaaatgggataaactctcggttccgggaactgcccacccctttcctggaaaactcatgaataatccaccccttgtttagcatgtaattattaaagaagtaattttaagtataaacaggtgagcagcccacaccactactccgcccatggagtggccattctttattcttttacttccttaataagcttgctttcattttactctgtggactcatcccgaattctttctcgtgcaaggtccaagaaccctctcttaggatctgcactgggacctacccctttttggcaacatgttcttggcaaccacgaagggactatcctgaggagatccctgacccaaaggaaatagactgcagaaccaattggctgactttgggtaagtggtggggtaaaccttacccagttaaatgatggtattgggttagagtacctcctaagacagagaaggttaaaggcccctcttaataaaaggcaaggatgcttgaccaaacttgggttccagccccaacttaggaaggttagagtccttcctaagatttagaggtttaaaggcctctctcagtgaagtccctcttggttaaaaatggatttggcataatgggatgttaattgctattctctttggattaatctgccttgcactctttgctgacagctatgggtgacaggactaggcatgtacacgataactggacatggggagctttttttctctggaaagggagaaactcgagagctgatgggacagtagtgaagattccttcactattgacaagtggtgacctgaacttttgattcagtgttgctgcaataagtgggtctttctctgcctctcttagctccttgccttccccaccctgccacagacaatgcttttctccttttctctccttttatatcttttctgttactcagggcgaccatcttgcccagacaccacatgctgaaacacttggtcggaaggatcattccaccccactttgagtggatcaaagatgacaaggcccaagtaggggcaagtttgagcctggccagttcaatattgggtgctaactggagtggctaatgtctatgttttgtcacacgtattttgctctgctcagaatggaagaagatggttttcctttgtgttgcggtttggcccccagggctgtggtgtggcgagccaagtcactagggctgcccaaggaaagggaacacagaagcctggcgtgctggcaaaagggtgggaatttcttaccagtcaggctttgggcctccctgtgtgcataactggttgaataaatggcaaaaataactgttcatcccctctgtaaagttttgattaatgggaaaagaatttgtgaggtacgtctgaagctgtagcaaatctggtgtactttgtgctataaatttatcttcctgtattgtactgccataaagaggagtaccttaggatagaacatgggcttaggaccccataagcccactgttaaagccagcctggcaagttggtcagtaacaaactttgctgcaggtccctgaaacaaacaagcaaaaacaactgaatgaagtttccttctcgtcttgttttatgtccttggaagcttgagcttgtgaccatatggcagtactttcttttagtctctgcttatccagaggacaggaatttaggggttcatgttgtagttagccccaaaaattacctcaagcagttaaaagcctttgcaagctcaaaattggctgctctagactccctctgggaagagcaatggaaattgcccagtgctgtggcttagtagctaaggctttgtcttttcacaatgacggcctgggttcagggttcaattcccagcttagggaatgggtcctttctggcttaatatctgtgtgacctttaccatttgttgattctcttctcctccatgaactacttctggcttcatttcttgaatcttcctttctctgagctacctgtggagattctaaatcttgtaaaaactgctaaccacctctttgaaaagaacttgtccattcatggtcaaatcataaccttagttaagccttattggtttcacctgtgagtttatttttggtaaagtttaaaagccagaaatattggctgttttgcccagctaaagtagggtgtatttgtctggttttacactgatataaagaacttccctgagactgggtaatttataaaggaaagagctttaattgactcacagtttggcatggcttcagaggcctcaggaaacttacaatcatggcagaaggcaaaagggaagcaaggaaccttcttcacatggcagcaggagagaatgcaggaggaactgccaaacacttttaaagcatcagatcttgtgagaacttaccgtcatgagaacagcatgatccaatcacccaccactaggtccctcactcaacacatggggattaaaattcaagatgagaattgggtggcaacatagagccaaaacatctcataggatagtaataagagatttaaaaggattttattttttaaggagtactacggttaaaagtcagctcaattaaaagcagatattcaagctataggtatattttaaaggcctttatgttttattctcttcttggattgtgtttttctggaaaaaaggtttttttcttttcttctcagtagacttaattgtttttctccattttgtcttcttgctactcttgatgcacacatgagaggacctaagataatacaacctgggactccttgggaaaaacagaagaggggccacagactgcgttttgggaaaaacgtctattttcctcatgaaaccccagggattaaaagcagacagatccctcttaaaatctaaggctctgttctgttttgctttgctttatctgacgttttttgactttttaggggtatcagaaattacttcgcagtatgtgagaattttgatttataataactaggtaggaaatatacttttaggggtggctaatggcagtcatgagaggatacttggctctttgcacatttggattgggagaagcatgctcttggccatctggaaggtatggaaaagtctccacccctccactgagagataaggctcccatcagggtgggctaatcacaaaatgagttgattggttttgggttgccttgcaataaaatgcatggtaaaatctttgcattgtcttgttctgtagtgtccttttgggattcaagatgtaatataaaaatgggatccttaattttgggagatctgttttgtcttccagctgtgccacattattaggtcctagaaactgtgtgttttaaagagaaacattaaaaactggcaaatgaaaaaaacttacacgtactgaaactatttctgtctgtgtatttatatttgttgtgtgtgtgatgtttatatatgaaagagctctgattaactggctgaaaaataataagtgcttaaatcaaatattgtcagaaaaacaaaaactaatgccttttagttcacatgacttaaataatctttgggaaataaagacaattataagattattggtaaaatttggagatttgacctaaattaggcaggtcagatatttggtttgctaaatgctttaaggtcataaactgcttctctgacttttgaaaattgttcagcttacctgctttagagccattagatcctagatacggtatggggacatgtggaattagccattccccctagcaatgctggaaagtgtcagaccttatctgcacttctgtctggtgtcctaggtgccacacctggtacataattagaatcacttgcttaccaagtttttcaccaaaaataaaagtggctaagagttaacattgtaacatgtaattgagactactgaagaaacagttttacatgcaaggtgtgtaagggagaagggaaggaagaggagagaaggcaggaaagagggaagggagggaggaatttctctctcacatagtgttaggatgtccctgaattaagagttggctgacatcagtttttgtcacagatgcatgaccttggctaagaatttagccctttcatgactgttttctcatttataaagtcataatcccagccttgcctaggtcacctcctcacttcttgagaataaaatcagaggatgctcgagacagccctttgaaaactaaaagaagatgcttaggtgtcatcagtaaaccctgggtgtggggcaggggaggacagaaaaatcactaagccttatgtctctaaaccattataatttcaaaaggttaaagcaaggttagatgttgtcacataaaaagctttgttctggccaggagctgtggttcacgcctgtaatcccagcattttgggaggccgaggtgggcagatcatgaggtcaggagattgagaccatcctggctaacatggtgaaaccccgtctctactagaaatacaaaaaaattagccgggcgtggtggcgggcgcctgtagtcccagctactcgggaggctgaggcaggagaatggtgtgaacccaggaggcggagcttgcagtgagccgagatcgcgcctctgcactccagcctgggaaacagaatgagactctgtctcaaaaaaaaaaaaaaaaaactttgttctgtgaaatatttattccctgcaaaactttctgaacaaagcagaggaaacacaagagtcaaagaagatgcagctgagtgctatggttaaggaagcagacactgaagtcagctcagcctggtttgaaataagcttggccattcattatctacaagaccatagaggttgtttaacctttctaaacctcactttcctatctgtaaaataggaagaacagccatctgacaagatgattccaattattaaataaaaataatgtaagcaaagagcttggcattgttcctggcacatagaaaatgctcaataaatggtctctgcagagtctggcacactcggtgatttcctaccaatacacttacatttgtttaaccgtgggtgaagcctgagtcatttcaggccagttagaaggttgataaagaatgtaagcagattcaaggttttagaaactgacaaagattctttgcctggccaaactttcatcagggtcctaagtccatctgtgtatgtccttgtaaaattcaggtttagcaaagaagctgctaagtcagtttggcaaaaagcctccaccctcaacatctgatcaccctcaatatatgattaggttcctcatcctccactgcctcccatgtgatatcggatcatcttgccctattttttttttttgttattgtttttttgaggtggagtctcgctctgtcgccaggctggagtgcagtggtgcaatcttggctcactgcaacttccacctcccgggttcaagtgattctcctgcctcagcctccctagtagctgggactagaggcacacgccaccatgtctggctaatttttgtgtttttagtagagacagggtttcactatgttggccaggctggtcttgaactcctgacctcatgagccgccggcctcagcctcccaaagtgctgggattacaggtgtgagccaccacacccagcccatcctgccctatcttaagccagaatcctattagttcagtttagtcagaatttcccttaccgctgatgtttgctgttggtaattttccttccactgaccctcactctgcttcttggctatacattcccacttgctcatgctgtattaggaggtgagctcaatctctctcccccactgcaagactgtcacagtggtccctatatttatcatgatggtcctgaataaaggattttttttttaaccatgctttaacaaataacattgaataattttttctttaacagaagaattgaggccaagttgttagattggaacaaaatgaatgggcaggaaatgaaagtgagtgtccccggccagattcacagaggcaatgcaatgcagaaacaagggtcacgtcagttctattttggatggacaaggggagagatttcaatgagaccacgacgatctggtttgaccataaaaggcactgcttggaatttttagaaaaagaaatcatgaaagatgaaataaatcctttggggggttgcgaggtaatttacacttctgggtaaagcaatggtaatatttcaagtagctcacgaaagactaactttacacctgctgtcctggtacgactattagcagtgttctaaaagtgcccaggtctggacaataaattatacataatactcttacttctgaagccttgggaataaatgaggactgtttggaaggattctcaatgaggcttttgcagaagttgtgaaagtagcagtttctcaaataacatacttaagttcgtgatctcttaaattaatggtcatgtttttctaggaagaagacctttggatttacagtcccagcaagcacagcaatgccttattctttttatctagattattttcctttaaattaatcgtcatgtttacccaggaagacctttggatttagagtctctgcaagcacagcaatgcctccttcttccttttatccagattattttcttccaagacaactgcaacaaaagttttgaaaaataggtcacctagatttcaaaactattttgtttccagccatctggggctgaggatgattagctgttcttggtatcatggcagaaacccgacgcaacacatttatttgcacatctcccagtgttgcagcattgttctgggtatttgatattcagacgatgtatcaagaatttgagccttggagaagaaaaccactcagcatttcaattagaatcagtgtgttgtgcatacaaaacatcactacagaaaatcttggaacatgttgtattattacgtgggtttttaaaactaaatattgccaagtagttgcaaggtaaattctaatctgcatgggtgatctcttttccatccctgagttttcctcaaagaaaggtggtaaatacagactcccggtttgcacttccaaatttttacccctttaggtttccagtctatgtttagtgaattcttctcagcacacttaatagactctgtataaagctttgattaaatggcatctaagaaagcatcccatgtgaatccatgtatttcttacaatgcccaaaataactataaaaatgtttagtggcttcatttacaataattgccatttttgtgcccttcccccatcttgctggatagattcttaatgttcttctctttcaccatgcgtttgtggagctgccagcgttctattcacagctgctaattatcaacacagaaaacagagatggctctatctcttgtaagagtatgttagaatttaactgcagctatttctccttgtctgcctcaatggtggatataggagaaaacataaggctaattgtattcagatagtaataatgaggtaatactactattaaaataataatagcaactgtatattgaacatttactaggtgcaaagaactttatttgcatgatgtcattaatcctcacaaaaccccacaatgtaagtgctttcactatattatttcagtaaagaaactaagccttagaaaggttaactagcttgcccagtgtctcacagctgggatcacacgatttaaacccaggtttttctggcatttgattttattcttaatttcacgctgtgatgtttatcttttatggtattatgttctgaaatatctaacaccattctgccatttgatctcaaagcattgtattagaattcttctgtcttcctggcaccttcaaagaaatatccaaaattaagatccttataatgcttacagaattttaagttgatagagattggctgtgcaaaacaacttataattaactcatggtttaggtgaggattttttcaatccattaaactctgaaattcttaaggagagagatggtatcaatcgtttcatcctcattgatgagcacaatagttgacaggtagttgtcatcaggaatgcttattgagtaaatgtggacaaaaaatagacaaaaatgttactcatgataatataattcactttagatgtgagagcaactcagatacaaaagctgaaatggacaatttcagtccatgctgagctgtgctcaaaaagggatggaatgaacaaagaatgtctttatgtttatgctgttactgagctgcctcattcttgcctttcctaattattatccttttgtgctggcactttccactttgctccctatgccttctggtcaggcacttcactcaccctttggagaaagcaatttttaaaaatatttatctttttttattatactttaagttctgggatacatgtgcagaacatgcaggtttgttacacaggtatacatgtgccatgatggtttgctgcacccatcaacccatcatttacattaggtatttctcctaatgctgtccctcccctactctcccacccgctgacaggccccggtgcgtgatgtccccctccctgtgtccatgtgttctcattgttggactcccacttatgagtgagaacatgcagtgttcggttttctgctcctgtgtcagtttgctgagaatgatggtttccagtttcatccatgtccctacaaaggacacaaactcatccttttttatggctgcatagtattccatggtgtatatgtgccacattttctttaaccagtctatcattgatgggcacttgggttggttccaagtctttgctattgtgaacactgctgcagtaaacatatgtgtgcaggtgtctttatagtaagaatgatttataatcctttgggtatatactcagtaatgggattgctgggtcaaatggtatatctggctctagaaccttgaggaattgccacactgtcttccacaatggttgaactaaattaccctcccaccaacagtgggtgaaggatatgaacaaacacttctcaaaataagacatttatgtggccaataaacatatgaaaaaaagctcattatcactagtcattagagaaatgcaaatcaaaaccacaatgagataccatcgcatgtcagttagaatggtgatcattaaaaagtcaggaaacaacagatgctggagaggatgtggagaaataggatgtggcaaatatacaccatggaatgctatgcagccataaaaaataatgagttcatgtccttcccagggacatggatgaagctggaaaccatcattctcagcaaactaacacaggaacagaaaaccaaacaccacatgttctcactcataagtgggagctgaacaatgagaacatatggacagaggggggaacatcacacaacggggcctgttggagggtgggggggctaggggagggacagcattaggagaaatacctaatgttgatgacgggttgatgggtgcagcaaaccaccatggcacatgtatacctatgtaacaagcctgcacattctgcccatgtatcccagaacttatactataatacaaaaaaaaaaaaggaacgcctttttgtttttgtatttatttgtgataaactttccatcctttcatttaccattgctgtttcagcacttttgcatgtaaggttattgacaaaactgattgttttccaagaaggacaacaggaattgattttggggtaagatttacaaactacacgtagatcataacaaactgctaataaactgccttctgtttctagtgggttgtaaacaaagtctgatttatcctctgtgtaaagtggacagatggaggaggtatcccgaggcccttgtagacacctatttaagagtgaaatgctctactactgcaggaagcagagtaaatatcctttcagtagttttgcaagaatgcaaacagagggtcagacaggaaacacctgaaagtggtattcctgcgatctgcatatgctgggtcagatctctgctactgaggtgtctctatttctatttgtttctctcctgccagacttcagtttgagtgttagctttaccaacaataagaccttggccaaattacttaaactgtcttagttccctcatttaaagaaagtgcatcgtgtgaaattcaagtgagacaacttacagaatgtgaaagtgattgtcaaatggtaaagcgctcttcaaatgttgcttattgtattagtctgttctcaggctgctaataaagatatacccaagactgggtagtttataaaggaaagaggtttaattgactcacagttccacatggctggagaggcctcacaatcaaggtggaaggtaaatgaggagcaaagtcatgtcttaaatagtggcaggcaagagagcttgtgcagggcaactctggtttataaaatcatcagctctcgtaattcttattcactatcatgagaacactaaaggaactgcccccatgagtcaactattccacctggccctacccttgacacgtggggattattacaattcaaggtgagatttgggtggggacacagccaaaccctatcacttatcattattacaggcatcatctttcaaaagtttccactaattggatgatgaatgatttattgttaatgattagccttctttcataattggccagctcaaagttctatttattaggcatagtatttaatgttttttagctgttgtactttctagcaaacactgctattggtagctcagtgtaggttctatttttaagaaataaagtcagcacagtggactagaatgaatgctggtttgaagtgagtagtttcatagttctggtctcaggttggagtgcaacttgttaccactctgagaaagtcattcaacttgttaccactctgagcaagtcattctcctctctgaacctcaggacagattaaataaggcaatgcccataaatcaacactctttcctacccttcatttttcaactagctcaaaaaaatacagtgaactgtttttcacctataattctcaagagttggggttttctagtttatctatttcctgattaattaaaattaaaaatttgggggccgggcacagtggctcacacctgtaatcccagcactttgagaggccatggcaggtggatcacttgagatcaggaggtcaagaccagcctggccaacatactgaaaccccgtctctattaagaatacaaaaaaaaaaatagctgcatgtcggggcacacatctgtagtcccagctacttgagaggctgaggtaaaactgcttgaacctggggggtggaggttgcagtgagccaagattgcgccactgcactccagcctgggtgacagagaaagactctatctcaaaaaataaataattaaaaattaaaaaattaaacttttctttcaatcattgccagaagcattttaggaagactaatccatatcacttaaagaacattatctatttagggggtatcatagagtttatttaatcaaaaccctgtacttttatgaggttggatatttatatgttggatatttataaggggtatcatagagtttatttaatcaaaaccctgtacttttatgaggttggatatttatatgttggtttcaacatataaatattgaaaccctatattgtttcaatactgaagatattcaggtaacttatggcaatgtacggaatttagggtcaatcttcacatatatttgctaagtattactatttcccaactgagttcccaaattagggaagaagagagaggttttctacaatagacattgtgcctgatagggtaagatttgagttgtgcttagttagtagtcatgcatgagatatataatttataagatcacaagtgttcacatatgcttcttactgtagggctgactatctgatgtcaggcccagcaatctccgttcaagaacacaaatttagagaaaaaagccagaatatttccagaaatatttattgtaatagaaattttgaatgctgtaatattttaattcctgagacttaagtattgcctgatgtggcagaatgaaaatacttcccactttaatgtcaaaatgtctcttaataaaactaactatacagcagaagcatatgattatcacaaaattttctgtgccctgttctagtcttgttataactctgctcttgcagtgttataaatcaagactataaataaagatgtaactttttattttctcagttttagaccaagatattcaagtactttttcctatagacagaaatgaagaaagcacttactaataaatagcactgagatttttattttcctcaaccaaaatggtgatgatataaatttagaattgaaatcctcaaaggttggaaatgttacactgagtgggatcttcccaaaactctcctacttttgtaatctttaaggtatactttctgacaatgaaagcaatcaagctgtgacagacctccaggtttagctatttaaaataatattattggaaagtaacattctcactaaaggtggtcagaattctagattgattaagttgggtggtttaagtgtctgagttacaagtgtcttattgagtgcaatatatcgatatacttatttttcaaaatgttataatgggtttaagtatcaataccttgcagacaaaagaaatttgagatgtgtgctttataagaaaattcacagcatggaaatttaatatatagttcaggaaatttagttctgaacactaccttagaacttcctttacagaacgttagatttaagatggtaagtgtcttagtaaatataagttgatgattaagagcttgggctttggagtgataaaagcccagaatcagatattggtcctcccacgtaacaggtgtgtgagcttgaaccatttactttcacaagttttttttttccttaaaagaaacaatttatttagaataaaacaaaagcagctcaactgtgagcacacgtttgagagacagctactcttaagctgtatgagccataaaaagggtttttatttacttttccagaaatcttgtgtacacagcacgaagcaaagaggtcatttttttttcccacttaaaacaccagcattggaatcacaatagcagatacacaactttaagctgccattttagtaaaatgcacaaatactaaacatactagctttcttccatcagagccccatataaactccacataagccacaacttctcttcaaaaaggtccattagagctttgaattccatatcttcatccgctgttcaaccagttttgcttgtggcgtgggggagagaaaggttattcagtacaaatgtttacaatattaaaaatatatgtatttcccctatgtcattatagatgaacataacattaacaagaccttcctggatagttcacctcaacttcaaaaagcagcaatagtacccactggcataaatcttgaaatgaatttactgtatgaatagacatataacaagactgcaattgcagataataagactgaaaataccctttatactcgtgtaactgagtaagcatgccaaaaaattcagaaaaaaagtttcacaatcaatttataatttatcaatatattctaaatataacttaaaaagtgaaactacaaaaaggtgaagtttagtcaaacttttggcccatccatctactaagtttttatcttcccataagaaaaagagtgataaaggtggcagctacctcccatgattgtcactaggatttaatgagatcacgagataatcacagtctttactaagacccaagatataacagatgctgtaaatcaaagaaagaaactggattaaaatgttttgagaatcagtttcataacccttgggctcttcatccaaggatctttaaacaagatgtaggatacaaaatttttgcgggtgaaatggaggagggatttgtttaagtgatttggggcaagagggtttgaaggacggtaggtcacacctgctccttaagcctcaccaaggggaaggggctctgctcacagcagcctggtgaggggcttgaatgagcctgctggggaaagcttaatatgggtctcccagaactttagaggcaacagacttgagtcagactctcaccaagaaagatggagggcagcagagaaatgcacgagcggctttcctgggagggtggaggcgaggtgctgcggcatctgcagggtaactgcattctctctcatttctctagcgggtcaaagaatatgtgagattccccacacatttatgccacaggaggagaaaagcctgcctaggggtgttttaacttatgcccagaagtaccacctggaagaggcaacgagactttattcataagaatctaagtggagcattctcccagacaaccagcggcggagcaaggaggggctggccaaacagtgacgttgactggtgcatgagacgaacagaggctcacagaagagcctctgaagagcccacaaaaaatgtccataaggtaaaagagtcagctttgaacttatttttcagtaggcaacagaagcttcacagaagagagcttgaagctctcttgaagcagcatcatggttcaagcaataccttctcggtcacactgtgccccttccctttccagtgctccaacttcagtgagggagatagagggtgagaaaaaagacaagaagacatcctttcccgcttaaatcaagttctgagctctgatcatcctctgggactagacagcctaatttctgaagttagactgtctgtgatttaaagagattgcaggactttctagactgatcagagaagtcacagcccctgcccattttccacctagggtcatagaaagactatgtctagtatgcacattttaaagacagcaatggaaaatgaaaataaagggttttggttcatgttccatgagctgaatttattcaaagtacaactgattattggtataaacagctctttctcctttttaaatcaactggaacctcacttgctggacacaagacccttatttgtacaagcaaatggtttctttttttgagtcacacttctaacctgccatcctggctttagccagatgccaccaggagtgcttgttagacatacccagcccagttttatataaagccaaacaatatgaaaagtgggaatgtaggcagcaataagatgtaatgtctaattatagaatcagaatgcaagacatacactaatcacagatataaagaagaaattggggactgattgccattacatacctaacaaaaatctattgattatcagcacactgtgaagccagactgcacattgctggaggttagggagctgtgacaaaaggactggttatagccttgtttctaaaggacaacctgatttcatgcaatttcttttaacagttgattgagagccttgcccaggctggaacctggtagttgtgctgatgaacctaccctacaacccaagggccttccccattgctactcagcacacttgaatttccataaacttttggacaacttagaagcagtgtggaggggtcttagcaagcccgtcatctttgtcttgaatgctcttctctcatcttcctggaatcccctggcataatgaaaactaaacttgaagctccagtgtcaggctctgtcttcataaccagagcttagcatagtgattggcacttagtatgtgcttgataaatgatagcgtgggtgggggaaagggtcttattttcattactgcaatccatcttgaagggcaaacctcacacaaagggttggtgaagaggaatattgtctccaaaatgagctgtggctttcttttacatggggaggcatttttaatatgatcatagatcgctacagctggaaggtccaataagataatatatttcagcccttcacagtatcctagaccactatcgcctcatatcatattggcccagcttcttgggatgaagccgatcagtacagagatcatccctgtcccttcaggtctggaagtgtattacagacatatcctgctgcaaaaccctgatcaactaaaatataagctcgctaaggtaaattaggtgttaggataccacttgattaaaaaaatgttttaccttttacctaaatactaaaataatttcagtatttcttcaaatataaattaatagttgcacagagtacatttaaaataactccaatgataactgcattgcaaaagaaaatcagatatatacttttcaaaaaaagaaattttccaacttcagaatgtgatatatcaaaatgctctttctttgagagagtacaatcgtgtggtatttatttatatgtctattcctttgagttgcattacctttatatacatataaaatgaatatatataacttgtttaatatataagaaggtaaaaggtataagtatatactttttcctagaagcaagaaattttgcttacttttaaaattcaccagaatattaagaaatctttgttttactctgatttatccattgagcttggtagtaaatttgttactcaatgaaagaaactaattatacagaaaactggtaaagatgggtaatattcattctaggttttaactaagggaaaaattttccttcagcaaagcacaagaaagtgttttctttctagctctagggaaagcctgtaaactataattaagtattgaattaatgctactagtttagaatcaacggtcagtataatcaatacttgagccttcataaagtatggggacaagcatcagcaaaactgctggaaaaaaacagaactcaagaataactccatttgctgctctatgtcccaaccttaacaataaaggggacaatagtattaatgctggacaaatagaaggtccagcttaagattttatttaaacacacacacatgaactctatattaaacgacaaaagctttgccactataaaaccactctgctaactagtgtaatattatttatatactttatatataatagcgtactattatttgctactttgatattgctttatctgtgaccttctttctttgttccgcattagccctgtggatcattatatatatatatatattttttttactattgtattgtatctttcagtggattttttgtgggactttggctgggttgcaatatgctccttaagataacgagagacatcctgagctgtcacaaaatccctgatgcttgtttattcaatgcaactaaagtgcaagacagtcccctctcaatgcttgccttccaggattacgctaacattctgctctgtttataagtcaactcgttgggctcttctgtggcaaggagcaagttgttctcattcctaccttcctacataatcattcaagaaatatttgttaagcatttactatgtgccaggtctatgggaaacaactaacgaagtctagctcccatgaagtttgcaattttgtgagggaagacaggcaataatgacaaaaaataaattaaataaatttgaaggctagcaggtgacaagtgctaaaaagaaaaagtccagcaagataagggaatagagagatgggggttagtttatgtggtatgatgaagaaagtagattgttagtgctcaataaatgcttattatgtatgtgaatgaacagctgttcataatcctacgtttgttatgtcagctggtccttcaagaaatgatgctagtccttcctccaggcatttcttttttaacttactgagttgttaatgatccctacactatttcggtgttagaattgaagaaattactgaaatgtaagtactaatgacttaaaaaaaaagtctagcacaattcttggcacatagtagatattttacaagcctccttgatttacagcattggaaacctgaaatagaactgagttttgactcaccttagaattccatacattttcctaatctgcaatgttaggctttttccctgtgagaaactttccaaatagtacctgtaatcataatcaactttactgagtacttattatgagaaataaatgagtttgttccatgttagttctttaagtcatcatcttatgaatccttacactgacactgagagaagtactcatgtggatccttttttctttttttggattgcaggaggtgcgacaggcttcaagccaaggctgtctgacctgagacaaaccaatgatcactctcacacgcattatctaaataaaacttatccacttaatttgaagtgacttttttgtagaaggctggttaacctgctaaagatacaaaaattgctgatggtacttgaatagtagtatttgagtgggtgtttgtggaggagaaatcttttaattagaatctgtgcatccctcacaataaaatgcaggcattagactttgatctcaaaggaaacttatagccctgttatttttaaaatatctactgttcactaatgggattaggttgaggtttgacacacagaaacctggattagtaatttatccttattgtctctccattattcagaaaataattcacagataggctgcttgattggacagttcaatgctactttgagtttttatttgtgaatgctccacagtagtgaatatcctaatgagtataaggattctgccaaggagatttgtcttcctcctcttgtttttggtctagggtattatgttttgagttggctctggtttccttgtgaattctccagagctaccagaaggcccttgaagcccttaacctcttaatgatgttcttctccaaaaggctcagccctgaaaaacagaattgaaatatgctcctctgtggaggctggcatttttccaaggctaatcagaaggctgaatccagtaaccctcccctgcagcactcagctagctagccagctttctttcccctccctccctccctccttctccctcccttccttccttcctaacttctttccttccttccttccttccttccttccttccttccttccttccttccttccttccttcctctctctttctatttttctctctctctcattaaagcaagttgcttcatttgtttcttagggcaaaaaatatcaaataaatgaacgaacacagcaaattggcctgtttccaaagggcagctagagatattgaggagaggacccaggatggctcttgaattatttttccagctgtgcttaccaaaagaaaacaagtcttctctggccagctgtgtcatatttaatgatgacagggggcactatgtctataagaagccaccagcttccacatgaccctttatgtgacaccattaagatcacacccagactcttaaaagttcactgaacttctttgaggttaataaataaattgccaaagattctccaaggccaagtaaggcttaggccacttctattttggagcctccagttgcattaaagatgaataaaaatccaaaagaattctctgaaagttgttacatattttaaacctattaaacccattaatactgttttaaagcaaagatacagagcaatatcagtgtgctccttacaaaaataattacagcatttattatataaaattaatcatagtttactataagctgtttaatggtaaaaaaattaaagattggtacaaaaatataaacatttaaaatgggtgatggatgtctttcagtcctgttacagtatctctgtgagtgtacccagatccttgtgtggatatagtttaaaagttagggccaggcacagtggcttatgcctgtaatcccagcactttgggaggccaaggtgggcagatcatgaggtcaagagattgagaccatcctggccacgatggtgaaaccccttctttactaaaaatacaaaaattagctgggcatggtggtgcgtgcctgtagtctcagctagtcaggagaatgaggcaggagaatcgcttgaaccggggaggcagatgttgcagtgagcagagatcatgccactgcgctccaacctggcaacagagctagactctgtctcaaaaaaaaaaaaaaaaaaaggaaataaggtctggcctcagcacctattgtagattctgtaagatgccattgagtacttcttgaacactagaacctaagggaaaacatcaacaaaccgaccttggcggatgcaacttagatctacactaagaaacactttaccaatgatctgagaacagcatgtcagcaaaatattaaccagtgcaagaaaatcttattttaagactaagctgtcttcaaataatttggagaactcaagatctattattttaggtttccaaacctttgagttttgttggattctgcttgattaaccactccttgctttattaacagagaatgccaacagtaacaaaatcttgacttgctatctctgtatcatcactgtaagaactagtgattgtctttggtttcacttacctaggattgtcttaggattcatccaggaggacaaagatacccatcctgccctaatcactccagaccaccatggaggttttggttctgatatttgatttttatggccttttgtactctcctcttttgttgtcagcaattatatttatcacatctgccactgagcctgcaaagaatagactctcatctgctccgtactttcttatttcttgggagattaaagattaaagaactaactttgttgactgtgtcttagaaaaagacacagacatcattaggacaatgttattatgaatacatgatacatggcattaacttcaatgtttggactttagttaatttatttttgtacttttactttgtcagagactctctgagtctcagattcttcatccataaaattatacacagaattttggtgaagataagtgtatttatataatgtaatagaatagatgtcatggtttaataggagtacaatattatatataattacacttaactgatatacacaagtatttacaattattattgtttctgattattagtggtgttgaagatagaagtttccagacaactgaattctgggaagatgagatcaaagtttgtaattttgagagaataggatccaagttggaaaaatccaaaagtaaatatgcagttagaaagaactggacttttgcatgcatcagactcagccagaggaaataggtatatttaagattcttttgagcatccctgctatcctggcatagcagggctttaccatacttccagaaatgcttaaaggcctttcattcagacatgccaagtagaggtattccctcatcaaattctctcccagaaaaagctcgatgacctgggttgtactcatggacgaaagacgggaatagagttaacacaaagatagaacttcagaacaattttctgtggccaattgcccttctgggactttaggttcccttatgcattataaactagagtttatatataaacaaatgaatatatgtaaatataatatacaaaacataaatagcaaatatgtaaaataaaatatataatttataaaattttctatttatatatcatttatcatggagtctgaaacatggaaagtactccagaaacatagcttgttccattactgtagaattaaatactcaccaaaacatcaatcaattatacagctttgtgttttcctctatttttatacagtatcctcattcattcattagtattaaaatatacactttcatttttctaaaaatggttattactcagaaattctcatatatgtaacattggaaacattactactattcacatatttaactttataattggtgacctagtagtccactggtttcctttaacacagtttgtttaatgattcctataactttgaacattgttaagctatttattctgctaattaaaaaacgaagtcaccaaataagccagtgcccataagttagtgctttaaggcaggagagtgaatttttctcctaaattctgggaccaaccctccatgcagagaaagctgtttgtatgtccaatgcttactgatgatcaggtaagctcgaatgtctttcacccactctcccacataccatagtgctttattattattattatttttaacccaatgagtcatgaggagcttttttgaaaaaccaagattcctttaaactttggcagtgccacggtgcaaccagagaaggctgaccagtactaagccattccactgagcttggccaggcaatcaacccacagaaatgatctgctcttcatttctcagtgggggataaaggtggaaatcatcacacatataaacatccctacaagaaaaatgcttaaaacgtcacttctacctagccagcaagagtgtctgttctgagggtaaattaaaccagttaaagattaaaaattacaacacgggcacagctgggcctgaaaacatgaggattcaagcaataacaattggtaactgtcaaagatatagctaaatagaaagaagctgactctgatctgatgcagtctcagggccacttggtctacctcaggaccccattataagtcacataaacaaattccatagctggctactagtcttctccttcccaggctcttgtgtcccgcagaccatcttccaggtgccatcaaaactactacctgagagactgtccactcagaatcagtaagaatgtaaggaatcaccagattccatacattttatttaaactgccccagcatttcacctcagcctaccttttttaggcttattgttccagactacttccctcatgctatgctctagccaaattgaactcccactgttctctcctatatgccctgtgttttcctgcctttgtatctttgcataagctatctactttgtctagaatgtgtaaacacaaaaatcctctcaaaactttggttgcttaactattgacttgctggcatatattcttcaaggtgcatctcatctgctgcctgttctgaggggccatttttccatactttattattgataacaataattgggaacattgactgaatgactgaatgctgagactattccgagcactctgctaaaggtttcatagacttatctcacaaaatgataaaagtataacataatgttgtagagtacagaatgccagggttcaaatcctggctctacttcttgttggctgtatgagcttggatgtttattgacattctgtgtcttcacgtgtgaaatgtggataatgataatacagctaataccaaatagagttactatgaggaatatgtgaaataatatatatatataaatcccacagaacagtttctggccaattctaattataaatacctgatgctgttattatagtacctcacaatatgctacaaggtagatgtcatcattattcctgatacaggaggtagaaggaaattatttaggtagatagcgagggtaaaagaatcctcggcagaatttcccttttaacaaaaagcagccccaaatcatttcttttctaacaaagagcagcttgaaaaattgagctgcagacatagataagcaagctggaagtttgcacagatgaatactggcagctgtgccaatagaaaagggctacccgagggccaggtatgttcaacatggagatgctgtctttccttttctttgtcaccacatgtacaataaagaaacaggcaacctggcactggccaggtagagaacccatctgcaaaataaaagcttagggtgggggtggccatgcaaatggcacacctagccctaaccagtttttcataccttatgcaaatagcacacttggtctgaccaatcttttgtgccctatctaaatcagacaccacctccccaagctcatccataaaaccccttgcatttcactgtgaaccagaagacctgcttgggactcctctctctggaagacagaggttttctctttcttttgcctattaaacctccactcttaacctcactcttcgtgtgtctgcattgttggtttccttggcatgagacaacgaacctcggttattacctcagatgaatgatgccgcttcattcccacttaagagatgagaaaattgaagctcaaaaaggttgaaaacatgtcctaagttacatggctgataagtgacatctagaacacacatataaatttgtcaatttgaagcctcttattttctgcaatatagacaaactggttgtctttttgatctaggaattttccttagggctaaacaataacagcaaaaaaaaaaaattcactaacatttattgaatatttactatgtgccaggcatagtactcaacactactcatgcattatcctacttgattcttacagcagaatgagcaaaaggaaccctttttaatccttattttatagaggaagaaactttgctttagagaaacttgttcagtcacacagcttacatgtgacagagctagaagtcaaaccctggctcttacctaaaacaacatcctgcctagtggaagctattcccttactcttcttttcttccagttctcttagtggtagctacttctgtgtcacttgacactctgtgagttgtgcatatatcacacactcctgctaacctgccagtcacctgaagagtaggaccctgccctatacaccatcgcctacctagaaatgtcttccaagtagtggatgcctaataaatgttggactgaattcaatgtcacattggaagttggattataaagaatcaaatggtgcataaaaatattttgcatatatgctaacactttaaattataatggcaggaggcttgagtccagttcctttatggatgaacaatgaatgagaaaaaactgttgcaatagttaagaagctcagccctgaaattggattgagctgattatcttgccccatacttataaatgtttttgtttgttggtttgacttatccattccaaaccagtttccccatctataaatagaagataagaataatatttcccttttaggtttgttgataggattaaaagaatattcatgaaaactacttgggatcatgactcatacatggttagcactcagcaagtttgcttcataaataaaaactgatttttaaaaagtcaaataattacagaatagctccttatcatcccagcaattacacgtctagatctaatatcttcctcaggaaagatcacaaccattgcgaaataaacttaagtgaagatgagggaagagaaaataaaacactcacttgggaaaggtgctctgaaagggccaagcatgtgagaaatggcaggaaggaggccattttgtggtaaacagctgcgttcttaacccaagggacacaatcctcatatgacgcctttgtgttgttaagatgtgtgataaaggccccatggggagggttttcctttgttctccagtctcatggagagatcacatgttatactcacttatttagagactctcatctctaatttgttaagagctgcaagattaagactgatgtaaagtctgaaggccaataagaaaaaatgagtaagcacacccatttcccaaggaagatatcactcatggtgccagaaaatacacacacacacacacacacacacacacacacaaaagaaacctatattacatgaaattgcagcatttgaaggtttctattatgaactgcactgtgttttcccaaaatttatacgttgaagccttaaccccgatcccaacgtggctgtatttggagataagaaggtaatgaaggttaaggaaggtcttgagagtgggattctagtctgataatattggtatccttatcaagagaggaagaaacaccagagatctctctcctagtgcacagagaggaggccattggcaagccagcaagaaaggcctcaccagaaaccaaccctgtaattacctcgacatcggacttccaatctacagaactgttgagaaaaaaattctgctatttaagccacccagtctgtggttttctattgcggcagcccaagtagaatcatccactaacatttgtattaaattctttcccatccacctatacaagtgatggttatattttccctgttaaaagtcagaatgactttttttttttttttgagacggagtctcaccctgtcgcccaggctggagtgcagtggcatgatctccactcactacaagctccgcctaccggattcaagtgattctcctacctcagcctcccaagcagctgggattataggctcgtgccgccaggcccggctaagttgtttttttgttgttgtttttttttttttttgtatttttagtggagatggggtttcaccatgttagccaggatggtctccatctcctgacctcgtgatccgccctcctccgcctcccaacgtgctgggatttcaggcgtgagccagcatgcccgacatggatgacttttaagagaaaggacttttgtatctctttcaagtcaagtggtgtgtttgggagatgtagtttggctttcctactttaaacaaaaagaaaaattaattactccccctccccccacccccttcacataacccttgttttgtaaagtgtctttattaggagtctcttccataagtacctccctctagacattaagcaagggcacagggccacagggagacaaagaccagctacacagccaaaagcagtgtgcgctcagcaataacacaggctctttgttagaggaattttactctttttccttctgaaattctttctggtcgaaaaagtttttacaattccatctccttaggccagccacacttggcacatttgggcaaggagggtggcataaaggtgtggcctgccctgatggatgaggttctgtaggactgcaggcttaagtggtgctgtggcttacactgatagagagtactcatctgtttattctcccttccaaaaagtatttttgaggatctgggttagagcagtcaagcaatagccaaagtctgccgtcagcttataaactagtatgaaaatacagactaccatataaaagcaaccaaattaataaataagagactttctgatgatggggagtactacagaaaagaacataaaatagaggaatggatgactgtaagttgtcatttggaatgagtctgcattgggatcaggaaggcttctctcagggatgacatctgatacataaggaggaatcagtcatgctgagatggggaaggcgaattccaggcaattagtacagaggccctgtcaagggaattacctcgttttgtttaaaaatctggatgaagtatggagtgcctggggccaaaaggggtgctggatcaactaggccatgcagaccaaactgagtactgtaaacttagtgcctgagaaatcattgcaggggttagagttaagtgagtgacatgaccatatttcattttaacaaggatcaccctgactataatacaatgacccacaggccaaatccagcctgcagcctacttttgtaaatagtttgactgggacacagctatgtccagtcatttaaatattgtctatagctgcttttgtgctacaacaggagagttaagtggttgtgacagagacctaccttaaggcccacaaaacctaaaatacttgctactgggcctttggaggaaaagttggttgcatggcagcaggaggctgtgcagttatccttggtggaagtgatggtggtgatgatggcttggcccatggtgcggggtggcactatagatatggggagatggagagatctaggacatgatttgcaagaagagacaactaaatttgctggtgaattaaacatcaagggagatagaggagaggattgagaggactcaaaatatttctagctttttggctagaacaactgagtggataagaaggccatctgctgagatggggagttctgggggaggggcagctttgtgggaagagtgaaaatgaaggactgctggagaatgttcagtttaaaatgcctttttatagggcctctctgttgttattttctcagtccagcacaagaaattgcaaagcaacccaatgacttttatctcctcctcattctataacacaaacaaaagccatgtgaccaatggcattatagctggcacttccttggatgctaaaccacaaactctcaaggcagggaccatgcctctaattgctcaaaattagatttccgtctctaccccagcacctgactcatagtagaagctcaataaatattggttttgaagtgaagaaatagtaaccggttactgagaacttacaatggcatcaggaactgagtaaggcacttaatacaagttacattacttaatcttttcaagagttcctcaagctagttgctgctatattaattctacatacagatttagaaactgaggcttagaggaaaggatgaaaagcacagatgcctttcctacagggttgagtcaggaaatatgaatgtgtgaaggggaccatgtactgaataatggtgactggcaaggcaatgaccttccttaagtgagcaatggctcctcagctgccaccgagcgttgctctgtgcaaatgcaaccacacgatatggtcaagtctgatttttcaagagaaattgaaaatccagtttatttgataaatatgaagtttctccattaaacataaaataaattctttaatgcctgctcattgttctagatcaggcattaaagaattcggtcttagcaactaccactcacacattcctcagtgtactaaccatcttccttgtggtagaaaagctaatctaccccttagtaaatattattggtgagtctggtgtaacacattgtgcctatgtgctcagcagaatgtattttttttttttttttgctaaagatgtttcttataatagctaaaggttccactaggcacttactttttggtctggaacactgtagccattttcagatgatgaccagagtgaaactccaaatcatattgtctgagtggctaatgaattcctgtagtcctcctaacgcaatgatgcaactacactgacatcactgacatcactgtgccaacaaaccatgtgattttagaattaaagatattaaatgcttctcctccccctttttaaagattcaattcttgttactacctttggtttatggtgacaggttactctactgatggttccaacttaaataatttcataaaagggagattaaaatgctatcgttggcttatcttttcaattttcagcacaacaacctctaatttgtaacaaggagaaacatttaaagcaagaggatgtttgaagtgtccaacaaattcaatctggtgaacaattaatgaatgactattatatgccaggatgtgtcctgggccccaggatacaaaacaaataagccattgcctctgcccaggagcactatctttccagtggaggaggaagacccataaaaataatatatcgagacacatgctataatagaaggattacaaaataccctgggaactaagataaaaggatgattaacaatgaggacatggtggcagagctgagagaagtctagcttaaggaaagctacagaggaaaggttacaactcagctctcactttaaggatgactagagtttcagaattcaagtcataagagttgcattttgggtgatacaagcaaacagctactaaaagtttaccgtgagtgaggtattattgcactcataactcattcctcacaacccaattaagattgggttttcagtctccacttttcatattaagaaagtgaggcccagaaaggtgaagtaatttatccagggcctcatagctaattattgtgaaaacttatattctattccaagtctatataacttgaaagcctgggcttttaaacagtaaatgctatcacaaggtagggtgagcaacatgtggacataaaatattgtggtttgaggactacagattaggccactatgagtggaagagagcttgcatcaaggagctttgggggtaggtgtgcacatgaagagcagctgtgaatatttcagtgtaaggcttgcaaagtaaactgggtacagattttatgactatagagttggagcgttattccataggtatcaaggacttttgggatgcttgtaagaatcagaataacaagatcaagaatgaactcattagacaaatccaagagttttgaacaaagctttggagaaattaaatgctggcaaatctactaggaggttattgaaacaatccagacaaaagacaacagtcttaaataaggatactggcagtgaggacaaagaagattaggatgtccccccttttgggactgaaccaatgtatatcttatacatattgattgatgtctcatgtctccctaaaatgtataaaatgatgtctcctgtctccctaaaatgaataaaaccaagccgtaccccaactactttgggcgcacttcatcaggacctcctgaggctgtgtcacgggctcatccttaatctcagcaaaataaactttctaaattgattgatgcctgtctcagatacttttgcgttcagacataatagcaacacccacaatagtgatacacggatgttaaaaataacgtttaatttgatgttaggcaccattcttccaagtacctctgtaatttgtatttgttaattggtgaaaactaaccaaggcagattaacttttatttttaattttttttagagataggatctcgttatgttgcctaggctggagtgcagttgctactcacaggagcaatcatagtgcatttcatagtgaactcctgacctcaagcaatcctcccacctcagccaccggcatagttgggactattggtccatgccaatgacccaagctcttttttgaaagtaactagtccatacacaaataatgaatgactaggggtttctgagcattccatgatactaggatataagtcaattaaacacacaccctttgaagagccacaatgaaaattgaaatcatttaatttattctgcatatatatgtatatcctgtattgctctaacaaaaagaaacacaggttatttgcaaatatccatgtgaaagcatgagaaataaatgagcatatcagtgcaaagggaagggaccaataggaatatttacattcttttcaaaaaggaatattctctttgattactaatagtttgactataatgaattaaatggaagtacaattatttgaaagaattattattcctttcaaagcaccttatagattcatgtcgtgactgaagcatcagagagaagaattctatcaaagacaacttgtatttgtgttgtctttacaggagaaatcatttaagtcagtaaaggtcagttttaaaaaaatgatagggaggcacctgccctcactccttactctggtacacacacaaattagagcattctaaccacccagccttagaattattgcagacgttaccttctgagctattcaaaaagcctttgttcatgaaaagttctcatggttataagacattaaaacaggaaagaccttgctcggcatgatgtgttgtatttatatttctttttgtttgaggaattcaaaaagctttacaaacaacatccagtaaatctctttaagactgttgctcatgggaattcttttccactcaatgcagactgggacaggtaaagggagaacaaacactgagagaagaaaaggagggtggatgggtagctgcagatctctaaagtcaccaagaaggtgcagggctactcacatttatcctcctacagggcctgccaatataaacagcctgtgctctacccttcccatgtggtagctgctgtttccagatttaccatctgttaacacaggtgcacaacagagaacaaaacagcagaagtgcagagtagggaggtaaagaacagaggacatgaaaaatcaacaattacaaagtactgtctgtgttctgtaaactgtgctagatgctgtcatattttatagtaggtgctcaataaatgcttattttcttccccttcacacaatttatgctatctgattaaaagaaactagtttttttggtagagaaaaggaagagagtccctgtgaattaatgttgctgatcatgaaataaatgaatgtatgcatgcatggaggcataaagggaaagggaggcatggtgtggggtcatgatctgtttacatggtccatacagtgattacacccaggtaggacccattccatttgtaggaaatatgactatgaaaaataacccaaaggatagaggtagccactgggaccaaaaatgcaaccttcctgtaaactttttttctagtaaagtggactatcaagggcgagggagaacccttcacaggtgaagtcactatcttagttcttgatgatggtagcagagctgagactgtgatgtggcattagggaaactcttcttactctctccatccacatgattaaatgtggtccttaaatttttataaatatctataaaaagaccttcgagaagtaatagctttcatgaaacaagagagctactcaaatcaactgagtcagggatgggatcccactggttctggagtctaatcgtccttggtgagaatccagcctctgttctttaacctgggcccagtgatgttatctctggaccctagtttccttatttctgaaaggagtgatcataatgatatgtagaataactgactttcagagccgctgtgataattattaaatgagataatgcgtgtggacatttagcacagtatcagacatggtaagaatttaacacatattaattgatgttggtagcaattttttaaaaatcctgaaatgataatgcagttgcacctgaggctccgcatcaatccacaaatttttaaagtattatgataatatttgatagaaatatgatgaaaaatttgacatatatggaatcaacttcaatccacaggttctgtttcttcttttttgtctcttcggaatgtgtcaagtactaatattgattaacctgattttgacttcaaaatatgagccatgacattttttaaactcatgcataagctgtatcatgtgctatttaacttacaaaggataaatttgtctattaaaagtttattcatcatggattttattttaggtaaaatagtcaaatgtagtaacacacggtttagtaaagattcagaaaaataatgaaggtctctgaggtttaattcctctaatgagaacatgtaaatactacagtaatcagaatattgtccactagtttcaaattttacaactttatgtaaacagttacagaaaagtctgtggcaatgttgcaactaaaaaatttaaataatttctgttggtaacgaaaaggcatagtgagcaatagctaaatgcaaatgaaggctaatttttaggagaggtaaaaataacttcttttaaaatacaaatcgaatgttacatagaacaaagaaaaataatttggaaaaacttacataatctgtagtttataccatataacaaaacaagcttcaggctgtttaatgagttaactatgaccttcaaatcatagaacaaaactaactgaaaatggactatcagatctttaaagaggcaataattccaaatgtttgaaaataaaacagtaaatcacaaagaaaaagttcaacataattgaatataaaagtgttttgttttgttttttgacatggagtttcactatattgcccactgtggccttgaactcctgggctccagggaacttcctgcttcagcttcctgagtggctgagactacaggtgtgcatatcatcatgaccagctaaaagagttttatacaatgaaatccccactagaacatacataaacgtatcatatatgcatgcaaaactaagtcagaaaacagcaaataaaaagtcccaagaatgcaatttattgaactatgtatagtgcaggtgcattgtttagggtgcactagtgcctctaccactgacccatacactaagggacattagtccctctattactggaaagtgtctgctcttactcttagaaacctctcttgtgaccttcttttatttttgatgataaagactttaagaggtggaaagagaggcaacaaattttaagggttatgtcttatcttttgatcctatttccatggctgggtaaattgtttccagaaaataattaagaggaagagtaaaaatacatgcccataccagaagatgttcttatcagtgttatctaataatgaaaacaaaagaaaataaacagaggcaggtagaagttggaaaacagaaaagaaaaaaaggagggaagaaaaagagaaaggagaaggggagcagagagaaaaaagaaaaaagaaaagaaaatgaactgaatgtctaaaaaatgagatggcatatcaattcgactaattatcattttttaaagatagttttgtggaccatgcagtcacaagaagaaatgtttatgtgaactctgatctagagcatttatgcacaaatttgagcatctactcttcaggcactgttctaggcttcagggatatgaaaatgaacaaagagagtgctagtggtggacaagaaacaaaccaacaactgaataaaataccaatcaatgataagtgtaatataggtcattaagatggtgtgaggtgctggagagcacctggtggctcctctagactggatggtgagagagcctcccttaaaacaggacacttaagctgcaatttgaatgacaagaagcagctaacctaataaggtaaggagaagtgcaagtcaagaaaagtgtgtctgattaacaggaagaggaagacatgaggaagagatcaggagaggagtctgcaaagtcaattcgtaggatttggtaattttgacaatatttaaaagggtcattgtgttctctgtgaggagaatttaccatacaggggagagaagcaggtagtcccagtcgtgggttactgaggtagttcaggcaggggaagatggcagccctacatgggaaggtggcaatagagatggaaaagtaaacagatttagggaatgttttgaggtaaaagcaacaggattgttaacagattgaatgagagttataaaggaaagaaagaaatcaaggacagctcttcaaattggctttaaaacctaatgccatttactaaaatggagagaaagaaggacacgtttgtgctggggtggagcatgcatatgagtaaagaagtctactttgcccctgtgaagatcgaaagacttgtaaacacattagtggaaatgttaagtcaacaactgagtgtgagcctggacttctgaggggaagtcaggactgcagactggtgttatcctagagatgcagatgcatgagattacctggggagaatgtagccagaaaacaaggaagtcaagcactgagccttggtaaacccaaatgtttagagatggaaagcagaagagggacaagagaagaggcagtcagtgaaaaaaaaaaaaaaaatcactcagtgtgtagttatcaaaaccatgaagggaaagccattaataagaaaagtgtggtcaacagttttatctgagaggtcaatataagaaaaagaaagagaaaaaaatgactttagaattaagcatcaagggacatagtttgttaaggatttgacagatgcagtatcattagaatgatgacaatggaagcccaactagggcagctgtggataaagtgtgtggtgagtaggtgtagacagctttgagagaagactttttcaacacacattgctgtaaagggtagaatataaatggaataatgattgaaagggatgttaagctcaaataatttcttttaagatgtgaggtatgacagcctatttatatgctgatgtgagtgatacagttgagaggaagaaatggatgattctggagaatgagcaaataattgcaggaggaaagaccttgagaggtgagaggggtgggatccatagcccctaggtttctcactggtctggaaaggtacagggacactctcccattgggaaaagtatgaggttcctataccaagacacattaattctatgacctcatatttgtattagatagactgggaagaaatgcaagtaattaaaaacagttaaataaagacacagggtgaatcttctttctttaatatctcttagtgtctgcttttatactaaatagagtttttgtaaagtaacggattctcaaaaatgcttctaaatcaaggtgttcccagcagttgtacaagaaaagcactgaaaatatacaaaacccctgagctattatattttgacaatgtagttcttctgatggtaatccagctcctgtattaattcttcatatagttaataaatatctacatagtcttcctatgtgccaaaattgttataagaattttataaataatgtatttaatactgaaaataatattgactatgtagggagcatcaccttttccattttacacatgaggagtctggggcacagagaggttaggtaccttaagtccacagccatacagcaagtcagttacctgagattcaaacccaggcactctaatggcagactccttgcccttaacctctccactgtgttttggatttattatctaactttatcttacaacaaacttacaagaaaatataattattctatatttaacagctgagaaaagtggcacttagaaaagttaggtgactttctcaaggtcatgctaagtggctgggcaaatattcaaatctggatctttctgtaagtgtgtattattggcacttaacactagactaagtgtcagaagcggagagtaaaaatgttacatgtttcatcactcaaaaatgctaaataaatatgacaaatggtataaaaatggaacttttagtcatgggaaagaaaatagttaaattatcataataataaaagtaattaaacatttaatgatattataagcatggatttataggatattggtagttactaagctcaagaattttacaatctgaataagtttattacatttgaaaggcacttttaaaacatgggataaaaatacatatgtcttatgaatatttccaaaaataactcatgttcattgggaaaaaataggcttcacagacaagtgaaaaaagaaaggaaggaaaggagggaaagtgagaagaaagaagaaaactatatttaggaaggatttgagggtttgtttgatgtaattctttgacacttacatatatgcacacatgcacagataaatatatttgtatacaaacaggatcattctagtatattttttagttacctccttttctaactaaaatcatattgagagcattttctatagcaataaacatgatgcaaacccttatttttttatagttacattatatactaatgttagattgtactcttattcgtgtaattttctcctattatttaatgattgggctgtgtattagtttgccagggctaccataacaaaataccatcaaccaggtggcttaagcgacataaatttatcttctcacagttctaggggcttgaagtgcaagccaaagtgttggaaggtttagattcccctgatgtctttctccttgcctttcagacagcagctaccttcttgctgtgtcctcacatggccttttctctgtggtgcacaatctgggtgtccctttctcttgttataaggacacatgtcgtattggattaggactcaacccttatgacctcatttaaccttaattagctccctaaagggcctatctccaaatgcagtcacattgaagattagggcttcaacatatgaatttgggggtaaagggacataatttagtccataacaggttgtttcccaatttctgttggtatagatcatttgatgataaattataaagtgatttttattcaattatttcccaatgatataatcctaacagtgtgatgtgattgctaggtcaaagggtgtgtcattttaaggcttttgatatgaattgacaagttcatatcaaaaatcttctggaaagttttttccctttaaacttctgccaggagagtttgagaatgaaaacacaagcattctaaggaacaatatacatgtggtgtagaattctctaacccggagctaaatctttggtcaagccatcacctcttgactgcctatgacaaagggtgagtagcctgagactactccagttccaaacaccagaccacaggcagccagtttgttcactcctgagttccatatgaattttgggggagtagaggagaaattggtaaggggtgaagagttagaatagcctggatagatgagttcagactgttcagacagtctttgttttctatattctaaattaccccctttcagttcttcacatggcattaatggatagataaaactcccagttcatcccattgacaaagagaaacacagacagaagacagggaacgttctggttcatttgggggcagctataggctgtctttttcttctggctacacgcacactgttgaaggagagccttttcctactcagcattcttttcataaataactctgttctgctgtctcttgttggggtcaggttactacaggctttcgaatatcctagatgcattgcaggaaattaaatatggaatcattgcttcttcttctttgcattttgtctctggagactggtacttccacaattgggtaaatattttaatttagaggtggagaggaatctgaaactgaaatatagagaaggtaggttctttcacccaggtaatggagagggcttaacaatagttcctggtaaacaggagtagtttaatgaattaggcactttgagctttaatgtagttttatcttcgggaagataccaagagaagaatgaaaacttggcatgaacagggaaggccatttaaaagcaaataatcaagagttggttatatttgatgtttgctaccacaaaaatttacctcaattatgttaaaccaagcaagaatagacaaaattaaataacgttgtaaatgagctgccacattaaagtcacctaaggatcacccagccagacaccatgggggaatggaaaatacttagagaccaagagacagatagctctgtgagtaaccagctgcatagcttcaggaaaatacacaatctctctgtttcattctcctctcatgatatatgaaggtattaataccaacttaacagagtaattgtcaggcttaaatgagagaatacacaaaacacctagcatagtacatggcacacagaatttgttcctcaaacagaggtgtccttgcacttctgggagcagaaggaggattgcagatatttcaagggcctttcaatcttgatgtggaatctcgatgttccaatgagaacatgtgaaacaaggagaacaattatgcactgaacagtaccatagtgaccacaagtatgacaggaattcagacaagggaggtctgaatgtgctgggctactctgccagtgaaagattcgtctaaatgttgggtcatagatactagggttccaggaaaagcaacattaaagaagcaaattgtgcaaagaggatattgaaaatgggcggggtggggtgggatgctggagcaaagacacaaaaaatggtagggatattgagttaagtaaaagagatttaaaaagcttttcaagtgatccataatctatagaaagagcaattcggctaggggcagtggctcacgaccctgtaatcccagcaatttgggaggccaaggcgagaggatcacaaggtcaacagatcaagaccatcctagccaacatggtgaaaccctgtctctactaaaactgcaaaaattagctgggcatggtggcacacacctgtagtctcagctattcaggaggctgaggcaggagaattgcttgaacccaggaggcagaggttgcagtgagccaagatcatgccactgcactccaggctggtgacagagtgagactctgtctaaaagggaaagaaagaaagaaagaaagaaagaaagaaagagagagagagagagagagagagagggagagagagagagagagagggggagagagagagagagagagagggagagagagagagagagagaaagggagacagagagagagagaaagaaagaaagagagaagagagaaggaaggaaggaaggaaagaaagaaagaaaaaagcaattcatgctcataatagatacattaaaaaaaataattggaatgaccaaggaggattacggtatgagcatgtactgaataaatactaatagatgaaaataatggtttatcacaattcattttggaaataagaaaaagatctgggaatataaaccaattggtcacacactttccaaaaaagaaatgaccccagtattaatttgtataatgattagtagataggacatgaagaaagctcttttttccaactgatggtgatgatgtaattactttggtccacttgacgtgacaccatggctttcccttcagtatcattacagttttaatcacagcaggacagccctgctggtcttcacttggcttgtctaaatcctagggttttcatttcctgcatatctttatagtgaattcctttaattcactcatattaaaataaaaaagaccaagagaacaaaggaatcacttgctttaaaggtggaaaaaatatgaggctcactttcccctacctaatatccatcagggacttcctaatgttcaggtaaagacaacttcttgaaattctttttggtttgtcccttttcacattaaccaagtagtatgtgttcattggcaaaatcttgggaaatgcaagtcaacaaaaagaaaaaaaaattcacctgtaattctaccacctgaacactttttatatttttatatttccttcaggtctttttttctatgcacatacaaacaaattttaatagacacagtgttttcaaatctacattttcattgaatatattctaaacatctttgagttcattgccattttttaatctgtgatacttgtttaaacatttataacatgtccatcttgtgatactctttatatcttcattacattccaaccagtcaaggcaattttatgcagttttatactttgtagctagatattaaaaacttagaggttaaatgactatgcatttttaaggcatctgctattccctcacccaaccttgggttatgatctactccttagggttgtgtttccccccatcttttctccttctccctctcggcctcacttccctcaaagagacactgtaggccaatgggagaataagtgaagtccataaataattgtaatcactaccactggcaaataaaaagactttggattcagaagaggatttcttcaatcagcttgcaaacatgcctacatatctgaaggcaaaggaattaagagacttttctgtagaatttttttttgcttgttttccttttgaaaggaggaaaaaaataagtgatgttttttatctctctcttttaacaattaacaaaacaaaaatccagaatggacaggatgcatgcttatgtcatacaatcagctggtagctgaacaaatattaaactctgacttctgattcccaaatttgtgcctttccactgtgtcacattgctttactctaaacaaatcagagctgggataagtgaacttggtaccaaaataacaactgtgggaaaagaacacttgtcaagtcaagggattctctgtttatgagatattcttctgactccatatacaacagcagtacatgccctgagagatgggagagaaggaaaaagataatcttttattttttttcatttgatttttccttctaaggagagctatattcatactttgattaaaatatcacacatatgggtaagctggcttccaacatggcctctaaaaagggaaagctagacagtggcttcctgaatgtgcaagtgcaaatattttgcagagcagagaatgctcttaccttgggggtccacttaacacagattcataatgctgagtggaaagtggccgtaatataaactgataaaagcccttaaataaaccaaaaacctctcaatgagatcggccagtcaatcactcattttctgcttgcacattggccttaaggatgcagtatctgggctgcagcagagaaaacagtagtcaattcctttatgcattggattgaatagttagcctggcagcataccacattatatgcactgtttgatgtacagcttgaatttaatgacctgttggctaaactgaatggcaacattgtgtgtgcacacgcgtgcacgcacacacacatatacacagagtgaaagagaaaaatgacaataagctgatattgccttattaccttgagaagcatttactatgacaaagaactgacggaaaatgtgatggacagtcacaaagtcataaacacattggcttatagctggatgagtccttgtagagaatccatctcaacacttccttttcacttaaaggaaaataaacagtttaagggatttgcaatagttgtacaggtttctggctcagtggcatttgactacacaccaagagagaatttacagattacttaataccaaggttggagtactgataatcatagctcaaagaagaaaaatccaaagtgaaggcaggcaaatcagaatcaatactctcattaagtactcagtgacctttttccctccaggtttatatttttctcactttctgggttgatttttatgtattaaatacagaaaaaataataatgaaagagtcccttgactgtaactgaaatcaatgtatctaatgtgttttccaatatttctcatgcatatgccctcattagattcacatgcaagaaacggttcaaattggaaaaaaatctttaaaaagccattcataattttcctcgtaggatttaatagtcatttcttacttcagtcttatactctgttttctaatagttactaagtgatgaagtttcaagcatgctgaaattgagcacagcaaaccattcagtctgcaaagtgatctgtttgtgttgttttgtttgctttattttaaaaatccattttcttgcattactccctgaatcatggccattcatggcttgattccatgtaactaacattcttttttaactttaaggcaagacaggttacaaaacccctacacacacacacactttcaggtttgtaaactcaattttcatgcatttactgtttttcttcattcatgtgccttgattgatgttcttaagttttcttgtatagatttttacatatttgatactcaatttgtaaatgttcttatgttctgataaaggcctctgggtctctcagcaaaattttagtgcctcaaggcttacagcttaccgtgcttttaggattaagttttattcatctttgtaggttccctactcactacttactcccctacacatacgcctaacttagaagaacccatcgtagctgttagaattatttctaaacttaattcttcattgtattacaatcaagaccacaaatttcacaaatacctttttgcattcagcttaaaatatatttttcagttctgttcccattcaaaatgttcaaatatgcctctagttcctaattgaacaggtttattaggtgacatcattttaaaaaacagatactctttggtagtaatttacataaaaataagtcatgtgagttattttaacattcattactgagatgggtttggtcagacagtattaaaatatactatctaatggacagcattacaatgcgtaataaacagcatcaggaagtaggcactataaaataattcacactctgcttttacttccccaataaagaacaaatatgatttcgcttaaataagactttatatctttatggcaaatgttaaagtattaaaattttgtttgaggcctggtccttttgtggctgaatgggagacacatactgtcacaatgtttgtaatgttttattgttaacttttttgtttatagacttgtcttcctacataagccttttgagaataggatcctgatctttatcccatacacctagtatgaaaacaagcatgaagaagccatttggctaaccatttattagctggttgaatttgggcatgttccttaacatttctctgtcttagtttcctcaaatacagaagttaaaggggagtagagtagttcctgcctcaatgatatcacggttgtcaaatgatcagaactccgcctggcacacagcaggtgctcattcagtactcctcctttgtacaactcagggaggtgccactcacacagtcctccccggagttgtgcccctctggaacccaccctcaaagtgtgagatgtcataatcatcttcctcatcatcatgattattaggcccaagaagagaaagatttcatttcatctaaactacggagagggcggcaaaagtgtaagcagatccttcatgataaggatgactgtgcctacctcctaaagggaaaaagctcagaattctgcagaatgtgtatggatttttgtcctgtcatgtaataatccttgttagagcttttcaataaaaatggattatgactgagccacatagtattaaacttggatttttgtcttattaccatgtattctaataattactatgaactaaacccactatagactaatgaaaataggatgctgaatatcccagtgacaattgaaatttttagtttttaaagaaattaggtatacagaatgtcaattgcattaattatatcattgggtttcaaactattttgagacaagatcttttttttttttttttcaaaatattaggacatcaatgggtattttgtgtagagcgcctggatcctatcctccttgccttttccttctgtctagggctcagcagaaacactgtgtttgtctctgtaaaccagatggaactgctgacccaggtggagcaaaactggatagtcaaatatttgggtttgtagatgatttaaacattttgatatcaacatctttccttaaaaatatttaccacattttgttaaagatgtaaaatgcattttagtaaatctggaaatcagagaactcaaagaaaaatttctcataaacttaccacctacaacgaattccttttaatattttcatttgcactattttggccctttaaaacgtatgtatatatgtttgtgtaattttcttttcacagaattgggattaaattctatcttttgatttttgactttttttttaacttagacaaatcttacatattttttctatatcactaaacatttttctacaacatactgtttaaagggcttcattgcattccacatttgggataggtcacaattaacttatcatatatatgtgatccatatatctgtatatttgactatctacagtgactccaaaggacttctgaaaaattgctccacctgggtcagaggttctaaatgggtttacatagacaaacacaatttctggtgagccatagcaaaaaggaaaagaaaggacaataggatccaggctgtctacacaaaatacccgttgggtgtacagacagacaaccaaatcaaaatttcagtctctcatccaaacctattcttgttataattcctatttactgtaaacaaaaaatttaaacaaaaaagcctcgagttgcgtgaatttacaccacgtaaatgataagaccacagaaactatattgttcatagcgttaaattctgaaatatgtactgcccagtctattttgcagttggggatttatccagaggtgaaattcctgtgaaactgctctctggatctggaggaaaagaaaatgtttacagtttaaagaactgtcaaaaatacagaacaaaatttttgtctttcttatttattgcttgaaaaaagtaggaaggaaaactagataattttctttttaaaaatatatttaatgcctatttacatttttgttttaaaaagtgaatcctggattacactgtagaaatacacagaactcacacaaaatctcttaatagttatttaaacacaaaatctctgaatggtttattttaggactgggattcattctccccttattttctttttttcactgaggaaagtgtgtttatgtgggctttgttcttgaatgtagatttaagcagagcgttgctgtcctttttagcaagaattgtgtcttgatgaatatgtaacaataacattcaaatatatttgcctttttcttcatttactttaattttcagaatcacaatcatgttttcattaaaaggggaaagtagtttagcttatttgttaagagcaactttgcagtcagacagaattaaggtcagaatctcgttccatcagtcattagttggatgatctagagtaagtattaagttgcttgacctcaatatgccttagtttaattatgaataaaataagaatagaatcacttttttcaaagtgtgatggtaaaaggtatgcaacaaatttagtgcaatgctagtatctagtaagagtagtaaagcaaaataaaaaccaacataaaacaaaaactagcattaatatcaaatatgttttgaaagaaacccttagatatattttaacctggatttagtccaaaaagtaaactgacacatctcaatagttcctatttgctaatataaacattattatatttgattcatcaaatgaaagatacctgttgagaagaaagggaggattaaatactgattcaaagcattctcatcaccgtatgcattcatagtttagggccattagttacaagccacagagatcagttcacacaaataaagacttggacagggaactgtagtgctacttatgtttctcctgtaattgttacatgcattaatattccatttatatttggccctttatccttttaaaaacaaaagttccttttggacagggaccagggctaacaattggaagcctataaatattttctattttgagggtcttcagtgaagcttttgtggtattgctgctgctgataataatatacttgcaggaactatctattcatattcttccccctaccaccaaaaagaaaaatctcttggtttattttgctgtttccacatacaggaaccatagatttgctggcacaaattacatgtgaatggaaagatctgatgaggataattaaatgacctaagatatacatattaatatataatatctgccctgtctttattcttgtgagaatgtgaagtattaaaagtttttttataacttgaaaaataaagtattaaacatatgtaaattgtgaaaaaaacgccttagtctactaattatgaaagacgtaaataattgctgggacataagggaaacatttgaagctgcaaatcatactgttgaaatgtcattgggattgcccacaaaccagatctaaagcattaaatttcatacagataattcatttttagcaaatgtttgtctgcaggattatttcctgtattcatgattttcagcttctatatgaatgaaaactgaatgtgtaactgaagaacaataaatatcaattatgagggggtggtggggggcaggctagggatttgaagtagcacaatacccatccagaatacccacagttcaactccagatgccatgaagaaaggtggccctggtgttgccagattttcttttttttttttcctaagaggagaagatattttaatatctcctgaaatgtcaaaattataaaatttggataaaagtgtgttttaaaaaatattgtgttaggagcatatattgctttgtactaacatttcactcaggtttacaaacacttttcttgagctgggtccagtccacaaggctccagtttgtaaccactgtgctacataatcagacagactttatttccatctcagttaaaaaaatcgctaattgaatggctttgggtataacatttaacctatcaaagcttcatctttattggcaaaatgggaagaaaaatgcctacttcaccagcctgctgtgagaactgcaaaaacaggcatggatgaaaatactcagcgtactagatgcataatagatgctcaaagaatttaggtctttttctcattttctggataactttaaaaaggaagttgttctgttttgttcctttcatacttgctatattcagagcatatcagatatccttgttattaggaaggtcagcgctaacgcattaactactggaataaatagttttacttgaattataaagaaaattctaaactatgggtctctccacatcttctaaagagtaaagatgagtcagcatcaactctgaaaaaattttcaaatttacctagggggaagtgcatctttggcaaaagtctgccttgaacgaaatgctcttccactgcttcatcggctactctctgtcataaggatcctttcgttggtcaaacagcacttaagcaccacaaggctatgattagtgatggcaccacgtgaactgagaactgatcaattctgcttagattacagttgactacacggccaaagatcaatgtttcaaagcaagaggattatacaaaataaatgtagacagttcatgttttcaaactacacatgttagtgaaagttcagcaagcaaatgaccagcgagtggctagaaatattaattcttgtctctttactacatttcaggggcctcgactaaaccatgtaggcttgatttcaataaccgtacgtaggatgaaaggagaaaaacataaagtcacataccatagttaaaagagattaaacagtatatatgtagtcaaatctgcccatgtaagagtgttagtatgaatcaggcatgtttaagtgtgcatttggatactggactcttaaacctgtagagagcaaaaacccaaaggtcacactcagatgcaacaatcgatttcccttgtcgtaggctaatattttcctttctcttgtttcagagtgtggcattgcaccctgtaggtcaaaaatgtggacaatctggctaagaagagagcaagacaggtaaagcattccttctatgtgaaattgattgggggaaggcattcctttctacttcatttttaaaaagctgagacttatttttcattattgctaaacattttaagcatctggctcaaaatactctgtattctaaattttatagatgattttatttaatgaagtcctttaaaaagaagtcaaaattcaaatgttttccataatatagctaaaaataatatattctctaaaatacaaaacctgttttatagttaattaactacaacttaaattactccttaaaagacaacaggaaacagagactgacccagtggtcaaaataattccttcctttgggtttaggaaactagaactgagaagatgatggagaaacccctgtaattccagagtacccattttcataatctgaattacctagcaaatccataagaaagcaagttgagggcctataatatcttcaaaacatctaagtccttctctctctgttgccaatgtcaattagcagaattagcagcttgtgaattctcagcatggattttttaatataaattctccaaattggttatcatcatataaaaatttgttgactgttttgctcttcatttaatggcttattggtagaatgagacaatagcctagattttacagaatggtacttatttaaaatattgtcaagttgttttcatgagtattcttgcacttaaaatacctaataatttcattttggaaaataggttcaaattaggtatgcttgacctatgagtaggttaagggccttaaatatacgtcagtgatgactacggagtaagagctcagtttatttttggaatgtacctctctccatgaagtgctacataagaaagagccaggtaagaaatgcgggtaaaaaacaattgcctggtttttactgtggttataagcatttttcaggggaacatttccagtttggaaaagatggcatgatgaaaatatcaccctcttctcctaagcacatgctcagaggcttttttagagtcataataatctcagcaaatttcccttcttgaaaataataccgagtggttttctggccacatagtgtcagctaaaatttgtcagatttagttttccatgcatattctaactgaaactggactccagaaattcaagaattgcagtaagtgccatgatcttgatttaggtgccaaacaaagaaaggcaacaaaggctttttcctcatacttaagttacagcgtatcagcaggttagacacccgtagaaatcactgtcctcagtggttcaaaggcatgtccgtgtgtctgtcaagctaaccctcttgtacaagtcactctttttatatttgatttcaaaactctcatgaaagcaggatgctgccttaatttatctttggagtgagatgcatttctgattcaacttaatttttgaatggagataggatggaatgatttgtttatgattagtgaatttggtagagtagctttctaaaatagcacaatagctgtgagtgtgtatcatataacttgctgcttataataattaaattactaacttattttaataaattagtgaattaaaaggtattcattaatgatgttactatttctgacttgcaattcaatttttaaaagaaaataaaaagatccacggaagtgttcataatctttcttacttatattgtagcatgtagtgagcagtctttaatgatggattgttaagtgttatgatatattacctttaagaatatgattttgccttatcaaaatcataacatcctgaggatgtgaatgcaattcattttgtttttacagtcaaattaaaagaatgagaatcacagttgaaagagctactagttgaagtcttctacagtcttaggccaggagccctttaggggactctcattctttcattcattcagccactcagtcaaacagtctttattgagtatgcattttgtaccaaggcattcgttacaattggtgaacaacacagtttcattttctgccctcatggagcttacattctagtgaagagtagggaaagcaaataaatagctctgtaattacaacttttgatacgtattatgaaggaaacacacaggttgcagagagtaaaacgggatatatacctagggaattttctccaaggtattatgtttaaagctcaaagtttaagaagagtcaaccattcatatttaaaaaagaggaaagagtcagatgactggggttttatttgaaaactatgatatacatgaattcattatgaaataatgaatatagtgaaaaaaatagcaaaactacatcttggtgatatggtttggctgtgttcccacccaaatctcatcctgaattgtagttcccataatccccacatgtcgtgggagggacccagagggaggtaattggaccttgggggtggctttccccattctattgtcatggtattgagtaagttctcacgagagctgatggttttataaggggcttcccccttcactcagctctcattcttttccctcctgccaccatgtgaagaaggacatgcttgctttctcttctgccatgattgtaagtttcctgaggcctccccagccctgcagaacagtaagtcaattaaacctctttcctttatacattacccggtcttgggtatgtccttatagtagtgtgagaacggactaatacacttggtttattctgagaagtcgtttaaatatcttcccataatggatttgagttgcttaaccaaggttaaaactacaggacaggctgggcatggtggctcatgcctgtaatcccagcactttgggaggtccaggcaggcagatcacttgaggtcaggagtttaagaccagccttaccaacatggtaaaacctcgtctctactaaaaatacaaaaatttgccaggcacggtggtgagcacctgtagttccagctactcaggagactaaggcacaagaatcacttgaatccagcagggggaggttgcagtgagccaagaccatgccactgcattccagccagggcaacagagtgagaccctatctcaaaaatcataataataataaattaaaaattaaaaaataaaactacacgacataccactacaacactggggaaaactaacatgaatctgaaacagatgtgtttttgtttttgttttctaattgttgctgatatatgcacctggtgaaactcctagtgactcaaacagggatttcactgccttggattcagacctcattcattatcagcagacaaagaatgaccaaggttaatttaatacccattgtaagatgcagtggcaggtcaggttaacagagttcatatttcctgaatataatgcctgactcacgactgctttaaatcaagcaggatctatctgtatcataagaagtatttaaaagtaaagtgtgaacactctcaagtgggggaaaaacagcttgaatcgtcaagaaaaatgcatgcggaaatttaaaattcagtagagacacatttgttgacacggatagatggccactatacataaagcagaagcaatataaaacaatgcatacagtatggtccatgtatgaaactgtgtctgcatgtgtctctatgtgcatatacaaaaagatctaaaaggaaatattccaaaatgctaacagtaatgatttcttgatggtaggcttatgagcggttctcatcttccttttacacatttctgtattatcatttttccataatgaggatgtgttatttttaaatataaaaaaaactttaagcaacaaaatttacttgtagtaatgaataatgatttaaagaataatttttttagtgtgacaggtcccatttttactgcaagctaattaattataaaggacactttttccaaatgtagaatacagttcagacgccatgattttctatttggccagggctgaattacccaatacttacaccagtatgtgcctagggcattaataaagaaaaagagacaccagaaaattagaatatttgaaaaacaaataaatatttttgatagttcagaaaaatgtaggagaatttgttcagagaaaatatcagaaagtcgttgaactgatgcacacttattttatgacaatatcatttttacttttaagaatgtgtaggtggagagataattaggacatataggtaggaggtggcataacttttttcaagattcaggacctacaggaattttaatcagatcctaaacacggaaaaaaatggtcacctcccaacctctatgtcattaaaaacaaaaacaatatttatctataaaataagtgcatattagcccaacaaagttctgattttcacccaaacaaatgcttctacgtttttctgatatatcaagaagcctagattttctctaaaatgctttttgtgtgtgtgagcctttttttgttttgttttgctttgtttttgttttttgtttttttgcctgataccctaagcacatagttagtgtatttggcaattaaatatggccaaagaacaaattttggtacctgaaatattcaaataaaatgagccacacaacacagattagtaaattgaattaaaattatcttaccaattaaaattcaaattggtaagataatttgctacctttctactgttgtagtttgtgctcatgagactagggatccagcctgttacaccactcaccaaacacaaatttggacaagtctaacctccctgaatctgtttccacttattttaaataattattacgacactagctttgctgataatgatagaattgaaatgatagaatataaactgaaattgatagaatataaaatgaaaaagaatggaaaaatgacagaatcataaaaacttgtaataatataaggtgaagtgatggtactaattacaactatattgttttcaacattaactgtttcatggatgtatatcttatattctccaaggaaattctttcttgctagcatacgcaaatgctgctagtcatataaaacctctacaaatagttgttagtcaatttattaatttatcctgcttgaaagcacattttcccttgatagaataatagtggaatgtgtaaacagggaattgcaacacacttcacagagtaacaaccaagtataaacctaatttatgtctttcagtaaaagaccatcattgcgttatttatgttaaaacttccacagtaagctccaaccatgagaaacaaagcattgacttttcatgaaccaaaaagaaatgtagaaaactgttagactctccaaatattgcctaagtcatcctgaagcggacttgtagcaggcacataaaatcaaaatatgttctgatgtcacttgaaataagaaacatcctattacaaagtgagaaattaattagtgtgtcttaattaaaacaagttttactaaagacttacataccaatcaaaatatttaactttaatattctaacatgaatgacatttttaagatagcatttgagtggaagattagtttgttaaacagcacatttaaacattaatttgtatatacctttcatataatttgtttttttaaaaaaaacaacttgatggcccttgaattactttgtacaaagaccccattaaataacacagtacatttttcaaaattaactatacaatatgaaataattttaatataggtatttgacatcatactccataaagctgctgagaaagaagggctcttatgaacaggtaaatgttcagtttcctgaattctggcaggattacatgtaaatttctctaagaagatgatcagctgatttctttacaaatacctagaacctgtaatttagaagtcaactacaaaatggagtcttactgttataacctagaagtgtcttatcttaaacaactaatgtactctctcaaataaatgactcactctagaaaaagcaagagaagttcttgagaaggaaatctagtacatcctagacaaatgcatatctaggtcatacttttggaggttttgatgagagaagaattcattgctttatctgattagccagttgactactcacacttactatgaggaacttctacatttgcatatttctcatcttcataattcctcataaagttgaagcccattgactacatttgaggttccaaaaaatagcaataagcaatgtcctgtgcttatgccccatgcttagcttatctgaaacaaacgattgccatatttcatttttctcttctctaaatgaaatgatcctagcttttaaaaatctttcctcagagagttcaacttctagtgcttgaaacacacttcacttttctatggccccttagcaaaggccatataattgtcttaaatagtggggtcaaaagctagacctgtatttctatcagggtaatagctgacacatagctgaaacaggctatctacaaggagttttaagcacatggcctaagggatttgcctctgttcaaactgtaccaactttgcctataaaaccacctccaaatgaaaactcaaaaaaaagaaacaaaaacaaagccccaggatatctgctttcattgcatgaaatggggtcaactagtacaaatcttaattttttaagtgtgctataggcatatctaacattttaatttttggaagtcaagtgttatcactaaaagattcaggatgcaatgtgttatacaatttgttataacatacaagcccagtacctctttccttgccctacttcatatagttgttaaaattaggcacaaagtagcatgagtttacaaagctatggatctataatatataacatgctatgagcacatgcacaattgagtcaccaagggcccttctcatgtataaaccaaatagaacaattattctcagcaaaattaaactataaacctggttcaaatacatgtgaaaattataaatgtggggggtgtatgtagaatcagatgcaagactaaagacccaaacaattgttattttacattgtaaaaaatgtctgtactgacaatgatattgttagagaagagaataatggataaaactataatagcccatgtggtaaatgtaatattactaatacactttacctacataattttttctggctttaattcaatgaaatccattatcctgggcgggaatggaacctcctcatctcacgcatctttagtctcctgaactgccttaaagccttgacataataaaaggtcaagcagatcccagtaagcatttgtaaattacaatagacccccatttcagctacaagccacacattctcctgctcgctttgctcactctctggtttcatttcattgtataagcagactaatttggaaacggctgggctagggtgcttgggaatacctagattttcaaaacaatcctactttcctacttaattatttacagaaggagacccttaatacaacatctgagagaactgtgaaatggttcctggatactgaaggaatgaacatcagatagcagcactattaaataaaatgaatacatttcaccttccagcttagctgtgcttcctgggacacaaggcacaaacatgaaaaggttggggtggcatttcaagaaaactgatttgcttcaacattgatttggtaagatgctagacacaaaataataccacaaaccgcctcccattcccatcattgtaaattcagagtcctcaatatcatcccccacaaacccaattaaaaataaagaggcaggctacaaatttgcatctagttctatgacacagatcaaacgataggcatctgttccaatcggtcacaatgaaactaagggacaataaccagagtaaatttcacattaatccaaataaagccaatgaataataatataaaccagaagcatagtttcaaaaacatgcaattacttccaggcatgcaaggacatatgtaacccataaaaatggttgcaaagcacaccctacatataaatatgcttcataaatgcaatataaatgctaagtgacatgtgtatatatgatctgtatatccataagatatacatgtgtaagttcacagtcaaatctacgtataaaataaaactgggtcttgcaaatgatttctcaacaagagtatattagaatataaaataaaatgtcaaattctggggccactttttctaagcaatcaataaaataagcaaaaccaccttataatgagtctggtaagcttatgagacaccaaatgtatttctgaagaaggcccaaccctgtatgtgagagctgcaaatgaaatgattcctttcaataacaccctcttcttgttgttagctctttttccaacccctgatgctgttgctaagcttaggaaaaaaggcaccaagtggctcagtctgcattctgagccagttagagataaaatcagaacaccattttttttttttaaacacaagaggttgtcttctcacttctctcttcctggcaagcttcctctccctccatcctcatctctgtctccacatctcccccttctagtctgaggcacgggagtcattgttcaagttcaggccagaaatgtatacacaggtcaaataagaacactctaaaccaagaagggagccctactgtttcctactcaccatgctgagacccggagaagctgtttaaaggagggagagatgcaaactgaatccattttccttgtgaccgagtcggatgcagcctccgaacccaacatcagcagtggctgccggttttttttttccctctgtctctggttggcgatggtgcgaataggaaccacccttccagccccactagagtatcagcaatagaggcggcggcggcggcagcagcagcagcagcagcatcaccagttgggcctcctccctctcggaggatggggtgagctcggaagcagccaggaacttgcagcagacacctcctctggctcctcctctctctctccccctcccccagtgccccacccctgctgcggtagaggctgctggcccggcagctgctggttgccatggcaatgaccaatgataagcgaccaagctcagggggaggggagatgggcgaagcaagctgcagggtctggaggggagtgaatttgtgctgctgccctctaggatgctcttgatgtctcctaccctgaactccaggtctttttaaaaatggggcaaggggggctaggcacggggagagaataattaaaatttaattgaaatctagatagaaacataccaacggcttagctattttttgcattttctgtggttttccaataaaaagtatgaaatttattatcagaaaaataacaacaaatgtggagaaaattatgtcgcataatagcagattattattacttccaaacgtgttcgtcctttatagcatcttttactcaataccaggcaacaaggtttttagaaagcaaacggagtggctggactttgtaataaattaagagtctggttgattcctttgcactactcccggcttgttctcaggtgagttacttggtttcactgtttttccagctacccttctgaacaggacttggaggtaattgacacatccctgaggaaaagtaagtttggatagagaccgaaattcctttcaacaaccactattctcggtagcacaagttggtggacagttcccaatctttttagtgtcaaactcctggagcattcaatttcctgcaggcaattcctgtcgttttcatggatgcctttttggagttccgaagtcagttggcagtcagggtggtgggcaggaaaagggggaagtgaaatcagcaatgtccagttctaggcgagttctgtttctaactataaattatagatgacaccagtatttatctcgtggaggggttgtaaagattgaatgagataatgcactaaaagcacttggcatatagtaagtgtacaataaatatttactattagcagcatagtagtacattgcagccatctcttaatctaagggtttaaggggaataacatggcaatttcaggtaggagaaaaaattaagatgagaaaatccaaagtacgtaataaccatgatgatgatggcaaagacagagaggccctaagagattaagtgttctctacatcttgatatttgaggacattgtaaatctcagaggagttagatacatttcccaaattcacaactgataaacgacagaaccggaatcaaaatggactcttctaacacttacatttgctctcctaaccaccacacttttctgccactcctccataaaatggaaataatctttgttcttaatccacagagttatttacaggttcaaatgggtttaacacaagttccagagtcagacgatctaggctccattcctagcgccagtatttactataggtataatctggaacatatttattaacttcctcaaatctatgtttcttcatctgtaaaaagaaataatcacagaacctcatgagtcattacaaaaattaaactagatgacgtgtgtaaaatgtacggtctttagcagataggaaatgttcaataaatgtagctacagttacttgttactcatttgtaagtaactaatattaaaacatgagaagactttttcctgcatggtgtcactcttaatgtcaggggcttcttctaataaaactggcttgaagataactaggtgatgaggaaagagttgcagcagttccccagcacgtgacactggctttccatccacttggtgggaaagcctgcaacctcctttgtgcagctagtgtcccctgccttctgtcaaagtctcagcagccacacaacctgcacacacttccaagtcagcatcacctatgtgtaatgtgtaacataaaggaatgggatgtgatcatctcgcttctttttgtattcctgtattttatcttctgctttctctgcagagatgttcttgtaagtaagcagaccaggaagctgcaggctgtagaagttatgacacactagatgacagaaccctccacactgtcctcgggacagcatttcatccttagcgctaggagccaaatgtctaggggtgggtgattctagtttttcctctcctcccatcaacataaaacagctggtcaagagtcaattggtaagagaaaagtttggtgtttcctatctgaagaagtatccagtttaaccattcaaatacaacttactcatttgtttttggtcacgtccaggcagcactgttatcattatttaataatagttttcccttatttgctttaattatttatgatttacttgatttgctatttattcattttttaatgaaatgtttctctgacttcagcaaaacataaatgaaaattgacatggtaaagataatggacccatatgaaggaaacgaaaacaaattcttaatttttttagtaaaacaaagacttcaactttatttataataatttttaatttaaaaagaaacattaaaactctcacctctctattaccatcccctctcataccatgttctatttttctatatactatatataaaattaatatgaataatatactatgggataatataacattgcttaatgtggcatgctatactataatgtgtactgtattgtatattagtaatatactgtattattccctattagaatgtaaactacgagagggtagggatttttatttctgtgtttttttgtgaatggtgtctgggccatattaggtgctcaataaatatttgttgaagaatagaccagtaaataaataaaagaataactatctgcattgaatcatggctctgtaatttatatatatataaaaaaataaaataatacatatagtatcatttgttcagatatattgttgatatttctcataattacttagataattatactaattacctcatctagcacacatgcatattaacgtaatgtttatctgacacagattttaaaaatacacagttatgaaagtaaacatgtttgctcacgtatgttcgaagtcatctaacatgtcctcagtgggtaggcatggtgttctttgggaaaccctgattttcttctaagagcttcttggccaatagtactaattatgaccaaactgtctgcctctcctgggacttttacaactttgacttctgaattctgtgggatgtctgaaaaagtacagggtatgggtcttggctccaaaagtggcattaaaatttcaggagataccacagcataatgggaggaagctgcaaagtgtgggctctggagacagactacctggattgggtccaggctttaccatttcttttctgagtgaccttggacaagttgctttattcctctgtggctcagtttctttatctgtgtgacatgatagcagtacctaccccactgaattattgttctgagggatttgtttgcaccttgaaacatcatttattatctcatagtgtttgtggggcagaaatctgggagtggcttagctcagagcttctggctcaaagcctctcatgaggttgtagtttaacagttggctgtggttgccatctcatatgaaggcttggctgagttaagtgagtccaaactcactcctagggttgttggaagtctttggtcccattgagtcgtttttgaagtttttgtgtgcaaaatgttaaggagtacctggcacgtaataaatgacaagtcatatcaatatggttataaacacaattttattaactatggttatgcctagcacatttttctggatgtttccaaagcactcagatcacttggggttattctacaagcttgctgttaatggctgcagaccagctgtcaacagataatgaggaattctggagacgcttatgtcacacttagtcaaaagcctgatttcccccaaaaagggggcaaaaacaaaggcattcataagtgactgttgtttatcccctgcctcctttataaaggattattaatatagtatacatttatattaatatagtaatacatttacagagaacattaaatgtaagcagtaagggtcttcttgagtttgctaagaataaaggatctcattctgacctcactgtatgtcctttatcaatagtatcagtaagcaaatatattagaagaactctgctatgaactctacactcttatggccaatgatcttacagatgactccttgcataacaagtagacacttctgtgtttgctcagtccatttcctcttgaggttcctttgttgcctcaattcttcaacctttaaaatgtatccatcaactccttcaggggatcttcactgataccagggttagcattgtactgtgacacatcctaactacacttaacacggtgaatggtaaatattctttcctttgtctttcttattttagtgcaagcctttgaggtcaaggttaaagttcatccattcatttaatgttacttaatctaagaaatgtttattgctagtttctattgtgtgctgttactaggtaccagagatgtagctgtgagtcaggtagcatgagaactcccctcatggagcttatagtctaagaggaaagagagattacataattacttaaaataaattatgttgagcactacaatagagaaaatcaggcagctctgacagcagataaaagaaaagtataatgtagtttggaatcccagggaagatattactggagagattgtggggtgaaatggaagcaggtgatatggaatacgcatgtaggtcctgatatatgaaagaatatggcatgctgcttaaatgttgtttaatcctaatacctagcacagaacatggcacccattatgtgccacctacatgtttgtcaaaataatctggcttctccatctcccaacacacgtaaacacagaacttctttcttccatttttcttctgttaatttactaaggggattagggcttgtcaatagctatggagctgacaagctgtatgagataagaatgaatgaaaacaggctgaaggattaattcttctaacagtagaaaaagaggtatgatgctcacagtaactactgctgcattacagatttattaagtaagatttacatgataatacaaacttttgctctgaggctgaaatgagaagcagtttttccctttcaggtcctggacagttgtatattaccatgggagataacacatgggcttaggttacaaaaaaatcagggacaccaaagaaatgagaaaacttctgtttcaatgaccttttccaagattttacaatcagaaattctacaaataaaagccagtttaatttcagtgtatgtataagttttattgtaactttagtttttatttttagtcatttatgggaagcaccataattttcataatttttacaatgcttaaggactcaaaatgtcttattacatcactgggagtagagaacatgagccagagagtacaataaacacatcattgcacagagaaaaaacagacatagcttttcccctgtggagctcagagtcaaatgtgtgggatagccaaagaacaaaaatcaaatcactaaaatagtagcaaattttcacaagtactatgaagcaaggaaagaaaggatgaagaaggactgagggtagggaaaatgagagtgactcactgaggagtgacattcaaactgagaaatgacatttgaattatgccaatcacgtaagagctgagaaaagagagtttcatgtggatggatgagctctgaagagaaagttaggaatgagaaatacttttgaaggctgaaatatgggagcaagggtgaaattggcatgaggggaagtttggaaggtgggcaggggtcaaatcattcagcaccttgtagcccactgtaagttaattggagtttcttaattgcaatgaatagccattgcagaatttaaatttggtttaaagcattgtggaatgaactggtggtgggtgaaagtggatgcagttagcatgctacaataatctaggccagagatgatacctgttagattagggtggatatggagaaaattggactgtttcaaatgcattttagaggtagaattctggggattgctgagggattggctgttaaggttgagggagagggaggtgtcaaggattacttctaagtagacaactaacttctttcatttggaaggatacgctgtcaaggttcagttattaccttctgtaatgagtaaaggcctcagagcactggctctgggaaaatgtggggaaacttaagggtgttctaaatgctcaacttgtgggactcctttttgtgcctccccaggtttagtgcttttgagaatcaggcatgaacaatttgtcagtggatcaggcaaaccatcactgagcttatgctactgcaatgaaagcaacttggctaaaaagggcaggtgaggccctggattttcgttcagaaaattcccaaggaccttagaagtgggttgccataggaaacggccttcctctatccactcagaatgcattttctcccacagctagcttggcctcttcctcgatcacactcctgatcctgttaccttctaaccatgagacctcgtaactatatcttctgtgcctcattgtcctcatctatgaggccaggataataattgcctttgctattaagcggagatgtaaatgaactatgtttgtaaagacctgagcacaagtctggcatgtagaagggtctctttagtgccagctattctattacataatgcccttccctggatctgaatatttcttatgaaagccttgagggccttagtcttttccttcaggaccccaggtgttcgaacatttttcttaatacctcccacctcaagacccccaaataatcttttaggtacctcaaacagctaagtacttattttcctttgaaagacatgccaggtacagagagactgatggacaaaagggttgccggaatgtggcatttacagatttcatgatctgtctcacatgtttatgagccagctttctggctgataaactcatatcctgtatttacattttattactatttgatttctttcttacagttgatccaaagtgtgaaattgggagcctggagcttgccaacacttccatgttagaaaaaatgtacaatgaaagagtttgagttttgtgttttgtgttttgtgtggttttttgttttgttttgttttgttttccctgccaaggacacaaaaccttgtgagctaatctctgagatctctgtgtccgctcgctgccccactgcctcctcatgggacattttgcttaacatgtccttggctttagctactgctacaagctgaaggtctttctcatgagatgcctgaaactagtgggtttattcctgaattaaggctttggaagaaaggcagggccaagccaagagagaaggatttagacttcagggcagcagatttcctcatattaactcttttaaacctcttttaccctaagtccaaattccttcttgtttctcatcatccatttctctttctaatacatttctgaattcttaataaaactccaatccatttctcaaataaatctattaaactcttaactctggctgaagtataattctcaaaatggcactaccaggatccttaggcaaatgcaaaatgaactcatgtcaattattttaattaattaattaattaatgaggtgttaaaactgacccaaagtacatttgagaaattagatttttatagaaaatgtacaaataagaggacaagagcaagtttacttgtacaactcacttgtgcttcaagcttgagataaaattttatacgtatgattgatctaatttacgactttgaataaactaagccagtgattgactttttgaggtcatgatagccagcctttgcatcacctgaatcaacagattaatgaatattcatctcttttcttatatctgtgagaaacctcacactggatgttaaggacactattatctgatcctgaagtcggagaaatacaatttcataccctttcttctaactttctttggacttgccagattgggttttaaacccatctgctgaaacacaatatggccaaagttagatattggagttcttgtttcagcaatgttcatctctcacaatatcctcccatcttacagctatatatttatgacaaagagatacataaccaaaatatagagggcaaaaaaggataatggatgtaaacaatgctttcaggtagactatgcactggaccctgagcctctcttgacccagtgacactggggggtgtgaggcatgctgtactctgtgtggaaactgaaagatcccttctattcaacgcattcacacactagggcccaagagatcctgctttgacaactcttccagaagaaggtgaagaggattgttcctacctcactcacaaaggttaacatacagaggaaagagctttctccttctctaaaagagcataaagtagaggtgagagtgaattctttttaccttgaaagagactgctaagcattttgatctgacaaggactggggacattggtggccagggtgaatgggccgaccactgtgacatggaggagatgaggactcctgcagggtgacagaccatgtgtgaggtgcttgagaagcaacagcagctgcgtgcttagtggcgccgaagaagggcaggtccttacacgcagaggccagaggctgctgcactgattcttaagctcatataataaacttcttggggactttaagagagatatcgaagtggaagatgtggagggcagttagggaatatatgctgcaggaatgtggtctttcagtgtgaatatctccttcattcatccagatgaatcagggtttgagatatgaggttatatagcaaatagttgggtttttgttttttgtttttatagacagggtcattctctgtcacccaggctggaatgcagtggcacaatcataactcactgaggccttgaactcctggactcaagcaatcctcctgccttagcctcccaagtaactgggactacaggcatgcaccactgtgcctggctagtttttaaacaatttgcagagatggagtctgactatgttggttaggctggtctcaaactcttggccttaagtcatcctcccatcttggcctcccaaagtgctgggattataagcatgagccactcaaataattcttggttaaattccttatccaatcttttatatcttccttgccaacaggtaagccaagtgtgctgtagaaacagcgcagcgccgtgctacatccctatcattttacttttcgtgcttcattgcctctatgttagagcgcattgggacagtggcagaaaatacagacggttttatttgtacaatttgctcatgcctatatttcctgttaatcctatggtttgtcttcataaaagagaatttcttgaaacaggaagaaaaaggaatttttgcttcataaattccccttgatttgtctagagttgtctggcagaggtcttcacagctcagtgctcagaacttcatgcttctcctctgttcaacagaactgtaaactctgcagaccctgcttctctagggtcccttccagtggaagctcctcttgcaaagcctaacactatgtagtcatttttctccacagagttatggtgattgtgcttttgggcaacgcagagaatcagcagactttacactacagagaaactcttggagtcacttacatcatcccaactccatgcatatggagattttatattatgatgtaagaaattgggccagagccttttccagagtttggaatacttggctttcaatatgggagcagagtatcagtggtaaaattcaagactctttggttatttttatttatttatttttgagacattgtctctctctgttgcccaggctggagtgcagtggcgcaatcttggctcactgcaacctctacttcccgggtttaagcgattctcctgcctcagcctcctgagtagctgggactgcaggcgtgcgccaccacacccggctaattttcttggtatttttagtagagacgggtttcactgtgttagccaggatggtctcaatctcctgacctcatgatccgcccgcctcggcctcccaaagtactgggattacaggcttgagccaacgcatcaggttgactgttctgttattacaccatcttcttatctcctgaaaggcctcgtgtgtaataatgctatgaatagtgaatttacccttccttttcagcctaccatattattctaggtgaggctttcaaagtcactatattaggtgcaaattaacactgagtgagaaaaatgtcactgctttctgcatttccaaacagctcaatttccaatccttccttattttacatatagtcactgagtaagtggagacccagaaaggaggaataggttacatggcttcattactattttccccagattcccagaagctgtgatctgcctttgtaacatggaacaatttttttttagcatttttattttattttattttattttttcttttttttattattattatactttaagttttagggtacatgtgcacaatgtgcaggttagttacatatgtatacatgtggcatgctggtgtgctgcacccattaactcgtcatttagcattaggtatatctcctaatgctatccctccccactcctcccaccccataacattccccagagcgtgatgttccccttcctgtgtccatgtgttctcattgttcaattcccatctatgagtgagaacatgcggtgtttggttttttgtccttgcgatagtttactgagaatgatgatttccaatttcatccatgtccctgcaaaggacatgaactcatcatttttatggctgcatagtattccatggtgtatatgtgccacattttcttaatccagtctatcactgttggacatttaggttggttccaagtctttgctattgtgaatagtgccacaataaacatacatgtgcatgtgtctttatagcagcatgatttatagtcctttgggtatatacccagtaatgggatggctgggtcaaatggtatttctagttcttgatccctgaggaatcgccacactgacttccacaatggttgaactagtttacagtcccaccaacagtgtaaaagtgttcctatatctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgttttttttcttgtaaatttgtttgagttcattgtagattctggatattagccatttgtcagatgagtaggttttttaaatataagagcaaaagaagatatagcatactgagagtcatgcaaattccactgtaattctagagatttgctagccttcacaatcaggcgtatatttttattcttccttttgatacagtggtgtgtctaatgactatctggttcaaacacctaattattggagttaaaacagtgtgaatcagacgcaatggatctaatattttctccatttttccaaccatttctgtcttggccctgggatattatagcatagagaagtcacagaagagaaaagtgctttgcattatacaatgccctaatttcccagaattttctggaaaatggcctgggtctgactttatgcaaagatcataagtacggagacaagagtatatttgctttatgtaccttccctgaaggagaaatcttcatgtcctagatctaagtatgagatatcagacttagaaagaataatttatacctaattacagcctctgtgactgaattagaccaagtcaaaggcctggtcttttatagatcataataacaatgtctcctatttcttgaatcaaaggttgtaataaatattaaattctgttttttgagctctgtcccacagattatcctgagtaaggtgctataaatgagattttagaagcagattgtatgagaccaagataaagcagcttcaggcttaggctactaacatctcttgtgcttcccatttttaaaaaaatctaagccttaactaatctattacaaactaattctgtgcttcattcagtgtcctcaaccttcatactttcctccacttgacaccctattttcagatcagagaaacccctgtataaaacagaggatgagaaaatgaagatgattgagactaacaattccaagtacatgataattcttagtaatgtcttactaagataattcatagtaatttcttaatccagggactagtttgagggaccaaacttaaaggggaatcctaatgctattcctctccttttcctttaacatgtatgtgagtaatgtgtcactgatattcctaccgtcccctcctccatccacaccttcagtagagaagtggctccatgactgtcatcaggatttccgtaaaaccctcagttttggggaactgcagttggatgtggatgagaactgcaactggaaactagaactgcacctttcttccccaatgaaaaggctttagaagacatctcatttaaatcttttctccagttttgcttcaattaaaagttcatcaatgaaatgctcagtctcacctctcccaacactgtccccagaactttataagtctaaccatcaaggccaggatcttttcagatcatgccttctcacaggacctttactgtagtcaagaatcatctcactgaagacaggccacagaggaataatagaaccatttgcttttatcatatacattttcatctctccaagatccattcccactctaaattttctttgtggcaaaattttaagatgcagtctttaaagggagattttttttttcattgagccacctttgagtaccctagatgtgcttagaagaagtgtcaataatccaaagcttattatcagggaccagtctttgagacaaggcttcatgtctgtcttagaatttgtaatctgatttgcgctgacccttctttttatgtctcccatatacatttgggcagatggacaaagtttactgggaaacacttagcctgccttctcttaaaagctacaggcggaacttcactcataggttgccacactgaggggagccctttggtgacatctagtcaccctgtgcctccacttttatgtggcgcagtgaatgctgtctcttcctagatccatgtgagtctggtcttcatgactagaacagatcattgggaattgtcttataagatcagattattataaaaatagcttctgttgatgaggttgtggaggaacagatactcataggttgcatgtgtgaacaaaagttggtagtgagatgggggggtgcaggaggaagagagaaagcgagcgagagagagtgagattgctgacatgtatatgccagatctgtctgctcagagggcctggtagcaatgacacaacaatatccagagcatgaattctaaaggtcatacttcattaaaagaaaataaatcaggactcattggacaaaatggctgattccagatctgtggcaataaagataaaatgagcctggaacatcttgctgttgtagaaagtaaagaagtacttaaagaaagatggaaatacttcaaaagtcaaaggaaccagcttgaaaggagtggcattcacaaaatctgaaagagtttgggcatcaaaagattaataatagtagtggaatgtaattcatataataaaattagaatccatgattccattcttttataaataaataaaatgaaataaacagggaggaaagctttttcttacagcagaatgccaactcataactataaaaggaatgatccatcatttgggaaatcagcatttagcaaacatcatagtaatattctaaggatgaatcatcaatgctaaaactaatgggtaaatgtttgatgaggaagaggatatttatggagtgtcagactatatctctacaaggtccccctcccattctttacaaggggaaaaggaataactttacagtgaagaaacctagttggtaccagaattcccccttatccttagttttgcttcacacagtttctattacttgcaatcaattgcagtttaaaaatatcaagttagaaattacagaaataaataattcctaagttttaaattgtgcaccattctgagtgcgatgatgaaatctctcatgttcctactctgttccacctgagacatgaatcatccctttgtccagcatgttcacgctgtatacactacctgcctgttagtaacgtagtagctctctcagttattagatcaactgtgacggtattgcagtctttgtgttcaagtaacttgttctacttaagcgattaaacgtagtgagcaaggcatgtcaaaagccaagatagacttaaagctagttctcttatgccaaacagttagccaagttgtgaattcaaaggaaaagtgcttgaggaaaattcaaatgataagaaagtgaaacagccttattactgttatgttattatgaagaaagtttgagtggtctggatagaagataaaaccagccacaatattcccttaagccaaagcctaatctagagtaaggccctaactgtcttcaattctacaaggctgaaagaggtgagaaagctacagaagaaaagttggaagctagcagaagttagttcatgaggtttaaggaaagaagccatctccataacagaaaagtgcaaagtgaaacagcaagggcttatgtagaagctgcaggaaaccactcagaagatctaactagctaagatcattgatgaaggtggccatattatactacagattttcattgcagacaaaagagccttctattagaagacgttaccatctagaacatcctaaagaggaaaagtcagtgcctggcttccgagcttcagaggacaaactgacttgttaggggacagcagctgtgacctgaaattgaagccagggttcatttaccactctgaaaatgctggagcacttaaagaatgatgccaaatctactctgcctatgctctgcaaatgaaacaacaaagcctgaatgacagcacttctgtctacagcatggtttattgaatattttaaacccaatattgagaattactgctcaaaaaagtgatccctttcaaaatatttctactcactaataaggtacccagttacccaagagctctgatgaagatgtacaaggagattaacgttgtttttcatgattgttaacataatgttcattttcaacctatggttcagggagtcattttgactttcaagtcttattatttaattcatttcacaaggctatagctatcatagatagtgattcttgggaaggatctgtgtaaagtgaaagtctcctggaaaggattcattattctggatgccatgaagatcattcgacattcatggaaggaagtcaaaagatcaacattagtaggagttttgaagaacttgattctacccttatgaatgattttgaggattcaagacttcaatggaggaaataactgcagttatggtggaaatagcaagagcactggaattagaagtagactctgaagatgtgcctgtattcctgctatctcatgatacaactttcacagatgaggacgaggagttgcatcttatcgatgaccaaagaaaagtggtttcttgaaatgaaaactacccctggtgaagatgctgtgaaccttgttgaaatagcagcaaggcatttatagtattacatcaatttagttgataaagcagtggcagggtttgagaggattggctacaattttgaaagaagttccattgtgagtaaaatgctttcaaacaacattggtggctataaagaaatctttcataaaaggaagagtcgattgttgtggcagactccactgttgtcttactttaaaatattgccacaccactccagccttcaacaactcccaccctggtcagtcagcagcatcagtatcgaggcaagcaaacaattatgacttcctgaatgctcagatgatcattagcattttttagcaacaaaatattttaaattaagctatgcgcattgtttttttaaggcataatgctattgcacacttaatagactgcagtacaatgtaaacataacttttatacgcactgggaaacaaaaaaaattcctgtgacttgctttattctgatattcactttattgtggtctggaccaaacctgtaacttcactaaagtatgcccatatatagggttcagtactttctgcagcattaggcatccactgaggctgttggaacatatcccccagattaggggatagagggggctactgtatctctctaatcaagtgatcaaagttaacatcaccaagagtagaatgaacagacatcctatatatctctctctctttgtttttttgtttttgtttgtttgtttgtttgtttgttttgacagaatctaactctgtcgcccaggctggagtgcagtggcatgaacttggctcactgcaatctctgcctcctgggttcaagtgataagtgattttcctgccttagcctcctgagtagctgggactacaggtgcatgccaccacactaggctaatttttgtatttttagtaaagacggggtctccccatgttggcccggatggccttgaactcccgacctcaggtgatctgcctgcctcagcctcccaaagtgctgagattacaggcgtgagccaccacgcctggccctgtgtctccttaacatcatgcactcaaaaggacacagcatcacttctgaggtatttctaccaaaatgcataatctgattctaatcagataaaataaaagttttgtttctgtaattggttaactcccccaagaggataaagccaaccaataaatgactgaataaagaaaatgcacacagttaagagtaaataagtaaagcagacactagaagagataggagatgagatgtatgttttctccctttgactctgcaggtccttcttcatggttcatatgtgacaggagtactcagctgagtttttgaatgcctggggtatcatcttagccctggccctggtccagcaacaatttgcattgttgaccaaattttgatgtaattattttcagtaaagtatagttcaaatgtcttgtagagcctacttacataaaagaatttaaaaagagccaaactctgcattttccatcctcttataaatcttactgcattggcactgatataatttttagaccagtccatgctaaaaggagcattcttcaagtatagtgcagtaaagagcatttagaatatgttgtctgaaatggagaagagtttcctacaaataagcacataggaagaaaaatcccagtgaaaatggcagggagagcaggactaaccagtaggtcaaggcaagcaaacacggtgggaacaagttaaaggtaggggcagattgcaggatccaggttctgcaataccatccagacaacattatgcaaatctttaaaaagaagccttttagtcaaagtctcccattgatatttaaagtaatctcaaaggcctgagaaccagtatttttgacaaaaagaaaattctcatatgctttagtatagatgcatcatccctggtttaagcactgaaaattggtaattttgtatttacgtaatggctttagaaatactagattttatatcaaagactagattgatttatgatctaacataaatagtaacataaaagaggtaacttaaatagctccctcttgttctaatgaaatatattttccgttgactacagactgagagacatagcaacaaggaatgcaaactcctttgattccatatggtgaaatgaaaaccttggctcatccatcattctttaccagttgctttgagcaaataaatgcagagttctatcctaggagaagtgactccagttttcctcgattatcaattcaaaatcctcttgtgtgtagcaaggaggacatacccatttaaattaagttgatctgggagaccaatgtacatgtcttaaacttggtctgcctgggacagcagatacatccagccacaactactgagaaaacagcaagataaacaggtaaagataaggatttagaagcggcatcaagtgcatgcctaaatgaacctgggacttggcagtgagaattacagaccttagctgagatgaagggaagggaacactaaaaatagccttgaccttgatgtgagtatgatgtgagcccgggaaatcctacctgaatgcgtctttgttttactgtggcccttaccttacattttctggccaatgttgtccttgatggccctatatatgtgcttttcattctcttacacataaattgatctcttcaagttcagggggagcaactgatcctaggaatccttacgtatccaaaggcaattgctgatgattgtcctggggatgtttaaccggttcctataaggtggaggcatcatgccgaagaaacttaagtgtatacccctctctactttttcatttccaaggggaattagacagcttgggatttcatggatgtccaagggtagacatcagaagtcaggaaggacagaggctgatgtttctattgatgctcaattttctgttttccttttcaaagaaagaaaaaggagtggtccctaaaattctcttattctggttagctggtgtcaaggccacagtgggcatcataaacaccaccaggtcttcctgcctaggtcttctatgttctaagagtaactttgtgttgggcaatacagggctgtccaggttacatgggtcatagtggaaagggcagtgttatctgctgggtaaacttcaccccatctaggtaaatttacaggaaagggcagagttatctgctgggtaaaacttcaccctttctaggtaaattcacaatttcctctcttgagaccaaaacgtagaccttcccactgctaaactaattctgccatagtggcaaactcttccttaactttttgcctcccacctgaaactgatccccagataatgctatctcaagaaagcaagtgctgctcaggggtttggaggcctaactctctgtcctagcctggcttggtgacactccaagggagtatttcacacatgttccttagaagatgttgaattatttctcttttatcattcataacttaatgtcattgatacaagtctgtctccagtatgtttaattgaaagtactttacatcaggtaagtaacttctggcctttgactctgaatgtttgagagaaaaattctatctagatttataaaactatcacttgataagcctcctccttcctagtcagatgggtgaaatacttatgttagttcttaaagacacaatctgtagagatgtgcttccctctcttgcaatagaactgtagctttacgtggtaagactcgatagggaaaagcaggacttacgcagagaagtaactgcatatgttacactggggcagtctttggaagtgtgttgggaatagagatgtgaaatgaatgagaactgtaccacaggaatgatatctttgagaacaatatcttccttgaagatgacttgccccagtgcttaagcttgcttccccatgccttacgtgttcctctgttccggcccttgagaagctctgttatatcaccattctatggtataagcaggagatgccaatagacatcagttcccagtaccacatccttgcctctgttgatggctgtgctttcttttttaatgggcagtggccctttctcccattccactgtatgtagaattttatctgttgaacataaggagcagttcatccagggatcccctatgattgggacattttgctgagttatgcttatgatcagcagtagtcccatagaggaggctgctgcagggttgaatatcttggcactctatgcctttggagtcacaaaggacaacccattagcagtaacagccagggttagggagtctctggatgaggagaaggcatcattggcattcttcttccttctccagacttagcatcccctctttgtactatctcacagttccaccacattctttaatttttcaaccttttttttctttccttaagaggattctgattcagcagagcaaagaaggggagtggtgctccttttctaggatccgtcaacacagtagcttcatcttcagataggattctgacccctcaccctcagcttggaccaataacttgcctaaccatccccttcagagcttcccagatttgtatttaagtacctatccctggtacttaaattcccagataactaaatgatatgtgataattccaagttaattgaattacatttgaattgcagttctatagactttggaacttctattctttccatggcaggggaatgtgcacagataatgatatggtttggctgtgtcctcaccgaaaccaaattgaattgtatctcacagaattcccacgtgttgtgggagggactcaggggaaggtaattgaatcacgggggccagtatttcctgtgctattctcatgatagtgaataagtctcacaagatctgatgggtttaccagaggtttccacttttcttcttcctcatttttctcttgccactggcatgtaagaagggcctttcacctcctgccatgattctgaggcctccctagccatgtggaactgtaaatccaattaaacctctttttcttcccagtcttctgtatgtttttgtcagcagtctgaaaacagactaatacagatcatgcttataatgtctggtaaactaagttttagttgtagattcagatgttgggataatgggactacattgtcagtgaccttgaccatgggagggagatactgaactatgtctctctgggaatggagccataatacagggagggagaatgagtagaaaaaaaggtgcaaaatactctagaataatagaggtctcattagagagtaggggagggagaatgagaaagtgaatgagagagagagaaagagagatgttagagaagagggacaaaagaagagaatagatagaaacatccaatcccttatagcagtcagacagcctcacttctattgattctttttttcttaaaccatttaatttcataagcaaataatttgcatacttcagtttacataattattttaattctttggacaagcttatattcattatttcacttttaaggacacttaccctgaagggtaattttaacttgcctaagatcacatgactgctttttcattgtgaatcactgtttctctgggtgagatggtcagcccaatttcccaaacaatattccagtctagcgtggaaaattgtgactagaaagagcaaacaaccttggaaaatagttttattacacattatataaatgagagattcatatctatgtcagttagtgccaagcccagaaatcagaggtcattctaaatatttcaagcaaagagggatttaatgcagacaattggttacagtgctcttagaaacacagaaagaacacaaaaaagaagagtgttataaagacactggaagctgcgattgaacctggactgaagcctagctgcccttgccctctgtctgctggaggtgctgccattgatgctgaaactgcatccgggcaactgagcaggaaagttaggagtttatcttcctgctgctgcggctgaatgcatgactgctgcttttacagctggatccacaccactgcagctgagcaggaaatgcaggagtttatgatcctgctgttgctgctgaatgcattgctgctacttcttcagttggattcataccattgcagctgagcagaaagtcaggagattacacttctactgatgttgctgccacatcttgatgtaccattaataatagaaaataaaatggtttccctcttcttttatactatattctctcagactccactgtcaatgaaacctggaaaaaatggttttcaggctcccatttctgccagttattcagaaaagagcattacagagtaggggtagagctggcaattaatagacatagagtcaacatagttcacctgctgcttatacagtgtccatttgcctcccttgtacccttatttaaatttcattcaacaacaatcacaacaatatggtgcttttacctaacataattaacaattttgcatacaaacagaaaagctgtcactctggatattctgtaatttaaacactaaattgcacaatagccatcatcccactttatatgtaaaataggataagaaagggaaagacgaaaaaggaaacagctgattaacatacacaaatattgcataacagacgaggaataaatcatgtgtaactgcagtcatcatttctatgactggttgttaacagatcatcagcttctggtgatagttgcaatttcctcttctgcttttctatgcttccttttttttttttttttaacgatagagtctcactctgtggcccaggctagagtgcagtggtgtgaacaacacagctcactgtaaccgcaacctgctggtttcaagcgatcctcccccccagtccctcgagttgctgacaccacaagcatgcaccaccatgcctggctatatttttaaatttctgtagagacaggggtcttgccatgttgcccaggcttgtcttgaactcatgtgttcaagccatcttcctgccttggcctcccaatgtctgggattacaggcatgagtcaatgcacccagcctcatgtttcctttaatctcaagcaggtcctcctcaggttgatattatttacttagtggtgtaattcaaactttagttcttgaagagtctgagcccctagtagtccttttggttgagttgctatagttttacattaacttttattactggaagcacttcagagaatctcttgggttctatatgttgtcaacatgtcccattgtggagaacattgtattttcccttaatagagatcagttacctcaccttggctgttgcttcagtgacatgaggattcctcaaaaggccaggtgatggtcttatcttttagatcgatgaaaccatcatgtcatgtggtagaagtgctctcctttcagaattaagaccttaaaagaagcagagtttaaatttatagggccaggaaattgaaatttttcaagctggtcattgagtatacttctaacccctgattcctgtaactgtgaaatctggcaattattaaaaaaaatagcatcatattttgactggtggttcaaagaatataccacattctttgggacagcatcacatctttgaaggatgtctttgtttgtttatttgtttgtttgttttgagatagggtcttgccctgtcacccaggctggagtgcagtggaacacacatggctcactgtagcctcaacctcctgggttaaagtgatcctctcgcccagcctcccaagtagttggggctacaggcatgcaccaccatgcccgactatgttttttcatttttgtagagacaggggccccactatgttttccaggctggttgggggatgttttcggtcagaaagtagtatgactacatcttcagtaggccattctaatgctccgcagagctgagtgtttctggataatggagcacatggcaagatcagtaaatttaatgagtgtcagcccattgacccactttattttctatggaatacattcattggtcactagctgtggtaggctgaacaatgatgccccaatatgtctacctagtaatccctgaaacctgtaaatgtactatattatatagcaaaagggattttgcatatgcagttaagaatcttgagatgaggagaatatactggattgtctgtgtggtcccaatgatacaagtgttcttattttttttatttttatttttttgagacagggtcttgctctgtcacccaggctggagtgcagtggcactatctcggctcactgcagcctccaccttctggcctccagcgatcctccgatcttagtttcctgagtagccgagactacaggcacacgctgccacgcccggctaattttcatatttttcatagagatagggtttcaccatgttgcccaggctggtcttgaactcctgggctcacacaatctgcctgctttagcctcccaaagtgctgggattacaggcgtgagccactgcgcctggtcacaagtgttcttataagagggggtcagagggaggtaccactacgggagaggagaaggtgacatgatgacagaagtagaggctggaatgatgaacttgaagatggaaacaggggtagcaagccaaagaacattgatgggccactagaaactgaaacaggcaaggtgacagattctcccctcagctccagtagaaactagaaaccagtactgctgacattgactttagttcaatgaaataattttagacttctgacctccagaactgtaactgaataaaatagtattgtttaatgcccttaagtgtgtggtaattttttacagcaacaataagaaactaataaagcatcaatgttctgtggaatatgaagattccaaataagtcctttgcaagagtatctgtgaaggcactgtgtgcaggaaaggggaaatccattttcaaaataactatgttttttagtgatgataagttacttatcctaccattaggaaaggggtctagtaaaatcaacctaacaccaagtagctgcctagtcccctgaggaatgatgctactattagtagaaggactcagcatcagctatggtcaggtggatattcagcagtggtggtagccaggtcagccctggtgaaatccatgttgttgagccaatgcatagctttcatccctactgccatgaacatttttaacctcatcagattgagtgactgctagagtgcttggggaaagagactggctgacatctgcagagcatagcattttccatgtgattactgagaacatcctcttcagtgggtactcttgagtgagtattcacatggaacacaaatatccttatatcctatactcattctgagaaagttgatatactttctccccagatctccttgttactaaatcttcagttgtgttctttccaagtgtctgatgatctggctagcccatgaagtagtatatattagtaacttgagccaactctatccagaaaaaattacaaaaaacaatcaaacttctagaagatattctaaaggggaggctctcttttcttcattttataacacaaaagcttttaatagggctgtaattctgcatcatgcatttctagccttacaccagcacaatatgcaaagccatttgtaatcacaacccatttatttttttctctgtcaactgaaattaaagaatttcaggtgaggccacaggtgtatgcttgagggaggagcatcagagcaagaggagtaggtgctgttggagtcccagccatctgctcaggtagcatccactgcttcagcgcatgctcacagtgtcacttccaaaagcttttttataaaaaaaaaaaaaaaaaataacatgaggctgggcatggtggctcatgcctataatctcagcactttgggaggccaaggcgggtggatcacctgaggttaggagtttgagaccagcctggccaacatggtgaaaccctgtctctactaaaaaacaaaaattggctgggtgtggtggatgggggcctgtaatctcagctactcaggaggctgaggcagcagaatctcttgaacctgggaggtggaggttacactgagccatgattgcaccattgcactccagtctgggcaacagattgagactgtctaaaaaaaacaaaaacaaaaacaaaaacaaaaaactaaaaacaaaaaacaaaaaacgaacaacaacaaaaagtaatgtgaaaccttttctagggagattaaactttccagtcatcaaacctggtcatattacatctacaattatcccctaccttcttgcatcatcaatttctccatctttgcccaatatgagttcaaaaacatgctttggaaagttccaaagtcctccattgactccacatttccctggagatgcagatccatttctccactccctgtcacagtagatttcttgaaatagttatctttactcactgtctctaccccttcaccttccattcactcttcagctcatgccattctagctttttggtttgatttctccaaaattgctcttgtctctgtcattaatactttacttgctgaaacatccctcaggtctatatatatatactatatatatatatagtatttcacaacttcatattctctttattttcctcacattaaactggtgactctttttacatcagtacaatgtattttccttgtctataggaccgaggctctcatctttacctaaactcgctgcagagatcatgttcttccatggctttcaataccatctatatgctaaagattcctaaatgtatatctctagttgtgttctctcccctgagtctcaagcaaaaagccgattaactactattaactgctatgcatcaccactcaaaataacacactttaataaaaattaaatattcattgcctctcttgtaccctcaatttattccttaattgatatgatctagccaaaaacctagcaataattctccattcttgtcttcctcttagctacccactacatccaaatcaacagtcctaccatttttatgttcaacacacatttttaacctattttctcccctctatcttcacaatcattatcctagtcaaagccatgatctatcagttaaactaactcaacagcctttcagttggtcttcctgttccaccattctattatccattcttcacaaagtatccaggataatatgtaaacatgtagaaagatcatatcagttttcttttgaaaacctgctataacttctcattttgtctagaataaaatcaaaacctggttccacaatctacaaggctctacctgataaggcctcccttacctctgttccttcatctcctattacagtgctacttttcccattgtttatcacactccagccacatgttcttctttcggtttctcttgcacatcttcctgccttaggtcccttgcacttgcatttgcctctacctggaatcatgtctcacgaacctctgcagggctggcttcttcctgtttaaacttctgctcaaatgctacccactcatgcatgttctccttcaccatctcatctaaagtagctttaccacctcggtctcagcttcagttatctattgccatgtaacaattcaccaaaagcattgtgatttaaaacaactatttatttagtcatgactcaagggccagctatttggtcagggttttgctgggatagtttgtctttgcttcacattttgttatctgagatcacccatgcatttgtggtcagttggaaggagccctggagctggctctcaaacgccctcattcacctgcctggaagttgatggaatctatcagctggagggccttgatttttctccacatggcctctctagcaggctagtttggcctttcttacaaaacacctgggcttccagagaatgagagcataaactaaaaggcctctcgaggtattgcttgaaagttgcaccatatcaccttggccacagtgtattggccaaagtatatcatgaggttagccaagattaatgggtgagaaatagactctacatcctgataagcactgctgcatataatttttggtgatttcaaatctaacctgcctcctttcctgtgtcctcccatcagtctttatcatatcttcttatttatttatttcagagttcttaacattatctaaagttatcttgtttatgtatttgttttcttttgataatgagtcctgctccttccatttcatatttctttattttatagttcttaacattatctaaagttatcttgtttgtgtatttgttttcttttggtaatgagtcctactccttccatttcagtgtgagctctatgacaagaggcatcttttctgacttggatattattgaagctccagggattagaacagcaaacagtccttatttagcatatgaaaaatggtcaaggtttgatggtcaagtgaattaatgtatgaatgaattcatgaattcagaatacctggttcaacagaagactagtacttacagtgatttggaattatttcccttgaatactctctgggagctgaatggacaggctgactgaagataaaaggtgagaagtcctgtgaatgatgaacaggatttcgtggcctgtttgtgttctgagtaggttttagaacaaaattaaaatgctgctttattttcttgttcaaattctgaataaataatcacagacagcccttgctatgcattatcttactatcttccaataactgagaattaacttatcatatgaagtcccattgtagcctgctttctgtggaaggtcctatgtaaagctgaagaaggtcaactaggaatagccccacatgattttaagacagcaccgagaaaaagaaaatatatcaaaatattttttcaattaagattatttttaaacttctattttatcactacattatatttggaaaaaatagaatctctctctccctcccatctaactggaatttgttttaaattagtctgaaagataaaatttcattttaatttatggatttgtagttttggaggacagtagtagtatggatggataatagtagtatatttgggggacagtatagtagtaaactcaaagttattcaggaaaatgtaggtcaataggcacttattgagcatcctgaagacaaaggcatggattagacatatcttctacatttaaggaattttattataatgagggataaagattacacaagtggataatgaaaacatgaggcatgctgtggtagtggtgtgcacacagggccagcaaggccatgggaattgtatggcccaccttgttcatcagtgctagaagatggtgacagagaaggaaagaaatgtagtaaatgagcaaaagcaaagcgtgttccaagcaattagaagtaagtctaacctgtgacagggaaagagtagggataactggagtttaaattagcacctatgcaaaagctgaattccagcagctatgtcctgtaacagagctcacattctggccgggcgcagtggctcatgcctataatcctagcactttgggaggccgaggcgggtggatcacctgaggtcaggagtttgagacaagcctggccaacatggttaaaccaagtctccactaaaaatacaaaaattaacagggcgtggtggcacacgcctatggtcccagctattagggaggctgaggcaggagaatcgctcaaactcgggaagtagaggttgcagtgagccaagatcatgccattgtactccagcctgggagacagagcaagactctgtctcaaaaaaaaaaaaaaaaaaaaaaaagttcgcattacatcctgaaggccactggtttccaacttctttgcatatgcggaactccctaatgccaaaaaataaaacgtttattatccattagttaagaaagtgcacaaagacaaaaactttagtatttttttaaatgaacaaattaatattgcctttaaatttttttttatgaatcaaaccctcaaatatatttgaacaattttgttacctatttataggagtagtttcctttgtccacaaacaatgcatagtccatgtagaggttaactgagctcttgtattaaattcacatccagagacactgcttaagacatagaggaagcagcatggcacaatgagaagcacatagctaggcattcccatcctgcctttccatttacttagtcttcagtagcagacaattactaaacctgttgaggttcagtgtcctcatctgcaaaatgagaataaagactttcttatgtgtatttttaaggaagtaaatataaatgatcttgtgatagagagcaagagggagattagaagcaaggagctaagtgtaaatttcaggttatagtttgggtgactaggtgaatggttgagtcattaacagagagaaagagagagagagagacagacacagaggcaggcaggggcacacacacacacatacatacacacacacacatacacacccacacacacacagaaagagaatgcagaatgaatggcctggatgatgagagttcaatggagagacagggaaaagttagttagtagtatgaggacagtgggtacccaatcattactgacgacaaacctacttcacctacttacatgttctggcatagtgagaagagagatatgagaagagaggggactattttctaagttccagaagtggaaggatgagggaagacagacaatgtaaaaacagtgcctaatttattactgtctacatcaaatgttcaataaaaaacaaattagaacattgaaaacattcgtaggtttattggtattacaagtctcatgccattataagaaacaaataaatgggttcaatttgaagttccattctctaatcaacatctaccaacagttatggaggttaagtcaagttattctaccaactaccataatctctttttctatatactaccctcttgtcttttttctctcttctcttttctctatcaacagctgaggcaaagacaagtgagttattcatcacagactactgaaagtgagaggtgttgaaaggagagtactagatttcttgagccacattcaatttaaggaaatgaactggggaaaatattatgttggtacccaatgatgacattataataattaacattctttattttacatgcaagtatccaaaaaaagtttccagttgatcttctcttctgaaaatgtctaaggagtaactctatgaccagattatccttggcaaattgaagtatagatttgaggcaggtggaattcaggacgtgctaccagaaaatatggcacattggcatttgagaaaaccacagaaaaaggaaggtctctcttaccttcttctctctcttctcccctgaagaaggtcattaaaccctcattggagagatgccctctacatacccagggaaagcaaacattcttatatctgaagtcatagacacagataagaatctgaataaacaggccttgctaaattccccccatcatattgccattaaatcagaccttcattatccaattatacttctcactgactgaccacattttcctcaaacctaagattaaaaagcacaagtttacctgtttctttgggttttcatttctttatgaaagttcctttgtcacaaaaacttacattaaataaactcgtatgcttttttctgttagtctatcttttgttacaggtgccacagccaagaaccttgcaaccggtaaagaaaacaatcttttcctcccctacaaggtgtatatccttgctacatagacacttgcttttgaatggactgtttgcagctacagactatctttaatcctatggcatctgtaaaattcagcacaaaatattgagagcctttttcaactaaatagtttatagttttgtcttgatctgttttggattgagatattacctatttggagatttttcttgaaccaataggtagtaacttctttgtatctgtagtcgtggaaacagagcttgactttaaaaactattagaatagaaagcataaaaatgtggctattgattcagagaaatgcttggattttttcttttcttccttgcttttcccatttttttttaatttttctttttctttcctttctcctgctatccttctctacctctttctgttcctcatttttcttttcttacttccttatgcaattaataccatatcctctttatctaagaacattaaaattacactattttttttcttttattctttcaccttaaaatggagatattagcaaatagtgccagaaaacaaaaatatgatgacatgggaaaaaatggatctcaaatattatagaatagtatactatatgtatagaaatgaactcaaaagagttcataggcctaaagataaaactataggccaggcgcagtgctcacgcctgtaatcccagcactttgggaggccgaggtgggcggatcacaaggtcgagagattgagaccatcctggccaacatggtgaaaccctgtctctactaaaaatacaaaaattagcggggtgtggtggcatgtgcctgtagtcccagctactcaggaggctgaagcaggagaattgcttgaacccaggaggcggaggttgcagtgggccaagattgcgccactgcactccagcctggtgacagagcgagactctgtcaaaaaaaaaataaaattaaatttaaaaaagtacaaagttatattaagaaagaaagaccaaaatctgtgtgaccttggagtaggcaattttttttaaatttctatttttaacttagattcaggggtacatgtgcagatttgttacaaggaaaaatgtatgaaacatatatgtacaactgataaaatgaacttcatttttattaacattttttgctctgtgaaaaacaccactgacacaataacaaacaaaatgacatactgggagaaaataaagaacagtcacaacttaattatatgacaaatagaccaatttaaaaatgggcaaaagattttaatacttcactgaagaaatgcacaaaatgattctcaacatcattagtcattagagaaatataaattaaaactacaatgaaatatcactatacatacttgctaaaatagctaaagtttaaaagattgacaatatcaagtgttggttgggatgtggagtaactagaactcccatacattgctatgggaatacaaaataatactaccactttggaaaacagttggcaggatttttttatcaagttaaaaatacacttacaatatgcttcagcaattgtactatgtacttacctaagattaataaaaatatatgcccacacaaatatttgtatgtgaataatcatagcaactttaatcataatagttgagaaatgttaaaataaaaagttggaaacaacccaattacccaacaagagatgaatggataaacaaattgtggtatcttcaaaaatagaatactactgaggaagaaaataagaataaattattgatatatacaacaatgcagatgaattccaaaaaatgatacataaaagaaggtgaacacaaaagaatacataatgtttaccccatccgtgtaacatcctagaaaaggcaaacaatgtttagtgatagaaagcagattggtggttgtctggagttggaaggagcagtgttgactacaaaggagcaaagggaactttttggggtgatagaaatatttcattttttcaaattacgatgagatttcaaaagcatatatctttgtaaaaactcactgaactgtagaattatacaacatttatataaagattatttcttaagaatgtattatggtgatattttccagctgaaaaggtgattgcattgtcataattatgaaagtttctataacttatcattcagatccttgataaaatttaagttgttttcattacagattatacaccctatttttaaagaggggtgtgatatatcttcataaatctaaacagtagtcctctcctgacctttattttagagtctcttgagttttcagacatggaattcagcaggtaacataagcagagtggggtttatagacaattggtttatctgcactggaccctaaaagaattaattccaaagcactcatcatcttgaatagatgtgatattccgtactatcaatagcttctaattagcattttaaaagccttctaaatgaaatatagcagattcctttttctttttgttttttctaataggtaaagaagaaagatttctgatgcctgatatttgggacactagagagaatattatttaacaggaacaaaaacaaacttagttaattattctagcacagtaaaactgtagttgcaaaggtgaaatctatgttggatattatttatgaaattttaagaaatctaatttggcttttgaagatcataaaaatacagatacataatactcagtgaagtaaaaaataaaaaatcagcactgaattagtaaagactttttttccctcatgaacatgttccgattccttttcagggttttactgttcaaaatttcattacaacctcattaaatgaaaacatcttgttaaattctttaaacatttgctctgatcaattttcaaacaggaattttcagctaatatgaaaggtaaaacttaactcttaaaaaatgttcaatgcttcagtattcttgatacagaattaactttatttattgaggcagtatactgataatgtgctgtggttgtataatgcgggatacaaagataattatttgggaaactaaaataaacaaacaaatatgcacacactttcttgtatttcaggttgactgcaattactactagagaagaagcatcaaattattatgggaatatggaagagattagtttgagaaagcaagaaaaattcatggagcaccccacagctgagttaggtgacaaatcagtgagcctcacctcaagtcaactgatccagagtatctggaggttgtagcctattcatccaaattgtaaagaggctcttcgggtgattctcatgcattctaaagtttgaggaccactactgtaagtgacagcacttgtgcgtgtgatatttattgagtaggtaaaattttgataggtgaaaaaagagtgcataaagatgatttagcaggaaaaatgcctaaagactggaacacttgaggtttaatattattgagggcctatatcaccagaagagattaggactttctttagtagacagtgtgtagccgtgacaggtttttcatgacagcactactgtaattattttgtagtttagaagcattctgtggttcgggatgaattgggattgttcagtggggcgtgtaggaggatgcgttagagggaagatgggctgagtaaactcgggcaggtagaacccctggtctgttacattaaaccatgtcagaagagggtgaagaaaagagattggattggaaagacagtatgttttagaaatagagtccattgtctagattccatggaaaattttgttggtccttgatttttatctgctagataccagttgattttctcgtgagcatggggtggggaaagggattatagtatttggatatatttggctaagaagcaaatttattgactccatcccaataccacccttaggatacttaaaaaactaagagaagggaaaaagttagaaaaatttggggagtccaggtcttctgcagtagcagagatcttaaaaagacatttcagaaattggcaaacacagagacagagtaaaaagtggaaggcacttgactcagatgtagagaattaataaagggtcccagaggaggttgtacctgtgttctgctagccaagaaaaagttagacagatggatctggtgtatgtgttggggaatgcatgtgtttccctgtgtgtgtttgtattgtgaggaagtaaaacaaaaaggatgattcaatcagagaagtaggacagaggctagagagcatgacatgttcagggaacttggagcaattatttttcaaagaaagggaggtcatcagtgctaactgttacagaaagcagaggcaacagcagcagtaaaggagcttgacagacagtgtaacatcacggaagggccaaggagctctgcagtttgagtggttcaacccttgagggagttaaaacctcagttttctcattcctaaatgaggatcccaggactccttgtgaggatgcatgggaaatatttaatacaggatctggcacatagaattttatctagaggttagctcctataatttttattattctttattaactttcactttgtactaatttgcatctttaaggtttgaaagttaatctttattaagtcattcttttaagtattttaaaggtccctagaatataaaaaaatttcaaaaatgtagatgtaagctttcaagaaaagcacatagaattctttctgtaaaaaaagtgttgtttttttttaaaaaaaccctgaaatttagcacaaacattcaaaatataacttattgtgcatctgtgcttccacaaccatatttactataaatcttaccaaaatttcacggtctttctctctacttctcattctttgtctgttcaggtgtttatgtctacattttgtttaatttaataatatgcatggctctttctgcctttttccttctaatttccacagttacacatttaaagattttctttatttctaacacaacttttcctctggtgacttctaattcctagttttctcttatttcttcttctcttcttttaacacggactatatggagccaaaaaagtactatttattttgtattacaccttttattcatgaatacaaattaaatgagttgaatgaattatccattatctgtcaaaaataaagttaaatcacaaagaattttaagagtttattgtgagtacaaaagaatagttcatgaactgggaaacctcaagttgaagaatgcatgaaatctccatttaacagcagttccagcacaacttatagagcctggaggaggaagtattttggcctttttcatgattagctgtcatatatttgtttttaaggcaacagagcctgtttaagctgatttatctgtagctactggtttaatttcattgaaccatgcagaaaaggacaaaatgctaatgtctatgctttgtttatgttcaaggttaagatttcaggcaaatcaggatgattaaaattttggttacatggctgtgggcagttgaccacgtggtaatctaaattgtagcctccatttttatttatttattttgaacacatctaaaaggcacctagccacaaatagcatcccaaccaagtaacaaggttttgacttgatctccagtctattttgtttgttttcactatttcttggctttttagtgacttttgatttgtttaaaaggaaaagatctgcgttattccgtttttgtgaacgtcattttgttatatacatattccatatttttagctaaaagttagcttttgtttaaacaatgaaagaaaacaaaggatctctctgcactggattgtgagagtaaaaaaaagcaaaattgttggcagtgctagggcttggaaaagtaaaagctttgcatgttttttaatttaatagcttcccttgttatgcaactaaactgtatttgtacataggtggaataaactaaagtttttaagggataaattgggtcagagaaatggaaataaaaggacaatatttttcaagttcttatttttcaagaggcttagtataaattatattttaaaatgtttaatttcaaacacattttcttctccaataggacaattttttttgcttgttttcaatacactgttcctaccagatagcttcatatttcaaatgttctgaaaccaatagaggaaactgtacagaaatgtattggccctgtgactatgccctcttggagtttacttgcagttctgtggtcctgtatttaatgaggattatagttctttttttatccagggatggggaatctaatagtgtgagctgggtttattaccctattccctcacagggctacaaaacccttcttagtccacaaaattcatcttcagccattactctcgaatttctattttggaggcatggtttgtaattctggaattttttaaaattaaaagcagagagactttagtccaatcttgtacccatttgaggaatgttttctacaaaattatgcaacacattattacctgaagaagtaaataatgcaacaaattattacctgaagaagtaaataatgcaacaaattattacccgaagaaataaataatgcaacaaattattacctgaggaagtaaagtttctgtcatagaaatgcttatataccaggagacaattggtcactgttttagtgagcccaaagtattataagatgaataataacaataacaataactaattattcttgagcacatactatatggcaggcattgtgctatttgctctatgagggaattgttattattaacccctattggagatgaggaaactgagactttgagaaattctccaacttctcccaggacacagggcttgatggaggcagagccagattcaaactcagcctctctaaatcagagcctctgatcttaaccattatagggtacattttcccaccgaatgaaaattagtatctctttaatctctacccaattagtctaaattctaccttttggggccaaccagatcatgttcattcctcttccccattcacttatgtaccaaaaagaatattaattaagtacctcctaggtgtttgatattgttttgagcctgtaatacagcagtgaaaaaaaggataaaatttctgctttcacggtgttaacattttaatcccttaaatcttttgaaaagacccaccaacttctaagggttttcctttccttagcccaaatattcctgcttcttccaaccactcatcatggagaaaaatttcaaattcttatcaatattggtagtttccttcctctaaacatattctggtttgtaaatcatctcttttaaaacacaactacctgatacagtttggctcggtgtccccatccaaatctcatgtcaaaatctccagtgttggaagtggggcccggtgggaggtaatttggatcatgtgggtgctaaatctctcatgaatcatttagcacccatccctttggtgctgttcctgtgatactgttacacgacttcctcctcagctcttctaaaaactgggttcttgtcacacaaccaggaaagatcaggcttgtggacacatagaagggtgagaaaaacggaatttatcgggcaaaaaaggaaaaagagaaaaattttcaaactttcagtagagtgagaaggaagcctgttatccagcttctgccccaccacacaggaactcaagaggtcgggttcctcccctctgcaaagggcatgaacttctgtggctccacgtcattctcccagttcaggctggtcggaggttctccagggagccctttttacttgactgtctcagtagtgagtgagtcctcctgagatctgattgtttgaaagtgtgtagcacctcccctctctcttgctcttgtttggcctatgtgacctgactgctcccccttcaccttccaccatgattataggcctccccagaagctgagcagatgccgcatcatcatgcttcctgtatagcctgtggaaccatgagccaattaaacctcttttctttataaactacccagtctcaggtatctcttttttttttgagttggagtttcactcttatcacccgggcaggagtgcaatggtgcaatctttgcccactgcattctccacatcctgggttcaagcgattctcctgtctcagcctcccaagtagctgggattacatgtgcccaccatcatgcctgggtaattttggtatttttagtaaagatggagtttcaccatgttggccaggctagttttgaactcctgacctcaggtgatccaccctccttggcctcccaaagtgctgggattacaggcatgagttaccatgccaggccacaggtatttctttagagcaacgggagaatggcctgataaactaccatacatgaacatagcaatccacatgctttctgatgggtcagagagagaacagaaccattaaagatagacaatttgggttaatgggttgcttctgcttataatctccaagtcttgtctctccagacttgtagactggttcaattggacatgaaaatttgtagcattcaattatttaatttctgtttatcatggcaaaggtccttaatattagggatgtccttcgagtgtcctctagcatcacagacaagttgttggaagccatcttgcatccataactgctgttagagtgatatttaatgagagctgttagacggcggtttggctgaggcacttggcagactacagcatcctctagtggtcagatttaaacctcaagacgtgtatattctgaatatcacaagaaattaacctaaaccttagagtgtcaggcaactgtgtttggcaagtgtgcaatagcttttgactgattatttctgattcaatgggtgatctatttcctgctgtatattagaaaacctgctgttatctcaggctctgttagctctctacccagttttccattctaggctagttcttcatgagtttgggaattcaagctgctttttcatcttcttcctccacctccccctcctcttcctccccctgcccctccttctcctttccccctcctcctcctcctctctcttctctcctcctcctctttcttctttcctcctccttttccttctccttcttctcctcctctacctcctcttcctcctcctctacctcctcttcctcctcctcctcctccttattcttcttttaatagctgtacataccttttttttcttttggggaacttctttagttttatctgatttgcttccctgaatataaacacatagtcctttttaataggaaggtgttatctgaagtttctatagaaaaaataggcaatgagtaactcacgtgaggtgattgtggcttaatggaagaagcattagatttgaagtcagtcctgtattataataaaaacctaagcctgtcgctttgtttgcttgcaatattaggcaggtgatttcacttagttctaagtttactcataagataaggataatcttatagggttgttttggcccacacataaaccaaagtgtgctgcacaaaggtctcttgatcagttcatccagtctatagtcacttttttccttgtcagattatcttttgggaatggtttgatagtagaagagaccattcccaaagttaatccagaatcaggcctccccacctacctgcctcaggttagcacagcacaaacccatcaggccctatgaagcagatctcccagggaagcacaagaggaagtcctccatccaagccccgggttatcagggacaaccacaggctctacgttaccaccattcaccttagtaactaatggggaactggccctgctggggaagaactaaggctaagtccagaagctgctccatagccttgttaagaaaatgtactttttttgtttgttttctcaatgattcaaatctttttgagacaattatgtctgacccaaaatctacattctgagataagtggaaaatctcaaagactaaactctattccaccatataggcagctctatgcccatgcacgtagacctgtgccagccacaatagatgctcaatcaaatcccaaggaaacctaaaggagttattgcaatcagcagactgtgatgggtaacatgtttctggactgggtattttccaattgttccttaaaatagtagtccagtcctcaaagaatttcttgtattcatgatcatctgtgctctgccatttaatatctgcaatcacattttctaaggcagtgacctcaggatgtgagaaagatgaggaaagaaaaggaattatgagggaaaccctgtctgaaattacaggattcctgatgtttttaaaacttggtctattctcagtcttaccaaagtcccctgaccctggtataatcaaacatacctttgaggaaaaagcaaatggaaacaacaggggatattcagatacatttattcaacaataaggccagtcaggcctcgcggtgacctgatgggatttcaaaaccttggttctcagcaaggcccagatttttgaatgaggatagaagtctggcgtttcctgcagtagagattaaaaaaaatatatcagcttaaacttcactgatgaaaaagtgactatgggagaaaaacagggggaaaaataacagcttcatttaaagttggagaggtttgagatttataatcttttctctgtctttcattcatttatacattcacttagtcattaattcatcaaatatttattgattactgttgaatacactaaggatacaacagaaaggaaaaatatctgtccttacagtttttacagatctcgtggggtgttacagtgaacccctgaaattaaactcaaaactattgttgcatcttttgctcctgatgcctctgccttcgccaccaggtttccatctcagctgatgcctgagctattgttggaccttctaattgattgacctttcatcttagagctctggggattcgtatctgtgaggtctcacaaaagtaaatcacatatttattccacatgattcctgccagttctaaacatcctcccctccagataaaacctctctgttcgccccacactaccattaccaaactagttttctcttccctaaactaaatatctctaaattttataattgttccctagaagactgtttccaggtctttaatttttctaaccattttttctttgaatgtacgggcttacaaaaattcttctacttctctattactgaaggacatctgacttccatatacttttttttcttttttttttcttttctttttttcttttttttctttttttaagacagagtctcactctgttgcccaggctggagtgcagtggtgtgaccttggctcactgcagcctccacctcccgggttcaagtgattctcctgcctcagcctcccaagtagctgggattacaggtgaatgccaccatgcctggctaatatttgtatttttagtagagacggggttttaccatgttggccaggctggtctcaaactcctaacaaaagtgatccacctgcctgggacttccaaagtgctgggattacaggcatgagccaccatgcccagccaaactctttaagattttttaatgctttcttgtcccacaatcattaactgctcattaatactgatttccaaatcagttagcatacataagcacacacacctaaacagaataaacaagagttgctatgctgttcactctagtttcatatattcactatccacatatagctatgtaaatgtaaattagtttagataatattaaatattcagctgatcagttttactagccacatttaagttagtgttagccacattaaggctactgttttgtggctagtggctatgtattagacagcataaacatagaacatttccatcattatagaaggttctattggagatgcaggtttatggaaaagaatttgccggtacagattccctttgaagacgtagaaggaatagaaaaagtgtttattgaatatatttgccaagcacataatcaccaaaaagactgatttgcaagcccttgtttggtattatctacttgtctcaaactagggtcagcgtctggctttagttactaggtaataagtttgggacttttaatcaacagtgaaaaaggcaatgtcatacattaggaaatatgttgtatttgagaaagcaacattttgtctctagacctaaattttcttatctgagaaatataggaagagaggtcatgttttctagcatacaaatgtgcctcccatatttacatagttttgaacaaatagaaagaataagcagaaactcggaggtttcagaggctaagcagatagggtgttccagccctctactaatatttttctaatgtttcactgtaaatgttgagcggcacttggaaatttcccaagtctcaaagctgttgttctcttgctttctcctcccattggatggaaatatgatgtttgagcttaatgtcaagaacatgggtcatgagaaaactaacaggtggcttcaaattctttttacaagtcttaattatggaaacagatttattacaaagtagaatacctaatgttttgggtctaaaacttcaggatattagacctctcatccagaggtcctatttccacaatacttgctaaactctgagaattttccaaaatggtttaaaacagcccaagaagaaggtttgcattacagaaaagggaatttatgcagtagaatataatggaaatttacacagtcatttgagcctgagtcaaagtctttaatatcaagtcaatctcagaaaaactaaagtcactcgtggaatcccttttatttgctttgttcattccacacctttatttaacctggcatgctcttttgatattgccaaaattcagaactctatttaaatggcattctattctttttttttccttttttttaagatggagtctcactcttgtcacccaggttggagtgcagtggcacaatctcagctcactgcaacctctgcctcccagattgaagcgattcttctgcctcagcctcctgagtagctggtattataggcgcccgccaccatggggtttcaccatgttggccaggctggtctcaggtgatccacctgcatcggcctcccaaagtgctgggattacaggagtgagccactgcacccggctggcattctattcttttcatggatcctttcttggccccttttaataaaaaatatgtatctctgcttcactcctgttgcactttatttacacctcatcttctggcatttgccccaagttataagaagccatcctatacatgctcatgatgttttcttagtcataagcacaagtaagacagggaatattagcatgatgcttgagacatgctaaggtttcagttgctgagtgagataggaaatctgtgttgaatctatttctctgtatcacatcacctacttatggtcactgaggaaatgaagctttactgaaactggctttcatatccataagtaaaaatatatttttggttatataatctatacaatttatatttgcataactgagggctttaaaaaacacaatcattgcaaccactaataatttttttaattaaaggtattttgtgtgtactttataaaaatccaagctatcgactattttgctgtaaaaaatataggcttttatcatacaagtgacttctaaaaaataatatttaatgctaaatatataaaagggagaataagaaagagataactgtttttggaaaaagtaaatagtttgcttttctcggggtgagattcatattatcagtacacttgaagataactaacttaaaatatatagtttaaaagaaactcaagtttgtactcaccgattttcaaaacataacacgcattcattgggataagtatttccatcagtcccacagacagggtcatatatcttggtgcatccattaagttcattgtaacatttggcctaaaaatggaattaaacagaatcatttcccattattctccattcttgagttcatagcaaaatctctgaaatggttttatttctctggggaataactgtgattgggagaatgatactgtgtgttgtaagagaaataacctactatctggagacagaaaaccttgttttaagtcatgcctctgctatttctaagctgtgtgacattagtaagtcctatggcccttctgaaactcagtcagttcatctgcaaaacagtgatgatattaccatttcccacctatctcatagtgttgttgtgagatttacatggatgggtgagataatgttcaagtttgcaattactgcgggtgctggcatctctcaggttggccacatcttggggcacgttcttccttgtacactgtagtccacacacactggtcttctattaggcacttaaaggcactaggcattgtcgggtgttggaagtctttgcattctactccagtaagagtttataatcatcaaatgattgtcattgtcctagacattgttctagtgctttttatatattattctgtttaaacctcctaactatcctgtgaactaagtattatattcttcttcaggtgaagataatgaggcacaaagcaataaaattagccaaggccacccagctaaggaattcctaaattcagaattcaaacctagtcagagttcctgagctttagctcttaagtactttattctactacatctccccaccagttttgttttactaacactcattttttttttttggctcaaaataacccctcagttacttcggagcaccctccctgatttttctaactaggctaagttcctaacggcagcagaactttttcataacacttatcacaaatgtaatattgcattcattcatgaacttttggtctatcagctgtctctgactagatataaatgtactgagaacagggacacttcttcctctggtctccaaatttactgaaattacctcttaaacaaaaaaatatgaaaaggttagagttagaatatttttctagaaggagaacctagtttattattttctgtcattcattataaattagagccacaccttggtgattgggagagctgcatgccaacatggtcaaactggctgtaaggaggaagggctacttggagtgaagttgagaaggcttccaccccaaatacttgtctacagctatcactagtctatataaaaaccccttcacagcaagcactgtaggactatatggaacttgcttatacatcagtgaaattgtccttcaatatacgcctgtgggttggaactactactaccatttgcatttctcacgttaaccctccctagcattcatactcctcttaacttcaggctaaactgaaaggtgacagcaaggctgcatttttgttggatcaaactgttccagtctgagaaataagaaattacaaatatctctttacctctcttcccagggagtcagctccagtgttacctagaaataaatcagatatggtaagttgggtcctaaatgaaagaagtcagatctattcttcatcagaattctctgctttcattgcagactgtgacttctttactaggctctttcattccccaccctttctgatttctctaatcttccaaaagtatctgactgattttcctgtaccccttccttggcaaaaccttaaaaagtttgagtaaaactttgattatgaccaaagtatctcgatttgatgttttaggaagttgatctatttccttgaaaacagaaattatgcacttactgctggaaatgaatcaggcactgagcaaattatcttttgaatactcacaaacattctcaaaaccagttactagatctttaatctcacaattagtgaagtataatttttatctcagtttacagatgaaagtatggagagtttttataactagctgtgaaacagttatcataagcagtaaccaggtcttctgatgcaaagttagctttttcaattacatttaaattcccttttgtaagtattgttgaaaaaatagagttcttttgccaactcactatcagttcccaaagagctatttccaacaattgcatcatatggactatgggtctaactcacatttgttgaatttacaggtagtcaaaatagctaatctctattcccccagaaaatagcagaggttttgctgacaacatataggaaatgataactgtggataagttcatggaagggaaagggaactaatatgatagcaatcaaataaggaaacattcctgaaaattaattttaatatcatcaatctttgaggtgatctgagcaaagaggtagttctttgtatctaaatgtaatgaaaattagtgaggcatctatgagcttggagaatttcccccgggatagtcagaacttgatgttgttgggggcccactggcttttagaatctagttgagtctaaaaactgaagagcaggtgctcatcacaggcatctatttgtattaattaacatgcatgaggagggggaaagggaacactgactgttgccataaatattcagcaaataaaacaaacaatattcttcctcttcttagcaaagtgctgatttggctctccacaggatccttcactacatgagaggtgaagttgaaaatgttaaccatttccagtgataaaaaggaaactgatcttggctctgcgggttcagagttgtctgtcaacattgtcaagatgcagttggaggtatatgtgcaccatctattcaagcagaatattttctttcaaaacattcaaaatgtgtaatgtaaatacacaaaatgcaatttttgtatttccagatactaataagaaataccaggaattgaaaataaaaaattccctttatatcacatatattagctattcagggataaatctgacaaactatacatgattcaagtacactgaaacctatacaataaaaaaataaatttttaatcagtcaaattatgccttttatactgaataactggaagccatttatctattttatgcaatcccatgagaatttaaaatttgtaatttggccttacacatttacagaatgagaagtatacttaaagttaaaatatttttacccttttttctctaccatatcccaacaaagggtcagccacatcaatagaggaaaaccattttatttctgggaatttcttactagtagaattgttttccttatagtaggttaaaaattcctcttaaaaaataattcttacctgttgattttatttcatctcattaggtccaaaacatctctcgaagactagactacatcaaaagtctagaagataatgtgcttcacaaagcaacaggtcaaaacagttttatttaaatttgaaaaatatgcaacacttaccagatagactcaacagggccaaggcactgagaagaaagatgcctgttaccttcatggctgaagttctgcgtccagaggtcagttgaaaactgcaccgcacttaccacgtctcttcagaagcctgggactggaagggtcatatggcagatggcagcaaggccccacctactgggctatatcacagatctccctggttattgattgactctgtgtcatagcctggcctccaggttctgggaatgtcacctgtgtaagaaaggtgaaaggagccaggtgggcctgaaacatgcaaggcaaagattctgtcaggaaaatagttctagtggttagtttgatccctaactccctctgtggttgtgggaaagtcattcccttctcaagcctgttttctcacctgtaagatgaactcaaagatcccttctactctgtagttctggatagatgagcaggtatggatagctactagaaagaattttattccaagtagggtaaaacctctccattcttttttcctttcctccactcttcctttcttattcttctttctcttttctctatttttccctcactcattcacaaaacctaaagtagctgatggagtggcagatgagagggaaagagaaagcaagagagagagaggactcagttccctaaagcgtgtattctggagctagagggtgcttgttggagccacttttgctgtgcttctgtgtattcatctggaaattaaaataataataacacctaattcaaagggttactctttcatctgagaatatgtgctgggtaaaagagaatatgtgctggatatctaccatgtgttattagaagagaattctccatcctctctcatgttttggtgtgtcttatgagtagaggtactgataacctttgtttcagactatctttttaagggtgtttatataacaaacgaccttagaaaatacgtaatgtctccctctgcaccaaaaggcaggtttgtttactgtttagtgtaataaagttaatatctccttctagggcaaagaccatgttaattgccctttacaaaagatttcgggtttttaaaagcttggcctttctttcctttaacacactgtactttccctgcaactatcacttgatgccccttaaattggcctgtggaaattggggcttgggaaaccagaacaaattccaatactctggctgttgctatggaataattaagtcccttttctctgagccaggagtctgtgccttctgccagaaaccattataatgtggcaggctaacttcttagcttccaagtaggataaaatctcaaacccttcccaagtcatgacaagaactgtatttatctcttaagacagatcagtaaataaaaataacaatctctgtcttcatggagcttccattgcctttttgttgagggaggcaagtgacaaaaaataataagtgattataaaatatatcagataaatattatggagaaaaggacaagaaggataagggtgctggagggttaaggagatatgtatcatagcgtaatcagagaaggtcttgcttttcaggtgatatcacacagagacatgaaggaaatgaggatttgaactatgcatttattccaaggatgtgcattccagacagagagaatagtaagcgcaaaggttctgaggctgacgctggtttgacatgtttgagaaacatccaggaggacactctggcttgagcaaagtgatagagggcaaaatgggagatgaaataatggaagcagtgagggtctaaatctagtgcagtctagagtaaggactttggtttttatcaaagggaagctttggaagtgtttagttcttgaaatcactatttggatgttttacagctacctcaaatctaatatgttccatactactattttgatctttcaccacaatatttttgtctctattctccctacagcttcttttctttccagtagatcactcaagcccaaacctcgttgttctccctgatatttccctttcccctttctatgcatcatcttccacacttaatttgctaccaagttctcttcttggattcatgttcaaaataacctcaatcctggacacttctcattagcttccactgtcatatctaagacaatgccatcctttccccctgggtttctgcatttcctgcaaagagtttctcaatatttgttgttatttcttccttaaagctgctgcccatagaaaggcccatagggatctttatggactgcaaatttgatcatgtatctgtccagtttctcattgttcagaatgctcaggaagaatttaggtcctgtatgacttggctcctttctatctttattccccaagagattcttccttgctcaatctggtcatttccttgctacgttggtcatttctctgttaccctttactaggaccaacaaaacaaaataatacaaaacagcttttcaccttctaaggttaaaaggttaagtggtattttctcaagaagccattctttctgggtcttcctttacttctttctgcatctagattattccctcctattgtacgatcttcataaaacccttcattgcacttaaaataattccaactctatagctattcatacgattattatgtaatatctttatttttagggagtaaatacagttgctttatttattgtagcacctaacaaagtgtctggaaaatagttgatactaaataaatatttgctaaaaacataaattaagtgataaatgtatatatttctgaagaccaaggtttatgccttgttcacttctgtgtctccggtgcctccggttgagtagccattcattggttcaccattcggccttttattcattcaactattaatatattcaaatattcatcaagtccttactatacaaaaatttttggctgagtgctagggaaatggatatgatgtctgccctcatggagtttagtcttagcattgatagatgttggttggatcatatttgatttgatttgagatgaaaatatattggttcttttcatctcaaatcattatttaaatagtagttttgtgaccagtaagaaacttccaataaccactgttaaggaaggttcatatatgagaaaaggatttttttcttgggtctcacaagcagtgtggggagaagggaattggctgggatctggtcacagaaactcattagataataatagcagcagtaataactttagatttaggcctgcctgatgccaaagcctggacttttttcaccaaacagtgctttttaaacattttgactgtgaacctaaagtaaaaattttgagttatggcctagcatatgcattatatgtagatatgtgagcagacaaatacagttgttaaaaaataaaacagtcttattatatgtgaggactcttgatagatttttttattctattccatcccagtttgccaatcctaatctgtgattagaaaaaacatttcactacagaaacatatcctatggaccctagacaatcttgttttttaaatcactacaatactaagatgaattctagttaaaaactggccctaaatttgtgatagggaatggccctttgcagacaacaagttaaagaggataaaaaaaacccatggagaaaggggcctgtctccaattataaatctgccatttcaactgtgacatgagtgggcaaaacagttttctcaactacaaaaatacacatcatacagtgttcatttggtgtgagaataaaccaagaaaccataagtaaatattgtgcaaaaatattattcctcacatgtccaggaattataattgctagctagtaataatatcaccctccttccatgaattagaacaatagaaaatatactgaggcctcatacaatcaattcttgacagaataaatattgtttgccccgggagatgaggagtgcattgaccagagaaatcctgccaccgtgctagactattagtcatattgaatgtgtttacattgctcaaccttgtgtacattttttccttttcttctttactgctctgagtacatatttatgcatgtctatctttgggaactcaagtaaacatattatgacctactcccctctgattcaaggactaattattcacctgagtaaagagtgatgacaaaactcaagagaactgctctaatggatgttgataatacatgttggaatggggatattgggctggcacctgttgattttcacattctgtgcccaaagtttaactagtaagaaaaaaatgacagaaactagagatatacagcttattatatttagagacctccttgacatttggagacctccttgacatagctgcaacttaattcttcaacttttatttttcattatttagggaacttcatggcttttcataaatgacctcttgtttttattccactgcttgttctccaaataggttgcatgtgtacctatttgctgtacccatcctctacagcttgggtaaaatgtctgtggtgcttgatgcaattaggaaagatttactcactttcctttgcctctcatagcagtttgtaaagctatcacttaataattacattgattacatcctcctcctcatcattatcattatagccactactaatatttttcaaaagcttctattcatcagtcactgcagtattttattttcatcattttaatcctgatatcattgttatttctcttttataagaaaggaaactgaagcacagagatttcagttttcttgttcctggtaacagattaacagatatggtatttactgatttgtgtgtgtgtgtgtgtgtgtgtgtgtgtgtgtgtacaaacttaatgtcatggttagaacattggattaaactccaagaaaccaggattcttaatttaatactgccacaaagaaagggttgccccctcgtctatgtaaaccctgcacttaagcgtctctgttacagcactttaaactggaaattctaatttttcatttttcttatttgtctcctttactaaactcctggatgtcatgaccttttatctacacagtcaagtacactgttagatccagtggcacctgataatatgtgcgaaatccatgccttctaagcatttgtgggcatagtagactttaataagattgcaaagaattgcatcacacactaggcaacaaaatattttaaaaacatgtcagactttataactactcttaactggaagtctttcttggtcatttcccgccaagcagtagccaaacttacaaatgtatgttactccatcttcattctcttttctactctctccagccaggaatgaaacaaccagtttctttccttgtctagaacagaaacagatgacaccttggctctggagataccatatctaacaagttcttttcaggatattttcccaaaaaagacagttctttccctaaaataaattctggtgccagctgtaaagataataacatttccagcatgtcatttaatgattgaaagtctaatctttgcagaatgacagacctcagttcaaacctatgtgtaactttgagctaaacttcatatttatgaccctcaattttcataatttttcctctaaataccctcaggctggatgggttttaaaattcaaattttttttgtaaatttttgaaaagttatatgtgcagttcagaaagcccagtggtgcctggcacagcaccctttaatcaaatacaccaataattcttctgcaaaacgtatcatgtagagaaaataattatccttaaatcatctcttgacagattttgctgtcaaatgagttacaaaatgaaacaaaagaaaaacttctgaaacaaaacaaaaacaaaacaaacccctctgtggggtttgaaatgatgaattagggactgtggacctgtagatacttcacagagttgttatgaggaattaagaggataatgcctttgcataaggctcatagctcacaccaggacaacaaggggttaataagtgcctgtgcctacttctactattgctgccatatggtggctcatgtcaaatttgggatcaactacgtgccctttctctttccttatattggtgtaatctttccttattgtatgttcaatttataggaaatttctgaaactgctcttacattaacttcttttctttctttctttctttctttctttctttctttctttctttctttctttctttctttctttcttttttgggatggagtctcactctgtcacctgggctggagtgcagtggcatgatctcagcttactgcaacctctgtcttccgggttcaagtgattctcctgcctcagcctcctgagtagctgggactacaggcaagcaccgtggcacctggctaatttttgtatttttagtggagagggggtttcaccatgttggccaggctggtctcgaactcctgacctcaggtgatccacccgcctcggccccacaaagtgctgggattacaggcatgagccactgtgcccagccacattaacttttcttacagggacaagccatccgtgttggaggccacctgtcttggacccacaagagttttatgaatgcctcccatcagctcttttcactgatagacctctaagtctcgttttccagaagctttgctcttctctcaatctggcactgatcccctacagcaatcattaactaaatgttcaaacataagacaaggaagcatccagttgagaaacgtgtttactggaagaaaaaacaaatgtttcttgtaacctatgaaaatcaaagaagaattctgtagctaaaggtagtagtgtatatctggggacaaaaggtcaattaatgaataaccacatttcagataaggaaatatagaatgctgtggaacaactatagcaagagggagagtgtatgaagatcataaaaacaatttcagtagattctggcttctggtcccatactcttaaccaaacctcttatgtcttattaatgaatttattcttgccaattcatatgatcttttttactttttctcacttttctagatgtgttgtatatgtctccagactctagttggcttcactgtactgtgaaacatttccatataatgccctgatatcatttcaaacttttatactttataaaatatatctgattattttttaacaattcttctttcccaaatttctccagttctcttgagagcatagccattatttcaaatctttggtttagagtctcctggggtcttgttctttgcttttccatggctcttgatctaatccatcatcaactttcctaattcatctttcatctacattcatctttctattcatcttccatcactctaggcctacagtattcccccacggttccccatggtctctcctacttgctataggctatccatctcatggtcctgaagagggagaggacctggattgatgacttgatctgcctctcaccaacactgtgatccctgtctcctctttccctcaccagcctcctatttcccctaacatagtcactggattagtctgctctcatactgctaataaagacatacccaagactgcgtactttataaaggaaagaggtttaattgactcacagttccacatggctggggaggcctcaggaaacttacaatcatggcagaaggagaagcaaacacatccttcttcacatggcagcagcaaggagaagtattgagcaaaagggagaaaagtcccttataaaactatcagaccttgtgagaacttactcactgtcacaagaacagcatgagggtaaccacacccatgattcagttacctccccactgggtccctcccatgacacatagggattatgggaactacaattcaagatgagacttaggtggggacacagtcaaatcatatcagtcatcaaaccacgttaaacctacttgactctatctccatatttgttttgctgattcttcctccattcagatgattatcaacttgttgaagttgcctaactgttcattgcatcctgctattttaaaaatatgaaagtattttaggatagttttagatttgtcaaaaaattgtaaagtttgtacagaaaatgtatggatatccctaacccagttttccctattcttaacattttacattacctgggtacatttttcaaaactacaaaacaaacactggcatattaccattaattaaacactatacttcactgtgatttcagtagtttttccactagtattcttttcctgttccaggatctcatctaggatataacatcacatttagtgattgtgtttccttagtctctctgatctgtgacagaacagactaagaaaacacaaccattaaatgtgggaaaaaataactgattgtccttagtctcttctgtcacagattagaaaatattaaggaaaatcagttattcctcgtttttcattacctggacaagttttgaggagtagtcaggtattttttcaaatatccctcaattttttaaaaatgtttttctcatgagtagactggagttagggatttggggaaagaacctctaaattaaagagatcagatacctttctcatcagatattatggatacatgctattaatatgacatcacccgtgatgctaaactttatcatctggtccaggtggtgtttctcaactataaaactaattttgacccccttttcatagcccattatttggaagaaagccagtaagtgcagcccacattggggaatgaggagttaagcttcaactctttgagaacagagtatctccataaaccatttcaaattcctctataaggaacatatgtctctttctctttattgatatattcatgtacttagaaaaggatttatatcagtataaatattgagatagagaagtacaaagtctcgtgaatatgtatttaatattttggttataattcaataatacactatttattttggtggtcaaattgttccaggtttggtcattccattgggtgagctttcagactggctcctatagcactttgacatacttttattttgtgtttattttgtttgttgaaaattttgtttttgggcactacgagatgctcaactctctctctctctctctctctctctctctctctctctatatatatatatatatataatatatatgttttaagaaaacatttaaaaattgttatatattttaaggtgtacaacatgtttttatatacatagttaaacgactactacagtcaagctaattaacacattcatcatctcacattgttaccttttttaaaaaaatgataagaatgcttaacatctgtctactctcttagaaaatttctggtatacaatgaaatattattaattatagtcctcatgctgtatgttagatattcagacttttttttgttgttgttggagacggagttctgctctgtcgcccagtctggaatgcactggtgcaaccttggcttgctgcaacctccgcctcttgggttcatgagattttcctgccttaacctcccgagtagctgggattacaggcacccgccacaatgcccggctaatttttgtatttttagtagagatggggcttcaccatgttggccagactggtcttaaactcctgaccttgtgatccacctgcctcggcctcccaaagtactggaattacaggcatgagccaccgtgcctggccgatatctagactttttcatctgtataactttgtaccctttggcctccctattcccagtttaatcctgcaactaccttacttaaaattcctttttgcaattatgataaaatgcaaatccctagcattgcataagagatcctttgtgatttactccttacttatgaacaaattcatctgtatctcagtttaaatttcagctattctgagaagacttcttttatcagctgccccttcccattaaaacatgggtttagaaatctttctatgtatttccgtagtgtgctgaccacatggtagcagactctgaataaactatattgaatgaataatattgtgatcttcacaatggcaattaaccacagtgtcttcatttgtaaaacaaatgtgatggctttttagacattaatagtttggatgcaatgaaataagtttttgaaaatgctatgtgaattgttatcaattcacagatataaattatgttagaaaatcggggtgagaaaggaaacaaattacattaatttgaatcaactctcccccacgcctctccaatgcaaagctcaagacaagtagtttacttggcagcaagcaggagtaggaaaccaactgtaagtcaggaaaaggagaaaaaggggtgcatcattgttctgattacattgtgagcaacttgggcttcttttacacgggaaacttgctatttcttttactgttgtgaacagtggacttaacattcaatgcatgcaggagtggatacgagcagtaaagaagacctcaagcttatagaaaacctttttatatgtctaacatcccttaagtatctacttagtatgaggagaatgtgaaagtgaatgagatatggcctttccccaagttttggtgcttaaatgaagcatatgcagtcagagaataaggaggaaaaccaaattctacaaaccagattggaaagggtcttgcttgaataccaggctacaaaatttgggcttcacttatcatataaaggacacatagcgaagatacttaagcaggagagttacgagttacctgatcaaagctgtattttaggaatattgttttggtggggatttgaatggattacaattgggagggaacattggtaggtgagaaataatttgatgttaactattgggagcctgaactgggaggacagaatggagcatttcagggtatttcaatgtaaatgagaaaatagcgtggtcagggctcagaatctctgaagctgactaaggatgaatgatttggaggctatatgccacccagttgtctccttttatatttgataaggagccagaggtcctcgttaactttaattttttccagacatattttcatatagccctttaaattagatctgctgaacatctgagtctttttcaaagttccatcaaagttcacagtgaaagggttttaggatacatctgtatggtatttccttgtggaacagtggagctactttgtaggctctagcatgcaaagattttgttttttttttgagttgtgtatttgtttacgagtttatatccccctaataaatgtaatgcttctttaggggggcaatttggttttatatatctttatggctgctacagaagctagcatagtacttatcacaaagtactttaaaaaggcttattttcattgaatgaatagtatgttcacttaggattaaaaatgggcaaattctgttctaggaaatatgcaatgtgtagggtttgccaaatatctttcaggaaagagacagattttagacagtgagaaagacttaatcattcccaaagagagtgtttacccagtaagctgcattcgttctagggtcctcagttctgtttttggaaactcttggacactttgagacctaatcaatcaggctctcctttgtgttcccagtaccgctgaatagcttctattatagctttccatgtgaaccaggaggtccctggaatgcagagtctgcagcttccttttcccagtacctagtagatcataggtctttaaaaagtaaatgatgtgccaaacacatagtaggttcttaaaaagtaaatgactgaaccaagtaaaattgtgtttaaaaattattaccttattctcagatctttacctgcttacattaaagagccccatgttgtattgtgaaataaataagttacaggatgatcccatttatgtataaaacattgcaaatggttattaacagaaggcttgaatataattgggtcagagtcaagcagtaatttcactgtgtagtacagtttggattttttgaagcaataagaatgttttcctgtattattttttatcatgaaagtaacattttaaaatatgagaaaattatcctaaatgcaattttatttttgaagtacggcccatagcactaatcattttgcaaagcctgcatttggaaagagtctcctataatggctaattaagcccttgtaaagtgagagggaacaagctaataggaggtatcgggaacaagctaataggaggtatcagaaacagtgaactcagcctggagacctctgtctcaagagagaggaattataattgagtttagtacagcgccagaaccttgaaaagagtgggcaaaagcaactgagtcaaacaatgatttatccaatattaaggctgctctaaaatactgcagaggtcctccagttgatcctgtcacctttcagatgaggatgctaaagctgaaatcaagtaagaagcaagaacacttgcttcccacttgaggtaaaaggagctgtagaataaagttgtgggtagaaggttgagaaattcatcaaatgcacaatcaagaccaaaataacaaaaaattactgcctaaatccaagaagtcagtcccctaattgcttccattcttggctgttatgatgaacaggtgacctctgcaattttttccatcctctcagttttatccagtttagccacattatctccatctcaaccccagttgccacattttattattacctttagtgagctccaatatattatggaggatggatactctctttgctgccattctcagatatacccaaacccatattgttgattctttcaggacccaattttgtcattcctcaacagaatatcaaatcttactctaggaagagaccttaggcatttatacagtttccctctaacaaatttaacattgccattgccacagaaatcactgtactatgaggcgaacatcatcgttgattacatttagttgttagaaagccttccttgtgtaagccctcatggattataacctttatctctttctcctggactaggcttctggagatatatggaaaaagcccattctctagcttttatgatagctcatcatgtaactgcaggcaatgacccattcttctatgtccttgccaatgtaagtcttctcttctgcagtctaaacacgataataataaaaatgcgttgaactgagatttttggctttaaagaaacagagacttaaaagaaagagtcattcaataggagggcttcaagttggcactggaaagtcatcagaagctgagattgcttctgggatcagctcctctttcttctctcttttgtgggccactggcttgctggtcttttaaggtaactctgcattatccctcctctgctctttctttccagatattagcctctctatattatttttcttatttttcttaaaatttctactttcttatgatttcaccttgccatgtcccctgttggctcaaggcagacttttatttttagcttcaaccacctgctgcttcattttcttgtattagcactttcatcgtcctaaaatacaaactctgacctagttcagtgtgtgtgcatgcatgtgcatgtgtatatcaggttatgccacagtcctacggctgtctgtagctcgtctactctggagccattggagtggggttttgtggtgtgcctcatggtcttctagtaataggggctgttggggtagtgggcagcttccctcaggtatcctgagactcagcctgtccagtacaataatcccttacactggcttaaagccttttacaatttttttattttaattcacaaataaaaattgtatatatttatcgcgtataaaattttgttttaaatatatatacattgtggaatggctaaatagatccaattaacataagcattacttcacatacttattttgtttgtgtgtggtgagaacacataccttgaaagctttctgtgtacaaaatgcttttgaatacacatgacttatctaatactcaccaacactgtaaggtagctactcttaagttttaaaagacagagcaactaatatgaagtatctgatccaaagccaccctgttaacaagagttgtctagaatcatggtctatttcatcttaagacaagcattatttcttctctatcagagtttctcaaaattaggcatgtatcagactaacttggagggataattaaaccacaaattgctaagctccacccccaggatttctgatttagtttgtctacaagggagcaaaagaatttgttgacaaatttccaggagaggaccttgatgttggtctgaggaccatgcgctgagaaccactgttcgacgtaagtggcttcatctgaggctctcactgataagcagttgtaagatgcaaatgtttttagcagctgagtaagctggaaccaggtgaccggcagatataattctatttcagttgctccttgttatttgggacctcatgaccttttgtttttcctggaagagaatatagacccagtcatttacaaggctggatcagggacatgggggcttccctaaatagcattttaatgtgatcaatctaatcaattacctagaccagtataggtcacttagatttgaggatggtcataggttactgggaaatagcctgatgatgagtttggtctcgtgggtattgggaagagctataaattgagatcccagtgatctggattctaatcccaactactgactcactgtatgacattgagaccacttcaaataaacaccaaacctgtttctttgtctgcataatggatatatttatgctgaccacattcctgtatttttgtgaatattacatgaaataatatatatataaaaataaactttgtaaagtataaaacttaaatcctaataatggttatgataatggaataataatgttgctccttgagcattcccattctgctctgcaaacagggatgtcagaaaaaagttagagatcataaaggaaattcagatgttaggatagccattaccacaaatcataaaataacaagtattggaaaggaatggaacccttatgcattgctagttggaatgtaaaatggacagctactatgaataacagtatgatggttcttcaaaaaaaattaaacacagaattaccatatgacccagcaatttcacttctgggtctatacccaaagaattgaaatcaggaactcagagtttttacactcatattcacaatagcattattcacaataaacaaatgtggcaacacccaaatgcccatcaaaagaagaaatgataaatggaatatggtatatacatgcaatggaatattatccagccttaaaagagaagaaaattctgacacatgctaaatatggaagagtctagaagacattatgttaagtgaaaaaaagccagttacaaaagacaagtattttattatttcaattatatgagataactagaatagtcaaatttatagagacagaaagtagaatgtcgattactaaggggtgggggaaatggggaattattttttactagacaggagttttactttgggaggatgaaaatgttcaggtaatggatgatggtgatggtttcatagcaatgtaaatgtacttaatgccattgacctgtatacttaaacatgattaagatggccacttgtatgttatgtgtgtgctaccaaaagaaaatctgagagttggtaaatttgggatagttatgagaatctagggaaacagtctggctgcttttgcccagttcagaataacttatcctagaaatgctgtgtgcatgccagctgtgtgccaagagttttgtcttggggctcatgaaatagcaagtcccattggggaagatttgttggatcaggggaatttgctagaagaaaactgacaggagcttagaaattggcagttgtcagtctcagggcatctgtggctctccacattctttgtcagacaccagttactttttttttttttttttgagacctccaatttttttgatcccaaaggaaaagcttagaagattgagtgttgagtcaggggagacagggatctgtagatgtctagaatgttagagccataaggaagcttatgatttatcgaacatgggacccttcatttgaaaacccctgcccagaaaaaatgtcttgcctaaggttagtcagctactcttaaggggaacagggattagaaacaaatggccctgtgtcctaaattctttccacaacagcaggctgcttcatggatcaacaacacataattcaattccttttcaaagaagaaccaagatagaaattatagatgtttttgttattgtttgtctcttcttactccttctctacccaccaccactattcactcctgccctgcctccccgtagttcacatagttgctagaataagcttccctgaacatggttctcatctcaccacttaacacccaaaaacttctcgtggctccttagtgcctttagggaacacgtgtgttcttctgattaagacattaaaatccaaaatcttgtccttagtaatgaaactgcaatgtatccctacactggaaaaatatacaactgaaacagggttaatgaagaagttccctgtgtattaatcggaaagagctccaggtcatattgttaagtggggggaaaagtaaggtgctggaacgtttatatagtatgccaccatttgtgtatgaaagaggaggaataatacaatttattttttatttacttttgtttacatatagaaatgatccaaggataaataaaaaaggctaagaaagttttttgtattattcaaaccatgtaaataaatgtggtaattttgcaaaaatagaataaaatctgaccttgcctagccctctttctctctcaccattccctgcaaaaacctagaactcccacagctttagaattttcagtttctcataatcccaagtatctcatgaagctaactttcacaacaatactctctctctcttttacctatcaatttcctatttaatttttcatgtcttgcttagacacatctgctctgtgaaacttttcttgcctccccagatgaaatttagtcctaccttccttggtttcttagctttttgctcttttcccattattactctctcctgttagttccagaagttgaacattcatatacagaaaaatgagtcactgaagacaaaagatctgatttccagcccctgggacactgctaacccaaagtacaggtaaagcatccatttgtttccttcgttcacagcactggctttaactgaaaattcttttgcaaaaaatatttattactcagcatttatttgtcaccataaatgatgttttccaacattcattgaaagtggccttcaatgttggttatttcatataatatttttagctgtaacccttgttgagaacatatcttaaaaaaatgcattcgtctttgttccaagttactatatagaatggaatgagcttccttttctcttcctttgaggacgaaacactagctaattacgaggaactggtatgagggtggggtaagtgagatggagttgttcaagcacagggttgaatcctgtctttatttaaaatgtcacattttgtttatcatgatgtgttcgtattaattctgactacattgaagttttatttatcctggttgcttgagattttggtgtccttttagattttgcacctgaggcaggtgtcttgctagctgcttcaccccagtatctgccctgctgttgttctgattaccaaataccattatcttagttgcttgggtgtttctggcacaaatttaaatgaatatgagatccaactggtagttgtgcttttgacaacatttccatggaagctacagagacgatgtgtaggtggaaattccttgtgcctttcttgcttcttcacttagacattcctaggttcttcttatctctccaggactgggcaaaattcctactctccctgagggctttctcaggcttagcctgcatccttcatctacctactctcggggccacttatcccacttcccatcccagcactcacaattgttttgccaggaccatggctgtgctctccttccaacttctatttcttttgtatttagttctgtctctgaaactttgacttacagattttcaagtgttttcttagcaataagtctgaattgaggaacaactatcatgactggttagttcatttaattttgcccaggaactcttctccttagtttctaaaattatgtatttcaaatgtttatccttttaggttttatctatcctggcataggcccaaatcttgagattgctgcttacccacgtatatcattcttgataagacagggctctctttgaaatggcaaatgcctgctgtcttacctccttcctatccattaaggagttaggtcttcattttagtattcaatctattttctaccctctaggttttttctctttattgatttaacaaaagctaaaataaaaagctgaatcactatcacttccacaggagatgtattacttctaacccaaagggaatttgtgatatcagatatatgaagggctcccatttctttaggccttggcagatttggtgttcattaagcttccctcttcgtgccctccccaaacccgtcatttaatatatcagaactctggtgaatagcaaaaaaaatgatcagagcctggtaccctggtcctatattgatttataaatacttgttctagtgactcccagtttttctattatgaacagctttgtggttcctatagaaggggaagtctatcactgtccctttatttatgggttgggacaagaaagaatgggagctgactcctcttctacctgctgtaagatggaaggggtggtgactccagcttctgagtctacttcaggcagccagatggcagccactttcataatatacattagtgtcccaagtaagcctgggaggtggagagttaaaactgtcaaggaaccttgaatttagaaggaaaatgcatctttaccatttatcttttgcggagtacctccttagtaactctgggcttcgaaccaggaccatttccagaatgcaaagaattactcctattagagaaaaatgaacagtagatttacaatccttatatttataaagattgttaaaaattgtgtgtgtgtgtgtgtgtgtgtgtgtgtgtgtgcaagaacatgcattgagattttgaaacatgcccatggactacaacgaaaggttctttttttaaaaaacaagttttcttttgtttttaattagctcataatcattgtacctatttatggggtgcagtgtgatgtttatatatatgtatatgtgtgtgtgtatatatatatatatatatatatatataaaatgacaataaaatcagagtaaataccatatccatcacctcaacactcctcttttctagctattttaacttataatacattattgttgagtacagtcactgctttgcaactgagcatgagaattatctctcctaactgtaactttgtacccattgatacccattgataaaggttcatttaatgttgggcacgactgaggtttcttgctaatttttaccccactccttttcctcattacacattcaccaagtgcttagcatgtaacatacacagaagcagagtgttggcccatttttcaagttccttggttcaaaaacatcctattaacctcaagtcatcaaaaggatcttgatgacattgagctatcccttgaagttttaaaatcaaggtagctcatctctgctaggttttacctgacacgtatgtccaaacttgactttgattaagtaaaatttaagcagtttcctgctagtgctctggattctagcataaagtcattgctgcaggtcctgacccaattttatgacttgttttgtcacaagataactatctttttttctgtttgagtcttggtgaactgtcttcctctaaagaatgagaccttgtttgtttcttgcctccatcttccaggcacttaaggttgtattctaaaacatgacctagcacatagagctcacttaaaagttgtggtttattctcttaaattctgttggatgttggattatggtagagctgtttgggaagaggattgagtggtgggaaaatggagtaggaaattgggtcatgttataaaggactcatctgcctgggagctgggattcaggcactatctggctcctcactaagtgcccgttctaaggcagctagcagggagtggagcaagtgctcccagaaatcatgcccaatgaagacatagagaactggattgagacagctgttgataaaggccatagacaaggccaggggtcttaggagtaaggccacctggttcaggccctctctgtcttcccgaaatgatgtgaagtccagccacagggacacttgcaagggcaaccagcagaggaagaaggtggttaccacagtcgcaaggacctggaagggtcagctaaacttaaccagctgcctttctcttaacttcaaggctacaaggatgtagtagccagtgatgatagccagagggagaaagaagccaaagaaaaagtgggctgttgtgaccagcgtttggtgccatggaatgataatctctttccaaagttggtgacttccttgagtttcattctgcagatcatactggttgtacaaagagggtgacactttccaccacgagtttccttgaagatcaagtagggaacagagaaacaaattgccaaaagccaggtcctcaagggccccagagttgcctttgctggtgtgcaattgttccaggactagattggccacaggatcacaagtcagtggtccatggagatgagggtcagaaggaagacactggccagaaagttaaaaatagacatggtgctattgagtttacagagcagctggccaaagggttacagagctaccataaccagctggagaagcagtgggaagatgatgatgaagtcagccacgggcaggttgaggtaccacccacaccgtgttgactgtgcaggacatgtggaatccaactacccaaatgacaaggccattgccagccaagcctaggaagaaagtcactgtgtagatgatcatggaaaagatgtcaagagcagacttgaccctctccaaagagtcatcacaatagtcaaacatggacgtgggactctccacagtcaacagtgacaatgcagacacattctccatgctacctaaaaatagccaaggtatatttaggctcaaactttcaaactacataaactgcttaaattatcaccacttcctttcttatgatgactgcagacagctttcatgtccctgctttaggatgtgccattctctgttggtgatattcctcctcctcccccatgtgctcttgctcctcttcctcctcttcttgttttcttatccatattcttaaccacagttttcaccacttattctatgccagccactatgctagctatgttccatatattgcatatcatgaattaagcagctactaggagtccaatgttctgttcatatattgcatttaatttatttcccataacaaatctgtcatatggaaaagaattattatgaatgagaaaactaaggtaaagggaggttactaaattactgaaaatcaaacattcagcagtaaaaaagcagaaatgaattttgacgttagttctgcttaattaaaaattcatatactttacctgatttttttctttttactgtatattcctccttcaatgggctgaaggggggctcatattcgtatttttaatttagtttacaaaagggctttcctgtgcttcacactatttaataatttccaaaatgccatgttagctacgtaagacaaatgttttattattgaagtgatttttgacatatatgaaagcaaagactgaaaaaggttgttttctttgagctgtagctcactgccttaggaactagcagacctggttcttgaacccaaacctcctgaaaccaaatcttatcttttcctcacctcattacaatgctcttttttatgggtaaaggacatcaggaggtgggtgtccaccctggaggaagtgggatctctcctggtgactgaccctccaaactctcttaagggaagatggtcacgtcagctgcatttaggggccacatgaattattgtctaacccatatgaattattgttttctcatttccttatgggaaatgcctgctgcatattgttggcattgctatctgtttctgtcctattttcctgtttcaatttttaagttcctcaatgtgtggggccagtcttcaattctacctaatgcctgcttttgtttatgctgttctcgctacctagaatgccttcccctccaccattttctgttggtgaaatcttgcacacacacatcctagtagacttacttgcttctttctctgtttgttcatagcaccggatgtctgtttaattctagcagtcttgcctgcatattagaaatggttgctttgatatctatctcaggagtcacagcttattctacttctaccactaaataccttaggcaaggcatttaccctctctgagctttacagccttaatttttaaaagcaatatataatattaatacatacctcagagggttgttgtggtaatataaggaaatatttcagtgaaatatttagaaatatatctgatacatcaaaaacacccagcatgttggttattattctttttattgataccatcattactatcctaatttttgtttcatgcaccacatttgatttatattaacattccataaacacttgtttaattattatagtgctgataaaggataaagattcaatgagatgatacctgtgagtataaattatagaatcaagagttatataaagcagaatcctttttcttgaaggaaccagttatttcccttgttttagatgcttacttatttaagtgaagttttcctcttcttgcacaatctcttcccaacttttcacccttcatctggccccaaatggccacccccagacaactgtgaaacctgcctatgcctctctcagtagtggaaccccacacactcaccttcaccagcttggagctctgcttccctgctggggttttatagcagccaaatccattttggaggcttttgaatctatggggccaagggactctgaaggcatctgtgtcagttatcagactggtgaagtctctgtgctaggacctaagtaatacagtcgaaaggaggaacctgggggctcgtgttgaggtttgtctaaacgcctagaattcttttagggagggagcttgggatacaaacaatttttattcatcagggccttgaagttcagtgatcactggtccggataattaagactttaggaaatgtgacctcatctttgatgaaatttatgtctaagattttgaaacaaatataaagacaatttaaaagtgcatgagcatagtaaagcttgacgttaattacaacagcaacagctaatatttatggagtgcttattatagagcaggtttaaccccttcactattctgtactttggaatcagaagggtgtgatgataggattttgtaaaaaccacgtcagaggatcccctgtggaaacggaaagggtggttgcttaatcacagacggcaatgagatgattgaactttgtaggcttagtgttgagtctaaactgtgagaccagtctgtaaaatgagcttaatctaattgagctttagctataaaatccgtatatattcctctgaagcttaaataaacccagtaaataaaggtaattggacaaccagaaagcataatacaaatgtgtgatttacgatttggtttaaaatagttggacattattaggatgcaatattattaaatagtatttggaaaggccgtccgcatgggacactgtggtagatgagaaaactgatgctcagagagctcctgtctgtttatggcttggttgtgatggtgagggatctcccccatgtgcagaaagtcagaagtggatgcttcctcaatgatgagaggggcaactttgtgggaggaacaaagagtgagtgaagttttaaaattgcaagacaggggaaaggatagtgttggaggtaaatgttgaatacaaatatatgaacgtaaatctgaatttaagtattaaatgaaatatatttacataaacctggcacattcctgttaacaatagctcagaacaatctctagtgtacagtagcctttttgatccccagtttgcttttctcggtttcagttacccatggtcaactggagttcaaaaatattacacgaaaaatttcagaaatatacaactcataagttttaaatttcacactgctctgagtagcacgatgaaatctcatgcccagggacatgacttgtccctttgtctggagtacccgtgctgtggatgctgcttgcctgttactcacttggcagccaactcggttatcacactgactgtctcagtatcacagtgattatgttcaagtcacccatattttattttgtaatggccccagagtacaagagcagtgatgctggcaatttggaaatgccaaagagaagccacgaagtgcttcctttaagtgaaaatataaaagttcttgacttaataaggaaagaaaaaaataatatgctgaagtggttaagatctatagtaagaacaaatactttatctgtgaaactatgaagaagaaaaaattgtgctagtttttctgtcacacttcaagctgcaaaagttacagccacagtgcatgataacttttatttcagtacgttgttatagttgctctattttattattagctgttgttgttaatcttttactgtgcctaatttataaattaaacattatcatggataagaatgtgtaggagaaacagtatatataaagttcagaactattcgaggtttcaggcatccactgggggtcttggaatgtatcccttttggatatgcagggactctggtacaaagcctcttccattatatcatcataatggccatgattacacacccaaggggtcatatatctttgaattgaactttcatccagaactcttaaaaaacaaaatatgttggtaaatacttagatgcctaagtatttattatctcttatctcttctgactcttctaccttccagcagaagaccatggaagaaagataaacttttaaagcacagccttataggaaagttgtgttaatagatggtagcaggttttgtaattattccaataggtaaaatgaaaataaacttggggtcaaataaatactcttaggccaagccagtactaggcttgtctgatgcatattcacacaccaatacaattttattcttttaagctactttttgttagtctgatattttaatattgtttatgatgtgttagaacttgattctggcagccattctctgaactaaaaaagcttaatgtgatctggggccattaataaactctgatgtcttcttcaaagaagctgatagacctgctctgctctgtgctaggcaagacctaaatagtattacatttagctatggcaccactttggagattcttggaaacacttctggttgtgttgaggaggtgacaatggttgaccttaggcatccaaatgtgacctgtacatcttattattagtgctgctttctaagtttctgtccaggacataaacttagttctgtcctttctaaatgctttccacaatttttgatgacaatatgttggaatttctggagttggcactcatggactaaggaatgcaaggagggctgagtagcagcctgtgtcgacctaaatgtctgttgatttatcaaaatcctagtgtgacagaaggatcctgatgatcccccctatactgctgaatatttaggggatgctatgaaatctcctaagattagaggcctccaggtcttcaaggtacatcagccaatttgagtactttgtctttactcttaaattctccatattcccaaatccaatataaaagtttctaagcctctgagtttctccatacccccaaattcaatataaaaggtcctaagccttctgcagcatttgaggtagtatttcttttagctggcttatcatctgagaagtaaaacaaaaactaaaaacaatatttcttcctcctctttaaacatatattttttttcctttttcaattcattattttcttctagcacaggatgtggcacaaagatggccatcactaacattgcctgttaggttgcttttgttttgtaaactgtagcacaatcccggaaatggccacaagagggcatttgtgcaccactttgaaagttactcttgttcaacatcgcattccacaaacattcatagtttcccatggtttgaactttaataattccaccctgaaagaaagaaaatgaagctgaagtcatatcagacataatctaatccatattgtcattccaaagattccagatctcaggacctgtgatagtgtaactctttaaaatattgaagcattgtgaatgattttaaacatttcaaaaaaagaaatgttttaaatattttaattagtgttgaggcttaagtagctgtacttttgacttagattattatagatttgacagtcaaaaccttaaaatattgagacccatgggggaaaataatgtgtgcatcaacatttattgaatttgatactttttgtgatagagtcccagaaatgatatgtgagaagcttaataaggtttaaagtgctttgtttattgcagttttaagtgtcttcttcttgaattaaatcttaggttaaggaggctgttggagtcatatgatgatattatggtgcaaaattaattacctttgcaccaacctcatagacttggaaagtgtaatgaagataatctcatctattcttatctattacaagagccttttccacagtaaatttggtattagctaacctttatttgtaggattcagtatggagccattaaactttattttcttgtaatttgtagtcacatttcaaaaacctctcaaattcaatcctaaattcatatctatttttgcttcatgatgatagccctccaaatatctgaacaatctcttaagggtttcttggtttatcttctctccaggctggtgtcaccaagtttattaactgtctctcatatgatccttcaaaagcctggataatcttcttattatgggtttgttgtgaattaaatatgaccacacattctttgcaattcctcctaccaagaagtagagtttattttctctcctcttggcactgggcacgtcctatggcttcatttgaataatagaatgtggctgaagagatgccatgtgtcttttgaggctaaacattaggacatctagggttttaattttcatatcttggaatgcattttcctggaactcatgaattaccagatgctttgcaaactgcctccactgagctcatagccaaagccaatcacaaaatgccagtattctggctctccagccatcccagtgccccagtaaacatcaatcaatgaaacaggtgaagcagctatatggtatttttaaagaatcatgaaaaaagtacactgtgcttgttttgaaccactgaattttggagtattttgttatatggcattagacaactgagaggtccaggttgcaaatgatctcactgggttgagttcagatctaaatagaatgtgttgactgtgactaataacctgtaaaatagatttttttcttatttgattttgatggcacattttcatagtaacatattttttcagccatattttcataacctgtgatatttgaaatgatttgagaccagagctgttgttgcttatcttgacttaaaaagaaagaccactgaaatagagcctgtgactttttccccagttcctcagttttttctgacagccaaaaaataaatcctgaatttttctagacttgatggaatgacaaacatgatttcattaatacaatacttaactgtaaaccaagggtttgcacatacatcatctcacttaatccacacaaacgtatatggcagcattaataaccctttaacacacactgaagtatttgtgagtgataggacattggctagcaatttactctccaatggttctgaaaaaaagagttctatgtactgtattcaaatcttttctgtaagtttgaaattgtctcaaatttaaaatcttataccaaaaaaaatcttataatttgttcactggatgcagtgattatccattctcctacttctattctgtgtacaagctaaagaaaggtaaaattcttcaaagagaaattacaaataaaactccccaaacatcactcaaaattaaagtgttgagaagtagttcatgagcttggtgattgtggctgctctgactgaggttataattatgaagctggatagctaaaagtaaagatagagaggggataataataataatagtgtaacgtatcttgagtgttcattcccaggtactaatttttgtaagcattttgcatatgttaacttattacttataacacccttagaaggaaggaagtttgttagcccaactataaaatagttggtaaaactgaggcccagcaaggtaaataacttccccattggaaaagctgtgccatgaatacagacaggctggcttcaggacctgtgctctttgtcactaaacaaagaacaagggcactgaaagcacaaaagagcagcctcaaccctagaaagatgtggagaagctggagacagtgtttagcaaacatcaagcttgtcaggagcccacacacctcagtaaaaaggcctcctccaccctgtactaccaaaagaatcatagcgcatgttgttaaatcaaactaaatatggcctgagaaagcctccatacttccatatttgaatccttgtggatgaactataaccaccttagtaggtagacaagactgaagtatgcttctgtaacaataggtgagtctcagccaatcccagaagctatacttaaccactcatatgccgctgactgttcaaactatgctcaaataagacatgcaccaagctgtaaccaatccatctgtttctgtacctcacctctgtttttttatacatcactttccttttattgttctgaccgtgaggcatccctggagtcactctgaatctgctgtgattctggaggctgcccaatttttttctttttttttcccttgctcaattaaactgttaaatttaatttgtctaaagttttcttttaacagatctggtgtcagagtgggattaaaagtaaaactccagcaacccccaggaacaccaggtgaccaggtgaggtacctgaggagactattgtgctcactgctctcttgattgtagctggaggtcatgggtgagtttgctctcagattccgagctccaccaacttgtgttctgagctctatgtgtttatttgagcaatagttaggctggactgagtccaggattgaattggatttgataattaactgaactggattcagttagaggtctcaggcctcaggaaggtactttatttttaaaatgggatcttttgaatccaaagagtctgggactccaccttccaggactccatgtaaattttatgtataaaaattatggacccagaacatgtgcatttttagaaaaatgggttaaccgcactagagaaaacttagaattaagatggccacaatggggaagttttaatttggataaaattatttgtgaggcacattagaaaaggggggatcaaaagccccatgaaaacagtgggacgtattctttcattggtatgcagaggcctctaaaagaccacatgaatcaaacattgcttccttaaaagattctttgcaaaaaacaaatgaaaagcttaagcaaaagaccaagaatgtgataaaagaggactgtactctgactgaactaacctcaactattccttctctttatgtatctctacctacatagtctgagtccactaacctttttggtaaattaccctttcgccctgacgatgatgaaaaaaaaagaaatcagacagatgtcttacaaagtgagaccttctgaccagctgggcctgcctgctgtaactactttcactccatggtccaaaactaagcttagagccattgtgaagtactttcttgatccaagtgaaaatcctcaaaactttactgaggaatttagaatcctcatacaagcttacaatccaggacttcctgacctttatcaatttattcacatgatgttggggcctggtgaagcttgggaatggatggcagcagcagactgggacaaacctgaggcggatgttaaagacccctccaaaagttcttcatgagaaggacaaaaagtagctctaaaaattggtaaataccctttaaatttaattcctaaaatttgtccacaaaaaactgattggcccatcatacaatcttgtaaacagaaaaaggatgaaccagtttcagattacagaactcgcttagaaacactgtgaaacatgtagggctcaaagtatagcaaggagtatttcctgcagggactgaaacagcgttaactgctctgttcatacatggactccatcctgaacttaacagtttgattagaacacataaactggaataggaagttacaggaatgactgaattggtggtcttaactgaacatttggagatgactctagaggaaggaaaaactcaaaaggctaacaaacttatgacccttcaactacaatagttacaggggctgggagcaaaagtatggaagggaccttctcattctcattttaaatcacaaccaaaaggacctagaacaagaagttctttaccgcaagatgtctgccttcattgcagacaatcaagacacttgaaaagagattgtctgcttttatttcagtatgccaataagcctccctttaggccgactgtttccaccctaaaaagaacccaagagacctcagcccttctgataaaaatcaacattgatgaggctccaagggattctctggtaaatttctccctataatacctttaaataaacatggagaaacaaaggttaaaataaatggggagtcatgtacagtcatggtggataccagagctaccctatctaccgtaaactccacttcaataagccaacaaatcccttggagtaaaaaggtcattcctgtggtgggggtttcaaatcaagtacaagaggatctcttatctgaatccatccaattaactttggggccttttcataataacaaactttttactatgtgatactgctccagtaaattggctagggcgagatttactttcaaaactaaaagggcacatgcaattttccttgctcctttcaaatagcttctcctgaaaattctcatgatagtacttataatcagaggccaagggttttaatctttatattttttctagaggctttccaagttattatggcttgtattaccagggtaacagtaaaaatgagatcctctttaaatcaggccactttacggagcgctatgatccttaactgttctcactctctgagcaaggactatgaccaatttgaccctaagactgtcgaactgcttatattgtctgaaccttcagttggttaatttggttcagttcattttcacaagaactcctgttaagaagtataccttggtattttggtataatcctctttatagtcctaataatagtccccttggtgcactgtatctctcaagtcctaaatgtcttgtacgtggctatccattgagagttaaatggtctcactccaactgtgtcagcaacaacataaacattcagctggtacaaagctgcgacttgtgaatttcctactgacattaaagaagacttgtgaattccgtaatgagactgaagaagtctttcatgatggtgacagagaatggtgtcaattcctaaagtttggtcaatctctctaaatggagagactgaccaaaaatggggaattgttaaatcgaactaaatatggcctgagaaagcctctgtaactccatttttgagtccttgtggatgaactgtatcctaccttagtgggtagataagattgaaaacctaacttaggaatatgcttctatagcaacagctgagtctcagcccatcccatcagccatacttcaaccactcatatgctgctgactgttcaaactgtgttcaaataaggcagacactaagctgtaaccaatccagctgtttctgaacctcacttctgttttctctacgccactttccctttttttgtctataaatttgctgtgatcacgaggtatccctggggtcattctgcatctgctgtgattctggaggctgtccaattcattaaccttttttttccttgctctattaaactcttttgaatttaatttgtctcaagttttcttttaacaatgtaaacatttagcaatggggaaatgatttgtagccaagacactaatcctggacctataacttggcaaagtaaaacacaaacttttgttcttctttgatttgcacccacatgatggatgtgcagtctggcattttttttggaagggtgtggagcttacatatacaagacattagggccaaggtcaaagcctgactgattacactggtaaagatgcaagaagacacttttagatttagcgtttattacttagatagatatcaaaagagtaaaccaaaagtgccaaacccctctcattcatattccacacatcagaaaagaccacacccaaacaaaagggcccaataactgcactgggaactgctgctgctgaggagcgaacggtagacttcagctaaaaggttttggatcagtagtgggtggggccagagtcttcccggacactgaaaaatcttcctgtcttgtcttacactaatctgctttataatccccatgagcagatactcctgcttgagaattcatatttattcccagtgatcaagtcattccagatcaaggacaaagcttatcagtcaatcagagtttagggttctggagccagaccctcgcatctaactcatcttacacactcttggcttgtctgattgtaaactaaacattgttcgatatctgtcatgggcagatgctatgcatgaagagtggtgggcatagaaaagtgaaagacactgtcccatgcagctttcttggcataccttattgtctctgtttgttttctaaaataagcctttgtgaattctaatgttatttctcatcaaacaaacttgacagtagttccaaatagccagaaaatggcactttgaatttttccatcctgcaagatctaaataattcttataataaaataggcaaatggtctgaggtgcctgacatccaggcattcttttacaaatcagtcccttcctagtctctgtgcccagtgcaactcgtcccaagtcttccttctttccctcccgcctgtcccctcagtaccatcccaagcgttgctgagtctttctaatcttccttttctacagacccatctaacctgtcccttcctccccaggctgctccttgccaggccgagctaggtcccaattcttcctcagcctccgctcctccaccctataatctttttatcgcctcccctcctcacgcctggtctaccttacagtttccttctgtgactggccctccccgacctgcccagcaatttactcttaaaaaggtggctggagctaaaggcatagtcaaagttaatgctcctttttctttatcccaaatcagatagcgtttaggctctttgtcatcaaatataaaaacccagcccagttcatgacttgtttggcagcaaccctgagacgctttacagccctagaacctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaacttccaaacacctgaaccgcagccgccaggtgttcctccagaacctcctcccagaggagcttgctacacgtgccggaaatctggccactgggccaaggaatgcccgcagcctgggattcctcctaagcttcgtcccatctgtgtgggaccccactgaaaatcggactgttcaactcacctgacacccactcccagagcccctggaactctggcccaaggctctctgactgattccttcccagatcttctcggcttagtggctgaagactgacactgcccgatcacctcggaagccccctagaccatcacggacgccgagcttcgggtaactctcacagtggaaggtaagcccgtccccttcttaatcaatacggaggctacccactccacattaccttcttttcaagggcctgtttcccttgcctccataactgttgtaggtattgacagccaggcttctaaacctcttaaaattccccaactctggtgccaacttagacaatactctttaaagcacccctttttagttatccccacctgcccagttcccttattaggctgagacactttaactaaattatgcacttctgtgactattcctggactacagctatatctcattgccgctcttcttcccaaagaaggctcttcccaaagcctcttttgcctcttcctcttgtatccccccaccttaacccacaagtataagatacctctactccctccttggcgaccgatcatgcaccacttaccatctcattaaaacctaatcacctttaccccactcaacgccaatatcccatcccgcagcacactttaaaaagattaaagcctgttatcactcgcctgctagagcatggccttttaaaacctataaactctccttacaattcccccattttacctgtcctaaaaccagacaagtcttacaatttagttcaggatctgcgccttatcaaccaaattgttttgcctatccaccccatggtgccaaacccatatactctcctatcctcaatacctgcctctacaacccattattctgttctagatctcaaacatgctttctttactattccgttgcacccttaatcccagcctctcttcgctttcacttggactgaccctgacacccatcaagttcagcaatacctaggctgtactgccgcaaagcttcacagacagcccccattacttcaatcaagcccaaatttcttcctcatctgttacctatctcggcataattctcataaaaacacacgtgctctccctgccaatcgtgtccaactgatctctcaaacccaagcaccttctacaaaacaacaactcctttccttcctaggcatggttagcgcggtcagaattcttacacaacagccaggaccacaccctgtagcctttctgtccaaacaacttgaccttactcttttagcctagccctcatgactgcgtgcagcggctgccgctgctttaatatttttagaggccctcgaaatcacaaattgtgctcaactcactctctacagttctcataacttccaaaatctattttcttcctcatacctgatgcatatactttctgcttcccggctccttcagctatactcactctttgttgagtctcccacaattaccattgttcctggcccagacttcaatctggcctcccacattattcctgataccacacctgacccccatgactgtatctctctgatccacctgacaatcacatttccccaaatttccttctttcctgttccttaccctgatcacgcttgatttattgatggcggttccaccaggcctaatcgccacacaccagcaaaggcaggttatgctatagtacaaggcactagcccgcctcttagaacctctcatttcctttccatcatggaaatctatcctcaaggaaattacttctcagtgttccatctgctattctactactcctcagggattattcaagccccctcccttccctacacatcaagctccaggatttgccccacccaggactggcaaattagctttactcaacatgccctgagtcagataactaaaatacctcttagtctaggtagacactttcactggataggtacaggcctttcctacagggtctgagaaggccaccgcagtcatttcttcctttctgttagagacataattcctcagtttagccttcccacatcaatacagtctggtaacagttgagcctttattagtcaaatcagccaagcagtttttcaggctcttagtattcagtgaaacctttatatcccttatggtcctccatcttcaagaaaagtagaatggaccaaaggtctttaaaaaacacacctcaccaagctcagccaccaacttaaaaagaactggacaatacttctaccaccttctcttctcagaattcaggcctgtcctcagaatgctacaggatacagcgcatttaagctcctgtatagatgctcctttttattaggccccagtcttattccagacaccagaccaacttagactgtgccccccaaaaaacttgtcatccttactatcttctgtctagtcatactcctattcaccgttctcaactactcatacatgccctgctcttgtttacactgccggtttccactgtttttccaagccatcccagctgatatctccttgagatatccccaaactgccactcttaactcttgaagtaaataaataatctttactggcaagactatgctgaatctccttaggcactctctaatcagatatcctgagtcatcccaattcttagaccttttatacctgtttttctccttctgttattccatttcgtttctcaattcatccaaaaccgtatccaggccatcaccaatcattatatacgacaaatatttcttctaacatccccacaatatcaccccttaccacaagacctcctttcagcttaatctctcccactctaggttcccacgccgcccctaatcccgcttgaagcagccctgagaaacatcgcccattctctctgcataccaccccccaaaaatttacaccgccccaacacttcaacactattttgttttatttttattattaatataagaaggcaggaatgtcaggcctctgagcccaagccaagtcatcgtatcccctgtgacttgcacgtatacgcccagatggcctgaagtaactgaagaatcacaaaagaagtgaatatgccctgccccaccttaactgatgacattccaccacaaaagaagtgtaaatggctggtccttgccttaagtgatgacattaccttgtgaaagtccttctcttggctcatcctggctcaaaaagcacccccactgagcaccttgcgacccccactcctgcccgccagagaacaaactccctttgactgtaattttcctttacctacccaaatcctataaaatggccccacccctatctcccttcgctgactctcttttcggactcagcccgcctgcacccaggtgaaataaacagccatgttgctcacacaaagcctgtttggtggtctcttcacagggacgtgcatgaaaaaaagcttttcacataactcttgacccattgaaaagaagaaaaaaaaacccaacttaaagtgcagggctgtgttaactgctgacagggttgagaaaaggaaaaaaaaaaaaaaaaaaaaaaccctcaaagtgcggggttggaaagatgcctgagggaagaagctcttattcttatgcaaatggtttctccaagagggagagaaacttaattgctgtttgttccctggggttcgcatggagctggatccctcagccaggagaggggaagacactgtggatgtgtggctaggaacactggccagcctgccacatgtggcctttgggccatgagccccagtctcttccgggaggggagtggggcagagagctgctgctcacctgttcattccaaacaaatcaggaaaatgtcatagaaagcctggcttggactgaggctgatatccccaaccaccaagagtgatggcgggatgggggacagtttcctttaccctcagaagaagcctgagggaagaaagactctgaaacaaaagggaaacaacacccctacttccccttcttgcctgggggctagaatgtctttctaggactaacattagccaaaagattagaaattatgatttagcagtcatgtacctggaagttacaagattctgactctccccaaattgcccctggggataacatcactattgtaaaacctgagatcagtgcttgagatattttgcagactctgcacttgatggatcagttggcaccacccacatggataaactggctcatctgatcttgtagctttcatgcgcgtccgtgtgaagagaccaccaaacaggctttgtgtgagcaacatggctgtttatttcacctgggtgcaggcaggctgagtccgaaaagagagtcagagaagggagataagggtggggccgttttataggatttgggtaggtaaaggaaaattacagttaaagggagtttgttctctggtgggctggagtgggggtggcaaggtgctcagtgggggtgctttttgagccaggatgagccaagagaaggaatttcacaaggtaatgtcatcacttaaggcaaggaccggccatttacacttcttttgtggtggaatatcatcagttaaggtggggcagggcatattcacttcttttgtgattcttcagttacttcaggccatctgggcgtatacgtgcaagtcacaggggatgcgatggcttggcttgggctcagaggcctgacattcctgccttcttatagtaataataaaagtaaaataaaatagtgttgaagtgttggggaggcgaaaatttttgggggggtggtatgcagagagaatgggcgatgtttctcagggctgcttcaagcgggattaggggcggcgtgggcaccttgagtgggagagattaagattttagtttcctgactccggacaagttgagtaaagctaatttgccagtcctgggtgggggcaaatcctcgagcttgatgtgtagggaagggagggggcctgaataatccttgaggagtagtagaatagcagatggaacactgagaagttatttccttgaggatagatttccatgatggaaaggaaatgagaggttctaagaggcgggctagtgccttgtactatagcataacctgcctttgctggtgtgtggcgattaggcctggtggaaccaccatcaataaatcaagcgtgatcagggtgaggaacaggaaagaaggaaatttggggaaatggggtgaatgtcaggtggatcagagagatacagtcatgggggtcaggtgtggtatcaggaataatgtgggaggccagattgaagtctgggccaggaacaacggtaattgtgggagactcaacaaagaatgagtacagctgaaggagccgggaagcagaaagtatatgcatcaggtatgaggaagaaaatagattttggaagttatgagaactgtagagagtgaggtgagcacagtttgtgattttgagggcctctaaagtattaaagcagcggcagccgctgcacgcagacatgagggctaggctaaaacagtaaggtcaagttgtttggacagaaaggctacagggtgtggtcctggctgttgtgtaagaattctgaccgcgctaaccatgcctaggaaggaaaggagttgttgttttgtagaaggtgcttgggtttgagagatcagttggacacgattggcagggagagcacgtgtgtttttgagaattatgccgagataggtaacagatgaggaagaaatttgggcttgattgaagtaatgggggctgtctgtgaagctttgcggcagtacagcctaggtaatttgctgagcttgatgggtgtgtcagggtcagtccaagtgaaagcgaagagaggctgggattaagggcgcaacggaatagtaaagaaagcatgtttgagatctagaacagaataatgggttgtagaggcaggtattgaggataggagagtatatgggtttggcaccatggggtggataggcaaaacaatttggttgataaggcgcagatcctgaactaaattgtaagacttgtctggttttaggacaggtaaaatgggggaattgtaaggagattttataggttttaaaaggccatcctctagcaggtgagtgataacaggctttaatctttttaaagtgtgctgcgggatgggatattggtgttgagtggggtaagggtgattaggttttagtgagatggtaaggggtgcatgatcggtcgccaaggagggagtagaggtatcttatacttgtgggttaaggtggggggatacaagaggaagacgcaaaggaggctttggattgggaagaatggcggaatgagatatagctgtagtccaggagtagacagggaagccgataatttagtcaaagtgtctcagcctaataagggaactgggcaggtggggataactaaaaaggagtgcttaaaagagtactgtctaagttggcaccagagttggggagttttaagaggtttagaagcctggccgtcaatacctacaacagttatggaggcaagggaaacaggcccttgaaaagaaggtaatgtggagtgggtagcttccatattgattaacacggggacggacttaccttccagtgtgagagttacccgaagctccgcgtccgtgatggtctagggggcttccgaggtgatcgggcagtgtcggtcttcagccgctaagccgagaaggagtcagagagacttaggccagagttccgggggctctgcgagtggctgccaggtgagttgaacagtccgatttccagaggggtcctacacagatgggacacggcttaggaggaatcctgggctgcaggcattccttggcctggtggtcagatttctggcacttgtaggaagctcctgggagaggaggttctggaggaacacctggcggctgcggttcaggtgtttggaagttcttgtgtgctggagatgtggctggggtttgtctcacagtggaggcaaggaattgcaacttttttctattattgtacaccttgaaggcgaggttaattaaatcttgttgtggggtttgagggccggaatttaatttttggagttttatttaatgtcgggagcagattgggtaataaaatgtatattaagaataagacggccttttgaccttttagggtctagggctataaagtgtctcagggttgctgccgaacgagccatgaactgggctgggtttttatatttgatgacaaagagcctaaacgctatctgatttgggataaagaaaaaggagcattaaccttgactatgcctttagctccagccacctttttaaggataaattgctgggcaggtgggggagggctagtcacagaaggaaactgtaagccggactaggcgtgaggaggggaggcgataaaatgattatagggtggaggagcggaggctgaggaagaattgggacctagctcggcctgtcgaggaggggagaggtcagatgggtctgtagaaaaggaagattagaaagacttagcgacgcttggggttggtactgaggggacaggcgggagggaaagaaggaagatttgggtcaagttgcactggacacagagactaggaagggactgatgtgtaaaagaatgcctggacgtcaggcacctcagaccatttgcccatttgacgacagtttgtattggggtcaagcggcattgcagaagaaaataagacatttaggttttaggtcaggtatgagttgaagaggttttaaatttttgagaacacaggctaagggagaaggaggaggaatggaaggtggaagcttacctatagtgaaggaggcaagcccagagaaaagagtagagacacggaggaggggttgcaggggggtggttcttgccctccagaaaagcagagaaggggtaggggcatggaaataagggattggggcacagagataagaggttggggtgtggaaataagcgattgggggttcttgccccctaggaaactgggacttgccgctaagggtgaaggagaaggggttgaggggtacttgcccctgccccaggaaagcgggacttgccgctaagggtgaaggaccaaggcaggcgtccctgcgtggtctgacacccttgaaacgtgagtgtaaaatcagagaggcgtccctgcaatgattaaacaccaagggaaggctgccttcccagtcggtgaccggtgccggagttttgggttcacggataaaacatgtctcttttgtctctaccagaaaatgaaaggaattgaaattaagataagggagagactgaagtgtggcgccaagattgaaaggagaaagaggttgagggatagtgagggaggttggagaagagagtaaaaagaggccgcttaccggatttgaaattggtgagatgtttcttgggctggttggtctgaggacctgagatggtaggtggatctttctcacggagcaaagagcaggaggacaggggattgatctcctaagggaggtcccccgatccgagtcatggcaccaaatttcatgcgcgtccgtgtgaagagaccaccaaacaggctttgtgtgagcaacatggctgtttatttcacctgggtgcaggcgggctgagtccgaaaagagagtcagcgaagggagataagggtggggccgttttataggatttgggtaggtaaaggaaaattacagttaaagggagtttgttctctggcgggtaggagtgggggtggcaaggtgctcagtgggtgctttttgagccaggatgagtcaagagaaggaatttcacaaggtaatgtcatcacttaaggcaaggactggccatttacacttcttttgtggtggaatgtcatcagttaaggtggggcagggcatattcacttcttttgtgattcttcagttacttcaggccatctgggcttatacgtgcaagtcacaggggatacgatggcttggcttgggctcagaggcctgacagtagccccacccaggagttgactcagtgcaacagggcagcttcaactctggtttcatctccaacctaaccaatcagcactcctgactcactggcccctcacccaccaagttatccttaaaaactctgatccttgaatgccggaggagactgatttcagtaataataaaactccagtctcctccacagccagctctaagtgaataactctgtctctattgcaattcccctgtcttcatacattggctctgtctaggcagcaggcaaggtgaatctattgagtggttacagtaacaataccataacaaaggcacaagaaaaggctacatggctgttttaaaatgtagattctattcttcttgtgaacagatcaggagttgactgctgttgaaaagagattttagtgtgctcagatcccaatacaaggggccatgacacaccatggggctggaggcacacgggaagcaccagggttattcaagagacagatggagtggaggaaaatgtgagcaggagtctttattgtggtttctgaaggaagacaggagagatggggtaagcaggttttaaatgggctagtgtgaataattttggtgggctctgggatcttggggctgtccctagttggtcatggggtgattaaggcatgggaataatggcccacagtgcacaagcccaataaaggtcgttggggctttgggctctggattggttaatttgcatatgaaaggcatgctcctggtgatatctctaggaattagctagtcctgggaagggcagtcctttcaaggtcagcaaggccccaaggggtcaaaacgttaaaaatacagaattaaaagacatgattaatacagtggctcaaaacataggaagcccagaagtgaacaagtccaagtatgttttcaattctgagcatacccccaatccacttgttgtctttcacagctttctatttgcttcttcaacagcactaaccactagtgttttctgtttgtttacatgtttcttgcctgtgtatctcactacattgtcagctccaggaaggcaagaaatttgcttgtctggttttctgcactagtcctaattgctgacacagtgcctgagacacaatggatactcaataaacatttgttgaacaaatgagtgaaaacaatagtgtttgatggttatctgtgtatgcataatatgatttgcatgtacacacacatacatactactattcatatatgtatatgtatgtggatatttgtgggtgcttttgagttgatgtttttcatgtacattccagtcaagactgcatggctggctgactactagatagacccaacagaaatctatttgcccaggggtctcaggaatctcctggaaagaacttgccctctaggaccagcagagaagcctgatacagtaccaatcatttcagaggttaaaagagagaagcatttctgcatgtataatgctatatttcacctgaggaggcctcggtcctatccctcatggatttataacttggcttttataagaagtcagtttagaaactggaaaacctattttttattgaaagcgctacaatattttaggatgctgtgtcagtcagagtccagccaaaaagttaaaaccataccaagtgaccacacagaaagaattcaacatgtagggtaatttacaaagtgctagaaatgcagttaaagcaaccaagcagaagatgaatcaactctgagattagaaaatgcagaaagttgttactccttctaggtcaggaaggacagtgatgagaaggtggggtctaggagctggggccatgcagtaaaagctggaacaatgttggcctgtgtggcacagggggaaccacagataaaggacctttccaaaaggagatgagccttggagagggtgcagccactacccatgatagctcctgaattggagagagggagacatatcccttctccttttctctctctctccactctttcacctgtgccttcccctggcttaacttaatcagatgcagttggcaaggaagcctggaagcaaggaagcctggaaaccacattttaaaaagtcaactttctataatacagagccaggaatgaaagtgaagagaaaggatttaaaagcaagcaaacaaatttgagggcagcactggtttagtattccaaaagagaccataataaaaaactaaagggcgtcattgtggcaggctggatctccacaagcaaccaagtctccataagccctttgctgtaatgatgaatgtgtaagttaaacattgaagaactagagaaactggtgcctgagtaggagacctggaatgcagaaacaaacccgttaagaccctacctgggctttctcatcctcaaacctgattgagtgataaaagcattcatgcacatacaaaccataccaggacccatgtaaaattaagaaactttccagcccacagaccactagttaaagattagatttaggctaagtagaaatactcctgcatataggcatagagcttgaaattcatttatatatactaaaggaaaaactcataacttttagttggtctggtaaattactccgaccttctccctgtggctggttacaaaaataaactcgcttctttcccagttcacctgtatctcatcattggaccacgagagcaagcagctggaccctgttcctccggcaacggcatcaatcttaccaccaaccttggctctttgaggggcttggtatattaatatcactggcatcagtgggaatatgtgggagaaatggaagcagtactggtagagaaagaaggagaagtggcaggattgaggtgcatggcaggcattcatggtgtctttcatgtagtttataaagtagtttataaagtagcagaaagataaagaaatgacagttacaacatggtaacataaaaattagtaaaatgtgacataaattagatattaattttggtttggcatagcagaatgctctgtctgcataattttattagatcttcattacaataccacaccctcagatgaggacaaataaagccccaacctctggccttacatcttaaggtgtgttttctcaaaattttctgggttccactttggtggtgggaatggctggagccagcagtaccacgtggccggggagccctgagctggtcctgtgcccatatggactccgctttctatttcaccccttcatggttctttcttaccctcttccttgcatgtcgggcccactcgatgccccaaagaactccaggacttctgctcacaaatgaagttgtcctgaggtcctgtggctgaaccctggatccagaaagacagccttggaaacaaattactactcctgtagccagtaccttacaattacgtatttttgaatgattttatcggatttgattgccaaagaatcttgcaaaaacaattttttccccaagctacacaccttatggttggttgtgttatttatgttcccattttagatgagaggaccaatatcctagattaaaaatgtcaaatccaagattacacaaacagtgaaaattgaatcccaggtttttcaaaagacactctgattttagatcttaagcctattattctatccaaaggctcagagaagacatgctctgaacatactcaaagtaactgacactggaaaaggtaacagaggtgtgaaaatcttaccatagtagatgtgtgagtgggctgggggcaggtgaattccagagaaatgtggcactaaatgtcatgaagctgactctgtattataccagagtggcctccagattgctttcacaactgggtagttcatcagctaatgtgattctccaaactttaaatgattagaaaactggggaaaaatgtagaaaaccagaggaaaacactccttctaatccaaatataaattcttcacttcttttcaatgttcttccaggagaaggattcgttgggctctttgccttctgcttttatttctgtgcaagggtttatgcaagaggtacttgagaatgctgtactgtagagctttgtttctcatgggaacacacggggaagtggaaaaccctccaaattgtttggtgagaaaacataacatttatccctttctttggtggggtgagtcaagtggtagggactagaattcaggtcctcaatgggcatataaatatgtgtgtgcaaaagcagccatcacactttgtatggcaagtggaaccactggcttggtggattttgctagatttttctgatttttaaactcctgaaaaatatcccagataactgtcatgaagctggtaactatcttcctgctggtgaccatcagcctttgtagttactctggtaagtaactggaatacatctggaatatgtgacatttctttacttttctgttaataagagcacaactagtaagccttgcctcactgacagtggaatatggtggtaggaattgtatttttttttattttacttttaactgacacataataattgcacatatttgcagggttggaagaagttttggaatcacagaaaatggtgatgttggaaagtatttcagatccccaccatctaagctctagcccaatataagtattctaatacatcctacataggaagttagccaacttccacggagggtcaacaaagcacatttcactgctggatattggtcaccattcgtttttcttattttcctcaattttgagttaaaatttgactttataatttcttttgtgcttttgaactatatggagtcattcttgctatcatctccagttatccaatttgctagcttggttctcctgagatagctacattcatctgtttatccactcaatggatatttattgaatggctacaatttgttgggcactggataggcattggaagatttagacatgaagcagtcataaatattgttcttaaggtgctactctggtaggatagatagggcttctgcctaagttactataattctagactactgtaaacgtactgtgagatatccagatagaactcttttagtgtattggtgggtgattagtttaattttcaggtaagggtatagaagctggcttcttggaggagaatgggaactgatttatttttttggaaggaatcattgtaactatcaggaagacagtgtgggcacatgggaaaaagagatttcatgatagccactgctcattgagagaacagaaggctttgaagatcttctcccaggaagctgtaaacacatacagagaagatatttaccaaaatgtctgaaataagaagtatggagattaataatgaaaaattgattgccgcccacacctacaatggcaactttggcttttgatgtttattgaatttctgaaggaatttgtaacttcaccagttttggatatttcactgttctctaatgtccagggacaggtatctatgggcaaagtggcagcagaaaggaggtggggaaaataaataccgccccctctgggtgagaattttggagggacaataggtgattgaaaatttaaaaaaatatatacaggctccattttaataatttgaatggggaaataataggtttccaaaggaaaataaactatggcaggtcttagccagtaggaggatgtgtgttcttacgtgtgtgctcacatgcatgtgtgcatttatatatctgcacatgtttttgtaaaaaatacatcgtacatattttcctcaatctctactttttcccaccattcatcttctacgggaaagttatcttcctaaagccaaagatataaaacgtaattttcctatgtaaaagccttgatagcgccccactgccctcaggaaaaaaaaatccaaactcctttgtgtgacatccaacactttaaaaaatctgacctcactcaacttttgcagcctcactccctttatcttccatcctttggtcatagcctattggaaatctgcactccagccttctgggcagaaggctcaccatcctgtgtatgcacttttatcctaatggttccgtgcctttattggtcatgtttctaaaatgcttctcctcttctttaccttatgatcctgacatttgcctcaagacatagctctaacagcacttctggaaaattcctgcagcactctttcatgttagaattagtcatccctttcttgtgtttccatggagctttgtccataatgttagcatagcacatgctacactgtggcatacacagatcttctatcaccaactggactgtgtgaagtctctgaatgggcatccttgtcttatttgtctatgtatctgcacagactagatagagttggtgctcaattatgtttgtagcgttgagttgaattggttgggagcagtttcttgggctgtggttgggtccattcctgtctttatgtggagattcactatagcatctctcctttagcctcaaagctgtgagctgtggagacagtcacatacaaaataccatcgccttcagacaatcacaatgatctgttgaatgcttacgctgccagggtcagttgtaggcatgggtgcattagcgaaaaaacacacattccttgttctcatggagcctccattctaatgagaaaataaagacaataaaaacagcaaatgaagagttgctttttttaggtaatggtaagaaaaaataaatgacggagagtgactatggccattgcaggcttctccgaggaggtaatatttgaagagagaccaaataatgtgagaaagaaaggtaagtagctagctaaggaaaaaaagttctagggagatggaacagcaggtgcaaagggccagaggtagaagttttcaatggaagtaagatgagtggatctggaatggagctattgatggacacagggaaagaagatgaggtcatagtctgggcccagatgtgcctgtctcacctggtttctctttttcctgcagctactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggtaaccacagcttgggaggctaatctgccaaaggggaggcatactcaccctgaatgtctagctcctcttcttgtcccttgtaaatgtgcatttccactttactgattatattcataggaagtttgcacatcctggaatctcaggaaaaatacaatttctacatttctgggaagggtttttgaatgatagtgacatgtgttatagttgtgacaataccatttaccaccttcgtgattttggatgagacgtaatcactctgagtttttgtttccccatcagtaaaatagtggccaaacaggacactggaagtgaatatgttttgaaacatgcgaattacatgtaagctgctctaaattttgttgtccttctacatttcaggaggcgctatcacacttggtgtgacatcaagataaagagcggaggtggatggggatggaagatgatgctcctatcctccctgcctgaaacctgttctaccaattatagatcaaatgccctaaaatgtagtgacccgtgaaaaggacaaataaagcaatgaatacattttcagtcgtcctatttttatttctggggactctattcagaaggacgtatccagattagttttcccttggttcataaactcgagagagcctgtttttataaagaaaacctggaatcttaagtaagacataatcattccttctcctttccttatctctaatttaaacatctctatttttcccaaatgttttatctcacggtgttttcagacccttcactttcctatcccccatcctaaataaatttttacatttaaaaaatgaaaaaataattttcaaaatattgtctgataagactagcatcttactaacttcattggtttggcttctgtttcactagaatgctagttcttaagtttgtagttaagctatggccactcaatagctttcaccaatccttccaccaagttaggcctttactacatcatccttaggcaaatgggtgatgaactatcttttctttcctttactctgtcatctacagtgatgacagaattatctttccaaggaattattctggtaatatcatgacggcctgtagagcagatttcaagcttctgagcatggcatgcaaggctgttcatgatctggcttttggttacacgtctagtcttcttatctacattcctttcttcacatgcgctctactccagccacactgaacagataactaaatccttttccctctaacactcttacaccttaatgaaaaatcaagtttcttcctacctagaatgtctgccaccatcgaccttcagacctggcctgtgtcagtctttggactgtttgctgtcaggtccatttcctccacttcccctgttctgctctgctctgctctgctgtgtgttgaggcaggacaggaaacatgatactgattgctgcagcttgcatttctcaggttcccaaatcagctgacatttgggctaggttctgcccctgggaggcgcaggcagtagataggaagtaggaaaagaggaaaactattgtatgaccctttctggctctgtattagggagaagtctctggaaatgactgtaccacgtctgagctccaggtcctgctagataggcctgccttggtcccagcttttgctgggtgagtccagcctctgggctctggttacaccacctcctttctttttctctccagctgaagttagtggtttcctcctgttgtcagtttctgggtgccttaccatcacctacttgacttttagctcttctaatgtctattcaatcaattctttgcattacattccttctgttgtaagtactttgagtagtttctgtttcttaattggtttctgactaagatgatgttaaatgttatctctagggatattatcttaatttccttccattgcttgacttccattttttggcaactaaaatagctttcactctgtgaaatttcctactttatttccttattttacctatgcctataatgatagattaggttgcccagctgcagtaataaataatcccaaatctcagtggcttacgtgcacagtgtgtcacttgttcctcacagtatgtggccatctttggttggctgtagctatgatcaatgttttatgaattctatacaggagctgatggaatagtctctcttgtgcattttgcttatgtttacagggaaagagaacttggtgaacaatgagctaactcttaaagcttcttcttaaaagtgaagtatatgacttccaatcatgtttaattggccagagcaagtcatttgaccatgtttgacttctttaggaaggggatgtataattatcctataggaaagagcagtgccaaatatgattaatgtaatgtaattgaccacattacttgatgacttcaaagtaattgtcaccttagatgactctcatacttgcaattttcttttctattgaattacatgccatctttccgcctaccttagttttctgctatttgaccactatttttcagtttctttaaatggcccttattatttttgacttcccttggacattgatacctccaaagatactaaacttgattccccttctatttttactctgtgtataacctttattggagaatcttatgtactaccatggacgccaatataatctttatgttaggaactctaaaatctatggctacaatctataccttttttttttttttaaagaagagatttagttacctataagacacctccaagggatgctcttttttaggttcaactcaaacatttttacctgaactcattgtctctctttcaaaacccactcctatgttttaatttgctattcagtttacagcacagacattttagtggttgcctgagacagaaacttgggaataatcctaagtactctctgtcatcagcctcctttctgattggtaagcaagccttatcaacccttttcacaactattgcacacatttttcatgatcaccactggtactgttcctaaaacttactttctttctttcttctttcttttttctttctttctctctctctctctcttctttctttctttcttttctttttttgaagtgctatagtgccatcacagctcactgcagcctggacctcctgggttcaggtgatcctcccacctcagcctcctgagtagctaggactataggcacataccatcatgcctggctaatgttttttgtatttttttagataccatgttgcccaggctagtcttgaactcctgggcacaagcgatcctcctgcctcagcttcccagagtgctgggattagaggcatgagccactgttcccagctgcagatcttgtcatttcccttcaaactactgtgttaatctctcaagtgacttttgtattcccaaaggtccccttctaatccatcatccatacacagaaggagacttcctaaaatacaggaattattccccaacttcaaattcatccatagttttttaatgctgattgaaaaaaaaagagtcagacactatgttaaatcaatagacacattaataatataagtttaaacgtatttgttttcatacttatttcaaagtctcttttctagactgtcaagttaaatggttagtgactctaatgtacatgtctgtatcctcagcacatcgcacagagcctgaagatagtcggtgttggttctgttgaataaatgggattgtttctgttaagttgtatctgattgggttggcccctttgttttgttccactagtcatattattaagcctttcattgctctctctctcccagtgttttgcatatttgagaaggatgcctctctatgtcttcactaaggtattaaatggaaaagattggggataaagttctctgccattgtactctgagtaatagcagtaatctgacagtttactgggttggaaggttttttttccaggggtgtatcaaacagagggattaagaaggaatctggggacaaattatgtttgggaaggcaggcagaaactgatgataaacattatcataaaagtgacaacaccaaatgctggtgaggatgtagacaagctggatcactcacacattgctggtgtgaaagtaaaacagtacagctactctggtaaaatagtttgacattttgttaaaaaactaaacatgcaactaccataaaacccagcaattgtactcttgggcatttatcccagagaaacaaaaacttatatttatgcaaaaacctgtacacaaatggtcataacaattttattttagtagccaaaaactggaaacaacacagttgttcttcagtggatgaatggataaattttggacatctttgtaaagaaatactattcaacaaaaaaggagaacaaactatttatatacacagtaacctggatgcatccttagagaattatgctgagtgaaaaaatgtcaaaccccaaaggttaaattttgtatacttttatttatgtaacattctcaaaatgacaaaattatagaaataaagaacaaatttgtaatttccaggggttaaggagacgatgggggcaggaaggaagtgagtgtgttatataagagctgtatgagagatccttatgaggacagaaatattctgtgttttacctgtatcaatgtcagcatactggttttgatgtagcagcatagttttgcaagatactaccattggaggaaacttggtagaaaatatgctggattgctctgtatgatttcttaaaacttcatgtgaatctatagttatcttaaaaagtttaaaaattattttaaagatcatcagaatatagaaatatatacatataattatcatataatcatatggaatataattaacatgttatatataattatatacaactataattatgtataactgtagttacatatatgcatatatgtaactttcattctcttcatccataaattccacaaattagaggaaaccactgttcacattgatgtgcttttttcaagacattttctaaatatttacaaacatacatgaatgatacattgcacatatgaatgacatatgccttatttaaattgttatctatgtgaatattaatttaatttatataatgtatattatattgtttctaatatctaattatattttttgttattataaaaagtgctatagtgagcatgcatattttgcatacatttttgtctttatgtcttcagaaaaaccttgaaagtggaaatgcaaggtccagaattacatggtgtctaaaattttgataactagtcacacatttcaatggggaagaacagttggtatctcaggtgactgaggtcggagaagtgccatttccaaagatgggattagggacccaagacaatgcctagggtatgattgttctccctaagctagctgtaaatccctttttattatgtgctggagggtcaagccatgcaaggtatgaattatatgatttcttagtttcatgtctaagataggcagtacaaccagacaggtaagtacaatttatttgctacattattttttattttagaaagcaaccagatgaagagctcgcaggctattgaggcagattaaagacagcagagggcgctcattattagcaaaatcaaggaaaacatttgtgtatatatgcaaggtagataatgagaaatatcagcaccttctattgcattaaatttttcactggggattcacaactaaatggcaactacctgatgctccccctttctagtaactacctctgacttcatttcaagcattgttaaatggtgcattctttgttctgtccttaactctctcattatcaaatgagaacttgttttctgatactgacaatgaccataataacagtgatagctattggtcattcattgtttcctccatatattttcgattcagcaaataattattgaatattagttgcaggatctttgctggacaggaagcatacagtaataaattgtcatgacccatatctccatagatttcacagtgtaaagggagagatagaaaccacacaaataaacatgggtaaaaggataattataagttatgataataacaataaaggaaaagaataggatcctaagaaaggtcacagtgacaagagattgcctgtttattttaggtcatttctatggacatgccaagttgggacttgaggttggaagaacccatcttaaccaaataatattctgtgtggaaggtactaagtgcatgaatatcctgaggataaggagaacttggcttcttcaaagaactgaaacatcacctgtgtttcagtgcacaggtggcagcaggagcacagggacacaagccaaggtcaaaccatgcattaggtgtcatggtcatggccctgtatttatcctaagagcccagaaaagccttgggaaattttgtatccaatgttctccatatacctgagtggcaacactgcatatgcaaccatatccacttgcattagtcagactcctacgagtcattcctgatacttccctctccctgacacgtcatgtagaactaatcaccatgtcctgtcaacctaatgtcttaatattctcttgaatccttccacatggttctgtctgcattgaccctcccttgctcaagagcttttggctggcttcttgctttactctggacccctctgtctagcctgcacaacagccaactgatatttttaaaatgcaacaatgatcatatgtgttccaatgctcaaaatcctttggtggctttccattgttcttggatttaagaataaaatcctgaccataacctatgaggtcctgtaagacttactttcttccttcttatttgctttccagccaccttgacgtttcttcatggctagagaacagtatacctagcacagggcttttgcaaatgccattcactcaactataaatgcctcttctccttcattgccttatgaattttgtcctattcaaccactttattatttctcttttgagatctcagcacatgtctcccttccttaggaaccttccttcacccagttgatacacatctgtgacagcttccaagagaaccatcttccttccttcccaagcaagtctctcaaaatgtaattataggtttatgtaggattatctgatgattttttgtatctcccacttatttgtgagctccaagattgttcagtatttaaattgtgtggttttgggagtatatgcatatgtttaaattctttaagtgtatactttaaatgcatgcagtttttgtacatcagttataagtttagaaaattacttatatgctgtgagtccataaagtgtccatttgggccaataagggagtggctacattttgaaggctttttcacaatgtccattagcattttttaaaatgccctttgatcttgcaattcaatttttgaaaaccttttataaaaacattaaataaaaatatttatatataaatattagtgcatgtgcttatacatataagcttgtttattgcagaatcctttgaaaagctgaaaaaatagaaatgatatgaaagtctatcaatagggaaataatgagatattgaatagctttttaaagatttctatctgtttacctaaactaaatgccatgagaaattattcagtgacagtcaagctgcagagtaaagcactcacccaaaccccactctacatgtgaatatgtttggatatgtttgaacagtcagggacaacagcaacaatattggttgctgatatggctggtttgggaataatcggattagtgtgggagattgttaacttttagaagtatatacacatttccatattcccctcatttttccctctcacatggtaacatatgccactttaataatttttggatctaaattttgaagaaaacattctgtcaattagtacatattaaaaagtaattcctctcacctaggtaatgggttgatagatacagcaaaccaccatggcacacgtttatctatgtaacaaacctgcatgtcctgcacatgtatcccagaacataaaataaaattaattttcttaaaaagaaagtaattcctctcactctcaaaataaatacaaaaggaaatcagtcacacagacttttgttcgagtttggctccagcgttactcaactgggtgatcttgtcagattctcaattgcatcatttcaaaagggaataatcatatctaatttttgtactaagtatgaggattcaatgaggtagcatttatgcaggaccaagcatggaaggtatcctaatgaaatctgtttcttaataaaggtaggtaagtttgaaggattataaggctatccttgaatgtcaagcattgccatagtctgagttttggtttaagctttcttctgtggttgaaatgcccttccttctccttctccatgtcttcaaatcctttatcattcatcaagtcatggatcaaatattattacatcagagaaatctttccggatttccgagggagcatgaatggttctttgtgctggttcccatgttcccatgtccgtgcctctgttatgctgcaccgtgttgagtatgtttagttggttatgcacgcatatcttctgcatcaagactgtgaggcacttgaaagcaaaaatcatgagatattcaactgtgtacccttactatcttgcccttgggtagaagctctatcatttaaatttcttcactttttgcaaaatacaagaaacatttacagaacagctgctctctgctagacactgttctaattgctcatgattgcaccagaaacattgaacaaaaaaggccaaattcttgcctcgtggagattacattttaatgaaggtaggcagaaaaaggaatgaaataaataaagttttaacattgtgttaaaagacatatattaaaaaatatatatccataggaggaaaaattaagcagccaaagaatatagacgtattagggcagaagatgcagttttaaataaaatgatcaatgaaggcttcactgagaaggtgatatttagtacaagaccttaagaaatgaaggagcaagccatgtggccacctcgcgaaagagtaatttaggcacagggaagaggaaatgtaaggccctataaaaagaacatacttggactatttaaagactgacaaggatcccaatatggctggagtgaaaagagaaagctaatgagtaggagaaaggaagggaagtgaataactcaggtaggatctttgccacattgtaaagaaatttttaaatgaagtgtttgtttcaaatgagatgggaaatggcagaaggaattaatctgaattgaattttatttaaatagaattactctatctactcagcatttctgtaaaaagtcaagcataaattccctcaagcacttgagtcatgatagaaagtttgggatttgggacagaatagtgatgatgtagattgtgtcctcagcatgtcacaggggaattctctgctgggagttagacacacttggctggagctcccatgtagcctctaccaattttggtatcttaggcatgataccaatcagcctcctgagcctcagtttcttcacctgtcatatgcagaaaacaatacctccctaattcacttcaatcgcattgcagttatgagattacaaggagatgatactgggaaagagtcccaaaagaaaaattctatgcagatgaaagagattcttgatctttaagaacaggtgtacctgctggctgaagacatgggtcttattggagggtaggggaagaaggcaatgaaggggaggaagaggaaacacacattgtaaagcagttgggaaatcttcaaaatctctatagatcgttggagatctttgtcagcgacccgttaggaatttaccaaatcttgtattgatatggcactttcccaaccctcaacatgaaaaagtgatttcaaaatgtacaatagacaggtgaagataaaggcaggaaagttctggtagagtatgtttctcacatataagtagtgtattaattaatatagttgtagtaaatatgttatctaggcacaaatcagtgagtcaacattggaaaagagattttgcagccacatttgatggggagaagcagtttgtgtgccagatactgaatataatagacattctaagtaatttagttaagtgggatgtgatatttgaaattgacacaatccctagaaaatgcagagtgtgagttgtctgaatttattgtagaaagtaacatgcatttttcaacatttagtaggaattcactcttggtttatctacctgtattattaaaattatttgtgctgcatgcacacctcttctggctaagtaaaaacaggaagacagacaaacaaaacatttattaaacatacatttgagttactttcagagtttatgtgtttgggaaggacaaaacccaagatagcttttgagaactcagtagaagcacatagaaactttattctagattagagcactgctttaactggcatcttgctctataataagatttcagtcttgtcttactgtccacagtaaacaattctgggagattactgtatttctagctctgctatgtcacattttacttctggtaagtgggcaagaaccatagccatggctgcagaggatccacctctgtgtaataaggtggtggcacgaaaggcctgcaactaaacatttcaatgactcttccatccctgacactgctattttatgagaaaaatagtgactctgtgggaaggcaatgattttattaattttaaaaaggtcagtttttaagtttactagcataggagagtgggctcagatagttttaaaatactttctaaaaaagatgtgtaaaacttttaactctgaaattgcatacatttttaggagttgagagcttgttttgaggtcaggttttaatcctctttctgtcacttattggctctgtgaattcgaacttgctacattatctgggctttagtcctcttattttgaaccattctttggttatcctgttgaatatataaatatataaatattcaccaagagatatatatttgcatcattaaaactttaaacatggccagaaaaaattactaatagcaacacaaatcctctccatcaactatgtgatcccaaagcgccatatttattctaactttctaaaagcaaaaatgcagtcagggtgttcaaaatgagttctgtttggttgaagccagagcctgaatcctgagaactcgttgggagttgctttgagggctctgtcctggaggacttgtggagccaaactggaaaagcaggatttggctgctcttggattgtccaggagccacatgggtgtgtcctttgaaacacaagccaaagagaggaaaacaattaccaagtagagctggtttaagacgttaaataaaccaaataacttttaacctttcccttaaaatttttatgcttctgcactttaaaatagaagaggtttcataataaaatcaactataatacattcttgaggaaatgagcaacaaaaacaacaaagcaaaaattcagagtatataaagaaagaatcagaaacaagaatgaagggagaatgtacattgaataaactcctaaggataagttgagtcaccagtttcactgagtttctggatagataggtgatgaaaaagaaaaaaactaagtcacataaatcttttttttttttttttttttgagacagagtccctctctgttgcccaggctggagtgcagtggctgtgatcctggctcactgcagcttctgcctcccaggttcaagcgattcttctgcctcagcctcccgagtagctgggactacaggcacccgctaccacacctggctaattttttgtatttttagtagagacagggtttcacagttttagccagaatggtctcgatctcctgatctcatgatttgcctgcctcagcctcccaaagtgctgggattacgagccacagtttcgctcttgttgccctggctggagtgcagtggcttgatcttggtttaccacaacctctgcctccctggttcaagcgattctcctgcctcagcctcatgagtagctgggattactggcatgtgccaccatgcccggctaattttgtatttttagtagagacagtgtttctccatgttggtcaggctggtttccacctcccgacctcaggtgatctgcccgctcggcctcccaaagcgctgggatttggtaggcacctgtaatggcatgaggcactatgcccagccatcacataaatcttataagcagaaaagaggaatctgactttagggaaggcatattttttttttttttgcctgatttctaaaagaaaaattttccataagacttcatgaaaacgtaatcaagtgacattgtggccacgggcaattttgcttatcaggtgcactggaatttcctgtctgacttacttattcctagatccctccctaggaagttctgactgagcaagtctaagcataaaagtctagtgtgtcctatagtacattttgccttaatccaaaacacttgtataaaaattaagaattcataaagtgactttctatccattacctcttttgataattttagtaatctagtgaggtttgtccaaatttgtttttaagcaggaaagaaaatttatacttaaaatatcaaatgacttaagacacaaaaaaagatgacttgaattcatatggttttaaacaatgcaggacaaatggagttaaaattttaattttattgaaaatattaaagccagtaaaaatcatgccaatgttgttcagtagaggctgagaggttctcagatgaaccaggtattcggttattggatatttttccaaatactgtacctctctctactcatcatatcaggttgtgtgtagaatctcttctctcagagttcaccttatttgtagagcattcataatgcttatcccctcctccagatattccttcttatcttttccaaggcattcccaaggcccctttatgcataactttatcatttccttccacagttatgagatacacagagctatgtgattgctgagtccataaacttctcaacagccagctagttattcattttggtagcattggctgattgatatagtaggtatggattaaagaagcattaaagaaatgtgtaaaaaaaaaaaaaagggagggatcggccgggaatggtggctcacacctgtaattccagcattttgggaggccgaaggggggtgaatcactgtcaggagttcaagaccatcatggccaacatggtgaaacctcatttctactaaaggaaaatacaaaaattagccgggtgtggtgatgcacacctgtagtcccagctactcgggaggctgagtcaggagaatcacttgaacccaggaggcagaggttgcagtgagccgagatggcaccactgcactccaacctgggtgacagagtgagactctgtctcaaaaaaaaaaaaatcaatgttaataagagaaacataagatctatctatccaactacctatcttaatttaggaaattctggctgcatgccatgtctcatgcctataatcggaacagtttaggaggctgaggtgggcatccaagtgatcacttagatcacttgaggccaggagttcaacaccagcctgggcagcatggtgaaaccctgtctctactaagaatacaaaaattagtctctcccttagttgcttccttctccctagtttaatgttttttatattacaaccctagattgagccattcctccctgctcatcagggcatcttaggttggttcatgcatcaattccaagtttttcatgtgcagttaaaaaatttatggcattaagattccctatgttttaaaaattcataaggagaaaagtggggctcaggcaggtaaagtggcctgaccacggttacataaccattaagtggctgatttagaagttgaatttacatcttgtctatgtcttctgttctttctgctcctccatgtggccttgcctattagactacatcatagaccagacctgtaggatgtactccaaggatttggggtgtgggtaccaaaaattataggtgtgtaccagaagccggaatgaaggcaaagtattaggacacctgcaagaagaggcaggctgttctctgagaagatgggaatgaagacatacaaacataagtgactgagtttaaaagcttaattggccttagggtaagagtcaggagtgtcggggttgggcatgttttgatttcaatgcccaagcctgattctcatccttagaagcacatgggaaagggtgggctaagttccgggggaatatgatagtagctttctgaacttacattaatcacacccaggttatgaaatggagccaatggggaaaaggagcatttccagaccagatcacaaacagaagttgggaaaggccatgcttcctgaatatgcagataaagtaactcaactaagcaaaggggtggtgttgtatttctatgaacatcttgaggtatgacttagattacttagcttaatcattattctccactgccttctcctatactattctgctctgtttccagtagcactatggcttagagatacagcacaggccttggaatcaggctgcttaaattcaaattgtgtcttcatcctttatcaatatagccacattagcaaacctccctgaaccttcatttccttatttataaaatttaagaataataatatctattttgcatagtgattatgaattaaatactacaagcccttagtcattaatcacttagcttaatgcctaaaacagagtaagaacacagttcataccagctactaatattactacttttccagatctaacacttttgttttcgtatttcaatatgcattttcaggagagacccgagtagggaaaaagcaagtatttctgagcactcaaactatattgtttgcccatatatctaactgcgtgagatagaaagtttgttatcctttctctctgaattaggttcagcaaatttcactcttcttatgagtaactaactgcatgattacgtgggtccttagattgctagtgcgtgctagcccctcatttcacaggctgaacttgtacaaagcaagttcctagcagatttgtgacaggaatcaggtctccaaacttgccatccttattcacttcatctcacagctctacctcctctcttaagaaaattttattattagaaacttgtacatgaaaaaaatatattcatttatttttttaaaatgtactttttctgcttgtaggtagacatgggtaaccaaaattattaaataaaactggacagactctttttcctttgtccaatacactgttatttcagttgtaaattttaagtgaaaaatcacctgaggatgtcactttgatgaatgttttccttcattatcatcaaattccataaatcctcttgagaaaaaaagagaaaataagaattacaattgagactgaacaggagtgttagaatgatcactaaggcgctgtataatgtttgagccacactgttcttctctagatttttctatgtcagaaagaaataagacctaaaatttctacatagttcatagtgggcaagtaatttatgcataattatcttttttgcatctgccaacaaacccattagttaggtatctattcacacataaactccataaagtcatatattttggtatatttttccagtaatatatccccagcacttagaacagtgcatggcaaatagtagaaattaataaatatttgttgaatgcatctttattatctctttttatgtgtgagaaaacctttgaagcttaaagattaaacaacctgtccaaagcacatggctggtaagttacaaagaaaatttaaaaatttggctctccagagtcattactaaatgctagaaacattatgccctatggcttaaggactgggtaccagggtatctgctgagatcgtaaaagataactaaaatatggtttgtgaattgcagtctagtggagaaaacagacaactcagatacaagtaatttaatacaatgtggggataaaagttgttatgaagatttctgcaaaggattatgaaatccctgaatatgaaaaactgaaatttctgatgttaagtgtctatgacttttttacagagtttgtttttgaattgggctttagaaaatgattagacttgccaagtgaacagagtggggttttggctttggggctaggcattttcagcagagggaaaaatcacacgcacagatattgggggtttatacaaacatgacctgctttaaaatgaaactcattagtcattggggcttcaggttgcagaggtgagaaatgtgactgaaagatacattggcatcagagaaggacatttgacatcagcctaatgcatttgcttgaattttggaggcaatggaaattcatgaaaaactttcaagcatggcagtgatatgaccaaatttaaatttttttgatataaagttctggtagtaggtagaagatgaattgatgagacagaaggtggaacttattagaaatccaataaaaagagagacagagaaaagtgaaacttattagaaatccaataaaaggaacttgggaaagagatgataaaggactcaacttgaccaactagtcagtggagctgaggaagagaaatgtatatagggtgcatatacatatacccgaggaaggtatatagggtagaatattcagcaattcgatgaaggtgatgatgagcaggaaggatttgagaagatccttagatttctggattctgggtggatgatgatgtgacttaatgagatatggaggaaggttttgagtgagatgatgggcttgggtttagaccagtggaatttgaaatagtggtagaaaaacgatggaattttgtagcaagcaatcagttattccatctggagctcaggaaaaaattgcaacagaaatgtgaatttgaaactcattagattataggcagtgttcccaatgtgtaaactgcaatgtgaagaaccaagcacgtttggaattctgaggaacaatgacatttggagggcaggtgcatgaagaaaagtcaaataaaaagaatgagaaagaatggctagtggtagagagagaaccaggaaaatacatcatggaacccagaggggaaaatattccctagaattaagggctctcaaagggtgagaggagttaagaatatgtatatttttcagaaaaatgatgagcaaaatgcagtctaggtagctccaagctgatccaaaagcaagtggagagaacaatccagtctattcattgtttcaaatgcatgtctctagcatttactatgcatctgacacaccacttaggcatcagacatattggagtaaataaagtaaaattcccacctttatgaatcattgttattcctctcattctctcttccaaatcaaatattgtttagtcattcaaggcccaaattacatcttgcttttgccataaacacttccctaagcacactggacccattgagaactcctttcgctggaaactgcctgtgatctttggctgacatttatcttgctactcatttttatttatggcattgtgcattggcttaagtaattttaccataaggactgcaaattatttgaggagaagggattaagagcctagactattccttcacaatccgtgtccctgctttgtacatgttaagtgcttagcaatactttctgacgtctcctcctatcctccaccccctattttgcttatggtcttcccttgagcagggagttatgggtatgttttagatcctggctctaccacccgcagatttatctcttgagcagatattgctgtgtctttgagcaaagatccttcaggatttctcagtcaaattgaggtagatgggctttaggtctgatctgcaagatatctttccttaattaattaattcaagtgcctgacactatatgccatgtactgtgctcttgcaaccagtcaggtgatttggtctctactttcacttagctacttgattaaaaataaataagtcatttcggatggtaacaaatattatgacactgtaacaaggtaaagtgatagagaataacaggcagtgggaatggaagaagacagtattaacaagaatggtcatagaatagtttctgaggaagtgacttttagattagctgtaagctcaagaactagtcattagaaaaggagagtattttagtaaggagggagagcaagggaagagagcctgagatggtaataatttctagcaacagaaagaaggtcatttactcagaatgtaatgagggaaagggaaaccagtagatgaagggccatttctgagcctagagcggacagcaattctttagcatatcagagagtcgactcttatggttaacacagagaaaaatgtcctattttatacttggaaaattccctagggaaggaatgaaaagaactcttagtgttctaactccttgttttgctgtgtggatgtaacaatactaattcaactggagtctaatctttagtttgtatgtaatgggtggtgctcctattgtcggcctatgactttccttcttgtttacattaacagtcttggaaaaataacagttgcaaaagcaaccacagtaggaaatgtaacaattaaaaaaaagcacctgtgagttttaacaatttgtggagaaggattgcctgtagaacactgcccaatcagatgacaatctatccctttaagcagatcagagattacaaaacccctgattactcctacatggaagtggttcttaatctgctattggttaaagacccctttgaaaatctaatagaagtcatgaacactttccccgggaaaatgcaaaaataaataaataaataaatcacactgacacaaaatattaataaaaatgtaaaggttttgtggatctttaaggcccatccatgcaacccagaacatctgatcaaggcatggcttttgaaaatttctgtatatcagaattacctgaaaagcttgttgaaaaccatatccatggccttgtccccagaaagatgcaaaatgggatgcagaaatctgcatttttaaaaataaattcccccaagggattctgtatcaggtgggtataccacacctagtcaaactctgcttaaggatctatatgggagaaaattagagagcagaggcttagagcagtggaaattgaaagcacctggaaatttggaagagtgaatttcatcttggagaactgaaatttgggagattaatatggggagaataaagcatacagtgtagtagtgtcaaatcaaaactatgtaggcaaaaataatatgtattgggaattagacacaggcttggaagcaggctgagaacattgggaagactctgggattggtgatctgcccgaaggcagtctctcatgatgaaaaccaacactcatgttgagaggttctctagattgtctttaaagagaggttatctactgtctctgctaaccttcttgagctactcaagctagaaaatataggcaggactcctcacacccatcactaacgaacatatcactacctcttaccttcatcacgtaatcacagtgcttacaaggggcgggccatctattattttaacttcacagttaaaatatgagcaaatagaggccttcagagtgggagggccttgttcaagaccacctagtaaaatagcaactgagttaggatcagaacttggctttttgttccttagtctagtgttcttcctcctccctatttgctcctgagattaaaaagaaaaaaaaaaaaaaatcctgtatggaaccacttgatgggaatgtcctttcccccaaaaagctcagggcagttgattcagatgcaaaatatattttaagtagggcaacatttttcaatgaaaaataacacatttacttatgccacaaattttgtttctcatgtattttaatgccatgaggtcattgtgtggtcattatcaacagagaattggacaaaaagcaacgtttttctcagtgcttacgtgctcctggacatggagcggaggatgaactcgactgcattctcaatgatctctgtgcccaggaggcttaggaatttggggaagtctggctttgggtctttgcccgagtcgtctggcttgtcgtctggcttgtctggtttgtcgtctgaaaaacaacagaatctcagaggtgattctcagcaacaaagaaggaatcattctttctgtgtggggaacgcttgggattctttctgacccactcacaaatttcatagccttatatggttatattcatcgaacatttaatgcctgtctggataaaatcttcacatgcattgtctcatttatttgtaaaaacaaacaaatagaccgactgatattgatacttaggtagacactggcaccgcctggtgagtgagaaaaccaaagttcccagaagctaagtacttatctcagagttaagcagccagtaagtgccagtgccaggactgacatacagaatgtctgtttttccatatgatctccatgcccatggtaataataatattaaagataaattatcaactgggtgaggtggctcatgcctgtaatcccagcactttgggagggtgagatgggagaattgcttgaggccagaagtttgagaccagcctgggtaacatagtgagacttccatctctacaaaaagtaaaaagtagccaggtgtgatggtgcacacctgtaatcccagctacttgggaggctgaggcaggaggatctcttgagcccagaagataggggctgtagtgagccatgatcgttccactgcactccaagcctgggtgacaaagtgagaccctgtctctgagaaataaaataaataaataaaaatgaaatatcaatgggtaacatttgttgaatacatgcctatgacgatctacatggattgtcttattttatcctcatagcaattctacaaggtaggaacaattatcccaatttaaaggtaaagtaatataatttgagagatgtttagaaactggttgaaagtcacatagttagtaagtggcagaaatacaattcaaacccatgtcagtttggcattaaaatttggattctaaagtactctatgatgagctgcacagtctttgatggaaaagttatgcaatttgcacttcttttagaagattcaaaatagtataacaataatgatgacaaagcaattctatcccttgcatatcacctagtagtttcataaatagtgattttacaaatgttgtgtaattttatcccctgagcaatcttacagagtatgcattttttagctcactgaactgaaaagtgaaaggattaagaggcttacagaagacctcatagacagtaagaaaaatgctaagatgataactgcaggcctcttaacactagattcttaagggcccattggaatgagggccaaggatccagagtgaggttgattatattcaaggtcccttgggggctttttgactttgcttgattgtctttattcccaggagatgagaagagatggaagagtgacagtagctacatgtggtcgcccctctgagccctggtcacaggataaagtgggacctttattttttaattgtattgtaccctgacaagtaatgttaccagactgggtacataaaaatacaggatgcctagttaaatttaaatttcagataaacaacaaatgcttttctggtactataaaaaagatccatgcaataattaggacaccctgatgctgaaagattattcattgcatatcagaaatccaaatctaactgtgtttctcgtagtttatctagcaacctcagcacaagttttaactcaagaagtcccaacttctagacaatgtacccctgactttggataaaggagatgtaactaccttttgtgtggaggctgccaaattatgtcagaaactttacatctatattatatcctaaaatggaaactattagtaaaaaagattggcaggcaattctatgagcatttattgtttactatgacacaactaaagatttgatagaagcaccagtttgggacatataaccaaaatcaatatactaatcatcacctattcatatatccaatgattggttccttcattcaaaaagtatttttgggcctacttttttaatgttttatttttgaaacagggcttcactctctcgtccaggctgaagggcagtgaagtgattacagctcactgcaggctcaacgtcctgggctcaagacatcctcccacctcagcctcctgagtagcagggacgacaggcatatgccaccacagctggctaattcttgtattttgtgtagagacggggtttcgccatattgcccaggctggtctcgaactcctgggcttgagtgatctgcccacgtcggcctcctgaagtgctggggtcacaggtgtgagccatcctgcctggcctgagcctactattatgtgcatagttatgctaagagtcaaggtaaaaaaaaaaaaagacaactgtagatatgaccttcacataaagtgctgggcaacccaggtactcagaaggattggtttgtttttattgtgggaaggaggcggaagcggaactcatgtgtaaggtgcctatcgtgcaggtactccatcagtgctttcagcacatgccttaatcgtcatttagctcagcagtggtatcacagttacagcagagaagacagatgctcaggaaaattaaatgactcacctgaaatcactcatctagaaagtggctgacccagggtttgaacctaattttttttaactccacaaagcacattattcacattgtataatacaacctccaaacaattgttctgtaaagacatttgccaaatgcaaagcagtaatttcttgcatgaaagatgagattttttctcctgtgtttctatctggctacttgcataataaattctattgacttgttattttaatatgacactaaaacctggcttttcaagatgcaagaagcctgggattggagtgggcggaaatcaaaatcttggccttagcttgtgaaccccatatatattgagaggtattaaagtgtgatggattgcatgctctggagttttatagatctgtctgattcctgcctttaacaaaaaattagccatgtaaacttgcacacagtgcttaactttgcatctctcagtttcctcatatgttgtcaggattgaaagatattttatatattatatatctatatatatatacacacacatacatatatctatattatatatacatacatatatcatatatataccacttatcgtagtaccaatcccaagataaacttaccttatataaataaataataaatgaaagaatgaataaataaatgttatctgttttattgttactattaataataatagcagcaaaatgatttataattcactttctcctctagtgctttagaagataatataaattttaaaaatgctattaaaatattaaacgattgatatcctagaaacaatcttcaaagtcaatagtttaatattttcttttttcaagtattatatgggatagcctttatttacagtaactactttgttgagtttcttagtgaatgtgaatataatgttcttaataaacagtattgctgatatttgtagagttttaatagtttacaaagtaattaaaaagcatattcatttgacctggtgaagttgatagttatcccgttttacagataaagaaactgaggttcaaagcagtgaacgatttaaccagtttcagagtttataagagacagggtggtgcctggtcttggtatcaaatctctcctttcacttcactgtagtgatttctttaggagtagaatggactgaataatatccgtggccatgtctagagtaattctgttgtaatgtctgtctgtgtgttcttcagccaagttacattcaaaggattctgtcactaaatgtttgcactccctctgttttctggtctatcattctgaatggagctcacagacttttgcagacaaacagtaaattaattaatgagaaggcagcatacagcatgagcttctatgtgcttggaaaaggtgggaaagaaatagttgctcgataatagtagaaagaatctaggaacctaggtttcactcccagatgccactttcacctgtatgtatgctcaagtaacttgccctctgcaacctgtttattaacctgcaaaaaggaaaatgataaaactgtacatgtttacatcattggattactatgagaaccaaatgagattatacatgacaacaatagcaggtagtatttattgcatgcttactatcaaccaggtacccttccaatttgtttcattccttttatttaattttcatgataactttacgagaaagttaaatgtccccatttatatgtgaggcctagagagattgaatagcattcctaaagtcacatttctggttagtggtagagccaggtacaggagttttattccagagtacatattcttcaccaatgaacattattaggaataattatcaaaaaataaatgccagtcagctcccatggaatttatactagaatagtgtcattatatcataagagcacataaaaaaatttcaaacttcatacatccactgaaaatagaggctaggtttttattaaaattctactttctttgtgttagaagatacacctcttgtctcccaggccagtgctctttctggagtgcccaaagaccccttctttcttttatgttctgaatcagtgccatcagctttctctagtcactgctaactactgaacaattcatgggctgtgatcagaagcacttacctgcatagcaggtcaggaataagacaagcagtcccaggacaactgtcaggcgaagtactgagacagccattctggtagcacggggtattcgtgcagataaattgttcagatacatgtgaaacaatgctccatttatagggcatagataggtgacatcatctgctttggaatttagattgttgcacaagatgtctgcacagcttgcttttggatctgtactaatgagacataccctatcattcaaaccaaacattttacatatagggaaagaaaaaccctcttgatttttaaaatttgtatctataaagggttctggagtgaatctcttgaggctagtttcaaggccagcattgataattaaagggatatcaggtagaattgctcgtcagtgccaagcagcaggcaacaaatcagattggcaaggcaagcctacaccctccctttacactctatgccttccctcgtgctctgggacaatcccttgttcccacatgggcatgccctttcacaccccatgcgtctgctcttgctcttccttcttcctcagataccctcctccttgtctcccttcggatcactcctacgtattcctcagttcaaatggtccttctttgtgataccttcatgataaccactccacccttctccaggcagtttgttacttcatcatctgccctatagcacacttgaccccattgtataagaactaagtgttggctgggcgcggtggctcacacctataatccaagcactttgggaggctgaggtgggcgaatcacgaagtcaggagttcaagaccatcctggccaacatggtgaaaccccgtctctactaaaaatacaaaaaattagctggtcgtagtggcagatacctgtaatcccaactacttgggaggctgaggcaggagaatcgcttgaaccctgggaggcggagattgcagtgagcggagatcacaccactgcactccagcctgggtgacagagtgagactctgtctcaaaacaaacagaaaacgacaacataaactgtcttatttattttacttttatttttctcttttttttccatcaacttttatttgaagttccaggctacacatgtagccagcaggatgtgcaggtttgttacatagggaaacatgtgccatgatgatgatttgctgcacagatcaacctgtcacctaggtttctttctttctttttttttttttttttttttgagactgagtctcgctctgttgccaggctggagtgcagtggcgcgatctcagttcactgcaacctccgactccctggttcaagtgattctcctgcctcagcctccctagtagctgggactacaggcatgtgccaccatgcccagctaagttttgtatttttagtagagacagggtttcactatgttggccaggatcatctcaatctcctgacctcgtgatctgcccgcctcagccttcccaagtgttgggattacaggcgtgagctaccgtgcctggctggcacctaggtattaagcccagcatccattagctattcttcctgatgctctctttccccttgaaaccctgacagaccccagtgtgtgttgctcccctgaatgtgcccatgtgttctcataggagaactaagtgttttaacagctctcttctctttcagcttgtggatccacttatttgtttattggcaaaatattgtacatattcgtggtgcacaatatgatgttttgaaatatgcatatattgtgcaaaggctatatctggctatttaatacccagactactcatacttatctttttttgtgtggcgagaacacttaaaatctgctctcttagcaattttcaagtatacaatacaatgttattaactatagccaccatgatgtaaaatagatgtctcaaactcattcctcctatttagctcaaattttatatcttttgaccaacatctccccaatccctcccactacccaactcccggtctctggtaactatcattctactctttgcctctgtgagttcatcttgtttagagtctgcatgtaaatgagatcatgtggtatgtatttgtctttctttgtctttcagtgcctggtttatttcatgtaacatcatgtcctccaggttcaactgtgttgcaaatgatagaatttccttcttttttaaggctctatagtaaatagtattccagtgtatacatatcatggtttctttttctattcacctgttgatggacacttaggttgattcctagcctgtaggtctcaagagaagaatgttttattactgctgaatcctcatggagcctactctattgcctggtcttggtctcacctttgacttcacctcctctgaaagtttgttccggtttttccaaatagagatagatgatcctctgatgtacctgctaggtcctttttaaatgtctttaccaataggctgtaggcttctcgaaggcaaaactatcttttttagagttgaatacatattaactgaggcacatggcaaataccaaaacacatacatacacacacacacacaaaacaaaacaaaacaaaacaaaacaaaaaaacagcagcagaagaaaaaataatctgggaattgattaagaccagtctttctccccgactgccagactccattgccttggtctctatacccatacccatcaccatggttccccttgaataaagtctaccttaccatctttttttttttaaaagaaataattaactggattaaatatatttgcacttggtgaaacagaatgttggatttgagatgctgctatgtatttcagatgtaaaataatctccctttgcaatacacgcaagagaataaagtttggttcaagtctagatgatattggttatcctgaggaatgctataaattcatttaattggaatgtggacttgggaatacctaaacttattgatttaccaatacttatactttgcatgtgtcaaaataccattttataaatgggaaagttaactaaagtatggacaaaaggaggttcatccagcatctcagagccaaggctagggcaatgtttcttacttactagttatactcttcacaaggcaccaaaccacttctggaacataatcaggcagctctgttgcaccttgtgtggtgtggccttccaaggccttcccaacgtatcttctcaggaaaacactggtcttgtctctcttgcacaaagggttgaatctagactctagactctagatcaccactgtttgtataggacagacaaggccagagtctctaataaaatctagacattaaaaggccttcattgaggtagatttatgtcatcagggtcactactgatgactgagcactgtgattgtccaagaggctagtaggggaatgacattcaagtgtcctctatcagttaggccatggatcctgacacattgctgtgtttgcctgggaaagggtacatatttttctaatcatcacaagggcactctatagataagagcaggctgtagatacagcaacttaagacagaaatttgctggcttcttaggaatagcagctggacagggcaagcagacaaatcctaaatcagctgcttttggaggtctggtgtcaaaaagctagcactgtcctgagtgtcaggatagctggcctcgattcctgtcagtaacactagctcattgcatggtcctgattcaataccctccgttttccctgcttcttgttcttattctttctctcctcttggtttgttcctcatagcttcaggtctcagctaaaatgtcttgtctttggtgaaaacttctatgactctctaatccaattcagatccctatgtgattaagttttctacactctgtattctttcttctcagcacttaatttttgatgatttaatgtctctctttccaaggaatgttaacatctcaaagggaagcattctgatcagtcttgttcagggagatggctttgctgtctaggatagtgctttgtttgtaaaagatacccaacaaatatgcattgaatcaatgagctaataaacaattctgagaagaggaaccaggttcttttggttattatctgtgtgactctggcaaatgacaggtaccctgtgggtctcagtttctacatctgtaaagggacataatataaatttctgcctatatatcagcaccattgtaagaatataggagataaaaatgaaacacctgataactgtaaagagcccttaatgttggccgtataaataacagttaaaaagctgtgatttatcttccattgccataaacaagtgaatttgctttaggttagatgagaaactgagattatgaaagagggttttatccaagctgggaagaaaaagagaaccttcttctacaacactattctagcttgggaagaaggtataggaatgaaggaaataagaaatgttttaattcctacagacttttccagacttaattaaaaatcatctgagtggttttttttctcaaggtagaaaagaattacaatttgggttggcaatctcatggagagatttcaatgtatgcattagtgttaaaagcacaggttttgggatcacacagaactgagtttgaatttcagatttgccccttacgagctgtgtgacactgtaaccttaagatatttttaatttctctgtgctttggatccagtgtccataaaataggaataatgatacctcttggtgttgttataaagattagataagaaaatttgtaaaactagcacagtgccttgcaaatactaagtgaaaaataaataataaacttgtctattctattctattctattctattctattctattctattctattctattctattctattctattctacattgagttgtcttagaggagggagagagacattttaggaccaccaccaccaccaccaccaccaccaccaccaccaccaccaccaccactaataataataataataggctgcctcctctggtcaggtgctgaattagatacaatgtatcaatacaattgttgagaggctaccatttcctcattttatacaaggaaatttaagcttagaggagttttcccaaggttacaaattatatacgagccagagcagggaattggacacacgaacgtgtgattccaatgttcctgctttcagctattctgttaagttgcactggcatatgctcatggttgctactggcaaaatgcctgggccaagcgaggaacaccatgttaccaacctgtttgcccacagattcatctgtgccaactctgctttttttcattagcctctgaataaagttctggcctatttcattcactatatttttgctcagtttgatatagcaaacatgcagtttacacggtgtcttttttatcctcggcagaaataggactggagatagggctgtaggataaaatacatgatgcccaattaaatgtgaatttcagataacaatgaggaattttttaggataaatatataccaaatatttcacaggaattcttatactaaaaaattatttgttgtttagctgaaattaattttttcttacatttttagctgaaatttaaatgtaaccgggcatctggtacttttatttgtgaatctacctggagaagccctcataattcttctcttattaaaaaacccgtgatcagggagtgcagaataggactgagagaggttacataaaggattaaagaatagtatgtgagaagttgaaatcaaatgaggaaactagaagtcattaaagggctctagttcctctttaacatcacatctggaatatgtttcctccttgaaagcctcataaagaaatcataaaaccctctcttgttcttggttcattccagctaaagtttcagactagtcttggaagggatgcatgtggcttcagctaggggtgccattcccatggtgtctacatgctaaggagtggtcacactctttgttaccctaatcaccttcctctatgtagcttatacattagtcaatcttcatgccatagatccatttaacagttactttttcagtgaacatttatttattgagcttatactatttgccaggtactctgccagacactggggacaagaaaatacaaaacaacagtccctgacctacctttgttgaggaggcaaacacgtaaccaaataattgcaatttaaatatgagaaatgctaatggagttgtgaacagattcctatagaagactaacagggagtggttaacgttgcctgcgggagggggtcacagacaaatcattgtttgggccttgaaaagtgattgtgtaggtgtttactatgcaaccaaggtgtggagaagacacctcaggtaggaggaatgacatctgtgaagacacagaagcatggaagagcattgcatatttctaggaatgaacctcaaattcttcagtgttattagaagtgaagattgaagtgaaataacttaatctcaaaatttgttttaattaatgagcatgttggaaggaaaaaaatggaggggaaagagaagagagaaggaacagaatgtttgggagtggagagtaaaaaatcattaagtatttaaactcttagctaggaattttttctctcttcctgttccctaattagaatttcagataaggacattgccatgcatcaaattatgttagaaatgtgaattttctttaccttttattatcacagaaccgattttctcacaaagtgctatcaattttcctcttaaatatccttaaaatttatcaacttctttcacgtccacaataagagtcacagtttggggcttcgtcttgactcttgcagtaacaatctaaagtctctctgatgtttgcctctccccattccaggctgtcttccacattgctgccatttttatcactctataacataattatgtttacatcctctgtcatttctctaataatttctgtggctcctgattgcatataaataaggcctttcatacttctttcacaatcaatatctctaacttcactttaggagtagtataattttaatgcatgagttctagagtcaggtagcctgcattcaatttctgacttcaccagggctggtatttactgggcatgtactgggatgctcatatccagtctactaggctgggttggtgtttgcaccctagttgttgaataatttaatatcttctcagctgctaacaatgtgatttggcagttagcttatactctctaaactttagttctctatcttcaatataaagataataaaagtatcagtcccaaaaattttaataaatctgaaataaaatattaatgaaataaataaattataaatgaagtcatgctatacaaagtttagcatcatgtatgtttaacaaatgctgactatttgcattatcgcctcccaccactctctaaccatgttacctcctgttttaccttaccaggcatgctccagaacttgacttattttatcactctacttgttctgcttgaaccaattcatccccaccaattcatccttcaaacattaaatccttcggaaagacattgtaaccacaaccctgacttaatccatggtacaattaatcacttttcctgtgtgctcactgtgcacacatctctattatattaaatcatgagttattgtttatatatctgccactgccattaagttacgaaagcattctttgcatcatttcaattttgttaaatttgttaaggttggttgaatgactccataaagtctatcctgattaatgtttcctctgcacatactaaaatttatatttaagttggagtattttataaaagttaattaggtcatttttcattaattgtgataatcagattttctttatctttactgattttctatctgtttattctatcaatcactgagagactagttttgaagtctccaactagaattttaaatttgtatacttctcttttcttgtctgtcaaattttactttgtagatttgagaatctattgttacttgcttatacatataggattgttatgttttcttagttaattgactcctttctgattatgcagtgttcctttttttttgtttgtttggttttttttttttgttgttggagatggagtctcactttgtcacccacgctggagtggagggctatggcgcgatctaggctcattgcaacctccacccccggggttcaagcaattctcctgcctcagcctcccgagtagctgggactacaggcgcaccccgccacgcctggctacttttttgtattttagtagacagtggctaagtttttgtattttagtagagacgatctaatttttcgtattttagtagagacgggatttcaccgtgttgccgatgctggtcttgaactcctgagctcaggcaatccgcccgcctctgcctcccaaagtgctaggattacaaacatgagccgccgtgccctgccgcaatgttcttttttatctctgatagtattctttgttctgaatactatctgttctcatgttaatataaccattccaagttttttgtgtgtgtttaatgataaatctttttgaattcacttactctcatctatgtttttatatttaaagtggatttttttgtaaacagcataatctatctctgttttataattaatgtgattagattgcttacattaatgtaattattaatataattgcttttaaatctacaatgttgctagatgttttattttccatcttttggcctacttttggattaactgactgtttgtttacagatctgtgttacctctattattgactcagtagataaacctactttaattgatcacagttactcttcgatttatagttttcgatttatagtttgacaatttatagctttcatgtcaattatgtatttattacctcatttggtcccacaaaaaccttgtaatttagctattattatacacttatctggcatagataaattatgcataattggcatagaaatatttacactattaatttggtactatggccttcttaatttaggtgggagtcactatttccatgtaattaatttataattttgtaaaatgttcccttcactccatcctatgtaccaaagtgaggcatgacatagtacctgttttgaaatgttgcctccaccctcagccatggctccagctgctagaaaaacaaaagccactggactcttaactgccttccttgtttacatctgattccttggcttgagatttggctattgttccagtggggctctggaatcacctctgccactgacattttatataaaacaaatcatacaatatgtggctttttgcgtccagcttcttttatttatcatgttttcaaggttcttctgcgtaatagtatgtatcagtacttcattctttattactgctaaataatattccagtgtatagatataccacattttatttatctattcatctgttgataaacacttggtttgttctactactatttggctattatgaataatgctactgtgaacattcctggataagtgtatgaatgaacatatattttcatttttcatgggtatacacataggaatggaattgctgggtcatatgataactcgttttaaacttgtgagaaacttccagactcttcaaagcatctacactatttcacattcccactagcaatttaagagaattccagtttctccatattataacctacccttgttattgcatcctttttattctagtcatcatagtaggtatggagtggtatataattttgcttttgatgtgcttttccctaatggctaatgatattgatcatacttcattgagcttattggcccaatcattttgggaggccaacattaccctgaggccaaaatcagaatgagaaatgacaagacaattacaaattaatatccctcagaaacataaaaataaaaatccccccaaaagtactagcaaatcaactaagtagggtttatatctgaaatgcgaatcttattcaacatttgaaaaatcaataaattcaatttatcatatggtcagattaaagatgaaaaagcatataatcatttcaatagatacagaaaagtcatttgacaagattcagtatctattatataatatacatatatagttatatacatatatataaaatagtatgtctttatgcatatacctctcagaagactagcaatagaagggaaattcctctacttgataaggaacatctataaaacactcatgcttaaagattttaacatcactcttaatgatgaaagattaatgcattcctcttggatcaagcacaagacacaaatatcctctctccctattcctttttgatgttgaagggaaggtccttactagtgcaataatggaagaaaaagaagtaagaggatggaaaagggagaggtaaaactgtctgtatttacagaaggcgtgactggctatgtggaaaatctcaaagaatctacaaaaatgctattagaaataataagtgcatttaacaagtttgaaggatacatggttaacctacaaaaatcaattgcatttctacatacttgcacagaacaattggaaattggaattaaaatgcgccttttctaataacaccaaaaccataaaattcttagatatatgtctaacaaaataactacaaattatgtttgcttataactatacagttctgttaaaagaagtaaaaaatgacccctaaataaatgaagatatttattgtattcatgaattagaagatgttgactcttcctaatgtgatctatagattcaacagagatctaatcataattctagcatgattttgtataaaaacaagcaaactaattttaatattaaacggaaaggcaaataactagaataacaaaaaaaatgaaaacaataaaaccatgtagaacgaagtctgaggcaccactcaaactattatcaaggcttccataaagctcaatgattaagacagtattatattggagaaaggctaggcatattgatggaacagaaggcagtccagaaatatacttacatttgtatggtcaattgctttgcaatgaaggtgcacaggtcaaccaatgaagaaaagataacgctttcgatacataatgggaagcaattggacaaaaagaaataaggaataaatgttgatctatatattgttatataaaaagtaactcaaaatgggtcacagtcctaaatgtaaaaacttatactctaaaatttcttgaaaaaaatatagagggaaaaatttgtatccttggattagataaaggtttcttagacataataccaaaaacatgattgtcacagacagaaatacactgttaaacagcaaagataaaccacagattaggaaaaaactctatatctgttaaaagatttggaaccagtatacataaattatggtttcaaaactaagtaatatgaaaacaacccaatttaaacaaaaggcacaaaatatttgaatagaaattcagagtagacatgtggaggacaagtatatgaaaagataatctgcaccatttgacattagagaaatgaaaatcaaaaccataatgagatattgctacccacctatctaaaactaaaacattaaaaacaaaatttaaaaagctaaaagaacaaaaacaaaataaaaaaatagcaagtgctaaagagtatatagagaaactaaaactctcataccttgttggtgggaatgtaacataagaaaatagtttggcagtatgtatacttattgtataaccatataagtatttacccagcaatctcactcttagatatatactaaagtgaaatcaatacttacatttacacaaaaaccacagatgaatgtttatagtggctgtaatagccctaaacataagctctagtacgtccacataataagatattactcagcaccattaggaatgaatcactaatctgtgcaacaccaagaatgaatttcaaagtattattccaagtggtaggagccagactcaaaatgctgtaactgtataattctaatttcattcatacaatgttttcaaaaagcaaaactgtagcaacaaaaagcagaactttggtggttaggggctgagcagggaggggaaggcttactacaaatgagcacaaaggaattcttttggatggtggacattttgtgtcgtgagtatatagtctggtgacaaaattgtttgtgtttgacaaaactcacagaacttactttaaagggtaaatttaaactgtatgtaaaatataccttgatgtttagctatgtgtaaattataccctaataaaggaaaaaacatatttataatagccttgttgatggtggtggtagtgattagactacatgtgaagcggtagttatgtttacatgccatctctgcagtgaacgttctgcgtaatcttgaatacctcttttcccccttgctacgtccaagtttcttcattttccaatgataaatttggatgggatgatgactagagtttcttctggcactggcattctgtgaagactgaagaggtgatttctgaggttgcttttatgttccctcaatctttgaaacctatgcttttgttgagatctgggctgggcccacattctgagacatttccatacatgacaggtaggtgtgtgtttgtgcatgaggatggctagaggtaatcaggccaccaccctttatctttctcatgcctccttcaccaagctgtttatgactaatctctgaacagctgccatcaacagcaacccagagcccgaagatgaatttaaaaaaacaaaaaccccaaacatcttgtacactatcaggtatcctgttgtgtctcttgattgaacagctcaatagagtataacaaaaataattcccattcgtaatgcctgctcccaggtgggaactcacgcattctttacaattaccctacccacaaatgtaggtcattgtggatgtaattatcctcattttgcaaattattaaaaagaaaaaaaactaacagcagcaaagacacaataaaacaaaggcgtgaacattttaattcactaccctattgtcaatctactagtaagtggcagagctaggacttaaactcactgctatctgatactaaaaccattaataaaaatgcgtctaacagggttccagtctgaaaaatgagaacccggttactgttcatatacttatttatctattccttaatttatgcatttatcgacagatattttgtaactgcaaagtgtcaggaaatatactgtgcacaagagatataacaggagattggataggcactatccctgccaccgtggaacctacattttagtcagggggagcgaaaaaattcagcagggaattatgcttcagcatcgtaattgctacaatagaatattgtgggcagataaaggaagaccaaagaaatctcccagaggaaagttatctatgctgagatgtgagagataagtaggtgttaggcaaagatttacaggtaggaaaaagcatgacaataaatgagaaacttaagtagttcagtaggacagggacttgaagtaaagtgtcacggaacaggataaaaaaaaactgaaaaatatctagggcttgactcatccagaattctgagaagtttttaaaatggctgggactttttctaacagcaatatgcaagggttttaaatagagaagtgacatgatcagattttattttccagtttctttaattggtagtagaaaatgagagtgaaccaacactgaaggcaaagagaccatttaggaaatcattattatcattataatcacattgttataataatgaccataatgatagtgcttggagatggggttggagccagtggtaatgtaaccaagtggatggacttgagcagtaagtttttgtaactttattagccctaatgctgcaatcttgacatatattttgtaatataccttccattctattaaaattagtagataaaatatcctactaacacataatttcagaagtccataaaaaattaaaaataaaacaagaattaaaataaataatataatatgtattttaatacaggtaataaataaataaatgtataatatagtatgtatcttaataatataatatgtattttaatataatatgtattttaatatgtattttaatttaataatataatatgtattttaatatgtatttaatatttaaatataatcttattttaaaataagaattaaaataaataataatataatatgtattttaatataataatataatatgtaatttaatatagtatgtattttaatttccaccaggaaattaagtcctccatagaattacaaagtgcctccctgaagcattgccatttcaatagagaactacgagatttgaatgacattcagtcagtcccattgacaggtgtcagtgatgactggatttgttgtgtgaggcccagggagatgtcaagtatgtttctgtctttggtggccgtgtggttgtggtatattactcagcgttgtggatacccagtgaagagagctggggacaagggaaagatcatgggttccgtattggacaggttgaatttaaagtgattctgagacatttacattggagatgattggcaattaagaattttgtatgagtaaatataaaccttaagcccagaagggaagactttacttgagagatggattcggggtcatcattttacaaatggaggaaaaaaaaaagccatagagcagatgagactctccagggatagtgggtagaattagaagagtacttaggtaggtgcttgaggaccacacatagcaagaaagccctgcaggagaaatttcaaaacggctactcaagagaaaaaagaaaaaagaggatacttggatcccatagaaatgaaggaaagagagagtttatgaaaagaggaactgttctgctgtgttggctactgcttagagatctaggaagataaggtttgggttgctttactcatctagaaacaaggaagtctttagtcacctacaggaaaattgtcagtgtaacggtgggatcagcctcattacattggtgcctggaggtagcagaaggcaaggaaatagattccatcaggttccacatctctccaaggtcttgcatatctgtgaaacatgtgtgttgatgtcccctgtccacttcaaatgaggtacatttgaagtacctcaaatgtaaagaacttcaacataaagcagaataaaatacatctgtaatgctggcgtacgtaggagaaagggagaaatcatactctgcttttgctaattcttctgcttccatcgtaactgtcctcttaaactcatctctgaatgttgtaaaactactccaaacttaaagttctcatgttattgggaaggctaaaagcccacagttgtaatcgttctcaaaaatgttttccaccgggtctgtggctcatgcccgtatccaagtaatttgggaggcggaggcgggtggatcacctgagatcaagagattgagaccagcctggccaacatagtgaagccccgtatctactaaaaatacaaaaattagctgggcgtggtggcaggtgcctgtaatcccagctactcgggaggctgagacaggagaatcgcttgaacccgggaggcggaggttgctgtgagctgagatcgtgccattgcattccaccagcctgggcgacaagagtgaaactctgtctcaaaaaaaaaaaattaaaaaaaaaagatgttttcgtttactttgcttactttgctgcagcgtggagaaccctactcgctttctctgcgaaatcaccaaggcagctgggagcctgaacacatgtcctgaaaaccggagggcgggtgtatgatgagcaggccctcattctgcttggtaatgcggggctcagattcgcgtcctctacgctcacttttactttggccaaaccaactgtacccctgaatttccttcccacaaggttctagcatttaagggtgatgatggattctctgtgtgggagagcaatgctattgccacctatgtgagcaatgaggagctgtggggaagtgctccagaggcagcagcccaggctgtgcagtgggtgaactttgctgatgatagccagtaccagggtgttcccaccttgggcaaaatgcaccatgacaaacaggccacccaggatgcaggggaagaggtgaggtgaagtctggggctgctagatgctcacttgaagatgaagactttttctggtgggtgagtgagtgacattggctgacatcatagttatctgcaccttgttgtgactctataagcaggtaggttctagagccttctttctaccaggccattcccattatcaactgctggttcctcacctacatttaccagccccagttccaggctgtcttgggtggaaatgaaactgtgtgagaacatggcccactttgatgctaaaatatttgcagagagccagcctaaaaaggacactccacggaaagagaaaggttcacgggaagagaagcagaagccccaggctgagcggaaggaggagaaaaaggtggccacccctgctccttaagcggagatgaaggaatgtgagcagcccaagaacacctttgagttggatgaatttaagcacaagtactccatcgaggacacactctgaggcaatgacatgttttggagagcactttgataaagacggctggtccctgaggtactctgagtatcgcttccctgaagaactcaccagaccttcatgagttgcagtctcatcactggaatgttccagcgattggacgagctgaagaacatgtctttgctagtgtcatcctctttagagtcaacaatagcagctccatttcttgagtctgggtcttccaaggccaggagcttgcctttctgctgagtccagattggcagatggactccgagtcatataaaaggcagaaactggatcctggaagcaaagaggcccagacactggttggagagtacttttcctgggagggggtcttcaagcatttgggcaaagccttcagtcagcacaagatctccaagagaatatttttttttaccattgccaagcagcctgcacttgcccttcacgaagatgggaatcattaaaggaaactgaacattgacaataaaaagatgttttcgttcaacggctcatcagctatttagaaccccattctattgtttccctgagtgtaatccagattttgttttcacacttccaaaggtgagtggttcacgagggcaacttaccaggtgctagatagcatggactctgaaatcagacgaaagttggtttggatgctgcctctgccaaatctttgactgtgatatcttggacaaggaatttaagctaagagtcttttttttttttttaatgtgaaatgggaattataacacctagctctcagacctgttaaaagactcacatatgatgatgcatgtaaacagaaaatagcatagcctttggcacagagaatatgttaacatataatagatctaaaatttttccatttttaattgaaaaaagtacaattaaaaaagaattatttaattgaaaaagcattcttttcaattacaagattcttttctaattgagaagaattttaatttaattttcaagtaaaaaacaattatttttaattaaagaagaattctgtaattaaacaagaattctttttcaattaaaaaagaatttttaattaaaaatacaagaaagattctaccagtctttgattgctgaaatatttcttaatcgttttggctgaaagtgtctttctgtaattcccaagcattggccttagttattgctcttggacctggccaataagtgtaatctattttcccattatagctctccaatcattaaatcttctcccctccacggtaagcatctcaatttcttcaaactttccttaaagagcatgcttttaagacccctctctatcattgttgctacttttttgaattcactccaaggtgtccctattcatccagaatggagaaggtggaatttgatctgatagttgaaggattattggattttatggaatatattcagagactttagtctgtttgtggatcatctgaggtcaggagtttgagatcagcctggccaacatagtgaaaccccctctccacaaaaatacaaaaattagctgggcgccgtggtgcttgcctgtaattccagctactcggtaagctgaggcaggagaaccacttgaacccagaaagcagaggttgcagtgagctgagatcatgcactccagcctgggagacagggcgagaatcatctcaaaaaaaaatcaattatattcatttgacagcaaagtctcctcaatgtgtttggagtgggtgtgagacatgatcagatggtcattttggtgcattattcatatggtgggtgtaagggaaaagagagagaaataagggaatcgttcatgtgtattaattgagaatcaatattaatagtagtgtgacttggagaaaggtacagatttgaggtctacgttagctatttacaggaattattttaactttccctatttcctagaatatcagatatgaatatacttgtccacttttctccttttaaaacaaatgcttattaaatgtcaatttttttaaaaacagagcattgtttatacatgccaggactttagtctgtttgtgttgttacaaaggaatacctgaggctgtaattaaaaaggaaagaagtttatttggctcgcagctttgcaggctgtacaagaagcatgacaccagcatctgcttccagtgagggccttaggaagcttccactcatgcgggaaggtgcaggggagcaagtatcacatggtgagagaggagggagaggaggaggagccaggctccttttaacagtcaaatctcacagaaatgaatagagcaagaactccttcattatcgtgaggacagttcatgacagatctgcctccatgacccaaacaccttctaccaggccccatctccaacattaaggatcaaatttcaacatgagatttgaaggggacaaatacgcaactagatcatgcaaggaatttaaaaaaatcaaaaataaaacattagggatgtttatagtttgggacaatgtgattttaaaaaagcttcatagaacatggggcatttgaactttacttataaggatggttatatattatgtatttaattaattatgcatttatttaattatgtattaattacacattaattaattatgtatttcttttgtcttatttgacaaaagaaaagaagacattccaagtggaaaaaacaaggtgagcaaaggcaggtggaaagactaggttacagtcagggaaaattttattagtttacagttgtattgtctaatactatagccactagccatatatgagcacttaaaattagttaaatcaaattaaaaattcatttccacagccacactagtcacattccaagtgctagtaagttgtatatagctaatcgctagtatactgaacagcacagctatagaacattttcatcattacagaaagttcgattgagtagtgctgggctaaagaatgatgctgcgtatagagagtaagaaattatcagatttacacacacacacacacacacacacacacacaccagatttggagtctgaattttattgtgttggtgtatcaacatctgttttggttaaaagaaacaaaatgtaacttaaactggcttaaacaacaaatggagtttattagctcaattatctgaaaagtccagaaataacctcagcttcagaaatagctgcttcagagtttctgctgagcttttatttgattttctcttgtcttttttcttctatgtattggctttattctcaggctggctttccaatatagaaaaacagctgaagtagttctaggtctcaagctcccaaatgacattgtctttgttttatgttgctataacaaactacctgagactgggtaatttataaagaacagaaatgtgttggctcgcagttctggaggctgggaagtccaagactgaaggattgcacctagagaggctcttcctcttgcaccatcacatggtgggaggtattgtgtgggtgagagaaagaaagagagaaaatgagagagacagagagagcgccaaactcacttttataacaaatccagtcttctgataataaacccactcctgtgataacaacattaatctatttataaggaaagagccttcatgacctaatcacctcttaaaggtctcacccctcaacactgttgcattggggtttaagcttccaacacttgaactttgggggacacattcaaaccacagcgcacatgattcagaagaaaagagctgctcttcttcttctttttttttttttcttttttttgacggagttttgttcttcttgcccaggctggagtgcaatggcacagtctcggctcactgaaaactctgtctaccgggttcaagcaattctcttgccttagcctcccaagtagctgggattacaggtgcccaccatcatgcccagctaagtttttttatatttttactagagatggggtttcaccatgttggcgaggctggtcttgaactcctgacctcagctgatccacccgcctcagcctcccaaagtgctcttcttcttgatcttgaccacaggaaaataaattcctgcacctttttgaacttgccccatttatgtccctgcccactcctgcactgttttgctatggccaagggagtgtcatgtactgactgatgcctgacacaatcagcgtggcatgagagataggataatgtagatgggcttaggctggtctgggtcaatctttgaggtgagggtggagtcagttctacccataagccatctgggtgccacccagcctgggtggggttaaatggggctctttttaaaaagcaattcctgttgcaattcccaatacgaaatcattatgtaattttatttttttaaataacaaatctttatttgacttgattaggtttgaaaaactttaaactgtaatacagataaaacagagaagagatacagcaaagaataaccagaattgcctttttttataaaaagtgttatgattttatttaaaacataaattcacagaagataattaagttcaaaactttaaggaacgatttctaaggcacttaacacacaatatacatactgctataaaaagaatattaaaatccatgcaccacatagtcaaataaaatcttcattatcttattgctactctctaaactactcttgtgacaaaacaaatgaacaaataaacaaattgtaagttattaaaaacattaccaagcaaacaaacaaacaaaaagccttcaaactagagatcttagagtcagctgtgaaaatgatcaacttgtcatgaaaaaaatggtttgacacattatgaatgaaatgaaccacattaaacctgtgtaaaattagtcatgtcttaattgatggctaatcagcactaacaaaaaaaggagaaaagctaaaattccgtataaatatatatggaacttgacaatgatctcaatgaacattttctccctataaaatattatcactaacatattaataaatcttattttgcataatgacaatatgaaaatagtagaacacatacttcccataaaaagtgacatgttactttctacagaaataaccattaacgaccatcctattgcaaaactagcaagatcaggaagtctggttttagaatgatcttgttatctctttcgctctcttatgcctaacgtcttttttcctctttttccctcaaaagtattctgtttatcttccactctttctctgtcaacatagctatcataatatttattctaaaattattctttctttgaaaatgagcagcctatttcctgttttcccttttccaattctgagcttgctctcttgtcctcattctcctcttcctcttcctcaaattttctgggtggaccagctcatcttccacatcatctttattatcattattttcatactcatcctcttcctcttctgagttggcattcattagctttcttaccaaatccctctaaatatgttttgctgcatcagttgaaaaatatactttctctaagaatgtttaggactgctaaataagtcaaggttttgcagaactctactaaactgagctttctaagttttggtttcattccaaatgaaatcgttagaattttggcatttctttgccaggacttctaagtctccagaaatagcattgtttctaagaaaaccagtcaaagaaggacttatgcttcagccatacatagaaacactggttctttgaaaagatcattcctcccttcaatttctccatggatgactggcaactattaatgaccagtttggtcactcaggcttttcacgactccctcctcctctgttaccactagtctcatttttccccttcctccttcttgtactaattctaatatcaaaatttaaaaaaaaatagaaaatgaatgaaaagggaaacaaatataccactcacctccaacgaaaagatgtgtaagataaagaacaaaatagccaacggagttcaaataggtggaatgttaacttggcctcccttttctcttcatccgtaaacatccatagctcctttcccttcgatggctgttcagagacttgcattattttaaaaatatataatgtgatcagaactgtaattctggaatattatttggatggtggtgtgtgtaaattgcaccagagaggaaaaaaccaagaagcagggaattaattatgaaagtattctattaacccaggcaagaaaaaaggtggattaaacatgatttttttttctcagtggaaagtaagcagaggataaaattcctggcagtgttattaagctaaaatttgttagacctgtcttggaatctaggtgatcggcagggaaattatagtgactttaccatgaaaagggagcacagaaggaagattagaggaatgatggtaaattttggttgggcacttatcgaaattgaggggcatcttcagcgtttaggtagttttcccacaggtagatggcaaaatggaactgaaagaatggagttgagagtggatccccaaagatagaaaggcttgaacaggcaaaaacaaaaaaatgttgatagagtaccataaaaaactgttatgtataagaagaggtacttagcagtgaatctgagaagaaacagtaaggtaacttgcaggagaattctgagagttaattatctggagtttgagagaggagtgaatttaaggtggtaaagcatgtctatttggggggagaaaagagtgagagggttttgtgattattctataagcacttgcaaagggtttaacctcccaaataaaaagacgtatttcttttccacagataagagataagagttctagatgaaatatataggcacggagtagaaaaaaacaccttccatccctacttttttttcttattgtttttttccactccagataaaagagaaagttgaaatcagcttggtgtggtctccacagagagtcaaatacctcagctagcttcagtttgcacttccagaaccaccgtccacctttgtttaccctgcttgtgacccattgaggcttacttagttgaattatgtcaaggggcttccttgcctcctgttttcctgttgggtttggacaagggtgaacactgttggaccatcacagggcagtagtaaagtgttattgagtattttccttccggttttctccatgctgcttcattgcgtgttgactctgtcccactgtggtgtcttgtctacagtagggaccaatgggattggggtctggttttagctcagtgttgtgatgtaagcattaataaaccacctatgcataagcactttgtaatacccaggctccatatttccagtttgactgcctaagtttccctttaaacctctgacattctgtgagtgtggatagtgctttgctgttcagtacaatctgtgaaacagcaggatctacttttcctagcaagttgttagaaatgtagaattatagaccttactccaaatctactgaattggaatctacattctcaaaagatacccagatgatttatatgtattttaggacttgggaaatactgagatagtatacaattatagttaaagagtatggagtttagggtcagagtgacctggttatgagttttgactcttctactatttactagctctatgaacttgtgacaagttgttgacttttttgaatctcaaggtctaacctgaaaataataaccctagggatgttgtgaagagtcagtaagacaatgcgacaatgcgattcttattgttgtgcagcacttattcattaaatacttatagttaaagcaagtaagaaggaggccattagcctgagattgtctctgtaataggaactccaacataggcaaaccaaaactcaattaaatgtaaacggtaaaacacaagttaagtttaaccaattagaaacctccagctaacctctagcttgggactctccactgcaacacaccccagtaaagcaaatgcctagctgtagcctatcaagtaacttccttattttgctttcatggtctaaaaaagcttgctactcccactgcagcgaggggctgtctgaacttctggttctgttttccttttgactttcctgcttgattcatgaatcattctttgcttaaataaattctgttaaatttttgcctaaggtttttcttttaacattatggataccttcaatgttccagacactgtgctgggtgctcagcagtcaacaacacagacagtccctggcctcatgaagcttaggttgttttcaagtcctatggaccaaagttatgctttggtcctggaacaaggaagcatgatgcagtagatagatcattgacctcaagggtgaaaatacatagattgcaaccctccttcttttaaaggcatactgaagggccttaaacaagtcatttcagctttctgaaccttgtctgaaaatgggatcttaagaatattggactacatgagcatattccaaactgtgtttcatagaacactaaacttatgagcttctccatggaggagataagaaagacacgtggccaaataagtttgggaacttatttccttataaggaaatcacaagtaaaacatctctttaacttgaagtaattttgcatttctgacactcattattgacagactttctttcctcctttccttcttctttctctctctctccttccctcctttcttcttgcctttcctcccttctttccttcctttttctttctttctgttgcagtaatttgggaagatgttagaccgtttccctaaggccatttatggatatgatagtttgaggatctattttagtcaggagggaaggagaattttgtcaagggcagttctccatagccattggtcaagatgaccccatggttgtcagatttcccaaaagaaagcaccaagggttaattgaagggcaagaagggatttggagcatagtctttaagagttgtttgacattgagcaagtctctggcctcccaatttctgagtctggaagagggtgtggggtcagtctggtggctctgccatggtctgggaggctaagggtgtgtctgagctgtataaaaatctaattttggaaatgcttccttgcctgtgtttgagtggagagttgtgagttggtgttcatgaattttagaggcaaactctagtgtttgtcttcttgtttcagttggaaactgggttttctccagtgaaagctggcctttctctcccagtttaaggactgggatgtcctgtatttagttcaacaagggcctactacttacttagattaagtacccaaacctgtaccacttgcttagagtgttgatttcagaaatatggacacaatccagaatgatgcctgaagcttgtcacaactggtaatttgtgattgttctctcacgtaaagttctcaagcctttattgtgaagagaaatatgtcttatcaagttctaatgtctcaagcttatttttcttcgtactataaatggaatagaaactgtataaataagtatattctagtttagtgcagtgggaaaggaaggaagaggcgatgcatcaacaatttagggcaggagatacagcagaggagaggggttaggcatggagaaatgggcactgaggttagagaggaggggcctctgctcacattcagaggagaggatcttctacccacataaattcaagacaagggctcaggtacaggggccacagaaaagccccacttattcagaaagtacaaggcagttgttaagaacatagattctgtggaagacaaacccagatgtaaactcaagctctacaacttactgaatagggtagagaaatttattccttttagttcttggtttgctattttttaaaatgtggataataaaagcacctaccacataaagctgcttcaaggattaaatatgatagtgcatatactttatataattttatgtgcttagcaattgatttatagacagcacttaatacaatttgctactgcttttatttttatattattgtcattattattataactttcatttaacaaattagtatgtacactaagtatgccaagtcagcatcatgcctgagagaagaaagcctcatagccactcacatattttcataattcaacagagatttttaggcaatttagtactatgaaaatagaatctttctgacctgtatgcaaatcctggttctgctatttgacagcttgggaaaattattttaacttctccgaaaatttgctaggttatgaagattaaatggatgataaatctgtatacctaacagaggtgcctatcttaaataagccttagtaataatagctaatatcattacgaagtaaaatattttacttctaaaacacgcacagctgaagaagttgataaacaggcacagagcagaaaaacgacttacccaacattatagaaagggcaggactggaaccaagatcttcaagctttaggcccattggttttgcctatacatacatagaactctccatgaaggagtatttgaagtacgtttgagcggtgtggagcctagtgaacttgcagtgagagaccaaagttaaaatccagctctgccacttagtgactgggtgactttgtgcaacccatgcaacttctatgaacttctcttcccgcatcttataaaatggtgataatgacccttgtttgctttccaggaatgttgcgaagttcaaatgagattaaagagacgtttgaaaattatagagagcagcagatgtataagggatttatatttatattacatactttaaagtggcaagggaacatatgcttaatattagtttattagcatattgaaaataatttattttctagcttctgctttggagcaggaaggagcaaaagcagtattgttttaggtacccttcatgccagcacggtgtgtgcatatgtggatgcctccaagtgttgctgtaacgagaaaaacctgggagctccagctgcctggagttcttgtgcattcaacttcaaagaaaccaaacctgatatttaaagtaattaaaggtgattcaaatcttttcttgaatctcctggcaaagattaacagggatataatttataactgaaatcttctgaccatcccccttttcctgattcctccaatcctcatatctcttatactctgaagccactccaaaccttttctttaaaccttctctatcacataaaaactcaacttgattaacaaaaacaaaacaaccaaagaaaacgaaccttagtgactcttcatttttcttctcatctcttgtctttcagcttccatatctcagcttttaattgactaaatatgtgtctttctgataaaaattccatctctttacttttcaatttgtctctctgctcatttgccaattctatgtcaaaaattggccagagacgaactggagtggctgaaattcatcttctgaaggtgggaaagaattgaggcatagtaggaaatgctgaaaatgcagaattctcattaatacattggggaagggtagaagacaataaatacttacaggtttatatgtgcatagtttaaattcattgcaattttgtttcctttctccctttctttttttttttttttttttttttttgacacagttatgctcctgttgcccaggctggagtgcaatggtgtgatctgggctcactgcaacctctgcctccaggattcaagtgattatcctgcctcaggctcctgagtagctgggattacaggtgcctgccaccacacccagctaatttttgtatttttagtagagatggggtttcgccatattggccaggctggtctcgaactcttgacctcaggtgatctgcccgcctcagcctcccaaggtgctaggattacaggcatgagccctgcgcccagctgcaattttgttttcatctgtccaaaggaatgactgaattgtggatatggggatgtgaagtgtatattacgactccagttgtggagtagttgtcggaagctgcttattttttgattacttttcacaagggtttttccttcacattttcttcaagcgcctatcttgtgctctaaatttctactgaacaaacctctttaatactggctacaagtatccttatttaagtatatatcttttatctccaaatatttagtttccttaaatactgaaagctctcctgcaagaaaatgcctttttaataagggttaagtactgactaaccaccatgggacatcattttgatttattaagagggtgtaggaggacaagccattctctattgttgatcgccatcttgtggaaataacgatcaaaacggcataattcagatgttgcaatcctgcatgggtcagaattcttggattaggattccttctttgtcatatactttgagccagctacttaatctgtctcagtttttttcatctgtaaatgggggtaatctaccaacctcatggtgcctgactttattgaacacatggagctactactatgatgtatattacaatttgaggagcattgacaaataaaactaggttgctaaataagagcaatcataataacaagtagtaataatattgaaaatataaaaatggttagtatttactgaatgtctaccttgtggaagattagtagatgctgttctatgttctttacatgaagtattttctttaatgctccccacagccctttttattgaatactgtttctatattcaatgcacagatgaggaaactgagactctgaggttaactaatttgtccagtctcatggtgaatgaatagtaaaggtggaatcaaactcaagtctgatgtcactatgtgaaatctttactgctctaggatgcttgtgagaggattgggcctggaaatcatattttatagggagaaaactgtgtgtgtgtgtgtgtgtgtgtgtgtgtgtgagagagagagagagagagagtgtgtgtgtgtgttgggaacatttcaagtactctcttctagctactttaaaatatacaatacatttttgctaactatagtcaccctatgaaaaagtggtggctcatgcctgtaatcccaacactttgggaggctgaggcaggcagatcacctgaggtcaggagttcgagaccagcctggccaacatggtgaaaccctatctctagtaaaaatacaaaaaattagccaggcatggtggcaggcacctgtaatcccagctacttgggaggctgaggcaggagaatcgcttgaacctgggaggcggaggttgcagtaagccaagatcgtgccattgcactccagcctgggcaacagagcatgactccatctcaaaaaaaaaaaaaaaatgggcaaacaacattagaacttatatcttcaatctaaccatatgtttatatccgttactgaaatgttttccatctccctgccctcacatgccttctcagcctctagtatctataattctatgctatacctccataagatcaacttttttagttttcacatattagtgagaacatgtgatatttgtctttttgtgactggcttatttcactgaacatagtaatctccagttccatccattttgctgcaaatgacaggatttcatagtttttaaacggctgaatagtattctattatgtatatattccacatttttaaaatcagtttgtccattgatagacattgaggttgatttcatatctttgctgttgtactagtgctgcaatagacatatgggtgcacatatcgctttgatatactgatttcttttccttggtataagtatccaatagtgggattggcagattatatagtagttctatgtttggtttcttgagaaatctccataacattttccatagtggctgtattaatttacacttacatgaacactgaaatttattttatcgggtagaagtatagctattctcgctcttttttggtttccactggcatggaatatctttttttttcatccctttattttcagtctgtgtgtgtctttataggttaagtgtgtttcttggaggcaacagattatgtttttttttttaaattcattcagccagtctgtgttttgattggagatttagttgatttacattccatattattgttcataaataaggatttactcctgccgttttgttatttcttttccagttgttttgtgatcttctcttccttatttctttcctttctgtcttccttttagtgaagatgattttctctgaagacatgatttagtttcttgctttttatctttcgtgtatccattgtatgtattttggtttgaggttaccatgaggccagaacatactatcttataacccattattttaagctgataacaacctaacatgatttgcataaacaaacaaacaagccaaataacctaataaatactctacaccttaactttatcccccgctttttaactttttgttgtctctatttacattgtattgtacagtctatgtcttgaaaagttgttgtagttattatttttgattggttcattgtgtagtcattctactgaagataagagtagtttactcaccccagttacagtgttatgatattctgcgtttttctgcgtacttactattactagtgagttttgtacctgcagatgatttcttattgctcattaacatccttttctttctgattgaagtactccctttagcatttcttgtaggacaggtctggtgttgatgatatccctcagcttttgtttgtttgggaaagcctttatttctccttcgtgtttgaaggataatttcactggatatactattctagggtaaactttttttttctttcagcacctttaattaatcatgccactctctcctgtcctgcaaggtttccactgaaaaatctgcttccaagtatattagcgttccattgtatgttatttgtttcttttctcttgctgcttttaggatgctttctttacctttgggagtttgactattaaatgccttgaagtagtcttcttcggttaaatcttcttgtacttggatatcgatatctttctctagctttggggcattctctgttattatccctatgaataaactctctacctctatctctttctctgcctcctctttaataccaataaaccttagatttgccattttgcagctatttttttctagatcctgtcggcatgcttcattttttaaattctgttttcatttttctcccatatatattttaaatagcctctcttcaaattcactaattattctgcttgatcaattctgctattaagactcggatgcattccttagtatgccaattgcatttttcaactccagaacttctgcttaattctttttaggtatttcaatctctttgctaaatttatctgatattctgaatttcttctctgtgttatattgaatttctttgcgtttcctgaaaacggcaattttgaattatctgtctgaaaggttacatatctctgttccttcaggactggtccctggtgccttacttagttcatctggtaaggtcatgttttcctggatcatcttgatgcctgtagatgttcgtttatgtctggtcattgaagagttaggtatttattgtagtttttgcagtccaggtttacttgtatttatccttcttgggaaggctttcagatatttgaaaggacttgggtgttgtgatcaaaactgaatctgctttagtggtgaccccaagcccagtagcattgtaattcttttttttttttttttttttttttttttttgagacggagtctcgctctgtcgcccaggctggagtgcagtggcgcgatctcggctcactgcaagctccgcctcccgggttcacgccattctcctgcctcagcctcccgcgcagctgggactacaggcgcccgccaccacgcccggctaatttttttgtgttttttagtagagacggggtttcactgtgttagccaggatggtctcgatctcctgacctcgtgatccgcctgcctcggcctcccaaagtgctgggattacaggcgtgagccaccgcgcccggccagcattgtaattcttgtagactcatagagataacctccttgatggtcttggacaacatctggaagaattctctggattgccagacagagaattttgttcttttcccttattttctctcaaacagatggagtctgtctctgttttgagcaacttggagctgggttggagtgacataagaacctctgtggccatcacccctacgactgcattggatcagtcctaaagccagtaccgcactgggtattacacaaggcctgctgtaaccactctctgactaccacctatgttcactcaaagccctggggctctacaatcagcaggtggcaaagccaaccaggcttatattattctcttcagggtggcaaactcccccaggccccaggtgggtgccaaggtgctgtccaggagccagggactagattcaaaatcatagaactccacctggtattttattgtactgtggctgagctggcactaaaaccattagacacagttcttctcactcttctctcccctttccaaaggcaaaggagcctctccccatggccaccgccatgtcaggctcatggggaatactgccagactactactgatgttcccttaaggcctgagggctcttgagtcagcttgtggtgaatgctgtctggcctgggactcaccctgcagggatgcagcctcccctctggtacaaagcaggcccggaagtgctgtctaagagccaagtcctggaaccagggactccaaaagcgcacttggtgctctacccactgtggccaagctagtacctaaggtgcaaggcaaattctccttaacttttccccttgtttttatcaagcagaaggagtctcaccccatagccactacagctgggaatgtgttgagtcttacctgaggctagcaagtctcagagactcacccaagggcctcagtgtagtacctgggtactgctgacgcttattcagagctcaagggctcttcagttagcaggtgattaatcctgtcaggattgggtccttctcttcaaggcagcaggttcccttctaacccagggtgtgtctagaaatgtctgggagctagggcctggaaggggggcctcacagctctgaccatactctatgctgctgtagctaggctggtatccaagatgcaagacaaaattctccccactcctgtctctgctctcctcaagaggaaggaagggatctcttttggagctgcaagctatacagcttggggttacgggagggttagcactgcttaaattgtcctggctggtgatcagtaggttttgtgccctccaacccccagttcactgcgggcccagttcagccctaggactcacctaggtgttgcagtccttgtggcctagattctttttcaaatttatttggtgccccagagcactttagcccacagtggtgaggcttgtgggaactgaagtttggacctctgggatctgtgatttccctctggccagggctgatttaaatgcatcctctatgggccagcatcagctaagtttggtctagttttactttctgctataacaagggcagtgctgagtttaacgcctcataattgctggctctccatctccccggggaacagaaatactctctgtaccacactgcccctgccagggaggtgggggagaagtggcatcagtgattctagactgtatttcctccctcttcagtgcctctttcagtgatatgaagttaaaatcaggtattgtgagagcttacttgacttttggttcttacgaaggtttttttttttgagcgtagatagtttttacattggtttctttgcagggggaacaattggtggagccttctattctgccatattgctccacctctccatctgtttct

SEQ ID NO: 40 - DNA, 5174 bp, Homo sapiens
tttgttctttcttttgcagacatacattggaagtgtggttatatctgttaacccataccggtctttacccatttattcaccagagaaagtggaagaatacaggaacagaaatttttatgaactgagccctcacatgtaagtactgtactaaagcattaagtttctcttttactccagagatgtgtagttgacagatgtgtgcagctgtctcctttgaatttcagaataatgtttttgtcagttttttttaaaaagtttgataaaagtatgaagactttaattgttattattttaaattaaaaaaaggcagaatacttcatttgacgtcagacttttctgaaatatttggattcaggatgtaaaatattttctgttcaaaattctttgcaagtagcagctgctgctaattatttttgcaaataaaacaggaatgtgcattgtttattattataaagagcctaagcagctttttcatagtgttgttgggccaagaaaaatcctgagtgttgggttgtgtgatggtgtttgggtaaaaggaccaaacaataccttcagtttgtaatttttgcagacaatgttcaccagatgcgtgggataggccagtgatttcacttactctggaaagtcacttgtttgatttttctgaagaaggtcacttgttagtgtaaataattccttcacagtacctgtagattctgtttgtctgctcctttagagttcttcgttgacgtgcttaagagatgccgaaatgatttggccactttataccactacaattttgttttctagtctgaatgactgaaacataacactggaaaagtttgcctggatttggtagatccgtggtagaaccgggttattcaaccctagaacttttattcctccaaataaaaatatctgaaaaagaaagttggagagagaatacccagaaattatcacaaacaataccttaaactttttatttctcaaaaaacttttttatttattcttatgttacatttactgattcaagacaaatatgttcaccatttacattctcatgtccactactgagtttaaaggaaagagaaatatgctaagttgggccaagtcatgtaatgagttgagagcctcagacttctccgcttgttgcttaggcagaaacatttcctgcctcctctcctgtgggcatgcaagcatttttaccagaattcacgtacttatgattgtcagttgctgcaaggggcccacggtgtcttgcagacgggagttggttgatgcagcataacatcttttatgcaataaactgttgaatgcagatttagaatatttgtgaactgctgctgaacgtgggctgggaataacgtatgcaaaagtgccttggaaggtgtcaagcattctacaaagttatgttgttcgttattaccaccattgctattactttttcgcagtagcatcatcctctctctctcaaaacagatgatatgctgaaaacaaccccaaattgtcatgaaatgcacataaatacatgtgcatgtagatattgatgaggaaatgttcagtaaatgtcttggttgcggaaaagatttattggtcattggcatattggtagcggggcatttgaaaatggttaagctggcaatttgggtcactttagagttgagacattttcagtctttttaccgaaagcagtagtactcaaaatggggcagtttaaaaccccaggggacagttgacaatgtctggagacatttttgattgtgaaactgggggtaggagggtgcttgctgccagtgggtcagggatgctgctaagcacccttcaaagcatatgcagcccttcacagtaaagcgttgtctgttagccgtgtccatagtgccaaggttgagaaaccctgaaatgaagtgaaagaacctgcagaaagtctcattatgtcctagcagaaaggattttctctgtatgattaaagattggctttattaattttgacagaacataaaatctaataattaaggaacatatatataccactgtccagatgcttgttttagtttctcttgataatgcagcatgcagcgatatatttgggctgtttggaactaaagattatttattatttaaatgtatgaaaatggttattaatgaataaatctgctggtatattttaccagtcaagcaaattctgatcattttgttttcttctagaagtagatattgcaagtgttcttgtttcattttgccttaagacaaataatatctgaaatttgttttataaagttatcctgatagttaagcccctgtgatgaaatactttatttgatacctgaatattttaaattctagtcctcaaagccccacttctcaaagtatggtgcttggaccaattgtatcagaattcccccaggggcttatgaaaaaatctggattcctaggtcttacttctcataagccaggaatctacatttttcacaagctttctgggtgattcttaggcgcatgtaagtctgagaacgtgttgctttagatctatatttaagatgtttttctttcctttcttaactacttactgcaatttgtgatctttaacaataataatagtaataataaaagtatttatggctaatattttattaagtacttactattctgctctaaatactttatacgttttataactcatttcattctgaaaataatcttgtgagataggcactattacaaatggggaaattgtcacagaaagatcaagtaacttatccaaagccacacagctggtgggagtggagccggggtattaacattggttgcccctcttagctggaaatgggcttgccattttcatgacagggcctcttcctgtgcacttccaccccactacctttggttcgcctgtgttcctacaccacaaaccctccaggataatcttgactgtgcctcagtttacccccagcaattgtccacatgctctttttgcattttcagctttaatctccattctgggaatgtttagatatataatgtttgggtagatagagaatgtttagaagtctattctaggtcatagaagttcatgctccagaatatacatttttatcctggtgcctggaagattcctgtaggaggcagcatggcactgctactctagttcacacccctcacccccaaggaaaagaaccaccacgagcactaaaataaaatacattctcaatgtgcttaggataaagaaaatgactttttaccatggcctacaaagcactacgtggtgagcaaagtacagttttactaatgcatctgaagttgccagatccctctcattccctcccatcttgcttgttctgtcagtcctcaccccaccctcaccacattccctctcatgggagcatccttgcatagaattctgtgccttctgcctggaatgcttttccctctttctccaaagcaactcgtgttcttccttcagacctcaaattgcagaagacctcttagggaggaaccgtcctcacttgttccgtactaaggctagatccgttgcttttgccacatttactatttaatgtttgtttaagggatgatttgtctaagaatttgatgagggttcagtaaaaacatagtgaacaggacttgggttcaagtcccaggtcttccatttacaagctatataatcttgagcaaattacttgaaaaacttcaactcagagaaattaagtaattagcttattcagtgggaaaagaattattaattaactcctgggatttttgtgagggccaaatatgtagttgatatttagataatgatctaatacgtataaggtgcttagcatggaatctgccataactctgtgagaaaggaaagctatttctattaacaatgagaattatagcaattgttgtaataataaggtatgtgggacacatttccaacattctcacatgctctgtctcaccactttctgcatggtgggtcattttccacttcctttagtgtattttcctgcatttttctttgcagatgttcatctttgatggtattttgaaacagggtcaatgctaacttggttccctactaaaacagcctggcattctcaaacaggatgtttgtgatgtaagggggtaagatgaccttagcttttgatgcattctaactgtaaatatttcatgaatttagttccagtttgaatagaaaacaacttaagcagctgctcagactacatactttgaaaactttgccaattaacttacccaatattacatttgaaatttacttgtcaattttttttttttttttttgagtcggagtctcgctcgctctgtcgcccaggctggagtgcaatggcgcgatctcggctcactgcaacctccacctcccaggttcaagcaattctcctgcctcagcctcccaagtagctgggactacaggtgcccgccacgacgtctggctaatttttgtatttttagtagagacaggttttcaccatattggccaggctggtctcgaactcctgacctcatgatctaccctcctccgcctcccaaagtgttgggattacaggtgtgacactgtgcgcagccttttttttttttttttaagagatgaggtcttgctatgttgtccaggctggtttcaacttctgggctcaagagatcttcctacctcctgagtaggtaggtgggactataggcacatgtcactgcacctggcttacatttggaatttaatttgagctgtgttcactgttagtctgcaaaagcatccagatacttttgtaattcatatgttttgaaggtgtctacaatttatctttctttaaattttaggtaattaaaaaataattccattttgtataagtatatgactttcagatcgtggaaatgtatagattggtttcctacctattttcctttcaaaaatagctttctgttatcatttgtgggtctgttagtcccccaaacatggaactcctcagctggactcctcctctgcggctcctttccttctctgaactgtccccgttacgtgtgaagccacatctttgagcagggtatcactgggtggcatccccaaggaaatgtggctgtgctgtgtggcagagcctataccaccatttgcttttctagttaggtaagtgatgtctttccagtatgatttttaacttctttgaaaataaggaaggtaaaaaatgtattccagggaggac

SEQ ID NO: 41 - DNA, 6539 bp, Homo sapiens
gtccacccttgacaagataatatttgtccacctttgacaagatagtattcttacaggatgaaagtgtgtttatatatatatataacctgttcagttttcctagttgggagaaagtccttcataattaatatcattgtgacccctgtaaaaagaaaaaaaaaagtcagcagaacatttctacgttccttcattttctattctgtttaattttctagaaatatctgacagtctttttgaatcccagtggtggtaatactggaaaaacttgttgctctaaaaatggtaccttttgtgggatgacattggaaaggtgggaagttggagatctttttttccccttgtttctttctttcctttatgaacctttttctttttaaaagttatatcgctcatcactttatcacttagtttatcactttaccacttttgttggcaccttttttccccctcctgtcttttatgatgttgaaactgaaggggaaaatggagctgccaagataagttacagttaagtgacgtttgcttgtggcattgtccttggcattgcacagaaggaactaaaccagcaccactggtgctgccaggaatttagggtcgaagtagacaggaagagaaattgtgttctggtttaaagttcagtgagaaaagtttagtacatgctaaaatatagcactgatccctcagaaagtgcatttaaattttacattaaatgtaaatttgacattaaatttaaatgttgacattaaatgtactttctggaaagtacctttaaatttgacactaaaactctgatattatgttagatataatgagattatgtggtttgaatgtccaagagatacctgtagctctgatactgaattgaacgtgatctgagcccattgtggaaagattgacagacttgcagagggccagtgccaaagggaaggccctatgaggtgtgggtagggaagaggggaacactgggatactgttgactaaaaaggtggaaaaagatgagagaagaaggggaactatagctctatctagaatcagggagagcatggctcttgcttacagttagcagtagtttgtgacaaaatttgtggaaaatatgacagggctttggagaactcttaccgagaaccgtaaattagttcagagatatactttgaaaggattttaaatatataaatgtatgctttccatttatcaacaaactaaatagacattgttgaccatctgtcttcagagatgcaaagcattcttaaaatgtatacaatgaatggtgaagcagaactagtgttgattttaaaaggttgaaaccatacaacactaaagcttaagacgttaaaatacattttgtgtactaactaatgggcatgttttgttctttcttttgcagacatacattggaagtgtggttatatctgttaacccataccggtctttacccatttattcaccagagaaagtggaagaatacaggaacagaaatttttatgaactgagccctcacatgtaagtactgtactaaagcattaagtttctcttttactccagagatgtgtagttgacagatgtgtgcagctgtctcctttgaatttcagaataatgtttttgtcagttttttttaaaaagtttgataaaagtatgaagactttaattgttattattttaaattaaaaaaaggcagaatacttcatttgacgtcagacttttctgaaatatttggattcaggatgtaaaatattttctgttcaaaattctttgcaagtagcagctgctgctaattatttttgcaaataaaacaggaatgtgcattgtttattattataaagagcctaagcagctttttcatagtgttgttgggccaagaaaaatcctgagtgttgggttgtgtgatggtgtttgggtaaaaggaccaaacaataccttcagtttgtaatttttgcagacaatgttcaccagatgcgtgggataggccagtgatttcacttactctggaaagtcacttgtttgatttttctgaagaaggtcacttgttagtgtaaataattccttcacagtacctgtagattctgtttgtctgctcctttagagttcttcgttgacgtgcttaagagatgccgaaatgatttggccactttataccactacaattttgttttctagtctgaatgactgaaacataacactggaaaagtttgcctggatttggtagatccgtggtagaaccgggttattcaaccctagaacttttattcctccaaataaaaatatctgaaaaagaaagttggagagagaatacccagaaattatcacaaacaataccttaaactttttatttctcaaaaaacttttttatttattcttatgttacatttactgattcaagacaaatatgttcaccatttacattctcatgtccactactgagtttaaaggaaagagaaatatgctaagttgggccaagtcatgtaatgagttgagagcctcagacttctccgcttgttgcttaggcagaaacatttcctgcctcctctcctgtgggcatgcaagcatttttaccagaattcacgtacttatgattgtcagttgctgcaaggggcccacggtgtcttgcagacgggagttggttgatgcagcataacatcttttatgcaataaactgttgaatgcagatttagaatatttgtgaactgctgctgaacgtgggctgggaataacgtatgcaaaagtgccttggaaggtgtcaagcattctacaaagttatgttgttcgttattaccaccattgctattactttttcgcagtagcatcatcctctctctctcaaaacagatgatatgctgaaaacaaccccaaattgtcatgaaatgcacataaatacatgtgcatgtagatattgatgaggaaatgttcagtaaatgtcttggttgcggaaaagatttattggtcattggcatattggtagcggggcatttgaaaatggttaagctggcaatttgggtcactttagagttgagacattttcagtctttttaccgaaagcagtagtactcaaaatggggcagtttaaaaccccaggggacagttgacaatgtctggagacatttttgattgtgaaactgggggtaggagggtgcttgctgccagtgggtcagggatgctgctaagcacccttcaaagcatatgcagcccttcacagtaaagcgttgtctgttagccgtgtccatagtgccaaggttgagaaaccctgaaatgaagtgaaagaacctgcagaaagtctcattatgtcctagcagaaaggattttctctgtatgattaaagattggctttattaattttgacagaacataaaatctaataattaaggaacatatatataccactgtccagatgcttgttttagtttctcttgataatgcagcatgcagcgatatatttgggctgtttggaactaaagattatttattatttaaatgtatgaaaatggttattaatgaataaatctgctggtatattttaccagtcaagcaaattctgatcattttgttttcttctagaagtagatattgcaagtgttcttgtttcattttgccttaagacaaataatatctgaaatttgttttataaagttatcctgatagttaagcccctgtgatgaaatactttatttgatacctgaatattttaaattctagtcctcaaagccccacttctcaaagtatggtgcttggaccaattgtatcagaattcccccaggggcttatgaaaaaatctggattcctaggtcttacttctcataagccaggaatctacatttttcacaagctttctgggtgattcttaggcgcatgtaagtctgagaacgtgttgctttagatctatatttaagatgtttttctttcctttcttaactacttactgcaatttgtgatctttaacaataataatagtaataataaaagtatttatggctaatattttattaagtacttactattctgctctaaatactttatacgttttataactcatttcattctgaaaataatcttgtgagataggcactattacaaatggggaaattgtcacagaaagatcaagtaacttatccaaagccacacagctggtgggagtggagccggggtattaacattggttgcccctcttagctggaaatgggcttgccattttcatgacagggcctcttcctgtgcacttccaccccactacctttggttcgcctgtgttcctacaccacaaaccctccaggataatcttgactgtgcctcagtttacccccagcaattgtccacatgctctttttgcattttcagctttaatctccattctgggaatgtttagatatataatgtttgggtagatagagaatgtttagaagtctattctaggtcatagaagttcatgctccagaatatacatttttatcctggtgcctggaagattcctgtaggaggcagcatggcactgctactctagttcacacccctcacccccaaggaaaagaaccaccacgagcactaaaataaaatacattctcaatgtgcttaggataaagaaaatgactttttaccatggcctacaaagcactacgtggtgagcaaagtacagttttactaatgcatctgaagttgccagatccctctcattccctcccatcttgcttgttctgtcagtcctcaccccaccctcaccacattccctctcatgggagcatccttgcatagaattctgtgccttctgcctggaatgcttttccctctttctccaaagcaactcgtgttcttccttcagacctcaaattgcagaagacctcttagggaggaaccgtcctcacttgttccgtactaaggctagatccgttgcttttgccacatttactatttaatgtttgtttaagggatgatttgtctaagaatttgatgagggttcagtaaaaacatagtgaacaggacttgggttcaagtcccaggtcttccatttacaagctatataatcttgagcaaattacttgaaaaacttcaactcagagaaattaagtaattagcttattcagtgggaaaagaattattaattaactcctgggatttttgtgagggccaaatatgtagttgatatttagataatgatctaatacgtataaggtgcttagcatggaatctgccataactctgtgagaaaggaaagctatttctattaacaatgagaattatagcaattgttgtaataataaggtatgtgggacacatttccaacattctcacatgctctgtctcaccactttctgcatggtgggtcattttccacttcctttagtgtattttcctgcatttttctttgcagatgttcatctttgatggtattttgaaacagggtcaatgctaacttggttccctactaaaacagcctggcattctcaaacaggatgtttgtgatgtaagggggtaagatgaccttagcttttgatgcattctaactgtaaatatttcatgaatttagttccagtttgaatagaaaacaacttaagcagctgctcagactacatactttgaaaactttgccaattaacttacccaatattacatttgaaatttacttgtcaattttttttttttttttttgagtcggagtctcgctcgctctgtcgcccaggctggagtgcaatggcgcgatctcggctcactgcaacctccacctcccaggttcaagcaattctcctgcctcagcctcccaagtagctgggactacaggtgcccgccacgacgtctggctaatttttgtatttttagtagagacaggttttcaccatattggccaggctggtctcgaactcctgacctcatgatctaccctcctccgcctcccaaagtgttgggattacaggtgtgacactgtgcgcagccttttttttttttttttaagagatgaggtcttgctatgttgtccaggctggtttcaacttctgggctcaagagatcttcctacctcctgagtaggtaggtgggactataggcacatgtcactgcacctggcttacatttggaatttaatttgagctgtgttcactgttagtctgcaaaagcatccagatacttttgtaattcatatgttttgaaggtgtctacaatttatctttctttaaattttaggtaattaaaaaataattccattttgtataagtatatgactttcagatcgtggaaatgtatagattggtttcctacctattttcctttcaaaaatagctttctgttatcatttgtgggtctgttagtcccccaaacatggaactcctcagctggactcctcctctgcggctcctttccttctctgaactgtccccgttacgtgtgaagccacatctttgagcagggtatcactgggtggcatccccaaggaaatgtggctgtgctgtgtggcagagcctataccaccatttgcttttctagttaggtaagtgatgtctttccagtatgatttttaacttctttgaaaataaggaaggtaaaaaatgtattccagggaggac

SEQ ID NO: 42 - DNA, 1258 bp, Homo sapiens
tataccatattaattttctctaattaccactgtcagcacattactcctcttcggtgaggctgccaggagctccctgcttcttgtggctacaaatgtcaacaccgtcctcacatgctagaccttccagagcctagcttcacgggaaggcccagcttcattgctcttttctccctgtgagccccagaggcccactgtcttccctgggttttcttcgtgagtcagccatgtttcttttatgcctttagtttctgttctccccagcttccggttctctccctgcctttccaactacagcaggtcctccaataatgtcgtttcattcgatgtcatttcctcataatgttgatgaagaaaaagaaggggccactgtggagttcgtgtggtctccccaggtctgcgtgggttttctctggggactcgttttcttccacgtcccaaagatgtgcatgttaggttaactgatgtggctacatagtccccactgagtgtggtgggggtttgagtgtatcctccaatgggaacgcatcttgtccagggttggtgcccacccccctacctctgagctgctgggataggttccggccacccaagaccctgacctggaataagagggtgaagaattttcttactttttttgtttttccagtcccttcattatactaaaagtttatgttaatctttcttaattgtatgtatagctcacatttatttcagtgtttaacatagaagtgttttggtctttatttagaagtttgttgatgtttttgtgaccagaaatatgcaataggaacttaattattttttagagacagagtcttgcactgttgcccaggctgtaatgctgtggcctgactacagcttactgcagcctcaaactccagggctcaagcaatccccctacctcaaccccctgagtaactgggaccacaggtgcaaaccaccatgcctggctctttttttttttttttttttaagagagccagggcctcactgtgctgcccagcctggttcaaactcctggtctcaagcaatcctcccacctcaccctcccaaagtgctggaattacaggcatgagccatagcgcccagtgtaacttgtttatagaaattagcctatggtaaaattgattttgttatacattattttgcttaaattcatagttcccaagtaggtgaggacttactgtactccattcttcaaggccaagtccaggttctaccacctttttaatgttttccttgattgctgcagtgataa
